United States Patent 9,487,797 (GENOMIC PLANT SEQUENCES AND USES THEREOF) - sequence listing, part 12

SEQ ID NO: 25912 - DNA, 1292 bp, Oryza sativa
ctagctggtcctttggaagatcaaacaatgtaatgcctcaaaaagcacttatttccaaatcatgagcactgtgatgaaaaaacaaggctaatcttgcatctttttttttttgcggggaaggctaatcttgcatctattgtctcggggagaaaaaagtaataataattaacaaaggagctgagttcttagaccctaatccttccttgtcccccaaccttttcaataaagtgaaatgatgcaatagactttttgtttagttgtctatgggaagcactgctagctacactgtacttggcaattggtaggatcatgacaaaaaaacaagggttttactagtttttatctgtccatctaatcggttacagatataattaccagttcggtataaactaaattattactacagctcgaaataaatgaagtaatccttctctcctcgcgtatgttgaagtacaacaacagtaagtttgccagctaagaaatatcggtagctagtagtagcaaattatgccagacccgtcgagcgatagccagatgccaaataataacaacaacaataataaataaataaatagataataaagagaagaaaagagaagagaagaggaatgaaaaggaagtgctagctagctagctaggtcaatggatgagcaaagtcgcagttttgtttaatagcgaagtgataacgccagtaaacccattatgcagaggagtagttgttaaaagtgatgttgcatccaatcaaagaaaaccccggaaaagaaaaattatagctcacagtgacactgcacgagtatggtcctttcatttttctctccgatgtatagctattaatattattgagtattcgcatttatttatgtttatacctaaaaaactttaaagcttgtgaacacatttgcggtcatatggccctaatttttcgtttctcaaatatagcttgccatttccttttcttttgtgatacttggaatgaatttgcagttaacatgtttatgcaattttcaagtaaactgaccgctatgatcatatatctgtaaaactagaaaaacgtacaagaagcctacagggcccaaaatacattaagcccataacagagaaagcccacagacctagacaatagggccttgtactccttaacgggcctataaaatgcaccgggctagcacctaacatagccgatctaactcggcccatttgagcccgcgtcggtgtgaggtcctcatctcattctctcctcctcctcaagatttttctcttctcatcattcgttggcttgttgcccttgcaga

SEQ ID NO: 25913 - DNA, 1501 bp, Oryza sativa
aacaaatactactattccatttaacagcgggagaacttttgctgatgtatcaagaattctcagagcacacgcatcatctacatcactgcatgcgtatcaaccgtaccaaaaattaatccgttagcttaaccaaactcatctggttatgacaaaaaaaaatgctattgttctggtagctatctggacaccattcttcagttgtctgcctgtcggtgttagctaaatagttcagtcgctttctatgattcgagatatggctagctaaacacaattccaaaaggcccagaattctaagattcacactactttcagctctttcgtagtattaggttaatgattctaactggacacctaatcaggattttaaaaatattatagagaagagagagtgaggatgccttgtcaacctcagctcattcctagggaaggtgtatcgatcgcattacgtctccgagttgtcgcataaggcacacgataagtttgtttgcgcattttatatagcactccgtatcacttttgtacttctttgatctttgttagttttgatctgatcaagcagtagtaaactttaactattagtaaagtggttatgattacaaactaatgatacaattttgatactataatcagattattttataaaaatacagttggtgagagattggtaattcaaagtaaaaaccgacatttgtttctgaacggaggtaatactaactacgtacgcacgcacatttgagtaaatttgtacttcctccgtactcgtttaggacaatgtttaagtcaaaccttagaaatataaatcatgaataactctcaagttgttgagtttgaaaatgtaaaaattatatgaatagatttgtcttgaaaaatactttcatatgagtatgcatatattattttttaataaatatttttatagaaagaagaagttaaagttgtgttttggagaccgtgtcgctgtccaaaacgacttcctttacgagtacgtagggaatacgttaataaaagaaatacagtttacagtaaaaaaatccaataatatgcacaacaatagacaattcaataattaatctacactttccttccgcacctatagtacttggaccaaagtacatgttgaatgccaacgtctcatcagcgcattcaccttcaaaagatgtacaggccaccatttacgtcaatcgtaagccaacgcgtattcacgagaatacgttttctgtacgtgagaacacattccagtgtatacgccttcgcgctccatttacgatttcataacagggaggcgtatttcatagcgaacgtgacacgcagaaaccaacgaggagtccactccagtgatccgcgctcgcttggaaatccgagccgcggcctcagatccaattttccgagtcaaaattctgggaggaatccatccaatccgcggaggaagcttccaccgcgcagatccccaaaccccggcccatccccgtcctccaatccacatcgatcccctgcagattcg

SEQ ID NO: 25914 - DNA, 1501 bp, Oryza sativa
ttgcgcggtgcctgcacacgtgtaatgtgcgtgcatgtcaaaaccaatgggagcagctatatttactatatttgtggtatcacgcttttccctaataaataactagtcaaaaaattattttttagctaaaagtaactaaaatgtactccctttttctttaaatatttgatgccgtttactttttagcacatgtgatcgttcgtcttatttaaacacttttataaaatatataaaactatatgtatacataaaagtatatttaacaataaatcaaatgataggaaaataattgcaacatggactagagatataactatgttttcacttaacaccatatatatttgcaagcttttgcattttgcaccaggtcaatggtttagactgctatgttgcttctccaagtgcacataaattacttcacttataccaataactaacgcagcaatcgcaacggagcagtagctaaatttgcacaaaatcaatcaagtttaacccaaaattaacaatctccctaagaaaccataaataaagtacccgtgactccgtcctcttttcaatcctagcatcatgcgagatgttctccattgatgaaactgacaaagtcacactgcctgatgaagccggtgagggtttcgatgacctgtctaccgccgccctagtgactaatgttgaccacagagttgcttgacattatttttactgtagactttttaattaattagaactgtcgatttactagatcgatcccagggaagatggcaatgcagaacggaggtggagacgagtggagtccaccacctcctgcttgcattgcatgccatggacagagccacggtggcagctcaaacccttcactccagtccaaagtgaaaaagcttgtcaacatatatggtgttaagtgaaaacatgaacttatccctagtctaggttgtaaataaaataaacggtcaaatatatttaaaaaaaagtcaacgatgataaatatttagagagtgagggagtagtaaaagaatgtaacgtcgtattaacctctctaaaccccgtggcgtcagcgacgttttgcaaagcattcctcgcgctttcagctaattacgcattagtccccggtagcatgcaccatccgatctcgcgctactattttttaagcaagctggaaccaaccagaggagagaggagatttgccggttctccttgctgctggttatacacggtaatcgagcttatctaaccatcaggacccaaaaagaacccatcgcattgaaaagaaatttaaacaaagatttgaattgttgaccaattatcgctagagcccatgtggcattcgatcttggccaacgatagaatctgggcccacatgtcagcgagtacatatacagtatatagatagatagaagaaggaaacaactcaaccgcagcagttgtctcgtctcgtcagttgagttgagtagtgttgacttgagattcatcacatctgagtgagtaagagtttggaaaatgggcg

SEQ ID NO: 25915 - DNA, 659 bp, Oryza sativa
agtatgcactatgcaattggaggaagcacatcgtcatcactgttgcataatatagtttgatatatactctctcaataattaggacgaaaactgctgttcaagtgtgacagatatcataaatgacaccgcttttctgataacaacagtgcatcacattttatttattttttcgcaaaagggcaaatctctgatgatctggtaaatgaattatagcttctgaatcatatatggctccactgttatcacattttttttacaaattgtaatctgcaatttgagaaaacttagtcctgttcatctgctgctcatgtgtgcataaataggattatctttctggccatgaaaaatactcacgaacagaaggaacagaataaatgacatcgatatgagctgaattattgtaccagtatatacctgctaaaatccgacacattatgtgtaatatatttttattattttttaggaatcctttccattatgttgaaaagaacatggattaaatgctagagagtacgtagcacatgcttcctcgattaaaaatgaagaaataaaagattttgcagctgaagaaaaactttttaagaagtctgaaatcagtatagaaaaaaataaatgcaagaggctgcaccaagagctgaaaatggccatttcaactcatc

SEQ ID NO: 25916 - DNA, 1501 bp, Oryza sativa
ttgctctgatctgattattattatgtctgctcccccctcttgtactgattactgatgaaacatcgtgattcgatttgtgctccatgtacaggtttgcctcgcgtgcttgcttcccctcttcttgatccccgtcgtcaacgccctccccttgctcttccacctcatcctcgtaacgccccaatccctttcccctctctctctctctctctctctctctctctctctctctctctctctctctctctctctttttgttcaatcagatcttctcacgaatggttatttcatggttgtttctttactagcgagcgtataattcaaccatcttaggttagcctgatctgttagcttgattgactagcaacaaacaggaaggaactatctataactgcacattttggtttaaccacggttatcgaatactgcaagtaattggcaactatagtcctcgcttgccagtctgtgccttatccactaggattcctaaaggaatcttgataattgttgtgtgctttccccaaaaaggagacgattatttgccgttctttgtaaccatgttcccatagttatgctcattggacagctgaaatatcatacttcctccgtttcacaatgtaagactttctagtattgcctacattcatttagatgttgatgaatctagacatatgtatgtgtttagatccattaacatctatatgtatgtgagcaatgctagaaagtcttacattgtgaaacggagggactataatagttacactcctcgtagagccgaaagatatagcataaatagtaactgaaaggcaaaaggctacataaggttccccttcttgacttgacaataaataatgctgaaagatgttttgctattcatattactctggataacaaataactaaggccctgtttctctcagctttggattattataatctagattattgagtcagattactataagctagattgttataatatgtagtagaataagcggttagttgtttctttcctaaattattagagcctagattattgggtttgcaagtctaaagagagagtggggtggcatggtgggtaatttttcaccaaataatctggaaaaagctcacctaaatgagcttatcagattataataagctgggctccagattataataagctacttaaataagttgtctgtttctttccgcttactctcaataatctggattataataatcccaagctgaaagaaataaaataatgttctgtagctgctgagtgttttctatttgagggcagcaaaggcgtcaaatgttggaacaaatgaagaattttgtccatgtttcaaacatgccctgaactatgccaatctcttttcttaatgaaaacttgatgtacgcggtctagtttagcgctgcctgaagtagccttattggtgttttagcacgcaatgtgcatatgtttctaggttctcctgttatctgtattctgaaaattgattcatgttctgaatgacatt

SEQ ID NO: 25917 - DNA, 1267 bp, Oryza sativa
ctactaacaatggaaagatagatttacattgattaaaatggtacatgcaattgggtaatgataatatgttttttgcacatgagatgatcaatagagtgtcacgcgatgttccccttatatatagtcagaataaaagcagcctgacattgatggaaaaattaaacagctttgcacgttagaaagttgaggttattactgttatcaacaataaggtaatttgtctttttcctcagatcaacattgccaactccagccaacaaaaacccagtgaccgtgtcctgcaaacacaggggaggaaacagaatattcctttcagatgactataatcatgattaaacactggggaacctggctactcttagagcagcttatgtcaagaccaacaaaagagtgttgcatatttttctattaacaaaggtaggatgcggttttgtgtcagttctttattaagagcttcagtttactcctctggttctcattgaacgatgctgattggaaactatgggttgctactgtgaattaaccgatcaggaattcaggagtacatgtgaagcaagtgagaatggaagtatcaagtgtccttgagacaattttgcttaagcaacagccagctttcattcctcatattgaccatcggcatgttattatagaacaaaacactatgcattatactttatttctttcctgtaaccgtagtattccaattccatagctagcaaaatgcgtgacaaaattactaaactcgggtgattggacaagtagtaataaggcaacaagttgagcaactagagaaggactggagattatgcacacatctggtattgaaaaacagtttcccttataacatacatacatacatacatgcaacagaagtgcagtgattagctagttagttggaggaatggattgaggcatcccatccctgcaagtgcaagtaaatggatcgctagcagacatgacaagacaagagtgggcattcggcaattcaggaggtatggtatgattggggctattcaggagttgtggtatgattggggcgcaaacatgaagctaatgttggggtggcgtacctcgtcggcgatgatggcgatgagagcggagctgttggtcgggatgctgggcctccccgccatggaaacttaactaactaactggcaaaggagagaagaagaagaagaagagttagatgagagaagaaattgcgatgcgatgcgatggtggatcgattaggccatctgaatctgagactcgcgtggatgaatccgct

SEQ ID NO: 25918 - DNA, 1501 bp, Oryza sativa
tatagcgagaggttataattgattaagaagagaaaatagatagaaaaatcaaataggggatagttgtgagttgtaactagttcagatgaaagggataggttaagaaataccttacattttagagaaaaaaaagtttcaaaaataactatattttggaatggaaagaatagtttacaccatgcaccaatcatgcatctgctaaaggaacttgcggcctcatcttttcacttatacttatgcttatcagtcaaaatttgaaatttcaatcttaaattttaagttgattttaaggttttttcatcgaagtttatttttcagcctttgcttttacatagataagagtacgtatataaaatttttgttcactttttttttttgtaaatataccgtttcgcgatgggtctgatgatatatccaaagtatgtatagcctatatccaatccaacacgaggtcggtcggtcggtcggtccggtggtcacatagtgcggcaccggcagcagcattacaatctctctcgtgtctcgtgcatccagttgacaaacgcaagaacaggccagccaaactaattgactctttatcacctctatctttcactgtttacttgtaatagaatgtacttgaacttgacattgccgtcctcccttgtgtttagttagtacagaggaggcatagatagatagcattggcttgacagactgcgattgatgtgtgtccattattcttcatttcttctaccttgacaactgcttgacagttgacaaaacattgctccttgctccttgcttccatttgtcggatgatcagatcactgcatcccatggttttcaacccaaccaccgtgttcctttctttcggagcccacaggaacaagcaacctccctgcttctcttcagatgcattccttttgtcttctaaccaacacgagctccagtacctaagatatactccgtcccaaaaaaaaaaaaaaagtcaaaccctaggtatgaatctggacatgatatccagggtttgccttttttttggaacggaggaagtagtatataactagtactctctcgattttgcttgcaatgtttgactattcgtcttatttaaattttttttacaaatatacaaaacaaaaagttgttcttaaaatactttggataataaagtaaaccacaaagaaaataaataataattctaaaattttttgaataagacgaatggtcaaacagtgcaaccaaaaactcaaaatcccaggagtacatagtacaatgttttccatgataaagatgcatcatggctaaacaagtccataaacgccactgcaataccatgggctattcacctttcttttattttcttgagttgatgagctcactcaagtctgaactgatactacttttatagcatcttaaaaagctaaacttaagcagtgtagtagtgcaaattaaatggacgatcttcaggtaccaactcaataataaatccccaggttcttttttcttcctctatata

SEQ ID NO: 25919 - DNA, 1501 bp, Oryza sativa
gagctggggtcgagttggctatatataacggttaggtgacgtcatctagccgttactcacatatttgaactggagggttgccaggaggttccggacctgggtgccaggaacttccgggcaacacttaagaaaattttcaacctcacctcggcgccaggaagttccggacagaacctccgggtgggactctctgtcccgagtagagtcattttcaaaaacagctcctaaaaatatttcaacacttggacaccactaagaacacttgtgttatcttagaaccatacttggaaccccttttaatagtacggtttttcctaaactcaaagcgaaaaagtaaactagtctaactcggctccgagtcttctcgccactttgattttgatgttttgggggatctccaagcatcctagcccactcctaagcaacctgggactaatacaccactaggaacatcttcttgcttcaccttgagggttgtctatgtcaacaccatttcactattgggactattctcacctacactcattaagcatattagtcccaaatcaattatacctttgccttgatcaatgcccactttggattttgacttgatgttcatcgaagaaccacatcctcttgatcctcggcattccatcttgcggtcttcttataattgatacggattactcatagcttcaaatggcctcatacggtccatcatgaccatcatgacaaagccttcactcgcccttcaccaccggattcagtccatcggcgccaagcctcttgcttgcccttcaccccccacatggtccattgtagccgagccttgcttgcccttcaccgttttgccataaatagccacttcataccccgcatcatcaatgtcttcacttgctcctcatcaaggtataatgtccatcttctagccgagccttgctttctcttcaccggtttgccatagatagccatttcataccccgcatcatcaatgccttcacttgctcctcatcaaggtataatgtccatcttctagcttcaatcttttaacttgatgctgaaacttaacctaatctcaccaactcatggaaatagttagttccaacaatgggttgtcattaatcaccaaaacaatcaccgcgctcttaggatcatagatattccaatctccccttacaaggcaattctagtgcatagatctttcaatctccccctttttggtgattgatgacaacactatcacaaaataggaatttaaaaagaataccctagtatatgttaccatgagcatgaaacatatactagagggttggtttcatcaacatatgaaacgaatataagacacagctacatttaatcgaaagaacaaaaacaattattatcatctttatcactctaataaatacaatatatgcacccaatacaattagaaatcttaagggtgaaggatttaaataataataatttaagtggagataaggtgtaacaaagatcaattagtgtatgcatgtacgcagcc

SEQ ID NO: 25920 - DNA, 1501 bp, Oryza sativa
actgcgctagtggtcattgttgcttaacgaggagaatagcgatgtggttaaacacatgcacaagttaccggaggctagagtttgggatttcttttccagatttgcgtggaacttgagtaagcggttggagacctagtatccacttttgtcatcttttgttagttggcttctattcacgagacgacttcgttgtgaggtgttgtagtctaagtacccttgttttatttggtcggtggtgttgttcttatgcaaggtgtgatgctaagtactattgacaatgtatgtttggctatgtacgtatagtttggatgtagaggataggtttttaatcatttttttaaaaataaattgacattttctccctctacatgtttatctatgttttgttagtattgttgtattgctctcactaagcctagatgctcgctagatataatgtatttttgcttacttgtactcccctccgtacgttcaaattttttttatgagatagaacacaacctatatacaataggatgtgttccatccaatcgaacaattatattttgaaacggagaaattgtaagaattacaagttgtcctagcatatctgcactcttccatccatcccaaaataaataaaagaaaacttttgcaaaaccataaacagagtaaaacggaccgagacgagaataagccagcggagcacacgcgcaacaagacaatttttttgtttggcattcctatcaaaatattcccaacatagcatagcttctagtggaaactgtgaaccactgaaccaccaccatagacgatagcgtttgtagcttgcttgcaacggacaaaccaattaaataccccctccgtaaccgcgagattctaagttttcaacgaaggctgtatttagttccatgtcaaaattaaaagtttgaaaaaattagaacgatgtgacagaaaagttggaagtttgtgtgtagaaaagttcgatgtgacgaaaaagttaaaaattcgaagaaaaaagttagaatctaaatagggccaaagcgagaaagcttccttgcaaatcctggctgtgtgcatatgtatcagtacttccttcgtctcagtaagttaatttttttttattttttttatttattccaaaataaatttattttaaaagtaataattgtatcaaaattgatgaaagtagaaaataattatattgaaaatagataaatgagaaatagttgcattgacattgataaaacaaaggtattttagttttttattgatgatatgtgaaagaagatactttctccgttaaaaaaataaatctaaaacgggatgtgacacattctgtacaataaatatgaacaaagatatatatttagatttatactagcacactgcacacgacacacacaccagcaacgggggcacacgacacacacacaccagcaacggggattagaagttgacacgactgtctatctggaatcctagctgtgctgcggtagcaactgtcctcagatgctgatac

SEQ ID NO: 25921 - DNA, 1501 bp, Oryza sativa
aagaggagctccttgaagatgaaggctttggtgtctagctcgtgcctgccgtcaagcgcctgtggtcgtcgccctagtcttctgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaaagcccgttgggttatttccggtcgtgacaagttggtatcagagccacccttgaccctaggacgagccgtagaacccaagccttagcaatattttcaaaaataaaaatcctttgttatttgtgaaaactgtctagtctctctctgtcttgctgcttcatttatcgccaaaatctgacctttgaaaatgttgcttttctttttgtttttgtttgtagatggccggcagcgtcacccgtcgtggtttgggcatgactggcttcgtcttggagttgcggggcatgtgcgtggccctggggtatccacacggagtggactaccaggccaggccgcttccggagcaggagggtgacgatgcggagccccgcgctgcttgggaggtcactgcagtgatcctcgctggctcttctgagcggacttcgctgacagtcaccgcgggtggcgattccttccccgccgcttgccagagcgccgctctcctcgccatcggcactctccaccagcgctacccggacgagttgcagcactcgccctaccgctaccacccccgccgcggaggagcccgcgactacgccaccttccgggatgctagctcggaggatgacgctaccatcgtgcacctggcgcgcatggtggaggcgtacgacgcggctcgtatcgacttccatcagatggtgcgccgtgggatggtcgagaacaacatgaagatcctggagctgcgtcaggagaacctgcagctcaagaaggacctggacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggagggtgcgctgttgctcaccttccgtcctggcccgtcgcagcggtagacgagcagttagtaggtttgcgcgtgtgttctttctcgtttgtctttttgagttgtgtggggcatggtttatgccggtgtgtggcataactatgtcggagcctgtcttattttatttgcctaagcaacttgaacattaatgaacccatttaatagcagtaataaattcaagaattatagtagtcgtgggtggttagttttaattgtcagctctctctgttgctggttctgtgtggggttttc

SEQ ID NO: 25922 - DNA, 364 bp, Oryza sativa
aataagtttgaggagttgatgcatttagtgttggtgtacaataggggttatgatgaaaccttctttgttactaggtttgtaggtggtttgaaagctgacattaagcttgctattaagttgcataaacctagaacagttgatgctgctctttctctggctcaaacacaggaggaattgcttgaagaagctggtaagaaaagctactctagggggcagtttcagagactcttttaagcctgcaatgaaatcaactcatatgggcaagggtatattgggtactaatttagaagatgggaagcaaactgaggagaaatctaaatgggaagatagatttgaatccctcaaggcagctagaaaggctaga

SEQ ID NO: 25923 - DNA, 289 bp, Oryza sativa
attggtcgtgtcatttctgcgttcttgatccattcattgataagtctgattctcgacatcgtctaattgaatgatcgtttgtttttatgtcgattcttctccagtttgtgttcattctctgcaagaggttagtaatcctagtgctagtgaaatatttattattttgacataattatgcattgcaagcataactagttctcctttatttaggtagtattgacgggcgaaactgatcgctaacgaccatcagcacccgtcacactgagcaatcacagaaccacaatctaga

SEQ ID NO: 25924 - DNA, 1126 bp, Oryza sativa
atagccgaacccttcggttatgggcaagccgaccaatgtacccaagttagtgttttaattcttaaaacctgcttaacaactaaaatgtggaatggttggcctgggttggcttgggactagctgggacccagggtcgggttgccagttcggtctgaatcatcataggccttgggttaaggcaggttcgtgtgggttcacggccttgattaataatattggatagttctaggatcgtgtttacaaaatggccttgagcaactaaatgtctttaaatgctgtttactgcaaccctaacccctttatggtataattcccttgtactcccttgcatttattctgcatttgtgggtgtgtcttgttgagtacggtggttgtactcagtcttgctcaattttccccaagcccagatgaggagttcctggaagatgaaggctttggtgtctagctcgtgcctgccgtcaagcgcctgtggtcgtcgccctagtcttccgctgtttctcgtttgtctttgtgtgttgggccttcgctgcccgtgtaataattttatatacgcttccgcttgataaactctgaattgtatcaacttttggtgtaccttgcctcctgggacaaggaataatgcacgcacgtcaggaacgcctgttgggtgatttccggtcgtgacaagttggtatcagagcctcccttgaccctaggacgagccgtagatcccaagccttagcaatattttcaaaaataaaaatcctttgttacttgtgaaaattgtctagtctctctctgtcttgctgcttcatttatcgtcaaaatctgatcttttaaatgttgttttcctttttgtttttgtttgtagatggccggcagcgtcacccgtcgtggtttgagcatgactggcttcgtcttggagctgcggggcatgtgcgtggtcttggggtatccacatggagtggattaccaggccaggccgctcccggagcaggagggtgaggatgcagagcctcacgctggttgggaggtcactgcagtgatcctctccggctctcccgagcggacttcgctggcagtcaccgcgggtggagattccttccccgccgcttgccagaacgccgctctcctcgccatcggcacc

SEQ ID NO: 25925 - DNA, 1501 bp, Oryza sativa
taatgctatcattcacaggagaagcttccttctgattgctggttgaagcggatgacggtcttctgcttggtatcgccctccggaggttgattgcccttggctcggcctggagtaggtcggggagagacacaacttcttccatctacgacaattctttgctgaggctgtcgatgcagagagtggttgctatgatttattgccgagtcaggtgcagcaggaggagcattggtgcattgtttctgctatgggttctgattaacacgaggccttacgggtacggcgtttgctccagtgaccacaatacgattggaatgtctgcttcgtgtaaattggcggtaatgtggaggtcgattttgccttggttggggacagtttttggagtaatgcccttcttcactgcagttgtaacaaacaataactttcttacactcgggttcttcatcttgtacttgatttctcagctgctgtattggaacttccaaaggtacaacgcagatactggcccctgtcttgtcagctggtggctggggctgaaattgagcattgacaccttgtggtagtgcattcattggaattggagctgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaacggtgatcttggcggggatttgtgttgccttgatgcttctctccgttggaactggcgggttggttggccatcttcttcgtcagcagaaaactgaattgacaatcttttggtacatgatcagttccttcacaaaagaaataagtgatcttgttcgttggacacctgtcgggcggatggtcttcctcacaatgaacgcatgtagaggcacacgagctggcaacatgaccgatttctccacaacgagagcatgccttaagttctattttattctggttaaaaccttggggagacttctcatcttcatcatctgaggagacttgatctgaatcttcactaccagacactctacctccattagctaaaagatgctctgtcaactgttgtgcacctcggaaggaatttcttctctgatgttttgtcattcctggtggaggccattctgtgctggtaatgatcatcttacggacttcatcctcggttcgcattggtgcttttcttttctgctgaggacagttccttgcgtagtgcccttgctcatcacacataaaacagatgatacttgcttcttttgggtcaacatgcggcatggcatgaggggccttctgggatgttggcggtgcgctgacttgtggtgtgagtgcttggactgcctccaactgcacttgaggttgcatctgac

SEQ ID NO: 25926 - DNA, 1501 bp, Oryza sativa
tctttagtcaatacttaattcatcatatgatgtccggtcactttcatttatttaagctacttgatgcccttcaacttatgccatctatcctttgcctttcatcaatctcttgatgtagatcaaggcatgatatccatcttttagatctttatcttgagtctttaggagtcttgatctgacttgagcctcaaacatcatttttaattcttgagatctatttcttttattcaactaaatgacattgttagtccaaatgattcgattgtcaacctccacttgttgaccaaccaatcgcatatacaccacgtgtcatatagtcaaaatgtaaagttcccaattaagtttaagggattagcttggctcaaagacatgcataactaaaatatagaatttgcttcccctaaatatatctatataaaatatttgtgtgaagcaagagtatacattgagatgaaacattgggagcttattctataccaggatagaggttcattatcaacaaaattaaatgtattgggggttcaaaattaattgtattggttttaatgtcatagagacgacgagcaaaagaaaaatagcaaaaaacctccatcaccggtggactccaccctatcctctgcagccagccatatggagcacgatgtgcaaatgtaggacctgtgcagcccatcaatttagataaggtaatattggagattatatgttaatttgatttgcaaaaataaattagggttcatgagtaaaggtaaaggagagtttttagattggtgccattttaagctattggtaaaattgacaaatatatagctacatttagttgttaccaaactttggtaatgcataggaaattttggcaacaacacattgatcacattctaccaaaatttaataatgttgttaacttgccaaaattttagcattaccaaaatttaccaagattaattttggcaataatatgaaaaacccttaaaccaaggaaaaagaaaaagtcgagggggtgatcatatggatttatccagtatgaaattttgctcctgagtcctaactagtttgctctgctgagccgatacaataaatatttgctgatacaatttacgaaaatgcccctgagaagaaaaatcctaaacctcaatcctccaacttctccccttcctgagcagcagtcgcctcaagggttttgccacccgaatcgccgccgcctccgttttctccaggtaagagacgcttccaaccctaatccccccaacaccatcaacggatccacccactggttgtccgcctgcttctccccgccccaatccaccttaggaatagcgcctggctggatcccaggccgtttgcttgtttgcgtccggagattggagcgccgattgggatgaaaccgatcggcccttaatgtttatttttccccatcacgcgattgtatttgttgcctccgagagattctgtgctgttgctgaatccaattttcgtgtgatttttggcaggggattctgagata

SEQ ID NO: 25927 - DNA, 528 bp, Oryza sativa
aaaaaatatttttaatttaaataaatgctgaaatgatatttgtattatcaaattagccatttaagctatgtaaattccaagaaaatttccaatcaaataaatagttcaaatcaaaaaatatttcaattcatttttttcatataaatagttcaaatcaaagtccccatatcattatccggtgcaacgcattgacattttgctagtaattaaaaaataggtaaagcttccggttattttttcgtccgtcattaaagcatgggcccacacgatatttcgccactaatctgtgaatccggatgcgtgatggtgattttgatgctccacaaataaaagagaaacgaaaaaaaaggagaaagctagcaagcagcctagccaaacagcagcaggccggcccaacaaaaaaacaaacgcagcccatcagccagcccacaaagcaaagcagcagcccagcacagtactgcacgatactgtagtagtcaggaataagtttaccttagttccctgaatttgttgctgaatctgaaaggg

SEQ ID NO: 25928 - DNA, 181 bp, Oryza sativa
gggtgattagcagcgaaatttgaagttgaatttccagattaagtaggctattgtagaaaaatagtcagtttttcagttgccttcttagtcttatatttaaaatcatcttaaatacgtgttcacaaatgtatgacccatttcagttttgactatttaactaatgaaaatgaattttaatagg

SEQ ID NO: 25929 - DNA, 577 bp, Oryza sativa
gggaggacggccaccactgacgccaccgccgcatcccggaggcggtgccgagtcgtcgtcgtcgtcgtcattccaaatttcaatccaaactccgtcgttactctgcttgtcctcccgtcccggcaaatctaatcaaacaagtcactcacaaacacaatcccccgattccgaggtttgacgtcttataaatatgtttttttctttctttcttttcattttgacgagagaggagctgttcgttcgtattgtcaaatcaaaaaaaaaaaaaaagcattctggtatcagtatcagtagagtgtaattgactaaactggcaacaacaaaacaacgacaatgacgatgattttgaacagtgtaaatgtataaataaatgagagaatctacttatataccattgactttagtctagttcaataatctgccactgacttagtttaattttataatataccagcgtcttttgtttaacttatataatttaccatcgccgtcagttaagtctccgttagcacggtacaatttcgtactaatgaccaaaatacctctagaataaaaaaattaacccaatatattttca

SEQ ID NO: 25930 - DNA, 246 bp, Oryza sativa
tatatagcagtatggtagctaactctgtggtttactgaagtacaggctcagctgtttctgaaaacacaacactcaagaccaacaacagctttgtaagcttaaagtgagacactgaatcatcagtaacctttgaatcgatcttatcgtgaaccatcaaggcgacattgctgcatattaagaaaacaacaacaacaaaaacattagaatgcaaaaaaatccagattgaacaatgtgtgaattaacagg

SEQ ID NO: 25931 - DNA, 282 bp, Oryza sativa
tggcccactcttccttcgtgaaacaaacaagttaggcccaatctcttatgtttggagcggaccttcggtctttagataaatagaggaataagtttacttgatgttcctgaactttacattgagtttgtttgagatccccagtccgcaataccaaaaatctctacccctcaactatcacaaaccatgcaaaaaagatcctaaagcagtattgacccaatttttctccgctttcgccgatgtggcatatggtgggccccacatgtcagcgtcctctgggtcagc

SEQ ID NO: 25932 - DNA, 475 bp, Oryza sativa
cacatgtaatgcaatataaactcttggtgcattggttacatcattcagtttcattgacgcatgcgtcaggtttgctgtcaacgttgtgttggttaatggtgaggagcaagtctcaatcgagagttgcatgagaatgataggtttggtggaaatctcattgtcaaaaggttcatgattgatcgatgcttaaagaccgttttcagaagctgtattttatatactagtgtgcttcaacagctgatgttatctttttattaaaaaaccaaaccggcatgacatacacaagattctccttgattgcaatagctggaatgaggaaataaaggtgcatgccttggacaagttgttatgctaatcttcagaaagaattaattctgaacagtcacagattaatgctaattggtgggggtgcatgggacatacatactacacttatcagcatcatagtgctaactgctaacatttgtgcgtgtta

SEQ ID NO: 25933 - DNA, 448 bp, Oryza sativa
atctctccatcattgtgtataatatcaatacacatacacaattcattttcacttagttaatgctatttctctcttctctcattaagccatatctcctcaattgtttctagccctcaaatgattaatctatggttggaattacctccctcattttctcctctcataaagccacatcaaattacttttaaatttggaccatcattctatatactatttaaattatgataaaccacaataacttatgcaagtttctatcgtctaactatcttacatattatttttatttcttataaatataccaaactcccgcagcaacgcgtggggtttcatctagtttaaaatagatgtattagcacacattgtacttgtttacccatatacactttgtatcattgtatgcatgcgttgtcctagcttagaaaataaacagagagatggacaagtaagt

SEQ ID NO: 25934 - DNA, 201 bp, Oryza sativa
tttttaactgtaaagttttccattaattaaccctgatccaaaaaaaaggaggatcacctaacaaaatgcaaaagaataacaaagccccaataatatacatatgacaaattgagcacgtgcacagaattctgcctataaatattcgtgtacatttgactggcaaccagcaacagcactcaagcctccaaaccaaatggcttc

SEQ ID NO: 25935 - DNA, 457 bp, Oryza sativa
attaagtaaatactaggaaaaagttcactactttatcttgcttagtctgttgttccattcctttgtctggctctttatctcttgggcatccaagtcagaatgctacaaagtaaaatggtgtaattgtgatccactgtccaacccttatggtcataaggtaaagtacaactggcaatatttttttaaaagacaatttagttgcataatgttggtatccataagtcaataaaagaattgtgttgctctattgtctatataactccatgaaaagtaaaaaataacaagagatatactcagatgccgatgagtaatgacacattaactgaactgattatgccatgcgaggaaaccaaattgtggaagactagacaaatttaaaagtaatgaaaagaaaacgattattaccagaagagagtgcaaaacattctgaactgcctcagaaggtgtactgtctcaa

SEQ ID NO: 25936 - DNA, 1501 bp, Oryza sativa
caattagaccagaaaaaccaaaagagggggcaaggcaacccgaaagctaagctagggtttttgccatggctacatccgactcctgagctcccccttctccattcccgatctttactaatcctgcctgaaggataatatctctgatacgcaccaaaaagttgtctttaaatagggtccctctcataactagtttaaggttgattatatcgctagtgcatactatgtgtatctaagtaatcaaaagagtataatcttcttatgtatacctttataatcgaatatatcggtgatatatggttttagtgtgcagcacacgatttcacaacatcactacctaaaatttattttattttgggttggttttgcttattggtaggggttaatggaaaccttaacctttttttttgaaaaccccttcccccattaaaaaagagacactttcctggacctgggaaaaccttctgtgtgaaaaaacttttagtgggggaataggcaagggggcaattttaaataacaaaaggggtccttttaaaaccctaggaaaattactgggacattaaacctaatactatactctttttttttgaaacaaccccatagtatttgacaaacactttgatttaacaatggaaagtgaacattttgtgtacacttttagaaagcatgtgcttaattactcaataggtgttataatacattaatactatggatgttaatataattaaaataatatttaggaccatggtagtatgatacacttaaaaatatgatgatatccaaatattgcatttataaacaagatcttaactggcagccttatttctttcttggggtaggagatgaatcctatttttatatattcttttcaccgacttgtaatacactactatgtaaatactatactcttaaattaagagaagaaccaacatgtactcacttttagttatacacatagggagaactacaatacttcaccattcttttcttgatctcttaaaaaaggaagctctataaagaaagtaaagctaaggataagggtaaaaagaaagtactatgatgaatagcttggaataacctagtatatgctaatattagttgaattgaaaacaactactaaaacaagaataaaatgttgcattaatagtcaaagggtgagacaaagcacataagcatactctagaatatacaaaacttttaggaaatctgaaaaattttcaatacaatttctatgttaaaaaaattatatattgtgttttctttaattgtgtagtactagtagtcggagtaaggagaagcaaaacatgaggagggagcgacacaaaatttactagaggaaagaaagccaaaatggcaaagaaggaagaaaaaagaaaagggaggaagaagaagagacgctggcaacagctgcgtcgaaacgctttatcccttgcctcgcgagaacagaaaaaagaaaaaaaaagaagagaagaggggaaggccatccgaaaggaaattaggctag

SEQ ID NO: 25937 - DNA, 426 bp, Oryza sativa
ttcgttgtactgcataccaagatttctcaaggttccatggacgacgcagcctcgttccaagagcttcttgacgaggtaggccgcgatgtagccgctggccccggtgacacacaccctgctcatctctctctctctctctctctctctctcttctgaaaccgatcgattcagtgagtgggacgaattgtgaatttgtgatctcagcagtagttgtcatcgcactgttcatatccatccattcctgccctgctgacctgtgtggctaactgagtgcacccaagactttcgttgtttgatttcctttcctgcacgcaagtgggtgtcatatgtggctctgaacgaaacgagtttcaggtccatatctcgcaggactgaccggcttgagctgaaaaatatatagctcccacgagatatatgcattaaaga

SEQ ID NO: 25938 - DNA, 422 bp, Oryza sativa
gaaatgatcggttaggtttggactatagcacgatggaacttgactgaaagactgaaaaggagtttataactaaaaaatgaattggatgagtaaaacgaaaggcaaaatacattcaaaagaaaaaaaaagaaaagaaaggcaaagtcaatatcgactcttgtacgtggaagtatagtgtgtgtttaacttgagtaggaattgatgtgacaagctaacaaaatttatggacctttctatcatcatcatatacgcggttgatctttttgttgatggtgtagttggttcagctagttaaatagtaatcacaaaactcgaaacaagagcgtcgatatgtccgagtggttaaggagacagacttgaaatctgttgggcttcgcccgcgcaggttcgaaccctgctgtcgacgaccatttttttttagg

SEQ ID NO: 25939 - DNA, 683 bp, Oryza sativa
tcacatatctaaataataattccggtgtcctcaagatcactacagaggaattatgtgggactattgtcaaattgtcactgcccccatgctattatggcactattaaaataaaccgtagaaaattacatgttaacctctctagaagcaaaaataactctaaagacgtgaggaaaacggtatgggtaggagggttattaattgatgatgtggtttggttaaaatattattctgtacttggatttatcaagatgccattctcgattaggggagtttcttaacaacaaaatacgagacttttgcatgattttaaatcttacattaacttttgcatatattcatttcgatgaagaatgggtatgatcctataaaattcctgtgaaatgcctcattcaataaaaaataaagacctgaaattttatttgtggtatctatctatcatccccttctcaaattttagtgttttattagtagctatccaaacggctattcctacgttaattttcatgttttgtaatgatctgttttgccattgaagtcttatgaatttttctttttttaaaaaaaaatcatcatgttcctgcgtgaaataaacaagccttagcaaatgtaaaatacaatggctattgattaggccttttattttacttgttactagtaagaaaaaacacaacacttgtgaaaca

SEQ ID NO: 25940 - DNA, 630 bp, Oryza sativa
aaaatttaatatctacattctatgaacagactgtttttggtaaacggtagttggccttgggctaaatagacaattgtacgttgcgttccattaaaaggaaatcccatgctttctctaacttaattgacaaggcattctcttagtcccgtaggattaggactcaacttgaatgttctgaatgaccgactgttcactgtacattaatatgcacttcattttgtaacaaggacgtaaggccattttagtcaatgtactgaaacaaaaaagtgctaaatgcacctactacattcatgagttgcatattttgcattatcttttttttttctctctgtggagaacaaacgtgtactgaagaaagagagagagcaggagaattttaattcccctggctgtcttagttagcaaccaccactcattacaatacattagtccctgaaaacgaaatagccaacacaccatcctcctctctatccccctgtcgtcccaagcattcgtttttatagcctcaccacagctcaaaaacacaatgctagcgttgctgttcacgtcgttgccaagccacaaggagaaggaagaaggaagagaaggcagaaggaagcagcaggagaaggagaaggccagaagaaacaa

SEQ ID NO: 25941 - DNA, 1501 bp, Oryza sativa
aggtctaacaatcaacagtgttcacttgatatattgttcaatgatcagcatggccaggatagagatgttttttgaaattttctgtaacagcgaaatgtgtcgggaatacacatcttgtttttcaaacatgaacctcgtttctccaggccatgatagatgtatgctagctgcggcatgtttgtcctgggacggaattctcgaatctgttcaaaaaaaatttaacttttaatgaattggtacagacacggtgatccgattttttttttctaaatctgaaatatggtttcaagaaattctggtttggtgtagcgatggtatgaatgcaaacctgtggtcagagatcggatcagatatcgcacaactagtttggtaagtataaatgcaaatcgtggcacatgtggccacaaaaaaaggctgtccccgccgaacactcacattgtttagagcatgtaaaacggtttttatcagtggtctctatattgctatgcaaataaatttgatgacatggatgaaagagaaaggaggaaagagaaatatgattgttatgcatgacagcggctcagagttgactcttagcatttatttattagagcaaatttcgttgcatggtggtgaaagaaatgaaagaatagtaagaaaaatattttgatacattaatgattagagaccatattgtcatcaactattgtaagattttagtctctagataatgcagagctcatgcctgactctacctttatacatgcccttacactgttttaccatattataagctgtttttactttttttttcctaactaatatttttaattaaaaaattgactatttttatagaaaatataataatatttttaatacaaaacaaacatattatcaatgtatatattcaacataatatttaattaaactaatttaatgttgtgaatattaaaatttttataaacttagttaaatctaaagaagtttatagctagaaagaaagttaaaatgactattaagcccttgtttagttccaaacattttcttcaaactttcaacttttccatcacatcgaaactttcctacacacgtaaacttccaacttttccgtcacatcgtttcaatttcaaccaaacttctaattttagtgtgaactaaacacaccttaatatgaaatggaggaaggctgcgttctttcttcttatgaacagtgattacggaaaacggagcgatccattagcacatgattaattaagtatctgctattctttttaaaaaaaatggactaatatgatttttttaagtaactttcgtatagaaactttttacagaaaaatgcaccgtttagtagtttgaaaagcgtgctaacggaaaacgaggaggactttgctgaaaagaacgcagccgaagtagattttgtttcccaaacaactgacactgacactaagttcagtcttgtacgttatttgcattatttaaacaggttgagagagggccatagaaaccaaacgcatctgatctg

SEQ ID NO: 25942 - DNA, 1501 bp, Oryza sativa
aagacgagtggtcaaacgttgtaagcacaaactcaaaatcccgagtacgtactacgactacgaccccagcgcctgactccgatgccggtagcctagaacagatccagccatacgtacatgcagcagaatttgtttcgaatttattcatattttttttaaaaaaagaaacagctgagtttgctgtaatatagagtaatgatctcttttttgggtgaagattattttaattttattattgttatataatttagttaaggtgaaattcactgtgaggattcgtttggatatatatttttctagaaaatcatgagctacaattggtagttcgatcatttcaaattaacatgcgagttttttttgaagaaatttcttatacaacttcttttgtatttccaaaaccaaaataaacttaaaacccaactcaaatacgaatttgtattttcaaaagcgaacgaacttaaaaactgactcatatgcggataacatattaaagtaccggaaaaaacatttttaatttttataatagtataaagatagagatagagatagcgatagagatacagataagaataaaaaaagcttagtttggagtgcggtgattttctcaatggacacaagttgaccagaggcggtgggctgctagtttggcagtattatgcataaatacaagaagcatgtcttgagaaacagggcgttgcttgttggcgcgccagctgctccggcccagaaaagcccaccagcctattttttttcgcgatttgttttttctttttattttgtgattttttttcttttttctgattatttcttttaatctttagcgcacttatttttttaaaatgttttgagttgaaagtttttaaatcttaacttgaaaaatttttaaatctgatttgaaagtattcaaatctcgagttgaaagttttcgaatttgagttgaatattttcaaatctcgagttgaaagttttcgaatttgagttgaatattttcaaatctcgagtcgaaagtttttaatcggaatcgaaagttttcatatttttttaaatctaacttgaaagtttcaatcgaaagttttcatatttttttaaatctaacttgaaagtttcaatcggttagtagaaaaaatcttccggaaaaaagaaaatcatatcttaattactatcattatttactaataacttagttagttaggctaaactatccgaaaacggtcgccaccaacgcgtgcgcgttagcttttccgtgagaaacacacattgcaacgcctgcgagggccgtttccacgccacatgcattttgtttcttccacgttcaagatacggactcctaggacgaacaaaacgtattttttttttcttattaaaaccattaacatctgtatcaagcccggtcttagttttttctctatttaaaccgggccgagagagtcacagacaccaccatatttgactggactggaggaagaagagatcgaacaacaacaatcgatcgaggagaggt

SEQ ID NO: 25943 - DNA, 214 bp, Oryza sativa
atgaatcaataatttgtgagtactcgttaacttggttgggtaaacgatatgagcgtgtttctcaagagatcagatgggggatggatgggataccttcccttcctttattactttaggcttgcccaccagtaattgagataccctcaatcctgacttcctcacacgctcgctaccaatccatctcatcaacttgtgctgcattccattccatagt

SEQ ID NO: 25944 - DNA, 180 bp, Oryza sativa
aaatatgcatatttatttggatgtgacttttggaaagtatcatttaatggtaaaaaacggttattacaccaaaagttcaatcatagctccctgttctatatgtacctttcgaattgtttcagtgacagcaacagcaacccaagttggccataagcagggcaaccatattcaatgtggcaa

SEQ ID NO: 25945 - DNA, 1501 bp, Oryza sativa
agaccggtgggcctacccaacttgttgcatctgatccttccattgttaattgttatatcatgttcccttgtaaccatctagttgcgcctcgatattcgtgcactctgtgcgagtatcaacggtcgccttcaaacttaaaatctgagtaacttcttgggtaaaacttggtttgcaaaagctttggaaaacccgacgcctgggtcggtgccttgtgaaagaaaatgagttttaaaaataaaactcgcgacacaaggccattcctgggcggaatacttgtgcggtcgcatctaaggaccgattcctttggaattacatcggagcatacaatagtgcgaccacacgggtggaatgggacgcccctggctgagtaaattgctaatcgggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcccttaggtcaccagacgtggccattctacacgggctgggtgattcgggttagtaatgtcgtgtgggtaaagtgtaccccctctgcagaggttaacaaactgttcgaacagccgtgcccacggtcacgggcggatgtgaggtgattccttagcgtagtttttgttttaccctgttttatgaaaaggtgttaaggtttgggaaacctaatgcttgggaagcatttagctgtccgggggacagcgggaccgggtgtccctggaagtgattggtcgtttggggaccactattatcgggaagtttggaaaattggtttggtttgggaaaaaccagatttgaagccaactctgggagttgtgcaaatcttgataaataaatttgttcttctcacctcccgaccaagctgagacttgtctcgctctggttgtggaaagcacacacttagattgttgaaaacttgaaaacaaaactgtttgcaaaataacagccttcccttgaagcctgcattaaccacctaagttcccctggcttgctgagtacgtaagtactcacccttgctctatataaatatatatatagttcctccgtcttgaagaaaagatgaagtgaagcgaagattagagtttcgtcctggatcccagccgtcgcctgtggtgttgggtgttagaccgttggttccgctgcagctgctgttgttggtgttcgcctcgtccgtgtcgtcggttgcattctcgggctgtctgagctgcaacctaagttaaggtaaataagtcctctatttattctaaggatttgcaatgattcatatttgtcaccgtgggtaccagcactatgtcctgggactggtaccgagttcgcggtttcgtaggaagcggttcgcgccgtttttcctacgacacgctcctatcaggtgccgttgtgcggcggtgccggattggggtgtgacagaga

SEQ ID NO: 25946 - DNA, 1501 bp, Oryza sativa
tgtgtcggctttcgaaatgccttgtcatgaaagcccttaggtcaccagacgtggccattctacacgggctgggtgattcgggttagtaatgtcgtgtgggtaaagtgtaccccctctgcagaggttaacaaactgttcgaacagccgtgcccacggtcacgggcggatgtgaggtgattccttagcgtagtttttgttttaccctgttttatgaaaaggtgttaaggtttgggaaacctaatgcttgggaagcatttagctgtccgggggacagcgggaccgggtgtccctggaagtgattggtcgtttggggaccactattatcgggaagtttggaaaattggtttggtttgggaaaaaccagatttgaagccaactctgggagttgtgcaaatcttgataaataaatttgttcttctcacctcccgaccaagctgagacttgtctcgctctggttgtggaaagcacacacttagattgttgaaaacttgaaaacaaaactgtttgcaaaataacagccttcccttgaagcctgcattaaccacctaagttcccctggcttgctgagtacgtaagtactcacccttgctctatataaatatatatatagttcctccgtcttgaagaaaagatgaagtgaagcgaagattagagtttcgtcctggatcccagccgtcgcctgtggtgttgggtgttagaccgttggttccgctgcagctgctgttgttggtgttcgcctcgtccgtgtcgtcggttgcattctcgggctgtctgagctgcaacctaagttaaggtaaataagtcctctatttattctaaggatttgcaatgattcatatttgtcaccgtgggtaccagcactatgtcctgggactggtaccgagttcgcggtttcgtaggaagcggttcgcgccgtttttcctacgacacgctcctatcaggtgccgttgtgcggcggtgccggattggggtgtgacagagatggtgtaacatcccggcctagggcttaataggattaatagaatactcatatcaacaagttgcaacttcttttccggaagccaatctccaaagaactccagggttaagcgtgcttggcctggagcaatttgggatgggtgaccgaccgggaaattcttcccgggtgcacatgagtgaggacaaagtgtgcagaaaagatatgtgttggtctgtgagggcagtctatgacctatgaaagctatcaaatgtaagtgggcccggcgaaagctatcaaatgtaagtgggcccggcctgggggaaggcgggacgttacaaaatggtatcagagccgactctcgcggtttcacgggcgcgtgtgtcgcagttgcgcaggcatggtgcgcatggctggtgtagaccgggagtggttacacagcatggcacatgcgctggcactggacacatggacgtggccaagagaggacgttcctggcctagggttgatcgacgggggcgtcgatctctcttaagggggtgaggg

SEQ ID NO: 25947 - DNA, 240 bp, Oryza sativa
ctcctcctccacctcccctccccgccgcttcccgtccccaaccctctcctcccctctccaaaccctaaccctaaacccctcccaccccaatcccgtcctgtcaatcttgtcatcatcctcaccgccgccgcccggggctccctccctcccgcctccggattcggattcttcaagcttgcctgccggattcgattctgatggcttcggggtgaccgcccgcgaggagggaccaagcgtaga

SEQ ID NO: 25948 - DNA, 402 bp, Oryza sativa
gtgctgtctttggaggttatcaggtgttaggagcaagttgctcttgccagcccgccaccatggattcctcgtgaggtccaacggcaaggaagcaaggagagcatatgattttagaagcaaatgttctttgttttttgcggggacggggatggtaaaagttgtgtccccgttgtgattgacggggaccgtgacggtgaaatttgaaccccacgggggccgggacgcgagggcaatcaccgacggggaattctccgttgccatctctaggcgctaggggcgattgatcgccccttagtaatctcgtgtattaagaccactcaattatgagtacattaaaaactatgtgtcagggttacggataaggaataccctctacccttggatatacgacgagtacggata

SEQ ID NO: 25949 - DNA, 213 bp, Oryza sativa
ttttcttgttacgaccacgagatccaaaaatttttcagagtcgttaaaaaaaattgcccgcaacttggtgcttttcttggtagataaaaatacggcccggcccaacgtggcttgtgatccagcccatgggtctcgtggatcggccgacgggagcaattttggacggaattttatgaaattttcagataagttttcaaatctgcccattctagc

SEQ ID NO: 25950 - DNA, 252 bp, Oryza sativa
ccagaagaaattccaccaatgattgcatttcttgcacgataattaaaatcaacctgagccatatttgcaggcgtgatgtcagcatcatcgggcacagtgtaaggagatttaaccttattccacacattatgcccttgcgactggaggtaggcctccattcgtgccttccaaatgacaaaattgtgtccatcgaaaacaaatggtttcgcagagtatttttcctccatagctgcgttcgttgccacggttagg

SEQ ID NO: 25951 - DNA, 367 bp, Oryza sativa
ttctctgaaagttgatcttgagtctgctaagaaagagaattcatacctacaacaatctttagagaggtttgctcaaggaaagaaaaagttgaacatgatcctagaccaatccaaagtgtccataaacaatcaaggtataggctatgattttgctgagtctttgaggataggtacccatgagattttaggtgtcacagatgggatgatagaactagctcaaaaacctataaccttcaagtctgcaggtttcattggaaacactagttctagtacacccaaaacctcagaaccaaagatggtacctatgactagcaagtctaagcctgtagagttacctagacccaaaaatccaaaacaagttgagcac

SEQ ID NO: 25952 - DNA, 151 bp, Oryza sativa
agagagaggagtgtgaaagttcatggcccctgctgcctgctccgtgctctttttgtgattgataatggcgcttaacgctgctaatcctaaagttgcagggacatgcttaactttcaagagattttaaaaagctgctacgagcaatgcatta

SEQ ID NO: 25953 - DNA, 616 bp, Oryza sativa
atactcaagcttgcactgatcctttccctgttttgtatgtacggcaaacaaatgatgtgttggatatgagagatggaaagttctgctttattagtgtcctcctaagcataatgaaacaactagaatgtctatgcctatataaaaaaaacctttttcctttcagtacacttctatatttcgttgctgtctgatgaagaaatatcctcagtgattagttgttgtgagaaggacgacctagttagtaatagtgttttatggtgcacactacttattttaaaagataatactgtacatagttgtaagaagtttgatgagcactgcatgatgatcacatcgaatttcttattgagtcaagcttggtgtgagtgagtgagtgaatggcaatcatggatcccacatgtgccagttccatcggcaagtgtaaaattgctggcatactgtttgccatagttcagttttgcactttctgcctcttaactttttattttcttatttgcatatctgtatcaattgtgtgcttttggtatttgtttttcatatggattgtgccccataccaattgttttgtgactgaggtttactgtggaatatgccctaattcatgcttgtgttctct

SEQ ID NO: 25954 - DNA, 414 bp, Oryza sativa
agcatatgcgacccgttgaagaaatactcgtcagttccccgttcgatgttctgtgtgatggtgatggtgttggggcgaggcggtcctcttgtgttcaactctgtctttacattctacttcctctatctcacattatatcacattataagatctatttttttacatggttttcaacgatataatttgattattaattatttaatattatgttatcaataactataaaattagtataatataaaatattttgaaatatatagtatgcataatacttagtataaatattgctagtgtaattgttagtcaaaatttaacgagtttgattttcatagaaacaggagtgctctataatttgagacagagaaaagtatttgctaacggtgacatactagtgttggcatctcgaacccaata

SEQ ID NO: 25955 - DNA, 454 bp, Oryza sativa
tagaccatcatctagtgccccgggcccatatggtttcacaggtggtttcttcaaaaaatgttgggaaatcattcaacaggatctagtccaggctgtcaacagggccttctcctccccgctagaccgtcttagactaataaactcagcatacatcatcttattatgcctgtgaaatacttgcataattcatgaccttgtactagtcccgaagtgaaatacttgcataaacaattccgaagtttgtgcacatgctccggccggatcatagcatcaaaacatactcaatccatcttttaatacagggtatcgttaactttttaaatataacttaaatttatctttacacgtgatttaaattttctttatatttataaaaattttaaataggacgaaagatcaaacgttttaaaagaaaacaacgacgttatatataaaagacgtagataataatagg

SEQ ID NO: 25956 - DNA, 308 bp, Oryza sativa
taagctgtcacataagataaaaaatgatgtggcaagtgaataaatgaggaaagagaaggaaaccatgtcttgcatgagacactgtttctatacaacatccaaggcatcatgtgggataagtagcattaaatttaagtgtggaatagtggtgtttgcattagaaaaatattgtctagtactagtttcttaataatgtgaagtttatttaaactatgtctagtgtcttggattagaaatggcctaaaacaaccatacgtgcctttgcattgcagctcaacctccctcccatgtaccgtacgcattgcagc

SEQ ID NO: 25957 - DNA, 727 bp, Oryza sativa
tattgaacgacgtgagtataacgaatctataaagagatatatatatgtctttgttgcaccactatggctgtgttcgctggagcatgtttccaacctggaacagtatgcacggaaaacggaacagtccattagcacatgactaattaagtactccctccatctacttttgatagtcatatttcatcttaacacacagaccaaggataagtaattctacttatcatccatttaaacatgctactagtcattcatcgtaaacaagcgattcattaatatttacatttctcaaagcccatgtagccaatcatatgtggaaaaatggagagtcatgcattaaattcgagaaaatcattaagatgataggttgttggattgaaatatgcctatcaaaaataaaattttcagatttggaaatatgactatcaaaagtagatggagggagcattagctaattttttaaaaaaatggaccaatatcatttttataagcaacttttatatagaaacttttttaaaaaatcacaccgtttaatagtttgaaaagcgtgcgcgcagaaaacgagggaaacgagttggaaaacttgggggtaagaacacaacctatgttggtttttcaagggacaaagggagtatactattgaacccaaaaggccatataattaacccataacttgtcgttgctaattttcatatgtatcatcagtaacttaatttgttaattccatctc

SEQ ID NO: 25958 - DNA, 1501 bp, Oryza sativa
tttcttttatttttcccatagcataagaaacatactactacttcaatttctgctttttctctatttctatatttttcctatcctgcagatcaaaggatcacaaggtgttattttgtccgtagctgcacatgaaactatagctacgtttgaatggttttgcactaaaaaaaaatcattgcaacagttttttattagtcccaaaagccaagcattccccgcaaaaaaaaaaaaaaaagccaagcattaacctcacgaaaataggctggcgtttcgcggtgggcaggagaacgaacagagaaacacaggaggccaaaactgcaaattgcagcaaagcaaaaaggtagcggtgggtgcggctcagtctcccaggggtcgcaaccgtagatgcgcaaagaagaagaagaagaaaaaaaaggttaaaaattccgtaggcgcccgtggcgcagatcaaactcgcacgcgcacccgacgcatcatacacacacactgtctctctcactcactctgcatctgctgctgctgctgccactgccactcttgtccagaggccaccacacactctctctctctctcactcactcactctcctctactagctcgtctccatctcttctactcgtccaggcctccaagaatctctctgttcttgctgcttgcttggtggtggtggtagctttcataatggaggcggtggtggtggcggcgctggtgcttctcatgtcgtccagtctcgtcgcttcaggtgagcgagcttaagctcagctctccccgggggagggtctttttctaacctttctctttccgtctcgtttagatttctgtcctgagtgagtttgtgcctcttaaataatggctgggaactgcaaaggctgctgctttttgtttctgaaggttgattttgttggagttttggggggatttgttcaggtgttgttctattctacacttctacttgtcggtggttctttttctttttttgttctttgatgtttctcagtttctgcttggttcatccattggtatgtttggaacttggaagaagagatctttctgtttggttcttccattttctaggaaagatcagcattgcatgtaggagtacacgctacttttgttatggtttgtgaactactttttttttttcagattcccctttcctaccttgctatgtcaaacagtactagccatgtactgcttagctcttgctgttcatctattgctgaagaaaataactcaacaaggaccaaggacaagaaatctcttgttctcccctctgagacagttggagatgtgttcttctcaagttgatttattttttttacatttttactttctaaaacaagcaaaaccgttactacgccgattttctcctagttttctgctctttctgcgcagacgctactctctcttcttgattgctttcgtcacattccgcatcccatctcttcatcaagaaactggcataaaaactgccgccttttaatgaaacgcacgagttaat

SEQ ID NO: 25959 - DNA, 414 bp, Oryza sativa
cacacggcattatccaccaacatggaattatggtatttgcaaagccaattgttcaagtgaactggacttaaaaactcacctaagaggtaggaggcaccaagaaaacttagaagccctgaagagagaagacaaggaaatggaagcaaaggtgtatgcaaaggaagtggcgcagtttgttgaaaagaaccaaaagtttgtgccaagatggagttgcagcacttgcaaggctaattgcacatctgcatctgacttggagaatcacttccggggtagaaggcaccaacagaacgtaggaaggagttcaaacgtggtaatgctccgtgcataagcattactgcatacaactgagatgcggttgcagacctgaagatatagttggcagaggggatattgtctaattttggggggtttttc

SEQ ID NO: 25960 - DNA, 647 bp, Oryza sativa
ctatatttttttataaactgaatcaaaataaaaaacgtttggctagaaaaaaaagttaaaacaatttataatatggaagaagtattattccatacaatagtactattataaaaataaaaccccatgcttattcgatttatttttctatggtcgtgctaataaatatttatagattcatacaaagaaacatttttagatggttaaccagcagtgttgataataaacacaaaacagcagcgtgcaggaagccaggaagaggaaaaccgacggcgacgggacgcaccgggccaaaattttcaaacttgttactagtactgttctcttcccttctctccacttcgcaatggaaaaaaaaaaaccgggaaaaaataaaaatgtttgggcgtaccacggtggttgtacctagcagcaacgcgggagcacgacgccgttaacgcgctcgcccgcgcgaaatgacgctactaccctcgttgctcttatccactcgcgcctcgtaccaccacaaccctcccggtttccctcgtaaatccggaaaccgagcggaggtaggatggtcaattcaccgcgccgtccgacttccccaccgtggcgttggatataatcttctcgtatcgtctcgtccctcttccgttttttcccccaatttc

SEQ ID NO: 25961 - DNA, 770 bp, Oryza sativa
ttttcaaaaacaaagaactcgcaatgccacacttgctgacgaagatcatgatgaatcaacaaatggataggatgcggggcaaaagatttagcgagattagtgctgtagccttcccgtgatccttgtagctctgctttcctctctgctccctcttgtctatgcgtctcctctgttttttcttttggtcctttgtttctcaccgttatcggtagtgttgctgtacagtttcctccccttttaatataaaaccagcaaagctggctcaggtttcataaaaagaattaccatgttcatatttatattcggttcattcaatttaatctaaagcctacaaagcaaaaaaaaaccggtttccgatgttggactggactgtcagtgactatgctggtctggcgaatgtggccggggcacagagccacagattgtggtaaactacggcctgttgaattaagcccatatcgaactgggcctggatgtcacggccggcccacttttttccagtccgaatctctgtcgcggagtcatcacttctgtggtaacactggtactccgaggagaggatatcgcggcgcctcggcggtgcgaactccgaatcagaacgggagtcgaattgattcgtgaggatataaggcgcgctcggggacgtagcagccaatcaattcgacgtgtgattccactccacagcgcgctctctcgtctccggttcgcttcgccgcacgtacaactgtctctctcctttgtgacatctcgccaagctagctagctagcca

SEQ ID NO: 25962 - DNA, 259 bp, Oryza sativa
atgtcagattctatatttatctagattgtgaatatgtgactttccaaaacagttttgtacgtcgatttgtcaaatgataacagcaagtatggatgagcgataactgacgatttgtgaagctgtttttgtatgagatgattcctgtgcacagagctggtgtgtgtgtcttgtgctatgaaacttgaaggcgtgtgatatgacctactgttttgattttgctgtcgtggtctagtacctgccatatcctgaactgaattca

SEQ ID NO: 25963 - DNA, 159 bp, Oryza sativa
catgttcctttatattgacttcatctaccaagaatctgaatgtcccccattgtctttgggattagggccttagttttccccatcagcggaattgagagtttgaggcccatctaggcgaggtgttattgggccatgccgcctctttctccgccatccagc

SEQ ID NO: 25964 - DNA, 651 bp, Oryza sativa
ccatctataactaatggatgaaattttctatcatctcaacgctgatctttttacagtatatgatatcgatttttaacatatgcgaaatatgcataggattgtattagtcagtgtatccctgtatataaaatcaagtcattggatttcttgcactgacgaataaaatagtatatgaaccatatcgggtgctacagtattgcatcaactttgttatgttcaattaattcatccaagcggtgagaaaaaacagcaaataaataaaaggaaaaagagggcaggtgactgtggcctcgtcgccgagacagccaactacgccgcggtggcagggcgtagatccggcagtagcgggatcctgacgattcgccgccatcagtgcgtccggatccggcaatcagaagcctgaggccaccagatcgagctcctgggctctggatctgacggaagaagggagaggaagcattcggatccggaagcctaggccaccagatcgagctcctgggctctggatctgatggaagaagggagaggaagcgtccggatccggcaaccagaagcctgaggccactagatcgagctcctgggctctggatctgacgaaagaaggagaggaagagggcccgatgcagcagctgtagacgaaggcagtggcga

SEQ ID NO: 25965 - DNA, 163 bp, Oryza sativa
ggagtatatcactgttttgagagtggtttgcactgatatttccccggttatctgagcccttgtgttttagatgaagggcccagattaggcctaacgcaccactctgcactggtaatacttccgtggatccgcatcgtcctccttccttgtcgagccgagcagc

SEQ ID NO: 25966 - DNA, 1501 bp, Oryza sativa
aacttgtcttgaactacactctcttttggagtggaactttgtaataattggttgtagctctttttgagcaaaggccgggatatcatattccattatctaaaaaaaatgagtcccagttgaagtggcatgagtcctgtcatcctatcctagattgagttatcttgggacggagggagtactctacttgttatagtagagaaatggggatgcagtgtgtgtttaccgaagctataacagtacggagcgcgccacctcatgccagtgagcatgacgaatttcctctcatcccatacgaagtcgtagcaagattggcttcacactatataaaaacatttgcaatgaaaacattttcgggcgttgtttcataatatataaaaataatgtttcagcaaatagtgaaaggatgtttcaattaactataacatttgatccatacataatgaaacatcacgagtacacttgctgaaacattgttgatggaataaaaaatgaaacggatttccttactagagcgtttccgtgatatgcgggtgatttgttgtaatagtatggggggacagtgcgggagcgcgcgggtggaggcgggcgcccgatttttctaccgctgattgggcgcccgatcactggtgttttcgctaaacatctaccacgtaagagaaaattgggctctgtactaccataagacctataagttcacggttttgtatagtgtagagccttgtatttgggattagggatgtaatcaaactcgacgtaaagtaaagggatgcagagtagacttattcttactacatggccatacagcccaatgaccaccgcagcccacaaatgatgccctcaaaaaccgaatttttttcggttttagattttttttaaaaaaatatttacagaaatataatctatcggccaaaaaaattacaaaaatagaccctgccgcccacctctggggcggcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctgactgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgattgtaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaatcaatacattaccattgcattggcttacacaagaagatattacgttgtagatgtttattgcatgaaagagtaatatgat

SEQ ID NO: 25967 - DNA, 1501 bp, Oryza sativa
tgctccggatatatgcaacatgaattcatgatcatgggtctattttatatgctcaaagactggactatttattattccccgtaagggttatcaactgaatacttgcgccagtcgggattcaattgttacatctattttggagtatcccataagggataatcactcagatcagaagctattcatatgagctacgcttggtctatattacccggaagatttattactcgggagcatgttatatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgtcccgctgacttttttatataagtcaaggtgctgtttgggtttttaagcaattgattggatacaatatcattgctttttgccacgtaagtgtgtatttttattgaccaatattattgcttaggctgattatatattatggtcattttccaggcggttggtaaatcctttataagtttatttactcggattttacaccacatatgccatatatttccgggtgtggtgaaaccatgtgtcttttagggacttaagcacatctgttaaagcagtgtgcgcatggtgtgtgcccaatactttggaaatttctttattcacagcatataagcttctttatagctgttttgctatgtgaattttcaaagatgttgtcaactttaggttacactcatcatattttacaaagcagtcggtatatcacttggatcatcatattattcagggattcacaccgcatatgctacatattaatattaagtcgcttggttgactacaattatcgaaaccactcggttggttagattatttattccttgattatatgtttggtttgttcaattaaaccacatagtcgggggttacacctattaggtgcatctagtcgatgcatctgactttattttttcagccctccacagtcttcatatttggtaaaagtactcgggagatcatggcgaggatgattgaagcactcggctttggagtaatctagttcgagagaagattatctttctgactgtgaaggtctcaggggctactgtggagattatgggtaccccatacccacacggcatggttatccgactagttataggggataacttatatatataaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggcgggcagggagcccctctaggggca

SEQ ID NO: 25968 - DNA, 236 bp, Oryza sativa
aaataccatctccacactcgagagttttgaactggcattagttcccaataaaaaccctcagttgcccgacttactataacattgattgttatgtcacttgtctgtggatcaactctcaagcccctcattaaccatccttttatagaaggtacactcctctcagctggtctatcaattcccctttctgatacaataaaatctgacagatctaccccagttggcccgtaacggacgga

SEQ ID NO: 25969 - DNA, 307 bp, Oryza sativa
accggcggctccgcgaggtaataatcactaaccaaggtccaattattgttcaggattattcgctgattacgtgcgctgttagcagcgcgatgccgtcgctggtgatgctcgtggagaatgatgttccatgagtaatagtgattgccttgatgcttacgggggaatatataacttggttgttgtcgaaacatgaattcggcaataataaaatgggtagcgcacgagacctaaaagtggatggatgcggagacaaagtatttagacaggttcaggccctctcaatgagaggtaataccctactcctgtt

SEQ ID NO: 25970 - DNA, 1501 bp, Oryza sativa
gacagctaaaaaagcatggaaagaaacgagattttaacggaaaaacaaacaagagaataaatgtcatttcacagtttctagattatttggcatgctgtaacttattaaagtggtatatagcaacatatcaaaagttagtgctcaattcctcagtgtcattgataaaatctacatgtgacataatcctttgtaactcaggaaaaatagaaatagtcatttgaaagttagaatccggtagtgcgtcatattttgatatttttcagttgacagaaaggtttcagggcatactggatagcaaccgtttatagttatatggaaatctgaagtgaagtgtcatcactaacaaagaaacacaaccaatcaaatattacctttgccagcttttagagcgacaacacgtgaatcaccaacattaccaacatataggtggttgccaaccaaaatagcagtcacagctgttgaaccatcatccctaaaaggattagaagacactgactctaggaaatcagcatcagttttcaggaacgtttggcctgtattttgcaaaagcattcaagaaaatgataacatcagtactgtagcactggacctgaatgttcggaagaagtacagctggagcaagagggagaacattacttatagcaagctttgtgtctctaaggagctcagggtgattcacaaggttttcaaacaaatgttccttaagatattcagcagcaagtgatcctccatgacctaatgtatgaaatgttaggaacaaagacatattagggaatgaaaataacttaatgaaagaaaattcaaggacagtaccatcaaatacaccaaataggctgactgtctgttcgttgatcgtagtcatctttatgctaaaccgatcctccatagaaggcctcctccccttgaaacttgaataatcccagctaagtctaccatcctcactaccaaaaaggtcattgacattatgttaatccatgtgccgtctcaaatatctagtaaaaggaccacaactacaggaagttcaagaaattctgaaattgcacggacaagcaacttcgaatgccagcaagtaaatacatacataatatcgcgttgaggtccatattacaatcatataaataaagaaaactaaaatatgtaagatgtttagtacagcttctgaaacagaatcgaactacatgtcaaccacaagttcagaaaaggcagcattaggcgcagtccccatcatagactgaacacaactgtggagattatgggtaccccatacccacacggcatggttatccgactagttataggggataacttatatatataaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggcgggcagggagcccctctaggggca

SEQ ID NO: 25971 - DNA, 505 bp, Oryza sativa
ttgcgtttatgtggcttcgcgccattacttttcgtttttcttttgcgaaacagatcattagttagcacatatcatccacatcatcctatttggaaaaagttaagacatgaagtcttgagcgaccaaagttggactttcttcattacatattgtatttacaaacctagccatgcaatgtttcatagaatgtatccctttatatttataatgcccggtaacttggcctgactttatggaagcatcaagcatgtctccatgttaccataaatttcatgagatggtgtgtttgaagtgtgaattttcgtattttgcgtagttgatatctggtgaatttttttcagatacccaaaggagttcaaccagggcaggttatagttttaaggggtaaaggtaaattatgcaattattaattaaatctaagaccagagtgtgttcctagcaaagtgctaaatatattactattgtcaggattgcccaaccaggctgggtatcttggggaccaaca

SEQ ID NO: 25972 - DNA, 413 bp, Oryza sativa
aatagccggctcgcggttattgagcaccgggacatgtattacacttggctagactctaaattctttaacttgtgtgggatgggatattgcatgatgatttttatgctgatggagccacttcctgagaggcgggaatatggacgtcctcagaaaaccataacgactcaatggcgggaagctatccttgggatcacaatggatggtggacagaaccgtcattgtttaatatgaacactggtattaaaacttgatcagtccatgctaggtcttaggcttgtgaaaagaattacaaaatttactttgcgcaaaagaaccatagccatcctttgaattcctctgtcatgtgcatcattgctgtggtggcttgctgagtacggttggtactcacccttgcaaatataaaattaatcaga

SEQ ID NO: 25973 - DNA, 878 bp, Oryza sativa
ttagctaaaggcgcggtattgagagaagggagaggagatgcctcagcgtagagggattagggtattatgcggagcaagcttggacatattgaaaatttgctactgtgcatgacttgccttgtgcccattactacatcgtcgttggtgttgcaagctattgccactacctgccctgcctagttgcgaatgctaatatgcatgctatgtaaccggcaatgcaagatagtgcgtatcatgttgcaaattgtactactatttcttgcatgttacataattgtgccttgtttaagtgccatataatgtttctatgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttttcatctgggtcccttgccgccccaaagtacggccgcaagctctttatgggcggccaaaattgcaattagcccctgtatgggcggcaagggcctaatcgcaattttggccgacggcggcagacggcgcggtcgacccaccgtctgccacgtcagcttgccgcccaccattatggcagcaggggctatttctgcaattttttttgtcgatagattatttctgtaaatattaaaaaaaaatctaaaaacgaaaaaaattcctcaaaaacctaggcagccacccgtccgcaccgcagattgagatcccatcgccggtcttttgcttcccccgccgccgccgccgccgcattagcaaattagggacgacga

SEQ ID NO: 25974 - DNA, 176 bp, Oryza sativa
aaaaaaaaaacccttgagacccacatatcagtttcatatacaaattaataaaaatggtgggacccacgtgggccccacgagtcattctcacccctcatcttctttctcctgatctctccccatctctcgtcgtcttcatctctctcccctctcctccctcctctcgctggcacaga

SEQ ID NO: 25975 - DNA, 1501 bp, Oryza sativa
tgacttagctttgtcgtattccctcgatgacagcagaagtagccgatgtgggaataaagcagtccatcaatggtgacaaaaataccagtcggcgccagtggaaccaagccagtggtgtagatgatgaagcccattaacagcggcggagtccgccaaccgtataggcaaaaacaccagtcagcggcggcagaggcaggccagcggtgaagtcgtagacgcccaacagcagcggcataataggctagccgtataggcagaaacaccagtcggcggcggcgaaggccagccggtcggcgaagacgtggacgcccatgaatggtggtgtgaccaaccaaccgtataggcgaggacaccagtcggcggcgacggaggcaggccggcggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccaatcggcggcgacggaggcaggccggcggtgaagacgtagacgcccaacaacggtggtgtgaccaaccaaccatataggcgaagacaccagtcggcggcgacggaggcaggccggcggtgaagtcgtagacgcccaacagcggcggcataataggccagccgtgtaggcggaggcaccagtcggcgatggtgaaggcaagccagcagtgatgatgaagatgcccatcaacggtggaggtgacgtacccgacgacaaataaaacgggtcctctgcgttgaactatggtaggtgcaggtcattgccgtggccgtgtatatcatccgcacggctcaacctcaatccaaccaatatatgcaaacacagaaacaccaggaagagttgattagcgatcaaaaatataaatgcttaatatctcatatgcatggcatgattagatgaattgtgcacgttgatccatgcacgtgttttgatggcatgattttgctagccacgggagctgataaggccgtgtcaattgcttgtcgatcaaatgctggtgctttttctttgcccgagtcacagcaaggctgaaagcttgacgatacatgatcggactcgccaacaatcgacattaaacagaagacaaaggaaagtcaggcattaacccgtgattagtcatcaagaataaaatattgataatcaatatagaccagaaggattaaattaaccagggaagggaaaaacagactcggactaatccggtcagtatatccatccggtggcttacgcggccttcaacatcagacacccggtgggtgaggttcgcacgacatctgcccagctagttggctcggtttcgccgactcgacctcccggtgacatgtctatgtgaattaaatc

SEQ ID NO: 25976 - DNA, 1501 bp, Oryza sativa
ggaactgtggaagtactaaaaacaatctgttaacttttgctttagaaaagctttctatggttctgccaaaccagctctgtcagtagaccactgagcggtgagcaccatctaaaccgcagaattaatatgcaagccagagccagggatatatacatcacaacttcacaagcccactggttctaatagaagaagcaaaagcttcagtcttcaactaatactggtataaagccctgagacatgcataacaaacctgcacttgcatttcctgcactgatacttcctctcgccttcgatcatcttcacgccaccggacctgatcacggtccccttcaaagtgagcagagttcccctgtgcttcaccctcaccttcccaatgctcggggacgcttctgccgaacaccaccattaccaccaaatcacgatagcccgtaagcaactgcccaaaaacaccaaaaaaaactacacgggcattacgccgaacacaggtgtcgcatgcgtgcgctcaccagggcattcgagtgccgaccccgaggtgttgacgcgcacgtgcacgaacttcttctccattgtctcgtcgcccgccttcctctgagaatcaagagtctctgagaaaaaaaaaatggggggaacaagcaggtgcaggtcgtacggccgcctggactactaaccttgtcagctcgtcgagcggcggcatcgaatttgtcgagggcgcgttgcgcggcggcgtcgaacagctcgagcacgtccttggggtagtcgtagagttggtgggcgacctcggggtcgaactccaggagctccgcgaagctgcgagagggaggggagacggggttagggtttggaggggggagagaacggcggcagctggggaggaggacgaggactcactcgatgacgagggggaaatggagcttgccgtccgggaaggggaggaggatgcggcggaggtcgtcggcgtggaagcggttgaggaaactgtctaggcgactctcgaactcgtcgaggtcgtcgacggcgaactcctccgccggcggcggcatttgggcggcggtttgggccgcgtatggtggccgtacgggcaggaaagggcggagaaaagctggccgcggagaggacacaaggcggtgacgacggctgacgggactgactgacgcgaggtcacggtggtggtggtggcctcgatttgggggaatttgggtggagattaaattgggccggttcttggtctagaaagctaaagcccactatattgagcccgttaggcctctcgaaaaatgtggcccatataaaagttgcccccgttctttttcttctgaaaactcagaagaaatgtgcctgtctgttgttggtagcagactaacagtaacattttgctttattttcaccgggtaaaccagtgtttgttatttctcagccactttaaaaacgaagttgtctgttttcatagtagagcaggataatagtataactcacttcctacaattagcccattttaaagcca

SEQ ID NO: 25977 - DNA, 486 bp, Oryza sativa
ttagtgtaatttccatataaatttgattccacaattcctaattttacatatatgcattttactcaatattcgtgttatcttaactaatgaattcaccctagattaatattactcacattttatttttatataatttatttgagttttaattagggttaattcttattccatcgcgattaaatttaattgattcaaatatggtcgcgataatattttatttaatactatccacacctaatctttatttttaatttatatttattttaccaatttgtttttaaggtttattcctgattaactgttctttactcacgattaataatcttcgagatcaaatccaggtaaaataggcgaataagatcggcatgatgcaattagtttgaaaagtttttgaaaatccgtatttttagagttttgattttgtcggtcgaattttttttttagggtgttacaaaacactatatttttcagagatggcacgtcagg

SEQ ID NO: 25978 - DNA, 1501 bp, Oryza sativa
ctcgtgcgagcgcgtatctcattcggtccaatgctaactagcattttacatcttttgtcaacaaggatgctgtttctcttttgaaagcgcaagatggacccaaagcagcagccatgaagctgacagaagtcgcccactctcggcttaccttagacaacatcacatgcatcgtgctgcagtttcaccatggaaaatcaaccaacagcaactgatgttaacaaagttttgtcaccagatatcttgaaacgagagttggtcccctgatccgcggttctacaagattattactagattggttgagtcgtttttttcgtcatgtaggaagcttttaaatctgacgtgcacagtttactagcgaaacgtcttatggttgtttgatttcggtttcggatctcttgctattaggggtagccggccctgaaatattaagttatctatagcataagaaatgttctaaattttttaggtggctaatgatttaatgtctgtgcctatatacttcattagttattgtttgccaaatcccggcgtcgctaatagggatgaaaaccgtatataattttttctatcataccaatatcatttttgcaaaaaaaataatattatttcttctgtaattttttttaatttctctatacgtcatattaaaattatcactaaatatttaattttattaatataaaaactaaattcctgaccgttaccttttttaaaaactaataaaaaataatatcgttttcgatttttcatgcctatttgctagcagcagcagcaagcatcgcaagcttataatcacgattgcgaagctctttcttcttcaaaactcatgtttcacatgaagaacctttattttgaaaggaaaaaaatcaatatttattttgaaaggaaaaatcaatatttattttgaaaagaaaaaaatcatctcttttgcacttctgcttatgtaagtagggtatatgtcctgtgaaaacacgtgaaagttgaacataaaaagttttataatttcatgaaaaaatactagagataggtattgatatgaatacattctcaccaaacctcaaacttatactattaacctgattttttattctttagaataaagttgagcttagacttaagatttggtgggaattatttcatattatactgatctctgtagtattttttttattaaattaatttttttattaatttagagaacttctaggtctggtttttacgggttttactttttttaatggtaagtatgttcgtaacggcttacactgcccaagcaatttaagctgctctaaatcaagactctttcttttgttttgaactttgcttcaacgatatgataatgcaaaatatccaaaatgatttattaaaaaaaatcaaaaaaggactatctaaaaactaccacaagttttttgagtgaaaaaaaatcaaatctaactatagtatgatgtaatttcaccataactatatattataataagataagttgtataaaaaaatatat

SEQ ID NO: 25979 - DNA, 252 bp, Oryza sativa
tgttaaacaacatgcatgtattaatgtatatcttgcctaactgatctagctgagatttagattgttagtttagataagatgtatatcctttagatcaaatctcggctagattagaggctatataatcctataatctcagcgccgattggtgcgccaatataacacgcagccgtcgcaccgaaacaaagggcgacgttcaacccatctcactttcgctgttttacatggtatcagagcgagagaaaaccaatt

SEQ ID NO: 25980 - DNA, 1501 bp, Oryza sativa
cccctgagaccttcacagtcggaaagataaccttctctcgaactagattactccaaagccgagtgcttcaatcatcttcgccatggtctcccgagtacttttaccaaatctgaagactgtggagggctgaaaaatatagtcaggtgcatcgactagatgcacctaataggtgtaacccccgactatgtggttaatcgaacaaaccaaacatatagtcaaggaataaataatccaaccaaccgagtggttttgataattatagtcaaccaagcgacttaatattaatatgtagcatatgcggcgtgaatccctgaataatatgatccaagtgatataccgactgttttgtaaaatatgatgaatgtaacctaaagttggctacattattgaaaattcacatagcaaaacagctataaagaagcttgtatgttgtgaataaataaatttccaaagtattgggcatacgccatgcgcacactgctttaacagacgtgctttagtccctaaaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtcccaaaaagaacgtgacatgccacacctgaaaatatgggttgcagacatattaggcctaggccaaaaaatatgccttcgacaccctttaaaggatgacgcatgtaacatgctcccgagtaataaatcttccgggtaatatagaccaagcgtagctcatatgaatagcttctgatcttagtgattatcccttatgggatactccaaaatagatgtaacaatcgaatcccgactggcgcaagtattcagttgataacccttacggggaataataaatagtccagtctttgagtatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagataaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctc

SEQ ID NO: 25981 - DNA, 1501 bp, Oryza sativa
gtaaaataaggttgtaataacgtgtgattaattgagttttaattattacaaacttgaaaaatatattaatatgatattttagaacaacttttatatagaaagttttcgcacgaaacgcaccgttgagcagtttaaaaagcatgccacgagtatccaaaatttaatccaacttttgttggattaattgctgtcctcgtttggtagtattacatctgaatctaagcatttgatgttatgcaaatataggccaatggctgcattgcaacatgtaacagattcaaacaaaattgaacttataaagtatatgctaaataattataaatattaggggatgtttgattgatgcctaaccttaccataactaagtttaggttagttgtgatatggtggcataagtgtggcttataaatagtttgccacaagtgtgacatgcttaactctaaatttgagagcatgacatgtgggtcccaaagttaagaaagtgtggcataacacaattgcgacagcgaaccaaacagatgcctaaaaaactatggcatgactaaagtgtggtgtggtaaagtgtggcaaccaaataaataacccctagtcctatcaatttggcacatggtgtcaagtccacttggtgcatgttcatcaaggcttcccttgatgccttgttctcttaagaaccttctaagcggttaacacaaattcaaatcgaagtaagaatctgacacaaattgaattcgaaatttgctctcacaacgagagagaaacaaaagaattgcgcaaaaactaatcggcgaggcctctcgatattgtcttatcgcgcgacgccaaccataaaagccgtggagaagccagcgcacatgcatgcctttttttctattacacatgcatgtatttttccccttcttacaaagttttctctcaaattacttatccgatctataatccgattacactattgtgttcgttacaattaaatcttcaaaactagatcttacatgattatactacgataaaaaatatttatacttgtaaattacttttattatatacttaagttacttttatcatatatataaattacttttagatttgactaaattactttttatatattcataatgctttaagtcaattatgtttattatagtttttagtcaattgtataatttatggactttaaatttaatttttagatacaaaatatttttctctcgaatttacttctaatgttgtaacaacttacttttattttgtgctaacttacttctattgcatagctaagttacatctattgcatagctaagttactactacaatttaaataaattacttttaaattaatgaaatatttgaatatatttaacatggatcttgttttgtctcatattttatgtagagtacaatgatgtaaatagatcatgaaaataatacgtgatttaaaagatataagttattaaaaagcttaaatctaaaagtaatttatgtatagaacaaaagtaacttacat

SEQ ID NO: 25982 - DNA, 1501 bp, Oryza sativa
atgcacatgaagtccggcaacaatccttcaaaatattgtaatttcattttagttcaacatttcaaacaccaaagcgaaataaacatgaaagttggatatgtatatgtagtaaactaaagtgagtgctatgattgcactggtaactaaattctttagaagaagctttagtaatcagtgttgatcaaagagctgcattgtttctcggagttttaacaagttctaccaatttgatatctcgattaatccaacaatcaccaaagaaggaatgtgagatcaaggaccggctaggctctcctcagacacggagggtccttaggttaaacttgagcaagttctcgataaaatagcttatttcatctttggtgttcccctctagaatgtccaccacaaatgactcaatcactagtgttactagctggccatcgatgacctccaagtggataatcaaggtggatgagtagtcctggaataataacaaaaaaatcgactgtcaggaccactacaaataaagatcttcaacaaaatacatgcaaaaataaaaaatgataaaatcattatttttgcccctaaagttgaaatgtttccttatttgatgccattctctaaacaacatgcgggtctaaggcccacatttcagtgagacattatggacaagtatggtatgacccggttttctagtggcaagtaaggatatggtgccaaggcacatatagaatattacagttatttatttatccataaaaagctatatatttccattatctcaaataaaaatatctatattgtgtatcaaatttattggcttgatagcaataacaaaacacaggaaaatcttggaatggtgataaatattgaattgtacctttagcatgtgatcaccaccaataaacttgacacggagggtgtgatcattatcatcagggaaccctaacctttcaattctccttgtggatgggagcccactttgaacagtattaagttattttattagggcagtcctcttgtgcgagttccgtttaagctactctctatttgacgccaacctccctaacacttttggtctcaatgtttcctcacattacacaatttctcacaaaaggtttgaaaagttgtggcggatcaaacctcctcacaattgaccaaacctatataataatgatgagattgaagagtataaaaaaaacataactagtatcatcagttagttttcacagaagttgcaaaaaaaaattagtttgagtggttttcacatgtatggcaaaggagaattagctagcttcaaagtaaatcatttttggagggaaaaccccaaagtctatgttagatgcaacacacaagctgcatgtccaaatgtttgtgtgtgtgcgcgcgcacgcacgtgcgagtgtggggtattgaaataaacatgtacataatgttctctgaaatgatattaaatatttgaaagaagtattgagaaccaatcctactgccaagtgataatactttatgtaattctaaa

SEQ ID NO: 25983 - DNA, 1501 bp, Oryza sativa
attagtaatttaactctcaacatatttggtaaaatatcctggtttctactgaggcaaaaatatgtagcaaagcaaatatataggcattaagcatttaatagcaaatgataataaattatttatttgaactgaaagcgctaggcttttacatggctgcaattttgtttatgtaaatgagttaggtccatctcacagaacctcaatccctattgacccatattagaaaaccctgaatttgagtacaaccgttatatatataacacattaagatgtagaagacactaatttttatatcagtttttataataaactgattcgacaaagctaaccgggtccatttaccatttcataccattttaaacaaactgagagattagctcggagtcatctttgttcagatgcaaggaaagaaaaaaataaatactgcaatgttaaacaaaccgagagatcaaaggccaaatagagccagcagcatctcttaatacagaaatatatgatcaaaccccaaagaaagcatgcaccatttaatttctaatttggatgaatggcaatcgagcccattgcctctacatataactttgactgtacattaagagaataggcaagcatgcataggtggtacagtggcaaacagcagaaacggatcaataataatataattctcactcatattcttgtaaactatttaattctgatatataataaaatccagtatcaaccaaaacttttgaaagtgcagtgtgacagtagaattcttctgtttgactttttttgttgaatagtttcagcatatttggttctattttaaatgaacaacaatagacaggaaacctattcatctagatcatagcattttataaacctatgcatctggaagatcaatttgtacaaagcacattactctcttccatttaaaataaactactattttccatgaaggcaaggtataagttacaacgctatgatggcaatacattttaacacaagcaaatttatctatggtgccaatttgtaacaaaggcagaaaaactgggactatcagatcgtaaaaattttctaaacaagtgcataatctcggaagtgaagcctaacctattttctttaacagctaaacacatttgaaacaaaggcagaagctgagacacctgaatagaacaatttgttaagctatttctaaaatctagctgtcgaaacatgatttcggcaataataaaaaggggtagcgcacgagacctaaaagtggatggatgcagagacaaaggatttagacaggttcaggccctctcaatgagaggtaataccctactcctgtttggggatttgaatccgccgggtatgtattgatctgacgatcaggttgtgtcatctatgccccctagagggcctcctgcccaccttatataggatggggggcaggattacaagatagaaaccttaaccaatacggtatcggtttcctaaatcaggactttaggccgttccgtaatatacaaggaaacgt

SEQ ID NO: 25984 - DNA, 702 bp, Oryza sativa
tcaggttctcggacaggcggttggtgcagaaggacttcggcgcggcacgaccggtggaggggctcttccgatactgccaccgccactcggtctcggcggccggcggcgagaggcgggcgttccggctggtgcggttcgccggcgcggcgtcggaggagattcgccggggcgacgccacgttccagcagctgggcctccactgctggaccctgcacctcctcttcgggttcggcccacgggcccatggtgtcggacactgactgagcaactcccgagtccgaccgagacgacgatttcaccctattgtggattatcaagtagttgttaggagtagtattattattgtctttcgtccacggcgtttctgctgtattcgccaattctttggacatggttagatcgtgcgcgctagcggcatatcgctaaccaacgacgtccttctcttccaaaaaaacagttactagtacactcaacagtacacgcctttttttttcttcctagagagttttctcctaaattacttatccaatctataatccgattacaccattatgatcgttgcaattaaatctttacaacaagatcttatacgattatattctgataaaaaatatctatgttgtaaatacttttattatatatgtaagttacttttgttctatacataaattacttttagatttaagctttttaataacttat

SEQ ID NO: 25985 - DNA, 254 bp, Oryza sativa
tatatgttcgttttatatcaaaaatatttgactaggaaaaagagtcgaaacgacttagagtatgagtatttttcttaatcctcctgcacaaatctaaaataatacatggttcatattttgaaaaagaataaaaaaaacagagagacagtagtccgtccatgaagcgacgagatcaggagcaagcgatcgcgaagctgacgagcatcggcggtggcggggcggcggcgggagagacgacctcctgatcatcttca

SEQ ID NO: 25986 - DNA, 1501 bp, Oryza sativa
gacccatacaactgatgatgcttcattgtttggatgcaatctcctgtgctgcaaacaacaaactaaatattgatcttgtcatggactgatagatccatggcagtagtgtagaaggctggactactggaacacttctgaagtctgaacccgggtttgtgctcatctttctactgttctgcacagagaatttcactggaaataagcaaagtagtaactgaagcctgaagcttcctacctgagggactacaagaacagaacagcatatgctcctttgacaaacgaaacaagattaacaacagaactgccctttgtctaccaaaccctaaagcgagactaatctttttatgttaggtacgtgatcaccattcaccaaccggattagagattgacctccgggaattgatagctagcttgttccttaatcttttggacctcctgtagatgaatcctgcacacaaccaccaaaacttccatttgccttcgggacagggtccggaccatctcgttgcattatctggaaaattttctggttgcaagtcgctcttgcacataaatgactcgagaactactggatcagcaagtaagattgctttcaccgataaccagaaatcaattgcttcaccggtaaccagaagccgttgcaatctctcatcaaatctcttggcaaaatcctcgctttgacccatatgacagtacgagatggctagtcaccaaacatatattgctatttagttcaggcgtccagctgctacggctatagatcacctgttactctgcccccaaagttgatgatcggatcaccaattattcgcgtggctttttcatggcggctaagatttgcaaattgctgattctaatcagggattaagcaagcatagaaatactctgcttactatttttataaggggaaaatgtccttatggggtctaaaaggaagacaatgttggtagaacaaattaatggccagtctggtgacattgccaagctaccagttgaattaatgtgttcctcatctttctctgcttcgttgcaagaatatcatgcgacgtgtgtgcatcatgattcatgagaaagatgttgcagctgaaaaggcatcaaagcagcaagcttcagccgcaaactaactagagctttatgaccatgaagaaactgttcttttccaaaaggtatttggcaaaaagaaaatgaaccgaacagctagagtagagtcatttctaaggcaatttctgtctactattgagactttgggagaagtacctgttgaaagcaatgcgttttgcaaggcatggaccggttcctgctcccaaccaactccaacgaaagccacttcaccaactctctcagctgaagagctgctgcgacgttgtactcactcatctcgtcacctcgtcagtttcatgcatataagggccctagcttgcaatcctctctgcattgcatctcaacagagcaacacaaactcacacattgccaattccctttcttggtttgattctggctg

SEQ ID NO: 25987 - DNA, 526 bp, Oryza sativa
ataaaactatagatttaactcggtgtatcataaaactatacatttaacataaaatttatcacaaaactacacatttaagatgtagtgacacaaaattacatgtttagtaactaaattatcacgaaaatgcatgtttagaaccaatttaatcacaaagtaataatgtttataactcatcataacaatggtgctagggatttaaactccaaaagttgtagttttgtgataagttcaatattaaatatgcatttttgtgatacttaacctaaaatctgcagttttgtgataaatttagtgctaaatatgtagttttgtgatacaacttcttaaatctgtagttttgtgataatttggtcaaaatacctgtagttttgtaaaatttactctaaataaaactatatacattgctaagactgaaattaaagtgctatgcaatgtgtaattttaattcattttagctgcaatattgtacataattttaaaaattttatgacttataagtttatttcatgtaattttttttaga

SEQ ID NO: 25988 - DNA, 716 bp, Oryza sativa
aggttctgaacggtgcaattctggacaagaacaatatgacacttgccttacttcaggctcagtctgaacaggggacttgataatataccctgcatttcttatcaccaataatttgataataacaacgagttattccttggcttattttgttgaaactaatgtactagaacaccaaagcacaaataaaccatgggtttctgcagatcactcatcagaatattcaccaataacttgattggcacctagcagatcatccaattgtctgcgctccttccaccattttcccatgcttcttgccttaccctcatttctagaatttattcgctggtgctacataatgctcatcacgaacctgaattcctcttccatgctcccaatatttcacagttttcatggcataattctaactttaggtgacccggcaccccaaccaaccaaccaaccaccacccacccatgtgcctgcttgttttgctacaaacacaataatcatcttcagataatatgcttatacacctaaattatttacatgccatattcatcataaatgatagtttcatccgattgggttgagctcagaactttttaaaagccatgatacatattatgtggctacatacaacttttcaccttttcctaaaaccaatgcatagattgttgtgaaaatacaagtattttagagctctataacatctgagtagcatttctcgttgtagt

SEQ ID NO: 25989 - DNA, 1501 bp, Oryza sativa
attatatcttcaatttggacttgctccggatacatgcaacatgaattcatgatcatgggtctattttatatactcaaagactggactatttattattccccgtaagggttatcaactgaatacttgcgccagtcgggattcgattgttacatctattttggagtatcccataagggataatcactaagatcagaagctattcatatgagctacgcttggtctatattacccggaagatttattactcgggagcatgttacatgcgtcatcctttaaagggtgtcgaaggcatattttttggcctaggcctaatatgtctgcaacccatattttcaggtgtggcatgtcacgttctttttgggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttttagggactaaagcacgtctgttaaagcagtgtgcgcatggcgtatgcccaatactttggaaatttatttattcacaacatacaagcttctttatagctgttttgctatgtgaattttcaataatgtagccaactttaggttacattcatcatattttacaaaacagtcggtatatcacttggatcatattattcagggattcacgccgcatatgctacatattaatattaagtcgcttggttgactataattatcaaaaccactcggttggttggattatttattccttgactatatgtttggtttgttcgattaaccacatagtcgggggttacacctattaggtgcatctagtcgatgcacctgactatatttttcagccctccacagtcttcagatttggtaaaagtactcgggagaccatggcgaagatgattgaagcactcggctttggagtaatctagttcgagagaaggttatctttccgactgtgaaggtctcaggggctactgtggagattatgggtaccccatacccacacggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcataga

SEQ ID NO: 25990 - DNA, 1501 bp, Oryza sativa
aaactgggacactgatcggtatgaaagaaaaacgacgtgctacttggtacatgttgcaaacgtcccaatataaagtcaatattgatctttacctttttagagaaagagaaatgatctgataatgtcatgtagaatgagaagcaatttttcagttttgtacgtagcctgcactagctgcctgcacacctaggattcaagtttgaaccgaaatgtcgttcatccttgtgcaatgcacgctagaacccttgacactttatacaaggtgaagacaagagggggttggagcatatttaggaaaaaaagtaagtggttcctgtggtacttggtgctaaaaaggtatgagcatgaggtagattcacatatatcacgcaaccttttcaaccttaaaaataaaagaaatatttcttagtttgcttttcatcattttagaggcaaaaaagcttttctactttgtgctccaaacacccaacaactgaaccttggattggattcaaacctaacaaaaaagaagtcccatgtttgcaatggtcaaactcgattcgaagtagcaaaaaagtaatcttatgttctcctatctcacatggctttaggtgcatatcaaaactaatgaaatatttgaccagttggaatgcaagaaaaaacaacattggattttcaccgaggataattataaactatttttaactcttgcaagttcttattaaggaaggatctaggataatttaactcgtttttggctagttaaccctgttatgctaaaaaccagttaggaacatactaatttcattggaattttcttttagggatttttccttcaacatactaattgcattttattagacgcagtattgagttcaaatgaaattgttgcaatcaaaatggtgttaataataccaatttaaccgttgtaagtttttggagaccaaatgaacaaaagatatggtcgtatcctaggaaaaaaaactaccaatatgattacaacaagcagctcgggatggcatgggacagccaacagtttgatcaattatatattattttagaaaacaaaagcgtgcaagacacattcactttctacacacagacacatttggttaattacataccttgtacacttcaatgaacctggccggttagctttcttcccccgccacctcacgtaagtacatcaccatgatcaagctcatgactttccggttgctatcaccgaggcttcaagacaaggcaagcacatagtttgccttacacaatgacgaagcagatcactgaaaggtctatgctgctggtcattatatataccactcttgtgctttctcccctcttccattccacctcaacagacctgattaagagctagcagccaatctcttccccttctcttcgctggtgtcactgtgtttctactgcctaccggagatgaacagtggcgctggtggtgctgggggagcagcagtagggaggatgccggcggggagcctccagtgggcacagtggaggctagcgg

SEQ ID NO: 25991 - DNA, 1501 bp, Oryza sativa
tggaaaatagtagtttattttaaatggaagagagtaatgtgctttgtacaaattgatcttccagatgcataggtttataaaatgctatgatctagatgaataggtttcctgtctattgttgttcatttaaaatagaaccaaatatgctgaaactattcaacaaaaaaagtcaaacagaagaattctactgtcacactgcactttcaaaagttttggttgatactggattttattatatatcagaattaaatagtttacaagaatatgagtgagaattatattattattgatccgtttctgctgtttgccactgtaccacctatgcatgcttgcctattctcttaatgtacagtcaaagttatatgtagaggcaatgggctcgattgccattcatccaaattagaaattaaatggtgcatgctttctttggggtttgatcatatatttctgtattaagagatgctgctggctctatttggcctttgatctctcggtttgtttaacattgcagtatttatttttttctttccttgcatctgaacaaagatgactccgagctaatctctcagtttgtttaaaatggtatgaaatggtaaatggacccggttagctttgtcgaatcagtttattataaaaactgatataaaaattagtgtcttctacatcttaatgtgttatatatataacggttgtactcaaattcagggttttctaatatgggtcaatagggattgaggttctgtgagatggacctaactcatttacataaacaaaattgcagccatgtaaaagcctagcgctttcagttcaaataaataatttattatcatttgctattaaatgcttaatgcctatatatttgctttgctacatatttttgcctcagtagaaaccaggatattttaccaaatatgttgagagttaaattactaatactaagtgatgaatatgtctttataagcgtgtacctcgtggtagacgaacgcactgtcttcaatatggtgcttctcctgatatgtgttcgatatagacgttcatgtggcttcttgaggtgctctataaggaggaaggtgaccagtgaggagcagaagttgctgaatatttccaggcgatgcatgtattgcaaaaaatagcacatgtaaaactttcaggtgatatttgtatctgtatgtggtataaaaagttagatactatgagctattgtttgggtttggaaatgtttcactcagagtgatgaaaatattgcagaactccattcatggccaactttggaaagttattgacagtataataacattcatgagaacaatacaaatctctctatcgttattttattcgtgatcttaaatattaccttttggtttttgcattatcaattatcaccattgcgttagcacgggtatattacatgtataaaaaggagttcaccctctagcaatcttacatgtcaaatctatatactaatataaaaaggagaagttcacctctagtaatcctacat

SEQ ID NO: 25992 - DNA, 1501 bp, Oryza sativa
catgtttagtaactaaattatcacgaaaatgcatgtttagaaccaatttaatcacaaagtaataatgtttataactcatcataacaatggtgctagggatttaaactccaaaagttgtagttttgtgataagttcaatattaaatatgcatttttgtgatacttaacctaaaatctgcagttttgtgataaatttagtgctaaatatgtagttttgtgatacaacttcttaaatctgtagttttgtgataatttggtcaaaatacctgtagttttgtaaaatttactctaaataaaactatatacattgctaagactgaaattaaagtgctatgcaatgtgtaattttaattcattttagctgcaatattgtacataattttaaaaattttatgacttataagtttatttcatgtaattttttttagaattacacagtacaacacagacactcaaaacgcacgcacactcttgtatgtcggaatattttggtagtaagcaatagcaaagtgaatgagtgatatgaccattggattaatatattatcatccaatgtatgggaaatttaaatatactgcattatatttaaatgcaatatatgtaattaatttgtttggaagaaaacaatactggttgaacagatatgaacagttaatagaataatcgaccgattgtctcatagaaaaatgaatggtacatgagttaaaccaaagaattcaggcctacaatgaataaattcgtctaaggaaccctacgctacattagatgaattcatctcaacaaacagctatggttgtctacgttagagcaagggcagggtcctcttcttccactggaagagtgtattcatccctcgagaaaatacccttgtttcttttatgccatctaaatagttattaaaaattaaaaattaacaagatagattaatataaaatatatcaatccacagacatgcagatttaaattcaacttctacaagttataagaaataattatgaaattttaatttgttttttataacttgtagaggttaaatttgatcttacatatttgtagcatgatatatcccatactccctccgtttcaagttttaagactttgactaaaccgtttcaagtttcactaaatctatagacaaatatagttatagctataatactaaattagtttcatcaaatcaataattgaatatattttcataaaaaatttgtcttgggttaaaaattttactactttttttctacaaacttgatcaaacataaagcagcttgattttgaccaaagtcaaaacatcctataacctgaaacggaaggagtattaatctatctcatcaatttttaattttttattactattcatatgacatgtaagaaacgaaggatgtcacctagacgaagaaaatccatctctgcttccactgccgcccatcaacatctgtgtggcgagccgacaccgccatgtcgccatgatcctctgtggcgagccgcgcgcatcgacgagc

SEQ ID NO: 25993 - DNA, 160 bp, Oryza sativa
gaccgagtattactccggcggtcagaccgggactcaggccggtctgaccgctcctctggatgctggtcagaccgggccctggaccggtcagaccggcgcaatagtgccgattcagggggtagatccaatgactaatgctagttatttgtatcatcttaga

SEQ ID NO: 25994 - DNA, 660 bp, Oryza sativa
tttcctatttgtacaaattgaaattcctccaaacccccaaaccgattaaccttttaccatgggaaattaattaacattttttcatatttaaataaaataatttcaataaataattatggacttacatataaggcttacatgcttttattggctgcggctatagattgtactgcaccagctagctcttccaaccactcccaataaaactataaaagcttagagggttatatgtaaaaataataatttatctgcatgcactaaccagtttaacctaaaagcttaaaaatattccgatattttggaaaacgttttatgtctgttaaacttccatttctattgatggaagtggcagagtgtgcctctctttctccgaaaggaaaaagaaaaaaaaagaaaaatcagttttgctaaaaatataccatatttttacttgattccctatgtgtttttatctctcttatatgtttatatctcttctttctcttttcctaaatagccaatcaattattttttatttatcttaattctcttgtatactgtgtactaaaaaaataattatagcttaagtgttaaaagttacggtgtgtgttatatatatatatatatatatatatatatatatatatatatatatatatatatatatatatatatatagga

SEQ ID NO: 25995 - DNA, 1501 bp, Oryza sativa
gcaaacaatctccatcaccgacggactccaccctatcctctgtgaccagccacatggagcacgatgtgcaaatatgagacctatgcagcacatcgatttagatcagataatattggagattgcacattaatttgatttgaaaaaggaattggggcttcatgcgtgaaggtaatggagagtattgagatgtaaatcggagtgccatttccttacttgcttgttctgttaatgtcgctgacgtggagcagccgctggttgttgctcttggcctaggtgaacacctccttgctggttaaggtgctacccaacgtccagcaacgaggcccgaatcagggcctttgcctcaaccaccaccggccaccgctcgccggccatcgccgtcaaccgccacgatgtcgttgttctcctccatggtgctatagtgtgtcaccgatctatgggctgggatggtagatcaatttagatcaaaaaaaagggaaaaaatgaagtggggcgagagtggttggttgggtacgggaaaaatagaatatatatcggaagcaggaagctatttttatcgatgtaaatcatttactccgataatagtgggagtaggatgacagaacgtggggtaggatcggaagtagggaagttgtttttattatcaaagtaaatcgtttactccgataacagtgggagcaagatgacgggacgtggggtgaggtgggcggactaatacatgtttggcgctcggaatactaagaaacacgctgtgctcctaataatagtactacgtaatatgctattttattatagactacatttaacaaaactactaaacttgacaaaattatgatataattataaaatttgtcatatggcggacacagcaggggacacgtgcccccttactaaataggaactgccaagcttctctttcaatcttgtgtcgtcgtttccaacaaacactctgttattatccttaagttttctctaatggcacacaatttgaaatcaaaattcaacaagcacaaccacgatgcagtgcccatggctatcccctggagacatgaaaccatcaccgtatgctaacaaaactaattatgctcagcactaacaaagctaatctctattggctaaaatttatgtacagcattcctgatcttgtataacccacaacatttaatttgatcccattttactattctttactgaagctaatgctgaaactgatcatgtaaaccaccatcctgaacatattgcacatttctgctgctctgaactgaaaagatggtgctctgatctaacaaggcagtgctgaaactgaccctgcaaaacccacatttaattttaatctttaattatatcatacttcctggtttgttgctgatgtacctagtcaaggctgatgttgagcatgcaagatcccagtgaatttcttgacagttgacacataataattacgtatgcatccttgttgtattctcaaaataattcactctaactatatgtggcaggtctg

SEQ ID NO: 25996 - DNA, 1229 bp, Oryza sativa
taatttatgagtaaaatttcatacttatgtccgtagcgatccaaaagtaaatgctataacataaactacgatgataaaccgcaaaactgcctcgaaaatcaagttttaaagtttaaaaattataaattttggcttatacttttcccccatcccctttggtgcggaagcccgtgatgccccgtgacgtggtggtcgccgatatgtggggtccacatgtcagggactaggcccccctcaatcccccctctcgtcggcgtgatgacggcgtcggctcctcgcgagttctttctcccgccctccgccgcccgctgcccgcgcgggtcgccgatctccatatcgcgagcaaagcaaagcaggaaatgagatatactagtaaaaggtgaagtactcgagtatcttccccttccttctccttggcgtaagagagagagagatctcccgtctcgtcgtctcctccgcttccctcgcgccgagacgagtcgtccatctggcgagcagagcaagggagggggagggggaggggatcctggtgagcatccacatcctctttctggttcatctctcagctcccacccggaggagtacttttggtctggaatttgcttgggctcgttaaccctaagccttctcttctagttctagatctggaagaagcgagccttaaccttaatacaagtagtaacagtttgtttgttcccgcaaaagtttgggggttcaactgaacccccatgtcccaaggtgaatcgacatggagatttgtatattggtggccatttaggaaaatgggtgcaattttcccaccctggacaattagcttttttttctaaatgaacctcaaaagtatgcaaattaatggtgtcgattgaaatgaaggctaatccgagatcaatgtaaataagctatagtaaaataattgctcaaagcgcgatgaatccttttcattcatgcgaaattcagaggggacccacccatagtttttccccagtaaaagcagaattaatgaagccgaaggttctggaggtttatacgcaagatgaagttaagggttttatggcttctcaataggcgcctgttccagaactgagtacacaagagcatgaatgggtgggtaattcattctgactgcttcacttctgttccttccattattagtgggaattgctgctatgcttcttttatgtgtatgatcgtgtagatatgcactatattggtgttgcacatgttacagg

SEQ ID NO: 25997 - DNA, 1501 bp, Oryza sativa
aacacgctgtgctcctaataatagtactacgtaatatgctattttattatagactacatttaacaaaactactaaacttgacaaaattatgatataattataaaatttgtcatatggcggacacagcaggggacacgtgcccccttactaaataggaactgccaagcttctctttcaatcttgtgtcgtcgtttccaacaaacactctgttattatccttaagttttctctaatggcacacaatttgaaatcaaaattcaacaagcacaaccacgatgcagtgcccatggctatcccctggagacatgaaaccatcaccgtatgctaacaaaactaattatgctcagcactaacaaagctaatctctattggctaaaatttatgtacagcattcctgatcttgtataacccacaacatttaatttgatcccattttactattctttactgaagctaatgctgaaactgatcatgtaaaccaccatcctgaacatattgcacatttctgctgctctgaactgaaaagatggtgctctgatctaacaaggcagtgctgaaactgaccctgcaaaacccacatttaattttaatctttaattatatcatacttcctggtttgttgctgatgtacctagtcaaggctgatgttgagcatgcaagatcccagtgaatttcttgacagttgacacataataattacgtatgcatccttgttgtattctcaaaataattcactctaactatatgtggcaggtctggttaatactcaaagctactagactgccataggagaaggacatggtctgagtataagaggatttatttgctagtttgacaatatagaatatttatgttttcaaactggttacacatgtttaaacatatttgtagacgaatggactatggatcatggtcccaaaatgagttcaatcatcactacatatctatatgtgcatccatttgctatatgttcaaaatgcggcacagcctaaccatccatcagaattcagatggtggtcattcctgtttgtttactcctcagttcttcttgaaccacctggtgtttgtttgcaaatcacctgctgtttgtttgacaatcactagtacttttatttgcaaataacttacttccttggtaaataaatcctcttgtactcagaattcagatggtggtcattatagaatgacaataaaccactagtacttttatttgacaatcaccatctgaaccacctgctgtttgtttgacaataaaagtatctgtaggatcgagatgtcgactagagggggggtgaataggcgatttaaaactaaatgacacataatcaaaactaacctaagttgctaggcttggtgagggtcaactctaactaagcaactaaattatgttttgcaaacctagggtgatagtgactcaattatatctctagaaaagtaaatcacactcctatgtcaatgtttagcaatcctagggtgatatgatctcaagtatgtctctaga

SEQ ID NO: 25998 - DNA, 1189 bp, Oryza sativa
tgtgccaccggccgcgcggcatcctggcgtttccttcccctccgccgcaaccaccgtggccagttgccgacctcgcctccaaccacgcgtctaccgccgccggcatcctagcgctttcgtccccaactctgccacaaccgccttctcagtcgtcaccgcaaacaggcggccacggatggcgtcctagtgaatgtataccatgtataatgagttagggacaaataggtctttttacaacactaacggatgctaactgggctgtgatggcacgcaatagaggttaaggaaaactcgatggcatattattcaacttgacaaagtcagtggtatattgtagaagtgggcaaaactcaatggtactgagtgaattctatctttagttttacgcagttgagaggaatgagccatgaattacgccggacacggagaagtcatggcagagttaagtaacacacataccttaaaaatatactactggtacagatgatcgatcgatggatgcatccatttagggggtgtctagatccaggggtgtaaagttttggcgtgtcacaatggttattatacacggtgtctcatgggtgttcgggcactaataaaaaaattaattacataatccgtcagtaatcgcgagacgaatttattaagcctaattaatcagtcattaccaaatgtttaccgtaacattatattgtcaaatcatggagcaattaggcttaaaagattcgtcttgcaaattagtcgcaatatgtacaattagttattttttagcctatatttaatactttctgcagatatttaaatgttcgatgtgattggtaaaaaattttggggaaggatctttatcccatcgatcgaattaaaggcaacagcaacccatattaagtgacgatcagccgtcgtctgacctccacatttactcccacacattaaccatcatcaacctaccagaatgcgtgccaaactttgtttatcatttcgtacgttcctctcatccgtcatgctcatatcctttgtcccgttgtcacatttgcattatactccatccgtaaaaaaaaagaagtgaatatagtactgaatgtgacacatcctatataataaatttggacattgtgatattaaattgggtttttatgggaggaagcgcctttcgtgtgatatcacaatgcgagtgatgtgggagccaaca

SEQ ID NO: 25999 - DNA, 304 bp, Oryza sativa
  unsure (1)..(304): unsure at all n locations
ggcaccccctctcccgccgcatcccacaacacctcgctctaaaccctcgcggcggcggcggcggcggcggcgcctactccccctccccaccatctcgccgcagccggaccttcgcctcgcgctctcctccccccatcgtcgattcgcgtccaatcgagccaaggtttgcgccattttcttttcttgagggtgtatatatcctagctgctcggtttgacccaagctttcgatcttgtggtttttttttttgatttgggtttgtatccaggtgtaggtgttctcgtgcggagaaaggnnaagagaa

SEQ ID NO: 26000 - DNA, 1501 bp, Oryza sativa
tatgtcatatctaaaaataaattattataaatattatttatgactttgtcatgcaagatattatttagagtaaatttcactttggaccatatttattgaccaaaattttacattgggttagagctaggctcatgttttcacttaacaccacgtataattaccattctttgccctttggatctggttttatagttaccatcacacgagttgttatctaggtgctttgcattttacaagaaacaatgatatggaaatttttgccatgcaaatatgcttagcgcaaaaataatgattgtaacatgttacaggatatcctatctgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtaagcctcacctaaccacatttattgcggtctggtcgaacgtgtcacgctgcatgcagcgtagtgcagcgcgttcctttatccggtctgtgaccagtcacagaccggtcagatcacgggttaggtggcgactggcggtttgacgcacgccttgccccatccggtcaagacgaaagcctctaggcactcgtctcaagccggagctagcgtgtaatctcttagagatggcccgttagccctggttaaatttataccaggcttcatcccaaccattacaggcaagatgctacatgaagaagggcaaacatgcacgttgctaagctgacacgtggtggacaaggatgactgatctgtgaccggtctgacactggtcgcgtcatcaacagacagccataatcccacgtcgcacctgtttccggcggaagtgggggtaggtatgggccgtcccgtcagaagggcactcggacagcagccgtaccgatctccgtccatttatgaagagaagaacagtccagtttggagaaggagaggggcatgtggtatccccttgagatataaaaggaggacattgcccacttagatagagggaggacttttggacacaaggccttctccagatccgatcccagagcgattgggggctggttgacactttgttacttgttcatacacaaatccaccgaaacacaggagtagggtattacgcttcccagcggcccaaacctgtatacatcgcccgtgtctcgcgtttcttcctagctggcgttctttccacataccgagagagcttgagatttcaccccaagcccccggccgaaccggcaaaggggggcctgtgcggtctcccggtgaggagccacgagctccgtcatctggcgcgccaggtagggggctcagcgtgtgttttctgagctctcgtactcctccgtgtgcgccaagttttccttgttcagcctaa

SEQ ID NO: 26001 - DNA, 1501 bp, Oryza sativa
gaagaatcactccattgagagctgtagagatcctcctcctcttctcaaacaagatcaaagttttctccctaatggcatctgcaagagcatcaacaggcaaatccttcaagtctttgatccaactgttccatgactctgccaggttattgttgatgtagtcacactttatagcacaatcaaacttgcttctggcccacagtaggttgtgatattctttaagccattgtttcacctctggactagctgttgtcacttcatccatccacttgtcatgcttctcaagcatgtaagtcttagctgcaggccacatcttcctcgcatagatagacccatgaaataatttcttcatgttctccatcaaatgcctcatacactccctctgttctgcccatggaaataccttgtgaactgcagtttccaaccctttacatgcatcagtgtggatagctaattttggaactggaccaattgcattggctagctgctccataaaccaaacccagttctctttggtctctgaatcaaaaaaaccaaatgccaaaggaaacatccaattgtgtccatctaatgcattggctgcaggcatgtgtccattccaatatccattaagggcagtagaatctatgctaatgtagggtctacagcccccctaagaaaccatcaattgatgctttaaatgcacaaaagaatctattgaagtgaaccttatctccaattttaactgtgtctatctcaactacactacctggggacctcatttccacctctgccttgaacctatacaaccaatcaaatgaatcagaccacttaccaaataatttgtctgttgccctcttcctaccatgataaactgtatgataaggtatggttatcttgtaggtgtcctgcagctccttctgaagttcctttggacccatcccattcttcttgttgagaaatggaattgccctctcagcaacccaagcttgagatgccatccttccacgaactctgcttcttgaagcacacttgtgatcatatttgtttatttggacctgcaaaagcaaacaatattagcaactatgcaaaagttactccaatctgaattcagcaagcaaggtgtcaaattgcaaaggtaatttaaatggttagtataataccctgacactcttattaggttgggtctttgctctaattatccatgggcaaccaattgcatggcatttccctctaaacctttctttgtcagaattttcagtctctagttcaaactcatgaacaatggcatattgcttcattgccattctgaactcatccatagaagggtaaaatgtccccactgacatatctgggtcatccctgtcccaatccaacacatcaatgggtacttcatcgtccactacaatggctgcatctaacatgtcttgctgaatctcggttggaataataggaattgcagtttcttccatagctgctgcagcagctgctgctctctgatctgctgctttgaagcccatggcct

SEQ ID NO: 26002 - DNA, 1501 bp, Oryza sativa
cgtcctgacagcatgcgaggcggcggcgtgtggtccactccgcgtcatgaggttctggccgtagcgacgcgtggccatgggcggcgccgtgaggctgtggctggaggtggtctgcgtgttagcgtgggtcacgcttggtcactcgggccagcagcacagtgactaggcttgggtgctgaagggatggcgtggtggtccagcgacggtcgttgagcacaacggttgtatgggctttgattgggaatcgctggtgaaaaccttgccaggccatgggccggcatgacggcgactatgcctttaggcgtcattccctttcttggaggcgtcgttttggcgtcgatccttctagcagcaagaaccttccgtgtgcaacctagccattggtggactcctgcaacacttccaaagctctataggcctaaggtgtttgacgaggccttcgccgccttggtctcgtttcttgctctgctgcgggtgttcatcatccttatttggttactgttgggtagagtcggagctgcttcactgtacgggtgcgatgaagctcagcaacgatgatacactgcaatctccttatagggttgttgatgctagctatgtgtaggaagtggctccttggtagtttgggctgatgtgcttcgtcagtgtcaattttgtttgttcattttagctttgaggtagcatcgcagtgaagtcgaagctgctgtgttgattgggtggcaagctcggcaacgataacatgtgtaggttgctgtgtcgcctctatggcaattttggtcgatgccttatgttaggctccgtcgtggtagcatatgttaggttagctatggtgtggtcttgtagttatggttttcgctcagtttttcctaattaactaggcagcgtaaggtttgatcccgttttcttcttaaaattggacaccttcttaatataaaacgtcggcaatggcctgaccattttaaaaaaaaaattacgtctccgggcctctttgcatgtcatctaaattacatatttaattataatggttattcaaaataatatgtttttatgatggtaatgccacttttacctatcaagtcttaatatttatatcagtatatatcagttaagatttttagacctggctatgcatatattcctctaaaatatattcctctaaatatatatgtctatttcaaaacactacgtgtactccggaacagttcagctcttaaagagaacagtgtaaaacgacgttggaacgaacagtccttagcgaaaacttgccaagtcaaagtcgtcgggtgtgtacataaatttacatatcattgtttatttgttttaattttcgtggttaattagcacccaagtagctaggtaggacatgatagtgctacacccctctcgtctttatatacgattcctccgttccttgtgaaaactgaggttgcaaaagtagtgtgctcgatatatccaccaaaagcacacagatattcgcttatccatgtctccccaccgagga

SEQ ID NO: 26003 - DNA, 1501 bp, Oryza sativa
ttatggcttccgcccaaaaggaatcggaaacaccatattcatcaagcatagtccttgccatctcaatcaatgtacgatttttcctctccactacaccattttgttagggtgagtaggtagcggaaagttcgtgtttaataccaagatcatcacaatagtcctcgatattggtattcttaaactcggaaccattgtcacttctaattttcacaagagtgcaattaaattcattttaatccctttttgcaaactttttgaaaaactcggcaacaatagacttgtcatgcaaaaagaacacccaagtataacgagaataattatcaacaatcacaagacaatgactattaccaccgatgctcttataggttgttgggccaaacaaatccatatgcaagagctccaatggtctagatgtggacatgatactcttagtaggatgagaacatgcaacttgcttgccggcttgacaagcactacaaagcttatctttctcaaacttcacatctttcaagcccacaactagatcacgttttgaaagtttgctcaattgattcatgccaacatgggctagcctcctatgctaaagccaacccaatgaagtttttgcaactaaacaagttttcaaatttgctttactagaattgaaatcaaccaaataaagatttccatatctaaaacctttgaacacacaagacttgtcaagaaggctagaaacaataacttcttgcgggaagaaagcatatgacaagccaagatcacaaatttgagcaactgaaagcaaattgaaatttagagatttaacaagagagacattatcaattgacaaatcattggagatagcaattttacctaacccaattacctttcctttgctattgtctccaaaagtcactttctcttgttcattccctcctacttcaaatgtggtgaacatagccctatcaccggtcatgtgttgagtgcatccactatcaagcacccaatggctcccaccggtgcggtagttcacctacaaaagaagatcaagctcttttaggtacccaaacttgtttgggtccttggaggttagagaccaaaactttgggcacccaaatgacattctttttaccaccgagtataggggaacccacatatctagcaacaatgctaccatcatgagtcttccaaagcatataatgagaatcaaacatgcatatctaaatacatatcattgctcttgacaaaacgagtggcacggtgagaaggtttcttacccttctttggaatgaatccaagtccctccttgttaaggatgcaccgttgctcactcaaaatcttatcaagagtgttcttacccttgaagcacctctccaaactcttgttgagcttggccacttgctccttaagctcattgttctcaacaacaagtgaggcatcacaaatagaaatacaagagctagagctagagctaggcatatccacaagaccatcacaagaggtagaaatgctagatgatgcaaca

SEQ ID NO: 26004 - DNA, 1501 bp, Oryza sativa
gggggctaaatgtgtagttttatgatacaactccttaaatctgtagttttgtgataatttcgtcaaaatacctgtagttttgtgaaatttactcataatttaataatataattaatgctaaaattagatggatcaaaatagaaatttctattacaggtgtacaaacagagtcacaaaatatgctaattttcgcatttgcatgtgcgccggccaacgatgcgggattcgactgagacgtgccgatcgatgcatgcatgatcgccactactccacgttgaaactaaacccaagtcaaagtaaacacgtatatttgaagtgcacatagtttcattattagaaaccctcgatttagtcgaattagcgcttagattgaaatgaaaattacgacatacacccattattttggactctttaaatcatccattttggcatgggtgcagtgagcactaattaccgtgcacgcacgggatctaaaaacagtgcgcaggccgtccccgtcacgtctcactgctacatcctggtctatggctgatggccaattcaaccacatgagcgtactttcccggtctcataaaaaataaacatagtcccgttctaactttataaaggcacatatttttcttttttttcgttagcacgtttttcaaactattttataaaaaagatttctatatagaagttgttttaaaatatcagataaatttattttttaagtttgtaataattaaaacttaattaatcatgcgttaatagctttctcgttttaatcttaaaagacgcgaatattagggaatgtcataatatcaaataattagaaggggtgaggtttcgaacccaggtcgtctagtctaccaccttgtgtagctagtcggaagacccttggacatttctccacgcttttaatcttcatccttaaaagattcaagcgggcgcctgatacaaaatacgacaaatcctaagatatattacatcctatactaggtcttctctttatatgatagagcgagtaggcctgtatataagtgtgatcacgcccactcactgacagactcatagacaagaattccactacaacactctaccgatagtaaaaaaaataatctaaatcatcgtttttatttgatcgaatggttcagatctatttatactatcaccctaattagtgataatagaaacgtgaaaaggtattattgtaaaaaaggtgcgaagggacataattgtcatttagcatttagcagtgattaaatatttttttctcctttttttagctttttgataaaatatgagcgatgcgagcgcaatgaatgagcatggatcgatgtagccataaaaaaccctaatcactgcattagtaaattaatatataatttgcccttaataatgaattatttaaattatttttactggtaatataatactatctatcagtagatagcactagctagcgcattactccacacacaatcatctcaggcccagccaggcaaggcagcagcggcca

SEQ ID NO: 26005 - DNA, 1501 bp, Oryza sativa
ccccctgcgatagctcttgaccccatatcatcgatattgtcaccgtcagtgtaccactgggtctgggcagagttcgaaattccaaaatgatatttccgaaaattcgggtctattggtggaccttgatagtaagtgactccggtcaaatatttcgggtaaaaaaatttaaaagaaattcactggataaccctatctcctcctcagtcaccacatctcccacccccatctcctcctcagtcaccgctcgacacatccagatccagaaactccgccaccagagtcgctgctcgacgcagccggcagcccaccgccacgctacacgcctgcacctgcatgccacccccagccctcgccttctgcacgccgccagtcgcccccatccaccatcacgttgcatgccaccgcatcagcgagcgggcggtagtgcgcctccttcccacgggcacttctccttccaggcgtcccctatggaacaagtggatggaagtggaattcctgcctctgttgggaggggaagaggaaggggtcatagcaccggagatgctctagtggcctcagcatttgggggtttggggaaggaggagaaggcagcagcatcggcacggggtatggaagaggaaagggagatggaagaggagcaggtggcattgggcgagcaacggcggcaacaaaggtgaacagaggtaaagataacatttgtggcttaatcccctatcctagttctggcattgtgcttgctagatttgctgttaaagttttatcaattttggtattagtaattttgtagttgatgttttctaattattttactgcaacaaggattgatattttgtagttgacatatacctggtaaatatttgtctaggtgagcggtgtgcttaattagacagacaaaggtgtgcttaatttagttagacatttgtctaggtgattattgatatgtgctttgataaattactgatttatattttgtagttgatgccctttaaatatttttctacaagctctatacattaattctctagttgaggtcccatttttttcttgggataataggaaatatcagttcaagccgtatttacgatgtttggagccatgggcaaagggttggggtgaatggttttaaatgtttatattgctcttttactggatctggtggagctgttactcggctcagggagcatttggctggaaaaagagggaatgtgaagccatgcttgactgtacctccacatgttcggaaagcaatgtgggctaactcatactaaggaaactataagggattttaaccaaatgcaaaaacaaagggttgaagcaaatattgttgaatctatatacataccttcagatgaagaggtgcaatttgagatggcatgtagactgtcgttgggggacggtactttcactcgtagtgttggtagtagtaggaagagttgtgcttggagtactcctagaatgcagaatagtagattctatcactcctcaaggaaagatgactttg

SEQ ID NO: 26006 - DNA, 1501 bp, Oryza sativa
cttgagaggaggtagggggggacagcggtccgcgggaaaaaaaaagaaatctaaaatggaaaaaaagtgagaatatgaaacaaagactagaaatatttttaaaaaaaaatagccttgcttttgatcagttagctgaaaattccgaaaccatcagtcgactaataacaaagtgttgtcgacgtcggacatcgagtcgtctagcttcttcctactctcgatcgctatcatcaccacgcttctctcccacgcaaaatacagccaaatggtggcggtggtttcagaccagcaatggtgacaacaaatgtatatacgtcttctccggcaatggaccttaaaagcgacggcgacgtttggggtatctgttagtgttaggatcagggattgaaattttgcttcgaaatttcggaataggtatgcaactatctcgcctgaagtttttgaatttttaaagtttaatgaatttggtaagaatttattcaaattcagtcaaatttatttaaagtttgaccgttttgtgctccacataaaaaaataaaacaaacatggccatggtacatatgccttgctaaattctcaacatagaacatataaaaatgaaataaaaagtgagaaatagagtagcagaaagtataactaacatttggcgcaatggatctatcaaaccattcgacttcaaaaccttctcccctatgtttgtgtttataagagagaaaatcgtgctcaaatggcatggcagctcgggctcgactttatataggagaagctattttcgctggcggaccacttaagccatcgccatagaaaataataggagtggtggtggcttaagtgggccgctagcgaaaataggttcatcttcgctggcggcccacatcaccacaccgccagtgaagactttccatcttttttccatcttcgctggtggtcccttaggtccgccgccagtgaaaataggaatatcttcacgggcggcccgctttactcagccgccagcgaagatatgttttcgctggcggcccgtacccacgacccctccttacatatttgtgctggtggtcatagcccatggccgccagcgaaaattatagggcaacgttataaaaaatcggtttttaagtagtgagagggaaactgtttaattatatgcataaccaaattaaaggtctaatgccctcaaatacgaaaagaagttgaacgaaacgtacttaagaaagctgcgtatgcacagctcactgcatgatacaggtatttcatactagttaggaaatactcgatcgagtataatcacaatttcaaaattctggctatatggagtagagggaaaattaccttgacaaccgttgggacctttaaggtaaggattgccttggtatccttcttggcacctacagatgtagcctgttgtatcggaggagttgatacactttgcattgtcgcttttgcaagcataggatgtgagatttcccatagcttcctcacaagtgttggcggtgttgatagc

SEQ ID NO: 26007 - DNA, 430 bp, Oryza sativa
gataacgagtttgcttgacacgggtttcatgcgtgcaggtttgtaattttccattttgtttgcatgtatttcaattccaacctatgtgtaaattgttggtgctagctgaaagtttctacttgcaaatttacttagctggtggacttgattccgaggcccactacaaatacaagggttatttaattggcaaaccaagctacatatgcaaaagcagtatcaaaagcatttcagaagatggcgaaaactgaggtatatagagcaattggccagttcatgcagttctgcaacaaaaggggcatgttttcctctagagctgctgagattggatcatctagctagtacaatgcatgtacttcaaatctgaattatgcgtaaattgcatgaattccatactgttggtttgaaatatattaaaatattgtcagtttgt

SEQ ID NO: 26008 - DNA, 1501 bp, Oryza sativa
tgttttgggggttcagggaccatgggaattggaattttctcccaatgtttctgtggcgggaagaaggaagcgagcatgacagcatccggtgtttaaattttattcgcaagaagaaagaagggaaaatcgagcgatctagtacacgtacgctcgcggtccatcatggataggctagaaggaataaagtccactttaattactatacaatctgatgcgtatcatttgatcgcaatatcgaatatctaaacatctaattactaaaatcggtacaatttaattttcgagacgtattaatcggtgcaatttaattttagagacgtatttgctgatgttatttattgacctaatccacttgacagaatcattacgtggtactcacatatcatcctgtctctccttgtcattccctctatccttcctcctcaaccggcagctggccagctgccaggccaattgcgccagggcgatggcagatacagactacgtcgagggataccaattcaccctgtaaagtggtttctagttacaagattacatctcaaaagttctattacagctcaaaagacctatcctgtttccagtaggtcggtaacgcactaacgctgcatgcattcttccaaatcaaattgatctctactcattatacatattagtaatttaatactggatgtgatatatcttagaatacgaatctggacatattcatattcagatttataatagtcatgtctcatccgatactaggttattatattttgggacagagggagtagtatgcatactctagacctaactataggaaattggacctatattaaggagagtggattatgatctctcgaggggatgttccctcgttgtttgcatgtcacttaaatagttatgaaaaaaaattaagaagatatattaacatgtaatatatcactccacaaacatgcaagttcaaattcaacttctatatttcacaacgaaaaaaaattactgtgaatatgcgttaactagctatagtttaatttgtttaatttgtttttttcgttgtgagatgtagagattgaatttgaacttgcatgtttgtggagtaatatatcacatgttaatacatcttctttaatgtttttaaattttttcatgaccatttgagggacatgaaaaaaaaaatatgagaacattccctcgatggatcaaaattgtttccattttattgagggacttaaaatattctaggccagaatagactgcaacttatgtgcggcccatgctgttgggccggaacggattagagtaggccagattactacttacgtgcagcccatatgattgggcctgcatgggccgctgacacaggcgcgagcgggtccaacgccacgaagaattcggagctcgagtcggtgacggagtcggcgtctcgatcgcctacaagacgtcgaggccgaggcgggccccggacgtccatcacccacacgcgcatctccggtcgtagtggattgatttgcctcgtgat

SEQ ID NO: 26009 - DNA, 1501 bp, Oryza sativa
aggagtgcgctcgagaaaggcaatgaaaataacaatatctcgttctaacgaagatttacgttgccctaattaattcacttgtataagattttcttcattctttttacatcaaacggaatcatataaaatgcgctccaacatactactacagaagtcgtttttccatatggtcgaaaacacatttttgcgtgaacggagatccgcttgtaacataaggtctgaaaaaatgtcattttcccatgcgggctgcgcacccgcacgtaaaaatcctatttctacgtgtgggtgcttatgtcgtccgcactaaaataaaattctaaaaaaattaaaagtaagaaaaccttagaatcctggcggatcgagccattgcggggccagcgcccgcggatccggccatcacgtgcccagtggcggcggatccgcctgccggccgtcgcaggggctagtgcccgtggatctggccaatgagggcccggcagcggccgattacggccgtcgcggggctggaggcggcagatctggccgctcgcagccgcttcttcccgagcctattactgtcacgcgctgccattcctgagcccaccgcacatttcccggccaggcccggcctctccaaagcccgcagtcgctgctcccggacgttgctccccgagcacgtgaccgttgccaacgccgtcgctgcccccgctgtcaccgggaatgtcgttgggaagtgaggatgagagcaggttagaatgagtggaggggaggaagtgaggagaagataatggagagagatgggagaagagatttttctctttttgttgaatagattgagagggaaagaggaggaagattagacttgcaggcgggtctttaagaggcatgggtctcttaagtggcctgcctgcgaaaatatattactttcgcgtgcgggcctgttaagacgcccatatacgaaaattgatttttttttcaatacatgtccgtatgcgaaaatggaggtcgatttctgcagacgcggtcaattatgatccatttgcaacctaacgtgggcctcttttaggaaaattgtttatgtagtagtgccagttgttgaaataaataaaaaattcacgtcacactcaacctcttgttaaattttaatccatatgcttgttgagttgcctcccgtagtttttcttgctctctaataagatgctttggtctaaacgtgggattctttgttaaaacgtcatgtcatttagacatggccatattgttcagaaatgtcgttctatatgtccatgtctaacccgataattaaccaatttctgaacattattggaatatttccatgggcaaagagagcaagggggcattcataaagatttcgggtcaacccattatagcgacctttgcggaaatatatagtacatgcgaagacttggtacgaatcgttggatctttttgttttattgtacttttgtggtgaacgacacatccaagatgattcatggatgctagcggctacgcttgcctt

SEQ ID NO: 26010 - DNA, 652 bp, Oryza sativa
tttgatatgatgtgatatgatgaaaaagttagaagttgagggtcatctaaacacggaccaaaatttactgcaaacctagctcacaccgttccaaagaaaaagaaaaaagcttacctaatggagacgagaccgcctctccggctccccctcatctccctactgtgtctgtatacagtgcctctcacccaggcaccctctcgaccccttctcgccttctcttcctcacccctcctctcatttcaagaagaacaagagaaagctaagaacattttctagctctcaagtagtactcctatataataccaagaagagaagcagtaatagtctggggaggcttgaagggggaggagaagcatcaaatcgaaacagaccaacagaatctgaaaaatttactagtggtagaacaagattagtcctttcctcttccaaataatagtggattagctactagtttattagttcctttcttctaccaagtagtggattagagattagctactagtttgcaccttgaagagtgatctaggatggcaccgagctttgattttgcggcatcaatcctcctttgcgcggaggacaacaccgccattcttgatcttggcgaagagagcgaggagatttcttgggttgttggggttgatgcttctctagg

SEQ ID NO: 26011 - DNA, 1501 bp, Oryza sativa
tcctgttttgttctgctttggcgttcgtagggggtcatggatctggatggggatccacccctggaggatgagcatgaagtagtccactctcaacttccagagattgccacctctctggaagcgatgacaatcacaccaacaaaggagatcagagtgaggttgcaacagtctcctgaaacggcaacagttcaaaccactcacaacctcctcatgaaggttggacattctggaggccagcagaggcagatccctttggaggctttgaagaaatcaatggcaaaagcttggcaaagagtttatcttgacatctctcaggtagaaagcaatctctttatggctcattttcgtaattatgaagatctgtcctgggtttggcaaaagcaaccgtggtcttttggcagtgatgtttttctgcttgaatgggtttctttggatgagaaaattaaacctatgtcagcttacactttcaagcatcttatggttaatgtgcgtatctatggcattcccccaagtcttagaaatgttaagaatgtcaagttggctgctgaaaacataggtcaaatctcaaaagctgaaccaatagatccagatagtttgctgaggaatcagaaatttgtttgtgttagaatcaggattgatgtggaaaaaccagttcctgatcatgttatcttggagcttcctgataaatctgaacttaaagcttttctgcattatgaaagaactcccagaatatgtactttttgtggtctcctcttccataatgttcaggtctgtcctcaaagacaaagaattatcattcaatttccagatgcattcgaggaagatcttaaggataaactgggaaagtggatcactcagatcgattatatgccatcagaggcatttttggatatggaggaatccaacaaaaattcaattgtggaaaaattcaggcaacatttttcttctcctcaattcaagaacattcaagaacagcagaagcagcaagagagaggaagtgggaccagccagtcattaatgcccaagctagattggaaaaaagcgagtgagaaagctttgactttagctggctgcagcactgttcaagggcccccaagtcaagctgttcacactaccacagcaggcaaacaatgtgagaaaaaagacaaagaacctgatatacaaagtataccagaagttggtaccgaagagatgttggtacatggaagtacagagaaaaagaagctggtttcaagtactatagaggatcatgtcagctgcaactcaaagaatgtcaatactgctggtaaggtgcatcagatggaaccagtccagtctgttccattggttcaccgagtttcacccagtgcaagtgcccatcagaacagtttagttaaccctgctattggcaccaacgaagtgcaacacagaagaagcacaagagctaccaagatttatgagacagcctcacaacatttaagtaagaagagagggtttcatgaagcagcccatgaatctacca

SEQ ID NO: 26012 - DNA, 297 bp, Oryza sativa
tgttgttgataatcccaaacatgggggcaactagtcagtgcatgaaattttacagataacagcgtcagcatctcatacttcattttgatttacgctgagctgacgtttaatattctatgaccttttgaccttacttttgctccattgtggataaatctcaagtcatcaatacctttctattcaatttggttcatctaaagggatttacactggtctttcgcaatttcatctaaagagatttacacagtgcatcacacttcaatttgatttctgatcaacacaatttaatctgcagaa

SEQ ID NO: 26013 - DNA, 1501 bp, Oryza sativa
ggtcctgctgggtctcccccatccggatgatcctctccgccgcgccggagttgaacgccgatgtctgccgcgcaggcgtgtacttgatgaattccgggtcgtggttgctggccagggtgttcgacggctgcacggcggagaggcgtttctcgacgatcgcacgcagcgcggcgctcgtccgcgccgtggtctcctccacggccgcctgctcgtcatcgtcggcgtcggcggcggcggcgttgatcttgggcaagacgtcgccggggctggagtacacggtcttcccggcgttctccccctgtctcacgacggcgtcgaactcgacgcggccgccgctcccatcgacggtgaggctgagcacgccgccggaagacccccgctgctccccgtcgccgtcgccgccgcggcggcccatgtcgagcgggtactgcgcgacgtggacctcggggaaggcgccgccgtcgccgaagtcctccttcctccgaggcgcgagcgccgatcgcctcccgtagggcggcacgggattcaccgccctcgacgacctcggcgcgtcccctccgccgccgccgccgccgtaccgctccttgaaccactcgtcctcggtgtggtcgtgcggcggcgcgccgccgccgtgcgaggggtcaggcagccggagaaccatcacgaatcacgaggcaaatcaatccactacgaccggagatgcgcgtgtgggtgatggacgtccggggcccgcctcggcctcgacgtcttgtaggcgatcgagacgccgactccgtcaccgactcgagctccgaattcttcgtggcgttggacccgctcgcgcctgtgtcagcggcccatgcaggcccaatcatatgggctgcacgtaagtagtaatctggcctactctaatccgttccggcccaacagcatgggccgcacataagttgcagtctattctggcctagaatattttaagtccctcaataaaatggaaacaattttgatccatcgagggaatgttctcatattttttttttcatgtccctcaaatggtcatgaaaaaatttaaaaacattaaagaagatgtattaacatgtgatatattactccacaaacatgcaagttcaaattcaatctctacatctcacaacgaaaaaaacaaattaaacaaattaaactatagctagttaacgcatattcacagtaattttttttcgttgtgaaatatagaagttgaatttgaacttgcatgtttgtggagtgatatattacatgttaatatatcttcttaattttttttcataactatttaagtgacatgcaaacaacgagggaacatcccctcgagagatcataatccactctccttaatataggtccaatttcctatagttaggtctagagtatgcatactactccctctgtcccaaaatataataacctagtatcggatgagacatgactattataaatctgaatatgaatatgtccagattcgtattctaagatatatcacatc

SEQ ID NO: 26014 - DNA, 1501 bp, Oryza sativa
ggaaggaaggcggcaagcccgccgatggagctgtgacggctagatccggggagggaggggcgaccacagggcggttttccacagctgctggccggtgccggctcaccctctagacgctcgccgcattctccctgcgagtggagctgtggaggagagcagaagagagaaaagagaaaagagtagaagacgagaagagagaattgatgggtgggtcccacatataatagggtcgaatgattaagggaagaagcaacattttgtgcttcagtcaacgtcattagatgcccttaacagaatagggcataccatatcttcggatttgataagaagggccaaataagcaaagttgataaaaaagggtcaaattgatagttagctttcaaaagagggtcaaatgcgcaattgccccttaaaaaaagtcccatggtaaattgctggtgttatattgaagataaggactgaagagtatagcgaaaccatacaattcgcggttaattagggggcaaatcagaatgagaccacaaaatttagaaactaacaccgtagtcagcttaacactactaaacaatagttttttttttctgatgaccaaaatcaatcttggatgacggctagactaaaccacctacgaccaaaggccagagaaaatacactatctgcatatgcgggcttcatctgcgataaaaaatctatttttactggcagcaaggttaagtggaccgtcaaaaaaaattgacttttgcaggcggcaacattaagccaaccaccaacgaaaatgattttctaggaaaaataaataaattcccaaaaataactccaccgaatccaccgctcgcaacccgcactcgacctcctgccaccagtggcctgtttgaccccggcacccacaacccacgctcgagttcccatcgatggtggcccacacaaccccacctcccacaatgtgcactggagatctgccgccggtgccccgcgcaaccccgcgcatctgtggccccatgctcgagatccgctgtcagtaacccactatcgagatccgccaccagaggcctgcgcaacctggccatttgtggttcgtgcttgaaatccgccgccggtggcccgtgcgaccccaccacccgtagtcgctgtccgttcgcgtgacgccgtgagagaaaagatatggttaaggtcacttagtcctgccaggatctgcccgcccggcgctgccctgagttaggaaaggaggaaaggagggaggagggatcgagagggagtgagagaggagagggatgagaggctgaggataagacatatacaattgggaggaggaccatgtcttttatgtaggctgaaatttattttttatgtcggctcattgagaactgcttacgaaaatctatttttactaaggcaaattttactataggacgccgtgacttcatggatttagctgtaggacactatcagggttacgaataagatataccctctatccttggatgtacgttgtatactgata

SEQ ID NO: 26015 - DNA, 552 bp, Oryza sativa
cagggtggtatgtacgtagtcgaaggcgaggtgacataaatataggaaacggcgttgaggtacggtagaaggagggaggagagccagagtgtgtgggcccaccatctatggtttgcccatgcatgcatactttgctgcctgctgggcacgattgattcgatcgatccgtcaaataaggagcctttcctcatctaaaccttgccgcaaatacagaaatcgtcaacaataccagttgaaaaggcatatcagtgccggtttcctaaccgacactacagctaattaggcactgatgaaggggttgtcggtacccattttaaaaccgacattgatgtgttccctcgaataaataaaaacatagaggatggcttgaatcaagtcgatgcttcaagcggctctctaaaattcacagcccagcacatcgatgccctcctattccgcatccacaatacaaatcaacaacaagaacacaagagcatccgtgtatattccattatctaaaaaaaaaaagagcaaccgcacacatgcatcaaggcatcattgcaatattcagac

SEQ ID NO: 26016 - DNA, 1501 bp, Oryza sativa
gttctatgtacttagctttaattaataatggctacattgagaggaataagtttaattggaaacttaaaatgcctcttaagattaagatttttatgtggtacctgcttaaaggtgttgtcttaacaaatgataacttggttagaaggaattggcatggtaatttgaaatgttgcttctgtatgaaaaacgagactatccaacatttatttatggaatgtcattatgcaaaatttgtttggagagcattacaattttttttctggtttaaatattccacatagtatatctcatatttttttagaattggttcgtagggattgataaaaaaaccagtaaacttattctggtaggagcttccgctatatgttgggttctatggttgagtagaaataatatggtttttgataaatcaccatctatatcttatatgcaggttcttttcagggcaacacactggctccggtcctgggcacaactacaaaagtgtgaataagatatcaagttaataaaagctgcatgtcgtaatcttaagtcaacggttatgcagttttttgccaacttcggatgaaaatttacaaatagaattcaataatgttatgatcttttcttgcattggtttttagtacttagtgtatgttcctatccttttaggcatgtgtttttatgactttttttgtcatgcgtttttatttgtatgaattggtgtaataattggttgtagctcattgagcaaagactgggattctattcaattatctaaaaaaatatatgttaaactctccacctaattctttcgttattaccccttctttttgctctcgcttacataagaatgttgatatagtaccagtatgatattactacatagtataaatttgtggtcaatgattaacgatatgtgaacaagccatattagttattcaaaaccgttgattcaagttcccagatacacaaaaacactatccaaaaccgttgataaaatggtattgcaaagtttagatgattggttatccagttttaaagtttagggtgctagagggattttgaccgataggttaagggggtatggacttgttcctattaataatttcaaatttactattttatcacaaattaacataataataaacactgactaataaagaactcactaaatatgaatagttttgtcgtaattaaaagactaagcactagttaagaagcactatcttgtagtaacgagctaaacaatcaactcgcgggctagctcggctcgacttattaaaactatgaatccgaaccgatccgagttgagcttgatacaagcctatctgagccacgagcttcgatttcttgtccacccttacatagagcgtcatcctccatacaaacaaatcacataagtatagtcacactacatagctatataatgaattgagaaagcgacgcgtgaaaaggaaacaacgtaacgcagtgacttgaggaggcggccaagggtctcacaggcggatagtcggagaga

SEQ ID NO: 26017 - DNA, 1501 bp, Oryza sativa
  unsure (1)..(1501): unsure at all n locations
tgtaaacttttctacatttttttcagagatggggcagaataaggcctgcttcgatcagcttctgttataaaaagaaaacactgaatattcggttgtatactgcatttcttcttagtaaatgcacttttctaaagaatcttgctcgcgcctcttgcagaagacggaaggggagaggaagagaaagaaagagagaaaggatagagggggagaaaaagaaagacagagaggatgatatgtaggccccatattttttttttgcgaatgataaatgggtcctatatatatgtttttaattctactaccacctaaacgtcacagacaagtcaatactgtcatgtagatgtcacgtcagcgaaaccgtcctctggagggttgagatatccagtattgcggtttaaggattcgaaatagatttggtcacaagttaagggagtcattgtaaacatatttcaaagaataaagacaccataggtcccgggcccaacagaggcccaggacgcgagggttttatcactctccgttgccggagtccggtgagaaaaggaaagaactcgccgtcgccgaccgcgggcgaggtggccggcgtcccctcgagcggcgctctcctccacctccgcggcacatccatctttttccacgaccgcctccgccgcgccctcctattctccccggcgatggcgccgcctcttcttggttcttcagccaccctcaaccccggccactggttcctcggaggtatatacgcatatatgtctcgtctctgctcctctaccctgatctttcagttcttgtttaggaactcgagaatcgagatgaccgaggaagaagccagtgcattctgaaacaaaaaaaaacccctctaatctttggttcagttgcatatggtggctttacttgggcgccttcggttccanatatgttagtccattaaattcttgttgcaatttattggatgcttctgttatatctagtttacttgtttctaaaaccttggattactcaattccctaatcaattagtacagtttattttcccaaatataccagtttcaggttttagtttgtataaaatgtaggtgcattttattaattgatttgtggaatacttacctgttcttttgaacaagcaaatccaagattttaattcgtttatagctgcaaatcctttcgttttcaattggtactgtaaatcatacatagtttgttcgactaattcggttctaggtttgaaaagttgctctatgttaactgattttcagagtttctaccttaattaatcatttcgtggatgaatagataggttacttctttaaatcgaatcgtgaagcacaaacacgtacagcaaaatgcaaaaagttttaaatttcatcagtataaatatggcacattaattttccatcctgtattcatgtgattcattacgatttcatcaattttaatccagggctctggacacctgctaccctttgaaattacataactagcattgctgcatttctcaa

SEQ ID NO: 26018 - DNA, 1501 bp, Oryza sativa
gcattctgttcctttaaatgtttcttttaggagagttttagtagggcagaacttgactaattggcataacttttgtgcttcaattgtgcaaatccatttgacagaaaacaatgatttttttagatggaatcttcatcaaaatggtcaattctcggttcgttctatgtacttagctttaattaataatggctacattgagaggaataagtttaattggaaacttaaaatgcctcttaagattaagatttttatgtggtacctgcttaaaggtgttgtcttaacaaatgataacttggttagaaggaattggcatggtaatttgaaatgttgcttctgtatgaaaaacgagactatccaacatttatttatggaatgtcattatgcaaaatttgtttggagagcattacaattttttttctggtttaaatattccacatagtatatctcatatttttttagaattggttcgtagggattgataaaaaaaccagtaaacttattctggtaggagcttccgctatatgttgggttctatggttgagtagaaataatatggtttttgataaatcaccatctatatcttatatgcaggttcttttcagggcaacacactggctccggtcctgggcacaactacaaaagtgtgaataagatatcaagttaataaaagctgcatgtcgtaatcttaagtcaacggttatgcagttttttgccaacttcggatgaaaatttacaaatagaattcaataatgttatgatcttttcttgcattggtttttagtacttagtgtatgttcctatccttttaggcatgtgtttttatgactttttttgtcatgcgtttttatttgtatgaattggtgtaataattggttgtagctcattgagcaaagactgggattctattcaattatctaaaaaaatatatgttaaactctccacctaattctttcgttattaccccttctttttgctctcgcttacataagaatgttgatatagtaccagtatgatattactacatagtataaatttgtggtcaatgattaacgatatgtgaacaagccatattagttattcaaaaccgttgattcaagttcccagatacacaaaaacactatccaaaaccgttgataaaatggtattgcaaagtttagatgattggttatccagttttaaagtttagggtgctagagggattttgaccgataggttaagggggtatggacttgttcctattaataatttcaaatttactattttatcacaaattaacataataataaacactgactaataaagaactcactaaatatgaatagttttgtcgtaattaaaagactaagcactagttaagaagcactatcttgtagtaacgagctaaacaatcaactcgcgggctagctcggctcgacttattaaaactatgaatccgaaccgatccgagttgagcttgatacaagcctatctgagccacgagcttcgatttcttgtccaccct

SEQ ID NO: 26019 - DNA, 1501 bp, Oryza sativa
  unsure (1)..(1501): unsure at all n locations
acgatcggcatggcgctgccggaggccaacattgcgcagttcagctcatgcttcgccggtggactgaagcagctgtgacgaacagcttgttgcatttcctgcttcttactgctacgaattgttgcagagttcagaatttgttcagtttaggtgcttctgtaatgctagcggttggattgcaatcgttgatcaatcacataagcgattgcaaatttgcaattgtcaatcaatgaaaaagtcagataagctgtaaacttttctacatttttttcagagatggggcagaataaggcctgcttcgatcagcttctgttataaaaagaaaacactgaatattcggttgtatactgcatttcttcttagtaaatgcacttttctaaagaatcttgctcgcgcctcttgcagaagacggaaggggagaggaagagaaagaaagagagaaaggatagagggggagaaaaagaaagacagagaggatgatatgtaggccccatattttttttttgcgaatgataaatgggtcctatatatatgtttttaattctactaccacctaaacgtcacagacaagtcaatactgtcatgtagatgtcacgtcagcgaaaccgtcctctggagggttgagatatccagtattgcggtttaaggattcgaaatagatttggtcacaagttaagggagtcattgtaaacatatttcaaagaataaagacaccataggtcccgggcccaacagaggcccaggacgcgagggttttatcactctccgttgccggagtccggtgagaaaaggaaagaactcgccgtcgccgaccgcgggcgaggtggccggcgtcccctcgagcggcgctctcctccacctccgcggcacatccatctttttccacgaccgcctccgccgcgccctcctattctccccggcgatggcgccgcctcttcttggttcttcagccaccctcaaccccggccactggttcctcggaggtatatacgcatatatgtctcgtctctgctcctctaccctgatctttcagttcttgtttaggaactcgagaatcgagatgaccgaggaagaagccagtgcattctgaaacaaaaaaaaacccctctaatctttggttcagttgcatatggtggctttacttgggcgccttcggttccanatatgttagtccattaaattcttgttgcaatttattggatgcttctgttatatctagtttacttgtttctaaaaccttggattactcaattccctaatcaattagtacagtttattttcccaaatataccagtttcaggttttagtttgtataaaatgtaggtgcattttattaattgatttgtggaatacttacctgttcttttgaacaagcaaatccaagattttaattcgtttatagctgcaaatcctttcgttttcaattggtactgtaaatcatacatagtttgttcgactaattcggttctaggtttgaaaagttgctctatgttaactgatt

SEQ ID NO: 26020 - DNA, 1501 bp, Oryza sativa
tcattatgcaaaatttgtttggagagcattacaattttttttctggtttaaatattccacatagtatatctcatatttttttagaattggttcgtagggattgataaaaaaaccagtaaacttattctggtaggagcttccgctatatgttgggttctatggttgagtagaaataatatggtttttgataaatcaccatctatatcttatatgcaggttcttttcagggcaacacactggctccggtcctgggcacaactacaaaagtgtgaataagatatcaagttaataaaagctgcatgtcgtaatcttaagtcaacggttatgcagttttttgccaacttcggatgaaaatttacaaatagaattcaataatgttatgatcttttcttgcattggtttttagtacttagtgtatgttcctatccttttaggcatgtgtttttatgactttttttgtcatgcgtttttatttgtatgaattggtgtaataattggttgtagctcattgagcaaagactgggattctattcaattatctaaaaaaatatatgttaaactctccacctaattctttcgttattaccccttctttttgctctcgcttacataagaatgttgatatagtaccagtatgatattactacatagtataaatttgtggtcaatgattaacgatatgtgaacaagccatattagttattcaaaaccgttgattcaagttcccagatacacaaaaacactatccaaaaccgttgataaaatggtattgcaaagtttagatgattggttatccagttttaaagtttagggtgctagagggattttgaccgataggttaagggggtatggacttgttcctattaataatttcaaatttactattttatcacaaattaacataataataaacactgactaataaagaactcactaaatatgaatagttttgtcgtaattaaaagactaagcactagttaagaagcactatcttgtagtaacgagctaaacaatcaactcgcgggctagctcggctcgacttattaaaactatgaatccgaaccgatccgagttgagcttgatacaagcctatctgagccacgagcttcgatttcttgtccacccttacatagagcgtcatcctccatacaaacaaatcacataagtatagtcacactacatagctatataatgaattgagaaagcgacgcgtgaaaaggaaacaacgtaacgcagtgacttgaggaggcggccaagggtctcacaggcggatagtcggagagatggagagagacaacgacgagcacagcgcccccaaccccaaccaggttaggatcatgagcatagtaaagatacagggtgaactgatggttgaatcgaaaaaaagaaatccaaaccagccacctttgcggctggttctatgaaaatcatgcactattaagtaaggccatatttgtttcagcataagattattgtgatctagattactgtaaactggatt

SEQ ID NO: 26021 - DNA, 1501 bp, Oryza sativa
aggctcagctcgcagggaattaaccatgcgcatgcacagatcgatgaaaattaagggtggtgtatccaaactccaaagcaagctccgcgggtcttctttaacattttcgagttacggcgacgatgtatatttggttggcagagaaacgaaatagtatcgtgtctcttgtcactgagaatcatatataatactatctccgtccgaaaataagtgcagttttacactattcattttcaacgtttgaccgttcgtcttatttgaaaattttttatgattattatttttattgttattagatgataaaacatgaatagtactttatgtgtgactaattttttaaaaaaaatttataaatttttcaaataagacggacggtcaaacgttggacacggatttcgacgactgcacttattttaggacggaggcaagtatgtagagagacagaggaatttagaaaacgagtagacctgatcacgtatattactttgccacggtgagcagcggccgggcgcctaattaacagagatcagccaacaggaagcggctcctcccatgtttaaattaaaaataaataaaaatgtagcattctttgtttaccttttttatgagggcccttttgatttaccggttccacatggagtttgattgattccacaagacattatactttgaatctaattaaatatgcaaatggagctttgaaccaatcgcaatatatcaaacggtgtataccttacttattttctcgatccgattaacatccataagagggaatattctgaggttttagatttgtcttgttgatagattggacactctatcaaagtttgaaattagattgtttggacttatttgaattttcttatgaatatttttatagtttctccacaacaaataaatctcaaccgttctttgtctggagccatcgagatcgaacaatacagatatctctttctttattccatcgatgtcataattatagagaaacataaaatccccccccccctcttttttacattgctttagcacatttgtaaaatgcacaatgaataattgtttgatgtgagacatgttatttcatagtatttatttatggaagaaatcagaaatccttgcaaaatgatagactatgcatatttatcataaaaattattgacacgtgcctttgaaaaattatttgttgagtactccactagctaattaataggaaattgccaagttagaaactttgaattagtaatcagttatctagtaagaaatacttctctgcatagacctgtagaattacgcgagggcatgcatagacctacctagaagcctagaagtagaacaggtccaagtcaaagcatcacacggttgtacgtagcttgatctctcgtttcctacgcgcgtctttatgaaagatcgagctaagctctagctaattggacttatgaattatttagaatcgccgactcatatatatttagctagctataggttccgaagaaacttacccaga

SEQ ID NO: 26022 - DNA, 272 bp, Oryza sativa
ctttctttcagatgctagattaatcagttacaagtaaactaactaactttacttggccttgtttatgcagagggaggccacctgttgctttccaatttttctgctgggtcacgcatgaatagccaagacaataatcttaaaaatttctttcagacaaatgggcatgtggtttttcaaagagtggagaacaactgtagcctaagatattttacggaaaatgagatacggcaaatcacccgtggttatagcattttactgggaaaaaggttcat

SEQ ID NO: 26023 - DNA, 196 bp, Oryza sativa
cgccactggacgccggcgaggacgcgtctccggtgatttccccgcgaaacggaggcgaagccgggaaagaggaggcggctgcgacgccgggagaggtggcggcgcggccggagggtgcacgggcgaggcgggaggtgcggctggaggtggccggcaaggaggaatgagaagggcgacggcgggagtgcgcctccga

SEQ ID NO: 26024 - DNA, 1501 bp, Oryza sativa
catcataacaaaatttcaaacaccactaagtaaaagtgtctgcgcatatacgcgggctaccttcctacttggtaaataaactgtagacctgtagttgatatcgatgatggctaatgaaagtaacgtcgatgggtttcaatcgccgcgctgattaaagatgaagagcgatcggagcctggtcgattggagtgggccgattcgtcgccaataaatcaggatgtactgactggagcggccagtgcgttgctggcgaattagtcgatctcatgcgccgcgtttcctatcagctttgcgtccgcatctgttctctaccgtataaagaagttattaggatcatttccatctgtgttctgttattaatactccattcgtctcaaattatagtcacccctttttaaaaaaaaatcaaactcgatagttttaactaataatcgtactaactatatctataataagtatgcatattatgcatgttatatctctaaattcatatttaaaatacttttatgcgatgctaatttcatatttattgggatcatagaaagaaataaaatactagtcaaagtatattattgaatactgtgtaaaaaaattataggtattataatttgaggtagagggagtaggatgtaagattggtcattaatttaaagaaaaagagttttggatttgtcaatattaggtggaaacactcacggtggtggtaagatgggctggccgcggacagcgaacagaaaagcgaacagaaaacgacgaaaaggcgcgccacagaaaaaaaacgcattttctgttttcttcttttccttccacgccatgggaaaagatcgacgtttcatttttattgttttttctgatcagatatttgttctaattgtattattatttttttgaaaaagtttcagtgatatcagtattttttttaagaattacacagtataatacagacacacaacacatgcacactcacccctataaacgtactcatgcaaaccctacccctatgagcaacttcgaagacagagccggcaaatccatcttggagtattttttttaatctttagtaaaatttatgcactaaattttcaaattatagatataattctttgtaaatttagatatacaaaatttacatatataaagtttctctctatatagaaagtgtatacatagaaattttcctagtaaattgttcatttaaaaaaaatctgtcaacattttattatttctagtaaaatttacgcactaaactttctaactacagatggaatttctacataaagtttacacaaagtatatatatggcatgcgtgtgggatacatgtagtcaattttgtctactattataatctgacggttacatccatgtcaataacaaagggaatactaatattaaacgcatggtgtgaaattagtctgtgtagtacgataaattgcaagggtttcgacagaaattagcaccactgaattccattccacaacatcacgcgtattttgttttgca

SEQ ID NO: 26025 - DNA, 204 bp, Oryza sativa
tgacaattcaggggcccgaacctgtataaaaatccctgtctccatctcttttaccttactctcgcgtatatcctaataccaacgatccccatactatgcaaataccgaaatcgcgacatcaaacgtcgatagaggtagcgaacgagacttaaaaagatccagagatgaggatttagataggtttaagccctctcgatgagaggt

SEQ ID NO: 26026 - DNA, 1501 bp, Oryza sativa
gataaaatttttgttgagtagtatgttggtggacttgacatccccatgtaagatgatagggtggtcgactgatgagtgtagatatgcaagtgcttcagcagactcagcagcaacttttaggcggatctccagtgttctgatggatggatcattttggatgtggattagattgtacaaagtcttattttggacaaattcgtagacaagaattggaacatcaaactgaagacagcaaccaagaagcttgacgatgttttcatggttgactcgagaaagtatgagcagctcatctgtaaattctgcccaactatcctcatcaaatcccttgcacttcttgattgcaacagggttgtctggatgaagattaatacatcccctataaacagtcccctgacctccttgaccgattactaacatgttgtcgaacccatttgtcgccgactcaatttgatctcggtcatacaacataaatggaatgttgttatctctgctcatcatatttcttaacaattggcctccacgtagatgaaaatactcttccctctgtctcatgagttcttccctctgtctcatgaggtcttttcttatgattcgttgtttatatctgaaccattctatcccaagtaaaatagttagagtaaccaaaagggacgcacaaattcctgtcaagataggtaaacattttaaacgcaaataaatcgacgaggaattaggcgataagtagtgacaacaaaagataaacatatggatccatgttagtataaatgcaagaacttcataatttattcaaacatatatatctaaacaatgcgagattaattgaaaaagtttttgtgtaccgatagctagccctccgtcgcatggtccggtgtgtgcattgcctcgtgtaccgaaggggcaagtacagtcggagcctccatctttatttctgcattttccatagcaaatatacttatttggttccttgcactcatcaatatctgcaaaacaaaatacgcgtgatgttgtggaatggaattcagtggtgctaatttctgtcgaaacccttgcaatttatcgtactacacagactaatttcacaccatgcgtttaatattagtattccctttgttattgacatggatgtaaccgtcagattataatagtagacaaaattgactacatgtatcccacacgcatgccatatatatactttgtgtaaactttatgtagaaattccatctgtagttagaaagtttagtgcgtaaattttactagaaataataaaatgttgacagattttttttaaatgaacaatttactaggaaaatttctatgtatacactttctatatagagagaaactttatatatgtaaattttgtatatctaaatttacaaagaattatatctataatttgaaaatttagtgcataaattttactaaagattaaaaaaaatactccaagatggatttgccggctctgtcttcgaagttgctcataggggtagggtttgcatga

SEQ ID NO: 26027 - DNA, 384 bp, Oryza sativa
tacgcaactggaaaatcatgcataataggcagaagcagaattcaaaagtgatcataattgataaacgcgcttctcttgaagaaaaatgataatagtgctgggctgggctttgatgcacctccattctcttccggaaaaagtacaccgaaggtccctaaacttgtcatcgagttataaaaagttaaaaacatcctcaaactgcaaaaccagatatccgacgtcccttaattaattaaaaccgatcacaataggtcctttgatggttttgatcccggttttgtcctacgtagcggctgagtcagcgtgggacccacgtggccccatatgtcagggtccacgtcatctctctctctctctctcttctccttgctcactcgctgcagg

SEQ ID NO: 26028 - DNA, 1501 bp, Oryza sativa
acattttttataaaaagagtgctgactggactgccacgcgtacgccatgtagaccaaaaccaccacggatttagtcgatgggagtaatttgtccggtttgcatagttggggtgaagaatacccggttttgtggttcagggggtaattcggtcgaccacaatagattggggggaggggtaattcgtactttttccaaaccaaaaacctaaaaatttttagcggaaataaaagttaccttcaaattgatggaggtcttgacgtagtcctgtggccgccggtcgaaccgctcacaagcctccagtcggactgccaaaccttcgccggtcagaccgcccgaacactgccggtcagaccatgcgcacacctgcagttagaccgtcgggacccagaaacaccggtagatgacaaactcgaagatgtagattgaaactttttgactttattgcatcaactagtgtttataaagtgcaacaacagcactcctcaccaaaatctcgaactaaactcgaaaccctaattttctctcaactcaagcctctctaaaaccgataccgggagacctcaccctccctctctatttctatatgaggtaggctgtgcaaagcccatggatctaatacaacttaggactcctaacccacgtaggaaaccctctctctctttccttatctcaatcaatcttaccgaatttagactcctttccgaattcgactcctcttttcatacatacataatccttcttgtataccatatgaatttcttcatcaccacgtgcattgttctctagcctttagtatcccgcaggatctcttgatccctggacatcaacttctcccaagtttactccgatcattcaccggcaacactctctgatccctcaagcaacacctgcacatgcaacaaccaagaaaccatattccgagcacaagttcgtcccaacttgacttacattagtataacaatagtatccgtacgcatagaaaccatctagaagccaaaaccccaaaggaaacatccaaatctaacaagacaacccgaaaacaataacaatcaggatcatgccggtcagaccatcaggtaagctggtttgaccgccgcaacacctgtgctctgactggcggcacatgaccgatctgaccgccagggtcaaccgaaaacacccacttcacaaattcaaccatctattaaatctccaaaataacaatagcaaaccaccaatattttcatcacaaaatctaaatcaactccttgattttacacgatatacacttacgcgggtttaaaaaaaggacgaaaaataattgtgcatggatagagtcgaacaacgtacgaaaaacttagcgagccctccaagggcataaccattatcagatcgttagatcaatatacatccggcgtatgcaatgttcaaataggagtaggtacctctcatcgagagggcttaaacctatctaaatcctcatctctggatctttttaagtctcgttcgctacctctatcg

SEQ ID NO: 26029 - DNA, 403 bp, Oryza sativa
ttaaattgtttattagaaagttgaatgatgaataataatgtatagcgctaaagtttagagataatttttagatgttgcgaaagtcttgcttttgtattgcttagagtcataccttaaattatttccattgcatctgccatgtgcctttaacttataaggtgcagtataagaatattttcctagaaaatattttgatttctaaatcatagattttgtaatctttaaaaaaacattttttaggaagtccatttggatacacattcacatgtacacactatatactcatgatttgaattgctctgttttctaacaaagcaacgctaaattccgtttcttaataccgctggtattctgttgcagatattgatgagtgcaaggaaccatataagtacccctgccatgg

SEQ ID NO: 26030 - DNA, 226 bp, Oryza sativa
taggtatgtggtatccataaccctgacaatctctttcattatgaccgatttccagaatcgacaagattgtccctttatatggaaagcaacgaatataaagacaaatgatataaaactttttaatgttactggccagtagatccacgcgtttgtgcgacaatgacctccctcgctactaaatcatctcattcgccgaaaaacctaactcagcctcgccaaagaacga

SEQ ID NO: 26031 - DNA, 435 bp, Oryza sativa
ctaagtctaattacaaataaagtaatcttatatatatattcaaataatattacatgctaagactaaaatgtcatgtatgctaagtgtttcgtgcgtatatgctaagtctaattaagactacaatagtcaattgctacttgtcgcaccacttccgtagtcaataattacatactaagtctaattacaaataaagcaatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtatatagtcaaatgcgaagt

SEQ ID NO: 26032 - DNA, 271 bp, Oryza sativa
tgaacgagaacgagaacgatcgatcgaacgagagcgataacgagaacgatcgacggaagacaagtgagaacgagggaacgaacgtgaacgagctagggaacgtgaacgagcgaacgaacgaggacgaacgttaacgtgaaatgcaatatatatatatatatatatatgtatatatatatatatgtatatatatatatatgtatatatatatatatatatatgtatatgttacttcgcatttgactatatacatctttttgtatcttgcaga

SEQ ID NO: 26033 - DNA, 1501 bp, Oryza sativa
cgatctcggccgttcgttcccgtgaaccgctgccgtgcgcccggtccaccgcaaaccctagccgctgacgcaataaaccccttttccttttcaaaaataattcattattgcgtcataattcaattaaaatccatataagtgttttaatccgatttaatctttaaaaattcattactaattcatcttagctcggatttagttagttcaagtctctaaatttttctaaaattaagatctacctgttaaaaatatccacatgtactgttcatgcttgtttatgtgctgttttggtgattttgctcttttctgtttagattccgacgtttccggagagtccgtttttgcaggagaagaatttgaagagttccaaggccagcaaggcaagtcacacagatcccaaacaaccctttgagcatgttgatcccgtttaaagctattgtttctattcaaatattgcatttattttcgaatgtcattgggtggaattaacctattgtttgttatagccctttttgatcttgattactttattccttgataccttgggttattataacttgactagttgggctatatatattggttcagctagatattagatatgattgcttagccatgcttagaaacattagcgcactattgggataacttatgactcactattatttaatgatggcttaatgatcgttcacgatggtcaatcgtgattaggttaattaattactggccaactaaaacttgataatggtgggttgtgagcacatggttttgagagtcgtgttcacgagtttcggttgtgaaacattaaccgtgccaaccacaagccagcatgggtaacggctttaccttttatatagcatggttcattgcggagcaccagactgagaagtggcggagataagcccacgggggtcgctggggagtccatgccttgtttataagggggtgattatcatccaggaaaggtgccctgtggtggattgtgttgtgcgaggggtattgtcacagctcctttccgaggtaccgtggtggtattgaggcacatggtgacatgttgtgaggctgtgtcttgtgggtacagtggtacacctctggccagagtaaaactattcaaatagccgtacccgcggttatgggcgggtctaacaatgtctttcgtgattagtctcacacttctcatcataataaaagatgctataactggtaataatttgattagctcctggtttggaatggtatattcctggtttggagatagaactgtgcagccaggatggttgttcagaatggttgggcctatacaacagggtatgttgtatagcgttggattaatattgtttaattattacttaactgttttataaaattctgaaatgtttattaaatgctgtttatgcaaatgaaaccctactatgccatcctttgttatcctgtgcacttgcatatttgctgcgtgacttgctgagtatgtcatatactcaccttgcaatcattcatcaga

SEQ ID NO: 26034 - DNA, 1339 bp, Oryza sativa
tagatatgcatttttactacgttcaatgcccttgttctggtttaagaatgcttattagatctttattgtacttctagcttcgtcacagagtccacatactgacactaagctatgtgactcctcttctgttgggatttatgcctatcttttagtgatgcatgatgtttccttaacatgaatatcagtgctatccaacttagttctggagaaagtcattgcagagctggagtcgcatagttttcgctgctttaaagttgaggttggtggacagggtcttcaagtttgccaaggaggctgctcctattttaatggagatgttgtataatactttgtagttatggattagtcaacggtttgagatttgttcttcacactgtttcttctagattaatccattagttatgtccttattttagccccgggcagttcctgtatcaaataatcctaccgtcgcatgattgcccttggggtttgtatcaaatacaacttttttgctgatgcaactgttgtacgagggaaagtgctatggtagatgtgactactacctccaaatttatctattttattcacttatgaagcaagaggcaacccatacaatatatcacctcgagttcacaaataccaatatatctaatactctcacatcctttttgaaatttgtgtggaggttgcctcttgatttaggggtggctcatcatctctctcttcacttttctcctccacctcatcactcaatctaatgtggcacttgtaggggcaacatatgaagcattatagtacttgccctgagtaaaccatttcactgctgcgtttggtaatctgggagaggattctaatacctctatcctctcgcctaactttttctctcaaattcaatagaggtgattatgaaaaattctaaaacaatttggcaatatagtatggtagcatctacctcttcatcaaaaattatattcaaattttatctatatattgagaaacaaagaagacatccaggagtgaatagtaccaataccattcatatgctgtttttttttatttctcaatgtgtgagttaagttttgacttgattgtttaaaatagtttattttatgtatatggtatgaatgttgttttgtttgagaatttttggtaactatttatatggtgttttttttctcttgaaaaaaataatgggacatccccgcagaaatttaaaacacttttccattgtaccaaacacagacggacagacctttctatggctacaattggcatcagcggcatcaaatataggtttacttaaacatcgtgggaacgccggaagattaggggcgccacgtcagcgatttttgcaaaa

SEQ ID NO: 26035 - DNA, 1501 bp, Oryza sativa
ggcggcagagccaacggacgatggaggtggcctcacaagcgcggcggcacaagaggaggtggcccaggagcaacgtggcgaggggtagcggcgaggggtggagcgggtggtggtggatggcggtgaggaggcagctggcggcggggacgttcgccgcggagacgacgacgatgtccgctgcctcgacgatgtccgccgccttgacgacgacgacgggcgccgccgtcgtctccttccaaatccggccgctcctttcccgatccggtgaaatcaatagaggggaaatgatcttcgggatctcctctaccttttctcttttggaatcatcatctaaatcgctttggaaattcgtggattcgaggtcgaatcggatcggtctctttcctccgaaccccaatgtttccttcgcgtcgccggtcgccgtgggccttcgccgtcgccctccaacccctataaaaggatccccaagcccaccgctacccgtcgccaccctcgccttcgtctctcgccgtcggaagagccctagcgtcgtgtgacctagcgccgccatcgtcgccgccgctccagccgtgcgccgccgccgttccggtcgtcgtcgtcgctcgggaagatcgccatcatggtcaccaagtcgccgccgtcctcgtctgccccttcgccgtcgctgtcaaccgccggagcaccgtcgccgccgtcggcccgatcttctccgccgccttttcctcgacgccgctgccgtccgttcatcttccgccgccgttttggtcatcggtgagttcgccgcgtcgctctctacgtgatggtgccctccgttcgcgtcctcgcgccgtcgttcgccggcgagtttgcgcgcccgagccgccgccggagatgacgtcaccactgacgtcatcagggtccgtctgccgtgagccgccgtagacccgatcgatctcggccgtccgttttggatggatcgatctcggccgttcgttcccgtgaaccgctgccgtgcgcccggtccaccgcaaaccctagccgctgacgcaataaaccccttttccttttcaaaaataattcattattgcgtcataattcaattaaaatccatataagtgttttaatccgatttaatctttaaaaattcattactaattcatcttagctcggatttagttagttcaagtctctaaatttttctaaaattaagatctacctgttaaaaatatccacatgtactgttcatgcttgtttatgtgctgttttggtgattttgctcttttctgtttagattccgacgtttccggagagtccgtttttgcaggagaagaatttgaagagttccaaggccagcaaggcaagtcacacagatcccaaacaaccctttgagcatgttgatcccgtttaaagctattgtttctattcaaatattgcatttattttcgaatgtcattgggtggaattaacctattgtttgttatagccctttttgatcttgattactttattccttgataccttg

SEQ ID NO: 26036 - DNA, 410 bp, Oryza sativa
tccccttcgccatgttcgttctgtttcagagttcgtttttgttgcaatgactagccagatagatgtcttacccttaccaaatacccaaacggcctgaaaatttttgactgtatgaatcctcggtgttcccaagaataaaagtgaaaatattttacaggtgaaaaaaaaactgtattcccaagaaaatcttccttcaagaactgttggtaaaaggaaatgtgcgaatgaaaattcatttgcagctggaaaatttctgttgtctcagcaatagtttcaagaaaaatctaggtcgctgctcggtgaacccgtcgatttgttcagcttaaggaaagaaaacgataagtgacagaacatggcttcaaatttcaagtcttgcaatatctgacagttctacttctaacttgtgcaga

SEQ ID NO: 26037 - DNA, 1501 bp, Oryza sativa
gcacaggataacaaaggatggcatagtagggtttcatttgcataaacagcatttaataaacatttcagaattttataaaacagttaagtaataattaaacaatattaatccaacgctatacaacataccctgttgtataggcccaaccattctgaacaaccatcctggctgcacagttctatctccaaaccaggaatataccattccaaaccaggagctaatcaaattattaccagttatagcatcttttattatgatgagaagtgtgagactaatcacgaaagacattgttagacccgcccataaccgcgggtacggctatttgaatagttttactctggccagaggtgtaccactgtacccacaagacacagcctcacaacatgtcaccatgtgcctcaataccaccacggtacctcggaaaggagctgtgacaatacccctcgcacaacacaatccaccacagggcacctttcctggatgataatcacccccttataaacaaggcatggactccccagcgacccccgtgggcttatctccgccacttctcagtctggtgctccgcaatgaaccatgctatataaaaggtaaagccgttacccatgctggcttgtggttggcacggttaatgtttcacaaccgaaactcgtgaacacgactctcaaaaccatgtgctcacaacccaccattatcaagttttagttggccagtaattaattaacctaatcacgattgaccatcgtgaacgatcattaagccatcattaaataatagtgagtcataagttatcccaatagtgcgctaatgtttctaagcatggctaagcaatcatatctaatatctagctgaaccaatatatatagcccaactagtcaagttataataacccaaggtatcaaggaataaagtaatcaagatcaaaaagggctataacaaacaataggttaattccacccaatgacattcgaaaataaatgcaatatttgaatagaaacaatagctttaaacgggatcaacatgctcaaagggttgtttgggatctgtgtgacttgccttgctggccttggaactcttcaaattcttctcctgcaaaaacggactctccggaaacgtcggaatctaaacagaaaagagcaaaatcaccaaaacagcacataaacaagcatgaacagtacatgtggatatttttaacaggtagatcttaattttagaaaaatttagagacttgaactaactaaatccgagctaagatgaattagtaatgaatttttaaagattaaatcggattaaaacacttatatggattttaattgaattatgacgcaataatgaattatttttgaaaaggaaaaggggtttattgcgtcagcggctagggtttgcggtggaccgggcgcacggcagcggttcacgggaacgaacggccgagatcgatccatccaaaacggacggccgagatcgatcgggtctacggcggctcacggcagacggaccctga

SEQ ID NO: 26038 - DNA, 623 bp, Oryza sativa
ccctgttccaataaatatttttaaagaaacaaaaagtcaaagttgtattttggagaccgtgtcgctgtccaaaacgacttctttcatgagtacggagagagtatagagtaaattatatgtactgtactgcacttaagggtgcaaataggatgggtcgtggctatccgcgctgcgtgtcggttccaccggtcatttttggatttgtcctaagtcaaacgcacgttgctcttttaaatttgatcaagttcgtaaaaaaaaacataatgtctatgacacaaaattagttttattaaatggaccattaacatatttccgtagtatactaatttgttttggtatacaccggttttaaatgcgtcggtcaagcacaaggaaatttgacttggaacaaacccaaggtgatagcacattagttgttgctcgccagaccacactcctgcccgcgtatatatcaaataatattggggtttgggtaaacccatgaacctgcccaacaatttctgtactatctcttgagctttaagcctccaccacatagcataaactaaagctatatatgaatgtgagaaattaacttttagattaactattcataaagagagaaatcagaagatgaacagcca

SEQ ID NO: 26039 - DNA, 1501 bp, Oryza sativa
agtggcctgaccctgacgcgtgaattcatatcaatatttattacaccgaactcggttctttttcttccagcgtgggtaactttttacagcttgtatttattctgaaagtaaattgcttggaagcaaacatatgcataagagtctttttttacataataatgcagcatttgatggacatttaacatgaaactttgtaaatctagacacttgtgcagctgaaatagcatatatattgattggctctttcatatccataaagaatgaatgatttgttcgcttcagctatttgcatattatttgtttcaatcttatactactaattatagtttgaaacaataaaccatgctatagatgcatattcattcagaatttttcaacatcaattatttgccccatagaccatacagatagtcaccatcaacaattttctccacataaaaaagaaaccttaactatctgtcaccaaaagattgtaattcaggatttgcattctgttcatcacacagagtttatttagcgcaaaatgtttttccctacatgtcaatcccagaatataatcgttttcagattatcgcagtgtgaactgtttgatgtaacagattgtaggcaaccaaccaaccagtccaggggccccaggagtccaggcttgctttttgaaaacccttacctactccacaagcaattatgagaattgagatgttggaaaaactctgtgaatagtgtttgaacttttcgaaaaggttaaaaattgatgttatcatttatatactgctattcttcacatttgcattatttcctcaaagttttatttctctgagttcctttttggtatcccttatttctgcctagaaattaaattgacattcttcttctgtccactatgtattatggatgctttctggtgcatatactaaacagaaacacaataatggttttttttactaatcaagggtgataagaaggtactatatatattcaagaacatgcattttattatatcacagaagaaggggtgatccttgatgatataggcccttggataggctggtgactgaaggaacagctgttaattgtgtttcatgatataggcccctggatatttcagtttctggctctgtagaggggtttaaatttcataaatagattcaactgatgtataatgtgatctcaatcttttaagtactgacacagatattcaaaagctgaagcacaaaaacacgaaagtgtagccttcattatgggtggtgtggctgatacttgccaatagcatatatagcgataatcatccgtgtagtttgcattgtgcaggccataaaacccgagggttcaaagtgagtcagaagaactgtatccaggggattaaaagcagcggcctttgggttgttgcttggagtaccaaacttcggtaatatcgaattccaatttaataagcttatagcatacattagcattgatcaattcgattcgacatgagagcaggaagggttcgtcagatcactaa

SEQ ID NO: 26040 - DNA, 610 bp, Oryza sativa
gaaataacattaattattagaaatcaacaattataactttgcaaatgtagactgcatcatcgtaaacgtctataatgtttgaagaaagtttactgcattatattctttacacatctatctatatattatatactgaaaatccattaacatctgctatatactaaaagttcattgaactccctacaaacgctctcaaactgtcacatggcgttttacaaatgttcttaagacgccatgacgatctaataaattagaaaaaaaatcctaaaagttttgataaaaaaagaaaaaaaaccattgatattcctttaaataggtggacccaataatttaaccattagatctttaaaaaaatccagtacccccaaccccgccatatgtgggcacatatgtaagtacgtagtccttcaaccctctaactctcctcggagatcccactctcctgtcctattttcgagcccaacttttcctattttctaacaaacacataatgtataaataataataatcggatagttaatgatcatgactctcaaagttacatgcatttttctcaatttatttgcattttgttgtgttatttacaattaaatacataattcaagatcca

SEQ ID NO: 26041 - DNA, 159 bp, Oryza sativa
atcgttcactaaaaaccggcacatatgtaataggtgcaagttcttaattagaaccagcacctattatctttgtgacgtgtccgggtcgagacaataggtgccggttcatagtaataggtgccggttctcattacgaaccggccctattacattttaaca

SEQ ID NO: 26042 - DNA, 595 bp, Oryza sativa
gtgatcttaagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcagttttttttactcatgtaga

SEQ ID NO: 26043 - DNA, 1206 bp, Oryza sativa
ttccccgtacaaacatatgtttacgtttccaactactaagtttttttttttcaattctttgctcaactgttttctaatcattgttactaagttttctaaaaagcataggaattccaagttttctgatggaaaattccctattggcaaccaaaaatgttagaatagttcctggcattcttgtgcttgatcaaagcaaaataattcacttttgtaaaaattaatctttaggccagggagcttttcaaaagctgataataacaacttcatattcttcgccttctctaagtcatgctcaagaaaaataagagtatcgtttgcatattgtaaaatggatagaccatcgtccaccaaatgtggaacgaccccactaattaatatagctagcatatcaacaactatattaaaaaggactggggacattggatctccttgctttagacccttatatgtttaaaaattagagcccacttggtcatttacttttatcgcaacatgtccaccttagataaaagaagctatccattcataccatttatgtgaaaaacctttcatcctcaatgtttgttgtacaaatgaccattttattttatcatacgctttctcaaaatcaatcttaaaaatcacaccactcttcttttttcgatgcatttcatgtatgtaatataacaagtccttccatgatatttctcccaggtataaaagttgtttgagttggactaaatacgttttgagcaacctcagtaattttatttgtagcaactttggtataaaatttaaaactgacattaagtaaactggccatatattatcaagttaaaataaatagataattccacacgtactatattgactttataatctcgtccttgtaataatgaaaactgtggcactttcaaatgttctaggaaatgcaaacagtacaataaactagtaaaaataggcatgtatacatctagagggacagctgaatgttttccaaaagaggattttgttggagatctagctgaaatccaccaaagtcaatagaagtcaagtgcggtgttatctaatatattgctgttaatgatgatatattatattactgatgatgaaaagtagatcttccacttactgatatattatcaccatttgtctaatctgaaacgaccaatagattgctggcttgatttgtccgctcatctttttaaactgtttgtcggaaaaaga

SEQ ID NO: 26044 - DNA, 659 bp, Oryza sativa
ccatcggtaagggcgattttatattgtgcggggggccgcctgcaaatgggcggcgagggggggcatgaaattttgcaggcggccccccttgccgccctccgctagggcgattttgtactgtggggggggcggcctgcaaatgggcggcgagggggcatggaattttgcagggggcccccttgccgccctgggggagggcgatttttgcctctccccctataaagcccagtccctcctctgtgaaatttcattatattcactaaaaatccaaaaaaaacgaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttaaggcgtagtacagaaatgcgaggttaacgcagttattgttttcatcaggcacaa

SEQ ID NO: 26045 - DNA, 1501 bp, Oryza sativa
ttttcaaatataataatactataaattgtagttaatgtaattgcagtttaacttgaatgcaatcataatgtaaataggatatagttacgttgtgacttgaaaggatatgccatggcataatggtggaggcacatgcctgggatgcccacatatcgtggtttgaaattagaccacgtagggtttattaggtttatgtttcgctgcacacaaatctcaaagctaatcctgtgccaaaatatccaaagttttctcccttgtatagcaaatcccttaattgaataggctagatcagtcgatctaatgcaaatatttccaagataaccgtctcaaatgggcagcttgccatccatgatcgatgttatttcctcgttttgtctttgtgctgtagtagagtgacaaataacgaaaccaatacattcccttcaaaatttaaatgacgtccatagaaataatatgcgtccggccgaggcaaacgttcgtgttttatctctcgacttaacaaattataacttgattactatacgatgacggaaccaaaaattatcaaagtctaaggctgtgttcgataccaggagttctcaactccccctctcgttttccgcgcgcaggcttttcaaattactaaacggtatgcttttaaaaatatatatatgaaaattacttaaaaaatcatattaatctatttttataaaaaaattagataatacttaattaatcacgtactatggaccgctccgttttccgtgctcactttggaactggctagaacgaatgcagccttaggcagccctaggcttgcctccggcgctagacgtatatgcaactcttgcttagtcatatattaaagcataattatgtctattataactgggtatacattgttactattttgcagtttactaaattaagatggttatggctatcgtgttacatataaaatattaatacaatctttatatggaaactataccgttatctgcaacgtaacagtccgtaaggtatgtggggttaattatatatttatcacatcctgctggtgtcttattaatatatctcacgaaagtactcacctttctgcaatccatgcatctttttccgacaaacagtttaaaaagatgagcggacaaatcaagccagcaatctattggtcgtttcagattagacaaatggtgataatatatcagtaagtggaagatctacttttcatcatcagtaatataatatatcatcattaacagcaatatattagataacaccgcacttgacttctattgactttggtggatttcagctagatctccaacaaaatcctcttttggaaaacattcagctgtccctctagatgtatacatgcctatttttactagtttattgtactgtttgcatttcctagaacatttgaaagtgccacagttttcattattacaaggacgagattataaagtcaatatagtacgtgtggaattatctatttattttaacttgataatatatggccagt

SEQ ID NO: 26046 - DNA, 1312 bp, Oryza sativa
aatagtaagcctatgagtctggcattacatctgaataattagccaaggcatggcagtgcatagcagtacacaaagcttgcttcaaagcttgtcagattcccatggtggttgaatgagaatagatccaggtgtcttggccttcttgggtggaggaggaccaccaatttttgtcttctttgctggttcttgagctgagactgacacacaagccttcccagatgtaacctgaattgaagctgatgcagaacccttggagtatggcacaattgcttggaggttgactgtggccgaaccacctgcctgtgttgccaactttgccttagcattcatgctgacaatattggattgttgcccctgaaacaacacagcaaaataaagtggaaatgcttaagttaggaaatggatatgcaaatgaaattaagttgtaatgaaaatgagctaaccttctgcttagtagcacttgtggtgtttgttaggctgacagcactagtggtagcaccagctaacctcttccttttttttgctctgcacaaaactctgtggagtgtttgaaaggaccaagttgttatcacaacagtactcccaggattgcttctaagcaactcttgctgatagttgtacaatttttgatattgcccttttctggcatccatagccttcagcatcacaagtttcttggctctcttcaacttggaaaatgaagcatcagcaaacatttcctcctgaactgttgctttcatatgggccaagttccaggaagggttggacagtatgaacttctcatacttctcagctattcttcttgaggtcaccagcttattatctcttctagggggacatgcatgcaaattgtctaaggtagcaatctaccagctatcagaccttgtggtcttggacaaaagacacacccatgggcagcttggccagtcacatttagccctaacccttctaggatcactcttgatgaagttgattaccttcctctcacttagggcataagcagtcactgccttcctgaacaacttcttagagctaaatttcattccaagttcaaacacaggcacaccttgcttcttcttgtaccttggaaacttgctacttctagtagtcacctccccatcactttcaagctcatctattgacctttttgagtcactctcttcatatggtgtttcattgccactttttccttgatcagcatgtacatttgggttgctctgtgacccctctaaaccagcaccatcaatccctaaaatgaaaccagtcttgatcttcttcttcaccttcttgtactccttatgtatgtttgcag

SEQ ID NO: 26047 - DNA, 1501 bp, Oryza sativa
agcgtgaggattatatctccaatttggacttgttccggatacattccacatggattcatagtcatgagtctatcttctatgctcaaagactggaccaattattattccccgtaaaggttatcaaccgaatacttgcgccagtcgggattcaattgttacatctattttggagtatcccataagggataaccactcagatcagaagctattcatatgagctacgcttggtctatattacccggaagatttattactcgggagcatgttatatgcgtcatcctttaaagggtgtcgaaggcatatgttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttgccaagcagtcggtatatcacttggatcatattattcggggattcacaccgcatatgctatatattggtatcaagtcacttggttgactataattatcaaaaaccactcggttaattggatgacttattccttgactatatgtttggtttgttcaattaaccacatagtcgggggttacacctattaggtgcatctagtcgatgcatctgactttattttttcagccctccacagtcttctgacttggaaaaagtactcgggagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatatatgaaatatgtaacagatcatgacttgggtattacgtttccctgtatattatggaacagcctaaagtcctggtttgataagattgtaaagtagatttaggaaaccgataccgtattggttaaggtttctatcttgtaaccctgccccccaacctatataaggagggcagggagcccctctaggggcatga

SEQ ID NO: 26048 - DNA, 1501 bp, Oryza sativa
agcttctgagaatctgtagttacagattctaaaaaaatgaactaagaagccagaagctggagaagctgggtttcagagcttttccagattctcagaagctggttaccaaacagttacttctcagaatctaaagctcccccaactaggccctttgtttggtccttgtccatcctactaaatgggccttcatcgtatatatatggtccaggctagggaaataagtttagtttagttccctcatcttgacaccaagtttaaaattcgtcaccgcatcgcaatatcaggtatagcccgtcttcaaactcataaaaccgtgtcaactttcgtccaactcctaaagcagtatgtctctcggtttcatctaacatagagctttgactcccgtcagctgtgttgagtcggtgtgggacccatgcggaccccacatgttagcaacaactctttcttcatccactctcccctatctcccctctcttctcatcatcagcaggtcaggaggtaggccgcaaacagtgtggatagaggtagcgatcgagaaggtgaagggtggcccgacacgacgagagagctctgtgtgggtctcacctagtcagtgttagccatgagatccaccaacttcgtgtggccaatggggagaggggcaggcgtcggcgagtagaacggcggcctgacacgacaagagagctttgtgtcggcctcgcccaattgacgtcagtcgcaagctcctccaactctgtgcaattaatggggagaagggcagccgctggtgggcctcctcgcctcccaacggcgatagccggccaaccaccaaatctaagcgttaggcggcaacgccaatgtgaagaagtcgaccaaaggtgacccgactgctcgcgaggctatgatggcacgtcgtgaccttcggcggtgacagcctcggcgggatccccatcccccctcctcctcctcctccactgatgctggcgccctccatccgcgcctgcacgatcatcccgttcaactacacctcccacccactctgtctcatccctagccactgagacaaggggcaaagaaagggtaaagagaaagagagagagagagagagagagagaatgagaggatgtgtcactaatatgtgggatccaccaatttttattttatattttgtactgaattgttctgacatatggattctatgcagattaagctgccacgtcagccgaaactgggcactataatgtcctatgatcttaggtacatcgagtttacaagtccggaacatgctatactatgtttttttacgctgatacggagtactttgtaagtttgtattgttgtttagggatgaatttcaatctccgagtcaagatgagagacctaaagcggacttattgcccagcgttgggtgctcatcgagacgcctgtgcaaactggtcaggaataagttcacttcatgaccctcaaaagtgatcggattctaattcatgaccccaaaccgcaaaaccagatatcttgaccc

SEQ ID NO: 26049 - DNA, 1501 bp, Oryza sativa
atttgtcgaaacaagatttcggcaatactaaaagggggtggctatcaagctggaaaagtggatggggttgagaaacaaagaattttatacaggttcaggccttcttaacaagaagtaataccctactcctgtccggggattgatccaccgagtgtattattgatcgtatgatctgggagcagatcgtgccccaagaggcacccggacccctccttatataggggaaggggtccgtattacaaaatacagtccatatccctaacggaataggtagttacagataagattcaatcgtaaccgactaagatcccgagtatttccttaacatacaagtttggaatttaacccaagtccctttaaagatattctatctatacatggcaccccatacctagtcggattatacatgccgtgtaggtatggggtatccataatctccacagtagcccctgagacctttacagtcaacaaaatagttttctctcgtaatcccaaacgataatccgagcactccaacttcttctgccttggtctcccgagtatcaaaatcaaagactgtgaatggctgaaaatagaaaaaatcaggtgcatcgactagatgcacctaattaggtgtagcccccgactaagtgattagttaaaaaaactaaacatatagtcaaggtgtaaataacatccaaccgagtggttttacaaccgaatcatccaaagtatcatacaactaagcatatgagacgtttgataaaatatccagccgactgctttagctttgatataccaaaaatggaaatataaagaaacccgagtaaaaaatactataaggtccataatccaacacatatgacaagaatccgagtaaaaactctcaaaaagatccatcaaatgtgatataaatcgatgagtctaaataacctaggccatgactcacgtcataatcaaaataagcatataacatgccgagagaatgactattcaaaaaccagtcacctcaacaaaacccaaatagtttttgcagcctaaaaaggcctacaaaatcagtataacacttttctgtcaggcacctttttatttgcattgtagtaattccacagaattatctaactgcgtcaaaaaggattttaacagcattgggctatattgtcgtgagcaagtgttgccaaagcaaaaacaaatgcctaagcccctaaggatcacaacttaaccacgctgatagcaaaactgggctgaagtactgtttaggcccaggcccattagtactcccgataccctaatgagataacaccgaaggcatagcgtcgttttgtcttccccgccgaaactcttgccactttccctactcactgctatagtgcgaaatcacttcggtgaagctagggttcacaaatcccctccaatccatcctccaaagttccacaaaaatcttccgcgcaaccaccgcatcgatctcctatccattcccggccatatttcaaaccaaatcgcatcatccaatttgcatcca

SEQ ID NO: 26050 - DNA, 1501 bp, Oryza sativa
aagtgccctagtaaacctctgtcttgaagagacgatcataactcatgtactttgtttctaatttctagtgtaataaaagtcattagttctaaaaaaaaagggaggtgcctagaggtggccgagaaagctggtttgttcggtgtttgctaccccttcatttttttaaataacccacacaagacagcgcacaatttcgtactaatatagtagaaaacaaaacaagtctatagccctggaagactatagctagaaaaaaaataaccacaccacgcgtctacaaccggatccccgctagtaaagagtaaacatgaacacaacacccctaatggaatgggtcttcaaatgacaccaccagcgaagaaacggtgtcgagaaacaccaccgtcacctattctgagaacatgacatggttttcacctaaagaaaaccatcaaggagagaagagattctacaacaatgccccaagggaaaagtggcgcccatgagtgtcgctattgttggcccaaaggctaggctttcacccgtaatcttcatgccctcccatgccacgtgcacctgtccgtatcagcggccaccaccaactgagcaccttcaatgcatagccaccacaccagcgccttgccgtcgaccatccattaagcaggattgcaggatccagctcactcaacctccatccacacgattgggttgaggaggaagaggatgagagagaagagtggatctcctcttcctcgtactaggccgccagcgtggccatcttgtgacggcaaggcgtcaccacgagaggactagcgtatggatcagagtccgttgcatgccctgcaaacacccacctcacggcatcgctgacgcctccacctcgggcagactgcccaccttgctatcgcctcgccccgaagccatcattcgtcatcggatctcccatgtggtagcgcctcaacggtgccatcattcctgcctccatccatcgacatgttgccactggacaccggccacgccgcgatcgcctcccgttgggctccagctgtcgtcaccaatcagcatgggttcttgctacccgcgtgcgccactgccagagcacgacagccctcgctgccgcgcttgcctccaccagccttctcttgcgcctcatcggtctcctgctgtctcgtgcgctgctagtcggctcctccggccagatccattgcaggggcgacagatctagccgtgggtggaccagatcctatcgtggcggcatcggatccgtcgcctagcgctgcgcagcgtcgccgcctcgtcttccccacacatcgcatgtcaagccgccttccccgcgccgaggtggagcgccgccgagggtttgaccccacattcccctacaattttgattttcatgaacactgagttctcgatgtgtttacacggttcgtgtaagccataaactaaatatgtcggagaaaacgttgatgccatcaacttttagccaatcttctatttcttcctatagtccaaagtagaattc

SEQ ID NO: 26051 - DNA, 1501 bp, Oryza sativa
ccatatcaaagagttcaaatttgcgtactgtattcttcttcgagaaaaatgccgcaccatattaccataaggacgacactgcagcgttttatttacctgtttcaactaatttgtcaaaatttggtttggaacaacatgtgatctgtgtgtggagatggatttttatccctcgagtagacatctcaccatttcttacatatcatctaaatagtcataaaaaagttaaaaagcattaacaagattttagtttaagtcaatctcttctacgtacttgagtttttctcaattccttgtataccccaaaattttgcttttgatctcttctatacaattttcgttacatgacctttagtggttatataaaaaatcaaatttaccttgggcacgcaaggaatgaagaagtttgtcaaaatctttgttgtgtgactataatattcataagtttgttatactagactccaacgatattctctatgatcactttcttccatgactaaaggaaaaatggataattttataggaattaaacagtcggcagatggaaatggtgtggagagaatccaaatcaaaattcaggagtataaaaaggagtgagcaaaactcgtaaacatagaagggattggttgaaatttaaggaggcacacaagaaattttcctcattaataagagatatactccacaaacgtgtaggtcatatttgatttctagaagttgtaacagaacaataaattaaactaaaactagtacacaaacattcagagttgtatttttttttaatttttgttacagcttgtagaagttaaatttaaaattacatgcttgtgaagagatatatatttcatattaatctattttgtcatttttttaaaaaacattaataaatatttaggtaacatgtagaaaacaagtggatgtcgatgaataaaagcactttcccacctgcctaatgaaatagtatcataacattcaacgcaatgcaaactgtgttacaaatctagtaatcccaaaaaatcactgataaaattcctcaaaatctcagttatatatatataacttcaaaacgaaattactgtcggatgctcctatcctggaacaatcagtcctttagatcatgtgcaggtaatttgttgagcagaacagtgatctgctccggcatgcatgataaagctcagcgtggtatatcaggggatatggactgggtggatccatattactgatttgtggggcatctactagcttggcccacatgccattggttcaaatttgggcttgttaagctgctgtttttgggaactgggctttcaggccatttggttttgtttgatttgaagcccaaattcttttgtgggtcatatggtctcctttggaattttttttatttataattttttttattaaaagttttacaaaaataattttccattttgaaaattgacggaagtagtcgcctaccgcccaatcgccctttcagagggcggcgaaaatgacctggcagacggcc

SEQ ID NO: 26052 - DNA, 1501 bp, Oryza sativa
tgtgcgtgcaaatgcacatgttgacagtaatacaacttcttgtgtatcaattctaacaactaaacatgttgcatctaggccaaaattgcttcaaatacaaatgaccaatttactcaaaataatttgcatacatccataaaaacaatacttcatttgtaaattcatttatacatagaagatggacataacattatcaatcaaattaactatagacactgcataggtacatagtattttgatagataattttggtgcagggcatattggcatatagacttcttgtctatatattcgcaaattcgatgacattgtatctacttggacacaattaatataaattagttgtagcttatcttctctgatagtcatgcactaataaatatctctaagtcaataatatactctcttcatgatgagtgtatacatttattctatacggagaatatataattgtgcgttctgcaaatgtggcgtcaattagacaaagagaagatatatgaataattttattactcatttgcccaataaatgtatttgctacatgcaactacttacatgatgtccttttatgcaactttctaccggtttacttcttgtaaataaagtgcacaaaacgagtacaaaatagtaaagaatggttttctatacacaccttttattacaatcctagcaattaacatgattttctaatattcaaaggtatgtgtaatttacagaactactaacccacagaacaatcaattatcccaaacaaacaattgccaggaaataaaccataaaatattatgcttccaaaaggggtgctaaaacaaaggtttcacaagttcatggaagctcttttgcctaaaaacaatgtttctaggattaattatggttattcaagaaactaactaaatagttaaagcaaatacatagaaatacgggactaaggaataaatccttaattcttctctatttggcgtaaacccaattcatgaaggttcaaagtataaatggcgaatgtatatttcccttagtttctaatgtctcataggacttttccgcataatttccgagttccgcataatgccttggaaaccaaggacttttgaaataaaataccattttcggaccaaaatcacggttcgtgcccgactccttttaataggccaatttctacttggcccacctccttatactggctagctttaaaacctggccagcccatctcatatgtcgcctaatgggctattacgaccttcccccacaagaagtgggtgaggtatgatccaattgccattcttcaatggagacaatggatggaaccaatggcaaacgtgctagtgagccctcggtagagatggacgtctatggaaagttgccatggtcagaggcgaagcggcgatgcaacatctagtagcaccgacactggcattcgttggcatcaggccgtgtccggcgtccgacaatcatagctccatgttacgtgtcgatgaaactcagctcggcatataggccggca

SEQ ID NO: 26053 - DNA, 695 bp, Oryza sativa
aaggcggtaccccctggtactagacccagtggtttgcaacatcaagctccgaagatccctgatcgatggtggcactgcactcaatatccttttcgccaagactctggacgacatgcaaatccctcgcacggaattgaagccaagtaatgcgcccttccacggagtcatccccgggctgtcttctactccactcggctagattactctgtcggttactttcggcactcgagagaactttcgcacagagaatatttgcttcgaagttgctgattttgagacagcgtaccatgccatactcggacgcccggcgttagccaagttcatggctgtcccgcactacacctacatgatgatgaaaatgccaggtccccgaggagtcatatccctgcggagtgacatcaagcaagctgtcacttgcgacaaggaaagctgcgagatagcccagacccgcgagattgcgctcgctcgagaagaaatccgactggctgcgtccactgcaaccgaaggagaagtgtctgcaaccaagatgtcaaaaggcggagaaggcgacgccaagaccgagaagattcctctagatccctctgaccctactaagactgctgtaataggcgctaagttagattataaataggaaagcgtgctcatcacctttcttcaaaataataaagatatctttgcgtggaaaccatctgata

SEQ ID NO: 26054 - DNA, 575 bp, Oryza sativa
caatcttaagttatgcatagacaatcttgaaagctcttctacggcgtggattcaaagtgagccaaaatgcgtcacaaaaataagaacaagggttaaaacattaaaaaaataatcctgctatatgcaatgatttagagaggcaatgcacaatgatttagttctccttcaggctttagtcactttatacaaaaacacaaaaaagaccaaaaaggaaaaaagaaaaccaaaactattttatatataaaaggcccactacaagtaattacccactaggcccataaaggaccactacaagtcattacccattaggcccatcaaggcccatctaaaatttctagggtttcctcatcctcgatggggtttatccttcgagcacatatataatccgcacgccgccgcctccctctctgcttcgcactccattttccctctccccgctcgccgccgccgccgccgccagccaagctcgccgctcgccatgggtaagcctccccctcctctccctctctccggttcatctcgattagttttagctctcaatcccttccggatctgaccgtttcttggacaaatgt

SEQ ID NO: 26055 - DNA, 1501 bp, Oryza sativa
gtattacttcttgttaagaaggcctgaacctgtataaaattctttgtttctcaaccccatccacttttccagcttgatagccacccccttttagtattgccgaaatcttgtttcgacaaatttcaatcaaattttcaattttgatgtgaactaaacacacccatagtaggatgcatgagatcgtgagatgagtaaactcaaacttgcttaaggttgggaatcgctgattggtaactacattaattggccctcataattttatccatccaaattccccattggaccattacttacacttttgtagggtgattactggagggacgacacagggcacaattctctactgcttgtacatgcttcagagctgcaaaaaaaatgacaatttgaccctttcagaaaacttatttcgcaaataaaccgcgcacaaaacttatttcaaaaataaaccagaggttcagcgccaaatgcttcggcactgagcttagccacctcagtgccaggtcaaccggcactgaatgtcgtgccaccgtggatggcacgccgactcagtgtgccgacgtgtcaaagttcagcgccacccgactcggcgctgaggtggctaagctcagcgccattgtatttggcactgaaggggggaacttagtagctgtgccgagcattatggtatggctggctgctctgctagatctcagcgccaaataggttggcactgagtatggctggttccgtgccgggtggtttggcgctgagatatatttgacaggcttaaaactatgtttacttctgacacatttggagttaagtgaacacagcaaaaaatatgcagtcattcggttgataaccagtgcgcaaccaaagcaatgttgcgaagtgaaagtcacaactaagcaaaccatttaacatatatagaagcagtacttaactagagaacaagtcttagccatacataagaaggtccatagaaccccgcaaaaaaaaaaggtccatagaagtgcctaacagccataggtgcaaaagtgatgctaattctgacagccttacatgacgaggtccatacaaaagtcatattcagcataagttgtgcacatcaacttggaggataccaggacaatacttacaataactgaaccattaccatcgcttatatacaaacctgccgagatttgcggctcctggagatttttgagctggcgtggccacctgcgcgtgccgacgcgtcagcgaggcgctggatggcgggtggttttcgtgagctctcgcacgtccgtgtcgtcgttggtgattttgcaaaaacacccttcatttacttgataatttgttatagatccctggtccttagttctaacgttgtgcactcttacttagaggacctcttaagaaaacaatattctatatgaagaagcgaaaaaacggaaaattgaaccgcgctctgaaaactagaagtttaggggttgtttttgcaaccctcacccctttccccaaaccctagccgccaccattc

SEQ ID NO: 26056 - DNA, 1046 bp, Oryza sativa
ataaagctacttcttctaatactagaacaaagagttacttttgttatcgtatttagttacttctacaatttatttgaattacttttagatttcacgctgaacttacttcatgtagcttcatgttttacctctgcactatgtagctaaccacctgtattgtttacataaaaacattataatattatgactcactctaaacatctaaatatgatccgtatatatgaaacataattattttcttcgggtattgatatagggtgcatgcatgtgtaatcacgaacttcaagaaaatgtttatgtaactatcccatctaatctacttttaatccgctagattgttacatttacgttttgaagaactacaatcaaatgaagttgaaaaaaagtactatgaaaaagacaacaattacagaattactactcaaatggaattgacaaaaaaaagggtgatcacagtgtacatgcgacacgcaaggagcggaacaagaggccaattaatggtggaaaatggaaatggcatctactaatctcatggtttttggtgtgatcttcaagctagtgcacactcttctcatatggcaccgatgattggattagctagatgcaattgacaagcatatagactttcgttcaataaaggccatcaacaaacccaacttctaagaaatataatcgtataaactattttatcttggaaatgtctttgccatcacttttattctgttagacgtcgttaattttgtcaaaatgaccaaattaccctcctgaagacctcccatgacaaattctcttcccttccaccgccagccattcctcttcaatttctcccctccacttgaactgccggccactccctcttccacctcttctcgattaatgctaacatctagttgtaacaaaaaaaaaaagtagcccggccgtcatcatcgacaatgcctatatatatcaggccgagctttggtagctgcagagatctcaaagctatagcggctatttcatttcctcttagagtatagttgccgtccatactccaaatacgtactgcc

SEQ ID NO: 26057 - DNA, 1501 bp, Oryza sativa
aagtacgtagaagagattgacttaaactaaaatcttgttaatgctttttaacttttttatgactatttagatgatatgtaagaaatggtgagatgtctactcgagggataaaaatccatctccacacacagatcacatgttgttccaaaccaaattttgacaaattagttgaaacaggtaaataaaacgctgcagtgtcgtccttatggtaatatggtgcggcatttttctcgaagaagaatacagtacgcaaatttgaactctttgatatggatattcccgatgagtgtgacatgcgaaacgtaaatagcggattatttcctgcctatctttatttaaagattttcctgcctatctcgaaaaactctgtgttcggccctcctcccagcacgcaaaataaagctagtattattgcatgattaattaagtattaactatttttttgaaaaatgaatcaatatgattttttaaaataacatttatatagaaagtttttgcataaatcacaccgtttagcagtttgaaaagcatgcgcgcgaaaaacgagagaggtgggttgggaaaataggggaaagaacacagccttaatagtctttagtctatctacaaataaaattattttgtagcaattccatcacattaaatccaaagttccacttgttctaggcttctagcagcctttcaagctcacttttcatcatgcagttactacaagtttgctagaccaggatatgtgtccactacaagcttttttttgaaacctatgtccactacaagctgacaaaaacaagggttggcaagatgtcaacactatgtaacatgatgtcaacactgtgacacttcaaggtccaaaaagagagtacatggatgatctttttccttctcctagatcatgtttatgccctatatataaattctctccaaccatcttcttgtgttcatgactcttctcaatctaaccatatgcatcaacaatactagcctaatggagaagctggcagtaaccactgacattatctgaagaaattacttgccggttacagcaatgaagagaagctgaacccagaggagtggtactgagaacacaggtgccaatacaatgtatggtgagctactgtataatggagtaattctgtaactgtgttctcaggtcacccctttgggtttcttctcatgattctttgtccaatttgagatagtggtatacttgaatgattagattggtttatcttgattcatgagcaaggatatgtctatatactagggttagacatttcggaccgaaattcccctccgatacgatattattccggctgaatttctttaatttttcaaaattttcataaatttgggtaatatttattcaaattcaactaaattttgctcaaaatttcgaaatttcggaccgaaatttccaaaatttcgggatttcggtgacccccgatataaaagcacaaaccgataaagcaaaccctgctatatactatggaaacgtctagag

SEQ ID NO: 26058 - DNA, 1320 bp, Oryza sativa
  unsure (1)..(1320): unsure at all n locations
aaaaaaattccacccagtcttatcgaatatttagcagnatatatcagtatttaaatatagaaaanaactaattacttgtaaattacgatatgaatcttttaaatctgattgctccatgatttgataatgtggtgttacagtaaacatttaccaatgacgaattaattaggcttaataaattcgtctcgcagtttccaagctgaatctgtaatttgttttattattagtctatgtttaatactcgtgtgtccgtatatctaacgtgacacgctaaaaaatttcgttttgcttatcaaaatacatatatgtgtttgagtccgtttttaagctcgttcgctctttaaaatataaaaggagtcgtataagaaattattttaaaggaactcacattctaacttggggcgcttttagaaacacaacagttatcgtataagaaatcattttaaaaaactcgcatgctaatatgagataagagtcggactcctaattacaactcatgattttctaaaaatagtatccaaacaaattctcacaatgattttcactttagctaaattgtataattaataataataataataataataataataataataataataataataataaaataatattcacccattacaacgaacgtgtatttttcatagggtagtatcaagatttcagccgatcttacctgatttagccttatattttatgtgcttaattgatatgctagatccgccttttatattgagatcttcttgctttcaggtatattaagcttctcgtttgatatatattacttgctttaatatctttacatagagtggtatcggagtattagccgatacatgctaaatctatctaatcggctatgctatgagcgcttataatttcattgttaatatatatttcgatctaagtgatttatactgtctcgacatggcgatcaatctatcccaatcacttgacttaaatatatatcgacttaaggattatgtaccgttaatatctacagccgattgaatagatttagttctttcttgttattcatgactgccaatcgatgcaaagatgacatcggctcaaggataaatgatatgtcatcggcgactggccgatcggctatcggttatgaatttaactgctattttcctgtctttggttattggtgattgcaggatcaaatcaattggcacgctcatgaacctcaaaggcaagatttttggacctgcactggagttaagcagatctcccaggcctcatgtttttcgcatcaacacgcttttggcaagcccagtgggaccaagttacgacaattttctctca

SEQ ID NO: 26059 - DNA, 182 bp, Oryza sativa
caaagcatctcacaaaccttttagttagtctctttaatacacctcaaaagcttacatctccttggatctgtttttcttttagataacaagttttggatcgatcgcccccatcggatcctttttattttttgaaataagttttgcatcgttaaccaatgattgtaccatctcacttttctagg

SEQ ID NO: 26060 - DNA, 1081 bp, Oryza sativa
gatttatttggagagcagtacatattgcttttgggttataccatccacatagtatatatcatatttttagggattggcttggggtattgataaaaaaccaagaaacttatccttgtaggagcatctgcaatatgttaggcttggcttagtagaaatgatatggttattataaagcaccataaaaatcttatatacatgtacttttcagggcaacatactggcttcagtgttgggctcaactacaaaggtgtgatgaagacatcaagctaataaatgatgcatgtcgtaaacttgtgtcaatggtcatgcagattttcgccaactacagatggaggtccacgaagaggattcaataattgtgggtctttaatcttgtgttggtgcttattagcttgtgttgctttacgttaaattggtgtgctttgtggtttcattagattgtgaatgcttttgagcgatttggtgtaataaatggttgtagctcgttgagcaaatgccggaagtaattccattatctaaaaaaaaatatggccagtttactgtattattttcatagtagttttgtagatataaacatgagatcatgctataaaatcaaagtgtgttttgatcattatttcatgatgagcaatgggtattggggataattggtgtagatattggagatatttagcgaagtagttttggaagatgtaaataggattgtgattgtcaatttgggtccggtcaaatcgggtggactcggccggtcagaccagtgtgtgttgcatggttaaaccggccagcccgatggtctaacctgtcggctctgtgttagtttcagtttcaggatgtttctttggattttcgtgattaattcatgtttatgacttctagatggatacaatgcgtaagcaatactattgtgtgcaaatgttgagtcaagttagagagtacttgtgctcggatatggtttcttggttgactcatgtgtaggtgtgattcgagagagtgttgccgctgatggatcgggagtcaacttacgagaatatgacgtccagatgatcaggatagcatccgagatgcttaggctaaggatcaa

SEQ ID NO: 26061 - DNA, 1501 bp, Oryza sativa
aattgtaaaatacaggaaaaatacacgaacaatcatctaagagtaaaatgagaacaatcatttaagagtaaaatgagagtgatagactgcaatgtaactttcaagaggttgaagcttttgttaacttttatctaaaatcttagtagaacaatcatctaagagtaaaatgagagtgatagactgcaatggaatttttcaagaggttgaagcttttgttaactttcctctaaaatctcagtaaaaaaacacaaatattagggaatgacataatatcaaatagttagaaggggtgagtatttgaacccaggtcgtctagcccactactttgtgaagctagccggaagacccttggacgtttctcctaaaatcttagtaggactaagagtaaaatgagagtgatagactgcaatggaatttttggatactcgtggcacgcttttcaaactgctaaacggtgtgtctcgtgcgaaaactttatatataaaagttggtctaaaatatcatattaatctatttttcaagtttgtaataattaaaaccaaattagccacacgttattatcacctcgttttgtgtgaaatacttaatctttatcttcatcttcatcttcatctttaggagattcaaacaccaccatgtatttttaataagatttttataggaaaggaaatgattcaattctaaaaaaaggcccttctagaaatctttctttgtaaggttgtaatcttctaaattttctgtgttttccatacaaattaagggatccttagttcaaactgtaattttttatagctcaattgtaggtagagacgttagtggtggtgttcaccactgtttagttgagttgttgccgtatcttttttcttttgaaacgcttctctgatgggctatgcgttaagtgcaaaaaagctttcaactagtgcggttttcttcgtttagatatcaaaacaaagagttttatgaggtggcgaatttgagattgccgtgcattataagctacgtttcatgctcggttaaaaagcttttaaagaaaaggagtaacgcgccatactttatgataccctttttcttctaaaaaaacgaagtaacgtgatgacacacacgctactttcttcttactgcagtacaagaaacacttgtccgatgagcaagcacttttcagctagtttcttctttttagttgtgagacttgttttataattttaaaatactataaaacttgaggaaagttgtatgttataaacggtaaaggaagacaagtcatacatcaaaaaatatctcgcacagtaagtactaccgatgtagcaaattgtgccaatttgaattggtagtcctgccatgtattaaaggcaaattgacggtacaaagttcaacacgctaattagtagtatatgaaatgtcctcaagccaaaagggtgagatatgggataagaacgtctttagtcaaatggaacaatattataaagggagactatacatatcctagcaatagttgaatagc

SEQ ID NO: 26062 - DNA, 362 bp, Oryza sativa
aaactccatatcagtatacaatttagaactaactaaactttggaattaaaaaaagaaaatataagtagaagtttgagtctatattgaaatacaatttataaccttaatttataaaaataaaaaataaaaaatattgaaataagagtttacaatctatataaaaatacaatttagaaaaaaaaatgaaaatttggaatagaaataaggaatattggtagctagccgcgcagtttgcgcgggccaccatactagttgttattgaatacaaatccagaataagcctgtattcacttcgattgactgaatgaatgttctttgtttctcaaacaattgaaatatactgattgtcttgcaaatgtagc

SEQ ID NO: 26063 - DNA, 576 bp, Oryza sativa
tttttagctgtattccaccattcgcaaatttgtccatcaccgccaagaccatcttcaacattcggtaagtacatgataatgtcatatcacttaattgatctcttcttatttgcaaaagttatgccatgcattcaaattaatgctccgttattgttcaaattgtagggatcgcaagagaaaatgaaaataattgcgttcctctttgttggtatgatttttgtctgttcatgcactaattgtgtgttatggaatatagaatcaggtagaccaccggaggatttgcaccagaataaaatgaggaatttattggccagcactgatagaaaggttgctcctggcgatagaattgatcatcggtgccaacgtatcaattatccaaattgcaagtgaatgagctattggtaaagcaaatgaggtaccttaaagatactgaatgtcagtgtaggaaataagatgtaattagctaggctggtttgtatttgtaatataaaattttatgcataactattcaatttagtatatattgttcaatcatattgagaattatacacttgtgatgttttgttggaaataata

SEQ ID NO: 26064 - DNA, 1501 bp, Oryza sativa
aatagccgcacggaaaaaagatatattccacgtcacatacaacagaataattagttgagccttcttaactactaaagctttagatacaggtgctgatatttaggacaataattgttcagctattagaaacaaaatctaatagtataatgcaagagttcctgttgtaaaccagagattgaccatttatcgttgtttgcaaactgaccaaaattcaatgtacggaggtttccctgaaattacagaattgatgtgttttacacttgttcttcaagaacatgtaaatgtacgtactgcatgtccttgatacaaagaagaaagataggggctagaccatattgtattatttcttctgaatagtaaaagggtaatgtagttaaagggcttcatcatgctcacaagtaaaagagacagctgaaacgcactgattacttgaagacgatgaggatatctatccattgaattacacattatgtgcaacaaaataacatcttgtaaaaacttggcacaagccatgcaggtagaagtgtcacattgaaagccatgcagctagtgaacattaagcaaacattataacatcaacagcaatacaagattatttaccgaaagtctcccaaataatcacccaaggttcaattcactccaattgatccagcttcacgtgcttcctcaaaatatatttagatcctttcaggagaccaatctgaaagctctactaatgttcttccagtcacagtaagaaacaaaagaagattttaacaaacatatcagtggacgaaaacaaaacaaaacaaaacaaagaggacgaaaacctggcattggcagacctgctcatgttcaaaatctatctatctatctattattatatactaaaagttcattaatcttcctataaacgctctcatgccgccatgtggtgctctaaaaacgctcctacgatgccacgtggcgccctaataaaatagaaaaaatcatagaaattttgaaaaaaagaaaaacatctcaccattggttttcacttaaatcagtggcctcattatttttaaccattagatcaatttttgggaatagataacttaaaccaacctgtcggcctattagatcaatctcaatgaattcgttttctcttctcttcccctgccgtacgtgcacaccgtgcatatgtgctcacgtatttctttttctttttttgctcttcccttttctcgtagctattttctaacagctcaatataaaataatttaaaattagctaaatcatcatgattctcaatttatatacagttttcagttatctatactgtttttatttgtaattaaataaatactttaaaatccgtattacatttattttgctaggtaaaaaataaaatattgaacatagaaaaattttgacaacagttatgtcatcttaaatcattctacatatataaatttgtacattaaatatcttctaggcgcaagccatcacccatcacatcttaaaaattaagaaatgttgttta

SEQ ID NO: 26065 - DNA, 206 bp, Oryza sativa
acggcggcgtgtcgacggcggcggcgtggtcacggcgtgccgacggtggcgtgacgacgacggcggcggcggcgttgcgttctggggccgtgacggcggcggcgtggcgtggcggcggcgacggagagagacggagagagatcgagctgagatcggagagatcgagagataaagggagatctggcggcggcggctctcaccccaga

SEQ ID NO: 26066 - DNA, 427 bp, Oryza sativa
  unsure (1)..(427): unsure at all n locations
accaacagatgaaggatattgaattttgatgcatnngctactcatcgcttgatcattgattgncgtctcntgttcatgatgattatgaacaatatccntcctcccccccccccgcgttttgatgnacanccngctgnnaaccnncnnnnnnnnnnaannnctcagacacacttattcaagagaagatgttaataatgggttagtggacaaatctgtaagacttccatatagcttagttcgttgcttctattcaattcatgtacatagaaaagcttggggttcatgtgcttagtgagtttgcttctcatgtaatccatttgcatatgtgcgacatatgctggggttgtgttaacagtgaaatttggtaagcccagagtagtcatcggcttagagtcagcattggcttcgaagtcttgagattagccga

SEQ ID NO: 26067 - DNA, 1474 bp, Oryza sativa
agttcatcaaaccttcctgctctctcttgaaacctcccttgctacagtaaatcaccctctctcgacccctcttcctcctcgattccggcggcctcatcgccggcggcgggagggagaggggtcgtcccccctcccctagtatagctaagtagccgggctagtctcgttaggtcgggttcttcccgttttctcctcgttggtgtggtatggaagttggagatggtggtggattcgacgcggatgcagcttgtgatggcgaaggcgacgcggaatcgacctgagacgacggcagcggcgtggatctgttccgcggtggtggcggcggctcggatgcgacatgcggcagctacagcggctccgatgcagtttgtggtggcaatggcgactcggatatggtcagctgcggtggcggcctcacggatgcgacccgtggccggggcagacgcgcagatgcgacccgcggcggtggcggccgcgccgatgctgcccgcggcgacagcggccgcggcgatgctgcccgcggcggcggccgtgtggatgtggcccgcggcggcgacggccgcgccgttgctacccgcgacggcgacggctgcgccgatgcaggccgtgacggtgtcggtggtgtggatgtgtcttgcaatggcggcgtggatgcggctcggatgatctcctcttcttcaaccttctccatcgagttaccaagacagcaagttcttcgccaccatcttcggattgagtctttggttggctggatttggagaaattcttcctctctgtctcttggcagtaataaccatgcagggtttatcgttcgggttgagcccagattggatttgcaaccttggtttgcaggtttacagtccgtgctcctcagattcaacgatgaactccgtggaaatcttttgcggattccggtgatgctcacaccaaaatctacggcttcgcaccaaacctctcatatgtgtcattcccggggaggcagccgaaggggtttaccggttcgtcaagcggagtacacatcaatagaggcccttggatgcaatcgtcgcggcattgccgcagtaccctgttgattggctccttcattgctgcttagtttcattaggaagtttgctttcttttttcagttgacctctctcttgttaaagatggtccaactcttaggtttatcctgggcgatgtattggggaattcaattcccctaaatgttgtcgtttaataaagtgtgatgtgttttttttaaaaaaaaccaaggcgaattgagtgaggatttttattttttatgggggatcatatgaattgagtgctttttagataaaggctgtgaaggtcaataatatggatttataccattcaaaattatcgaagccagcaccaatactttttgcaaacagctaaatatactccctccgtttcacaatataagtcattctagcatttctcatattcatattgatgttaatgaatctagaca

SEQ ID NO: 26068 - DNA, 270 bp, Oryza sativa
cgtttaggattttcttccctttggcatgcaatatatatcttgtttggagtaccatactaccatgtggtttaacagtatgttaatttgtaattaaccaatctaatctacctgctgttcgttcctctgttggttaatttagtagtgacagtgttctggatcaagtagctaggtaggtgcagtagtgataaaagatcaaacctttttgtgctttagactttagaggagccatcagaaactgcaattgatgcctttgttatcctgttcttctga

SEQ ID NO: 26069 - DNA, 565 bp, Oryza sativa
gggagggagaaaataatgacgtgtttggctctcctcctcatctaaagaaccattacttctatcctggtctacctataaactattttgatgggatagaaacaaaatgtgctggtttttagctggatccgacaccattttttgataggaaatataggtgtcagttccaattaaaaactggcacctattgtacacaaaatgtgtctgttcttgcctttggtgtcccctcaggcgcgtgtgtgtgtgcaggaaaagcactataggtgctggtttagctgttatgacacctatagggccatcttccctgtgctattctgtagcagtgtgtcctgctcttttctatctgtcatcagtgtgcaggaactagattataaattttcctaccgctcacaagattgctaggagccaagtaggaacatcttgaaattttatgtactgtctatttgtctatttatttggttgtctatttatcttttaatctctatatgtaattagggcctcctgcagcttcaagtgccttttcaatctaacatggcaattcaaacaaaagtacaaactaattatgttt

SEQ ID NO: 26070 - DNA, 968 bp, Oryza sativa
gagcgaacgaacgtgaacgagttagggaacgtgaacgagcgaacgaacgaggacgatcgttaacgtgaaatgcaatatatatatatatgtatatatatgtatatatatgtatatatatgtatatatatatatatatgtatatatatgtatatatatatatatatgttacttcgcatttatcctaatacatttttttgtatttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggattggtgcgactcctagcaattgactattgtagtcttaattagacttagcatatacgcacgaaacacttagcatacattactatttagtcttagcatgtaatattatttgagttttaatataatattactttatttgtaattagacttggtatgtaattattgactacggaattggtgtgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaagtttgtgtagggttctaatgtacgacatttacacttagcatacatgacttagattgttaaaacataaatgtctcgtgacttagcagatgtttcttgtatcaacaga

SEQ ID NO: 26071 - DNA, 1501 bp, Oryza sativa
ttatctaattaagtactttcgttttgtaatatatgatgccatcgacttttaagatacgtttaactattcatcttgtaatatatgacgctgttgacttttgagatacatttaaccattcatcttatttaaaaaaaattatataattattatttattttatcgtgactttatttaccgtcaaatgttctttaagcatgacttaaattttttatatttaaaaataattttgaatatgaagaatggtcaaacgtttgttaaaaaatcgacaacgtcatatattgaaaaaatgaaggtagtatcattatatcatacttcgtcagtatacgaaaggcaccaatcatatagacacatagcttcttgcgttggtctatccatgaagaaaagtggaaggcaaccaaaaacagctaagaggctttattaaggcaatcctcgtaaagtagaatacaagttgtgttgaaggaagagccaagttacggtgtgcccataaattactattgaagcaaacaacacacttatggcttgtttagtaactcgatgtaaggggattgtgagtttacgtaagagaaatgatgataggattaaaatgagaatttgatttttaattctaatatcttgtttggtagaggtgatggaaattgataggaagtttagttggagattatgtcattaataaaaacggatggcttaaaattgtttagaaaaagtaaaggaggaattccctcctaattacctgccactacctaggtattgaaaagaagggagtttcttcctcaattctccatccccatcccaccaaaattcccatgtctcccaatcaaacaaaacacttaatagcctcatccctttaaactcccaatctcttctaaaatctccctccaaccaaatgggccgcaacaaggctagaatatgggaatgggagtatataatgtagacctcttgtcagttctgctagctaaattacatataagaataataatttagttttcttgctagttggctgcctataggttttcatctagatgtattctgagtaggtaaagctagctatatacttcctctgtttcacaatgtaagtcattctagtatttcccatatttatattgatgatgtctagattcattaacatcaatatgaatatgagaaatgctagaatgacttatattgtgaaacggagggagtatatttagctgtttgcaaaaagtattggtgctggcttcgataattttgaatggtataaatccatattattgaccttcacagcctttatctaaaaagcactcaattcatatgatcccccataaaaaataaaaatcctcactcaattcgccttggttttttttaaaaaaaacacatcacactttattaaacgacaacatttaggggaattgaattccccaatacatcgcccaggataaacctaagagttggaccatctttaacaagagagaggtcaactgaaaaaagaaagcaaacttcctaatgaaactaagcagcaatgaagg

SEQ ID NO: 26072 - DNA, 243 bp, Oryza sativa
aggggggaccggcgaaggtgtggtctggccacctcctcctctcgccccttcccatcgaccactggtgcttggcctcctctctgtctcaccccttttccacgctgggtggcctggtccaacaccgctcctcctcactggcacttaggagaggtcggatcgggtatcatccctcctcctctctgtggtgcctccttcccaccaccacttgggttggcctgatccgacactgcccctccctccagt

SEQ ID NO: 26073 - DNA, 254 bp, Oryza sativa
  unsure (1)..(254): unsure at all n locations
aaggattgaataccttgactacctgcttgcacgtcgactctagaggatccccaagtgagtgtctttattttactgtgaagatcaaaggcacctctaaaagtcaatacttagtatatgtgctatgacaagctntatatggtggtgttctgatatcctactatatgctcattctgttgtatatattaccttggcttgcatatttcaatttgctactttataccctaacttctatgctatatgatacaaactccatt

SEQ ID NO: 26074 - DNA, 319 bp, Oryza sativa
tagttgccgacactataccaatacaaatttttactaggtactctttttttttaaaataaacacattacaatctcatgtgcccccaatgcgtgggcactcaactatatgaatacatacgcacattctatccttatgagcacctccgaaaaactgggcccgacatatcttgagattgattaagttaccatgaacacctcactatcgatgggtacatcatctactactggaaaaaaattagccgtaaatactctaactctgttttaatatataatagtgattaaagttgtacatcaaagatcacaaaaagtgatatgtaaga

SEQ ID NO: 26075 - DNA, 522 bp, Oryza sativa
gcacgctgcacgcagttcttggatgaatgtggtatcgatgtatgcaggtgtgcaggtccgggcagcagcagtggcgcctataggccagcttggtgtttgtgcagagcggctcggtgacaggccggccaggagagccagtctgatcacggagtcggattgcttgcgtgactgaagccgagtttagtccaactttttctttaaactttaaactttttcatcacattaaaacttttctacacacataaactttcaacttttttatttaaactttcaattataatcaaacttttaattttggtgtggaattaaacacagcatgagatttgtctaggatttctttttggatgaatttggaaattgatggtttgagttctagtgaaattaggaattcaaagtagaaactataaatattatgatataaatagagagggtggttatgctcaaccacctaaaaatctcttgcgcccaactgctgcatcaggaatgttatcagttccatatgcccttgtttgtatccccacc

SEQ ID NO: 26076 - DNA, 1501 bp, Oryza sativa; identical to SEQ ID NO: 17574

SEQ ID NO: 26077 - DNA, 213 bp, Oryza sativa
atttaattcaaattccaatctttagaagcctatatatcctaaaccgtagatccgatctcagtgaaacctagacctaaattcatctaaattcaaatgcttcattttgatgcctaatttgttattttataattttatttgaatttattcaaatatcaattgaatttatatttgcctttttcaaatattttcttttaccccaaaataccctttagc

SEQ ID NO: 26078 - DNA, 340 bp, Oryza sativa
gggaaaaaaaaaggttttttttgggaaaatttttttttttaaggccacatgtttaactatttatcttatcaaaaaacttttgtgaaatatataaacttatatgtatacataaaggtatatttaacaatgaatcggatgattagaaaagaattaataattatttaattttttttaataagacgaacggtcaaatatgttttaaagtcacggcgtcaaatgttagcgacggagcgagtaagaattttggtaaaagaatcgaagatcattcagttcactgatggaagctgccattgcccattgcgtgcaggggtggctcaactgagagcgagaaggggtgaga

SEQ ID NO: 26079 - DNA, 405 bp, Oryza sativa
ttcgggttctgggacgagaattttgtagtccaagcgtctaggcaataggctccctggttccgaggtagatcgagaggaatcgggatccggggtgtgtcgcttgagcaaatctcggtgcgtggatctagaaacttccagatcacgagtttctagttcaataaagctcgctttcttactttggactaggaagtactgacacactggatggtcaattgttccgtttccgcccttctctgctactggttagtccgtacctgaatccagttgtggcttgaattgcgataagagaggctagtctaatccaaaggtctctagatcattctagaagcgagatttgggcttaagatgaactgaaacttgaatagggtatgcttgatctgttcactctcccatttcgcttctaga

SEQ ID NO: 26080 - DNA, 499 bp, Oryza sativa
actactttgtgatagaaaatggagaaaactgatgaagaaatcctatagtgatatatccgatggactttgcggatttatgcgctggacccatcttctcctttaactctcgtgattccttcaacaacgaaacatgacaataagattttacaggtaaagctagtgtaggacgtgggggtggatagagggaggtcagtgcaatgacggcccaatggcgggcaataggggaatcaagaaaacctcagttaatggccgctcggcggtgatagaagaagaacaatgtaggggcacctatgagaaggggaaataacagataaggagaagaagttaaatcaggctaaagtgacggaggaaggaggggcatagtttgagaggggtgctacagttgggcaataagactaaccatgaattgacggaggggttagtagtgcgctagataggggccaccgggccaggttgtggcctaccttactgtctagatatatagcaccttattgaacca

SEQ ID NO: 26081 - DNA, 480 bp, Oryza sativa
taccagtttactaattttggttgatttttcattgtaatgttcaaaaacctgtaaagtgatagataattcggaaatttggttatacggttaaacttttgatatggccatgcgcagcacaaatagttttaaatcatactttggttaaacaatgcatatttcttttgttttatttatgtattaattaattgagttagaaaagtgataagcatatgtatatttacttttgccgctaagataatttctattatgtgagcacacccttaatttgtatcctaaattcaccactgtacagtagaacacactagcctatatatctccctctcgagtgcagcgtgagttgacgcgccaaggcctactagcaacagagctgcaagcagagtggcagtgtgagtcgtaccgagagttgaagcacacatagccatctctctcgttgtttctccacgtaagctttttgtagcactagctttctagttgcaacga

SEQ ID NO: 26082 - DNA, 939 bp, Oryza sativa
ggcggtaatagcccgcaagccctaagaaactccgaacctgagtgactgtccttggtggggtccacttggtaaccgactccacatttgctggatccaccgctactccttgagcattcacgatgtgaccgagaaactgaacttccttaagccagaagtcacacttgctgaacttggcatatagctgatgctcctttaacttttcaagtaccagtcgaagatgctgctcatgttcttcctcggacttggagtagataagtatgtcatcaatgaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgataacctgatcgcaggtctatcttagagaacacagtagctcctttcaactgatcaaacagatcatcaatccttggcaaaggatacttgttcttgatggtgacctcattgagtgcgcggtagtcaacgcacatcctcttggttttgtctttcttctccacaaagataatcggagcaccccaaggcgacgtgctcggacggatgtatcccttctgtaactgttcatcgacttgcttcttgacttccgccaactcgctggctcccattctgtaaggcctcttgtggatcgatgcagttccaggtaccaagtctatccggaactcgatatccctttttggtggcattgttgtcagatcgtccggaaaaacctctggatactctctgactatgggaatatcctccagcttcttagtggttttctccactgctacctcttgtccttcaccagcagcctggtttaaactaatccctggcttctgcggcactggagactggaagatta

SEQ ID NO: 26083 - DNA, 293 bp, Oryza sativa
agctgctgtctaataatgctaattcagttatgttgccagtgttctcgaatctttgtagtatataacaaagctgtttcctggactgtgctatataaccgaataatggtttggtagtgattgtcttctcacttatcactaaggtgttcttttacttcattctgaaagaatatcacttcaattataaattcttatggtttctggttttcagtctgaatatccattaagttctatagctttacaacagcaccgagactgactgaagaatgtgacgtctatgatatgcaatatgcagg

SEQ ID NO: 26084 - DNA, 1501 bp, Oryza sativa
ggcttggtggcctacagtatatgaagaaaggcatgctaaataaaagaaaacaagttaatacaacataggcttacgacacaattaatttggtcgattcataaataaggaagattcgcaagaaattaattgatcaatagcaaagattttattattgattgcacctgaggtagttgctagatttgtttattcatcaccagcaagaatcatgttgccatatcaatattttacttgttgattcttctttcccctgtatattcaagtaaacggaaaacactagataatactcgtattagataaacaattctatccatgatctgaaaaaaatcaaaatatgccatagtctacatttcattgtagaaaaaaaaggatacaaaggattttttttattttctgaacctttttaatatttaattttagaaataaacctatcgaaattttattttcaagatcttttggccacgctaaccaaactggcgtggcaaaataatactgtcacgcctgccatgatagcgttatttggtcacatggcaaaactgtcacgtccgctataggtggcgtgccagtgttgttttgtcacgccagacaggttgtcatgaccaaaaggttcagattttagaaataagttttgaaaaggcttagttttaaaattaaaaattaaaaaggttcaaaaaaatacactaattcccaaagaagaaccgggtctgtaatatgatgttcttaacttgattttggtcttgaagacactggaagaacatacaaacagaagagtataaattagatagtacatgttggaattaatggacgggccttagcccactcgaagattaattctttggaacatcacaaaagtccacctcatgggatgacatgcatggggagtttagtatcaccttgcttatttaggagagggggacctccttaaaagggaggatgccctcctagccacttgaagcatatgagccacacgcacgcgctcgcctcgcctagccagggcaggcggcgtacgcgtcgaatggtcagtcaaaattaattcctcacccttgcacaaatgcaacctcctatccggttcggttacacagagtggagatcgtgtcccttgcgcagatgcaacctcctatccggttcgattatacagagtggagatcgtgcggacaccctctgtgctgcaccggcgatcgggtcgctcgtagatattactccatcccgctcgccggcgtgcaccggcgatagggagagcagtgcgcgccttcgtcgtcgcccgcaaccgcgagtaattcctgctaaacaaccgatctttcagcaacctcggtacgtgctcaacatgttgcgcatatttgatatattcatgttttactgcctaatttacatgtgtagatccaatgatgcattcatgctagtttacatctgcaatatcatgatttatttatggaataaattaaatcattatgtgcttataatttcaacaatcaaaaactttattataggcattgtgattttacta

SEQ ID NO: 26085 - DNA, 1488 bp, Oryza sativa
agataccaacaggatagagaacgcctattgctcagcaaaatccacctgttggagcccagtttgtacctgaacagcatatgtataatgtgcaacagcctccgcagaactatcttagcggtaatttcaatctccagtatccacctcggtcacctcagatccaatatcaagcaggaggatcacctcagccctagtttgttccccagctcaatcagtttgatccgatacagcagcagatgcaaggagtgccccatcaaaagccttaggccgacatgattgcagatgtgatgagggagtagtttgggcttaagccaaaggactctggaaatttgtatcggcacccttatcctgagtggtttgaaagagttccactgcctaaccgatacaaggttccagatttttcaaagttttcaagacaagacaatgtttcgacatatgagcatgtcagccgattcttggctcagtgtggagaggcatcggctgttgatgctttgagggttcgattgtttcctttgtctttgtccggatcagcattacatggttttcttcattgccttacacttctgttcaaggttgggccgatttggagaagcaattccatagctcttctatagtgggacccacgagatgaagctctctgacttgataggagttaggcagaggcatgatgaaaccgtgcaagattatatttagagattcagagatatgaggaacaagtgttatagttttgccttgacagattctcagttagccgatctcgcattccagggtttgatagctcagatcaaggagaaattttcatctcaggaatttgaaagcttgtctcatcttgcacagaaggtgaccctacatgagcaaaggtttgtagaggctaagaagaatttcaagaagatcaatcatgtatatccttatatgtatgattccgaagtggcagcagctgaatgggtgaggagcaaaaaggttgtgccatgtcaatgggtgaagagttttggaaaagaggaaaggtatgactttgatatcaccaaggctgataagatttttgatttgctacttcgggagaaacagatacaacttcatgctggtcacataatcccatcggctggggagctagggaagagaaaatattgtaagtggcataactctggttcccatgctactaatgattgcaaagtctttaggcagcagatccaagcagctattgagggagggaagataaaatttaatgattcaaagaagccgatgaaggtagatggacatcctttccccgtcaatatggtgcatacagctgggagagcagccgatgggggaaagaattcggagttctcaattgaattcagcaaggatgtcacgcccagaaattcatgaaccagaatttctaagctgaatgtgtattaaacccctgtccaggaccagccagggtacacaaacgacaattgttgacatacagatccacgtcttacaacaatataaaagattacaaatgcagcggaa

SEQ ID NO: 26086 - DNA, 1501 bp, Oryza sativa
tttaatcttgtatagttttcaatataaaaagatttgataactattgatatttatacaaaaatatagagcacagtacaaaatcgccctcccccagggcggcaagggggccgcctgcaaaattccatgccccctcgccgcccatttgcaggcgcccccccgcacagtacaaaatcgccctcgcggagggcggcaagggggccgcctgcaaatttccatgccccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccttcccagagggcggtaggcgactacttccgtcaattttcaaaatggaaaattatttttgtaaaacttttaataaaaaaaattaaaaataaaaaaaattcgtctcctttgagctccagtaccaaccaggtgaggaaattctcctgtttggattacggaaagcctgaggtcaactaggactgcatccacatgagacttcttccctgaagatcccaatgggccatcaatcgatatgattggattatgatagattgataatgtacactacactgattcttcaattcaattccatgtgttgcaaactgccattccaaataaaagaatgccattcttaaaaatatataaaaaaaactaagagaatgtttgcatgttcccgccatcatcatcttgttgaattagtgggcagcgtgcatgcatctcctctttgatcacggatcaccactactcatgtttccttctgcagctgtcataccaacataatttatatgtctaaattgacctgaatagatgaagtcagaggagttgattctgcgttgcagaaacgtggcaacaactacacagttttatctgatctctctccgcttcttctgccgtgattttttgagcatgacaaccacgcagaggttggaggaagggcagcacatgattttgtcggttactctggaaattacatttacatccaaggatcccagattataatatacattattcgttcgctgtcaggctttctcatcatctgcagtggttacgatcaacgaattgttgaagattgccaaaataaaccgaagattgcattggtgcacaacggttctgatcaaacatacaggagaggtaatacaaaatccttgattacaaaaccagaaagaaaaaattgcatgaataaaatccaaagtcccgaacagctcattacaaccatggactatggttaaaccaggttaaaccgtaaatgttagaacaaagctggattatgaccgcctggaagtattaattactagcatttttgatccattattcaaatactggcaccaacttcacattcactctctgttaactgcgctgatgcgcacaaattaacatcactcacaatttgaattaggagtgtcttaattaaga

SEQ ID NO: 26087 - DNA, 1005 bp, Oryza sativa
gccgacacaggtttaccatatgccgacgagaggggtcccagaccaacaacaggttaggtcccagaccttactgtgccaggaagcccaggggtcctccccgacaccaccccggcgaatccacatgtctctcggcatcaaggctcccctgataagctagttactcagctaggggtgtcccattccacccatgtggtcgtacttgtcttatgtttggatgaaattccaaggaaacggtccttaggtgcaagagcgggaaaccgtatacccggtacgttccccggtccgcggttttggaaattcatttagttcgcaagcaccgacccaggtgtcgggttttccaagtcttttgtaaaacccaagttttacccaagaagtttttcagattttaagtttgaaggcgcccgtcgatactcgcacagggtgcacgaatatcgagacgcaactagatggttacaaggggacacgatataacaattatcaaaggaaggatcaaatgcaacaaattaggtaggtccgccaatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagatttttggatttttggtctaaaggaaaaaggatttaattaaattctttttggaaaagaaaaagaaaagaaaaggaaagagggagggattatagacttttcctcgggcggctagggcgtggcccaagggaaaaggagcggaccgaccgagctaaa

SEQ ID NO: 26088 - DNA, 247 bp, Oryza sativa
cggcgtcatctattaaaaaatagaggtagtagttacttatattttttaaataagacgaacggtcaaatatgtttaaaaaagtcaacggcgtcaaacatttaaacatttagagaaggagtgagtatatatggtttttaaaaaagaatcatagtaattgttttttgagtttgctcgtagtagaaaaaatgtgtcataaatacgttccagcgtggggaaaacgtacgtgacgttacaccgtaaggtacca

SEQ ID NO: 26089 - DNA, 824 bp, Oryza sativa
ctaacatctatcggtagagggcagccgattaggttagacatcgacgttgacttagattatatgagatatctaccactctatgaaacttccagcgacttgattgtttagatattgttcttcttttcatacttaatgctgcatcagttgagtttgatctattaagtcgttcttagaatatcaatctctagcctgccttctggttgccgattagggtagcatcggagtttcagccgatcttatctgatttaactatatttactctatatgctttgttgatacgttaaatctgccctttatgttaagatattattgcatctaagtatattcagcttatgtttggtatgttctacttgttttaatatcttaatatagagttgtatcggagtattagccgatacatgctagatctactagatcggctatgctatgaacatatatagtcctgttattaatatatatttcgatctaagtgatttatactgtctcggcatggcgaccgatctatcccaatcacttgatttaagtgtatatccatataagaattatatattgtgaatatctatagccgatcgaatagatttagttctttattatctatttacaaccgccgatcgatttacatatgacatcagctcaaagataaatgatatgtcatcggcacttagccgatcggctatcgtttataggtttaactgtggtttctttgtttttatttcttattgattgcaggatcaaatcaactggcacgctagcacacccgaaggcgagttttggacatgcactggagttaagcagatctcacaggcctcgtgttttacgtcaac

SEQ ID NO: 26090 - DNA, 264 bp, Oryza sativa
gtaagttcacatatcatccctcaactttacatcgagtctatataaggtcccttaactgaaataccaggaatgtctaccccttaaatgttcaaactatgcaaaataggttacatgatagtacatatgggttgtttggataacgtggcatcctagtcagaataaaaaaaattgtggggcccatatgtcatcctcactccttttctcctctctctctctctatcctctctccgtcaagagcagggcaagcggggtgcggagcgacaa

SEQ ID NO: 26091 - DNA, 283 bp, Oryza sativa
  unsure (1)..(283): unsure at all n locations
cacgcctgatgattgacatccactcttacaccgncaaancatatggtttatacattatttattattggattaaattgaatggtaatttactgaaagatatttccaacattataaaccccaagaagatcttccctggcgcgtgtggaagtttgatcagatattaagcattttagataaagaaattaaataatctggccctcttcaccaaccgaatgtatcagagattagcatttttggataaataataaggcggccgagaagagggtagatttttttcttcagt

SEQ ID NO: 26092 - DNA, 165 bp, Oryza sativa
acggcgaattcgagctcggtaccccgcatataacatccatatgaatgtgaaaaatgttagaatggcttatattatgaaacggagggagtagtttttttcccattccgtaaaaattccgaacgttcgagtagacgtttacttgacttcgaacttcaaacagtaaga

SEQ ID NO: 26093 - DNA, 1017 bp, Oryza sativa
  unsure (1)..(1017): unsure at all n locations
cgacctttgatagacttctctgtaccctatctatgnaagnngntgagttatcatatatcttatataatctctgacaatatcgctatctaacctccaatcgggtagtgtctatcgctggagagcagccgattaggttaagtatcgacgttggcttagattatataggatatctaccactttatgaagcttccaatagcttgattgcctaaatattgtctttcttttcatacttatggctgcatcagttgagtttgatctcataagtcgtgcttagaactataatctctagcctgctttttgggtgtcgattagagtagtatcggggtttcagccgatcttacctaatttagccttatatttcatgtgctgaattgatatgttaaatctgccctttatgttaagatcttattgcttttaggtgtgacaaactttacgtttgatatattttacttgctttaatatcttaaggtagagtagtatcggagtattagccgatacaagctagatctatttgatcagctatgctgtgaatgattatagtgttcttgttaatatatatttcggtctaagtgatttatactgtctcggcatggcggacccgatcctatcccccaaatntaactctgtaattttttaaagggttaatttaattaaaattttcnccgggggggaaaaccccacgaagattatttatcattgatatctacagccgattgaatagatttagtttctttattattgcctcgcacagcctatcgatgcaaagatgacatcggctcgagtacaaatgatacgttatcggcggctggtcgaccggtatcatttatggactactactttctttgnctttatttcttgttgattgcaggatcaaatcaactggcatgctcatgaaccttaaaggcaagattttggacctgcactagagttaagcagatctcccaggcctcgtgtttttacatcaacactcttttggcacgcccggtgggacctgagttttcaacgacttcatcccga

SEQ ID NO: 26094 - DNA, 295 bp, Oryza sativa
gcggcttcgggtgggggcgccgcgccgccggcttctcgtcgcttgccatggcgctggaacgggggaggacggccggagtggcggctcgttggggacggcctcgcggaagagcaacggccggaaggacaacggcggcgacaacacgtcggccggccaactccctcctcgccgtctccatccctacttccctcccgctgtcgccgtctccgtcttccgctcctccctcgccccggatgggagtttcgtcggagcggcatcctcctcctccacctctccactgccattcccctcaagc

SEQ ID NO: 26095 - DNA, 321 bp, Oryza sativa
tggcatttttgggacaatcctgccaaacctctctcgcctgtcaaaaaaataaaaagtgggctgcatgttggaagagtttgttgacgtggatatatatctgattgatcgtacagccaacttgtgttagataagtgtgtccgaacataattaatttctttcaatttggtctagcagaattccagtccattgaactttgcttaatactaatatacagtaataacgtgataacgacgacatgttctctcttttttttttgggtcactttcgtcgtctataagaacccgggcaactctctacgccatcatatacgttttacgcgcc

SEQ ID NO: 26096 - DNA, 1501 bp, Oryza sativa
aaaaaatcaactacaaagttgtagatcgcatcgagggctacaagtttgatataaagtttgtcttcattagagtttacatgaaaaatttataaattatttttaaatataaagtctttagaccgtcctatttgacccagatgatattcaaatccaagtttagggaccggggtgatacaactgaataagttggatgacctaaacgagtgatctgcaagtttagggaccggaatgatacagtcgaacaaatttgaggacctgaacggtcgatttgcgagtttagggaccgggatgacgcagcggtacaagtttagagaccggtgaaggactttactctagaatacactagactagagtctagagtatacatagacatgctgcatagtaccatgtaagtggccaatttttttttttggttggcaaaacagattatgtgatatcgccccacaaacgtgcaagcacaagttatatatttgccatcaaacctgcaagcacaagctcaactctagatattgagaaaaatacatatatccggctaataatgtagctacgctttgtgtaattatgatttttcgccactgatgttataactcatgaacagatagattctacataataaatattgtctctttatctaactagatgaaactccgcgcgttgcaaaagtttagtatgataagagcaaataaaaataatatttaagatagctaaacaacataagtttacgtaagttgatgtggtttatataatgatgattcaaaagtaaaagtaagaagatgtagctttataacagaagaaaaggaggcagataatttggactatacatttacgatcaaagggctaaaaataattaaggttatatggtttaatgagagaagaaaacgaggaagataatttggaccatagattaatcatccaaaaactaaaaataattgtgatatggcttaatgagagaagagataaataacatgaactaagtgaggatgaactatatagatatataggatattataaaaaatgatggagagatttaaaatattatgtgatttatgtgacatgatgatttaacatgcttacattttaaagctctaaaatttaataattataaaataagtaatataacattctgtacagatgttcaaatgtaatagttgctagtggaagatgatgtgaccttctttttgcatgttgagttttagattttagtgggttgtaactttatataggataattaataaatattacctatcttcattaacaaattattattattattattattattatcatcatcattatcgtatacaaaacaaatatattcacatataccagtcacattaaaacttactgaaaaaagagtagtgggagcccaatcataccagagctggaatagtctagttttttttctttttttaaaaaaaaagagagagacggagaaagagaattcaaatgacaagctggattggaggcccatcatatcacgcttaaaaacctctcctcaccc

SEQ ID NO: 26097 - DNA, 1501 bp, Oryza sativa
ccatcacgcagtgccgcggctagctagcttaattagataggccgccgcactgccggcgagatcgtctcgtcgcgccatccttttcttctctcctgcagtcaattgttctttctgttggatctgatttggtgattgattcatgatttatcggtgtaatgttgtatacttgtcaaattgttggaaagatatatatatatatatatatatatatatatatatatatatatatatatatatatatcttaattaagacactcctaattcaaattgtgagtgatgttaatttgtgcgcatcagcgcagttaacagagagtgaatgtgaagttggtgccagtatttgaataatggatcaaaaatgctagtaattaatacttccaggcggtcataatccagctttgttctaacatttacggtttaacctggtttaaccatagtccatggttgtaatgagctgttcgggactttggattttattcatgcaattttttctttctggttttgtaatcaaggattttgtattacctctcctgtatgtttgatcagaaccgttgtgcaccaatgcaatcttcggtttattttggcaatcttcaacaattcgttgatcgtaaccactgcagatgatgagaaagcctgacagcgaacgaataatgtatattataatctgggatccttggatgtaaatgtaatttccagagtaaccgacaaaatcatgtgctgcccttcctccaacctctgcgtggttgtcatgctcaaaaaatcacggcagaagaagcggagagagatcagataaaactgtgtagttgttgccacgtttctgcaacgcagaatcaactcctctgacttcatctattcaggtcaatttagacatataaattatgttggtatgacagctgcagaaggaaacatgagtagtggtgatccgtgatcaaagaggagatgcatgcacgctgcccactaattcaacaagatgatgatggcgggaacatgcaaacattctcttagttttttttatatatttttaagaatggcattcttttatttggaatggcagtttgcaacacatggaattgaattgaagaatcagtgtagtgtacattatcaatctatcataatccaatcatatcgattgatggcccattgggatcttcagggaagaagtctcatgtggatgcagtcctagttgacctcaggctttccgtaatccaaacaggagaatttcctcacctggttggtactggagctcaaaggagacgaattttttttatttttaattttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcc

SEQ ID NO: 26098 - DNA, 159 bp, Oryza sativa
agcattgctcccttttaagtatttttttttattttgatcttcttatgtttttgttgctattgatatggtattagtatctcatgtagtgctcagctcagcttcaactagtattcaattgtgtttctgttaatgaaccctttcaatctatttggtgacagc

SEQ ID NO: 26099 - DNA, 286 bp, Oryza sativa
ttactagtgatatgatactccacatcacatgtcagagtaaaatattaagggtcacaagttaaacaaaagatagttcataaatgcctatggttaatggttaatagtacctcctgtcacaaaataagtaatgttttagacaactacacggtcaccaatgcacttgttttattataatattttaaaattttatttaatataaatctaaccatattatttttgaaagttggatcagaatatttaaagaaaaattgatcatcaaagttgtattccaaaaatttgtgaatga

SEQ ID NO: 26100 - DNA, 194 bp, Oryza sativa
tttccttagttttctctattagatgaaaatcgattaaacttccgaaattcataactaaatcatcgtaactcggattcgagtggttcaagttgctaaattcatctaaaatcaagatctacatgttaaaaatatccacatgtactgtttttgcttgtttttgtactattttgttgattttgttctttcgctttagt

SEQ ID NO: 26101 - DNA, 188 bp, Oryza sativa
gaacatattatttggatacttaaggtgattgtaaaaatctaaggagacactgttattcaattagaaatttaatttactcactagtcattgtaactatttttccttggacagataaagtaagcacaactttcttgtgtcactgtgtgtcatgctatcgatgtgcttagtgtatgtttaatttgccttgt

SEQ ID NO: 26102 - DNA, 151 bp, Oryza sativa
  unsure (1)..(151): unsure at all n locations
gtcagcatttagcagtgtcagttcatatacttctggcacttttatgaacttgcattattgtcttagttgcactactttcttttgtatccactgtattcagtagtggggggttttttttttttggggccctttnttttttttctttgctaga

SEQ ID NO: 26103 - DNA, 293 bp, Oryza sativa
attcaaattttgtctaacaatacttgtcactctaaaatactacttatcctatcactcacatcttatttaaattctttttcttctacccctcaacgacctttccattttcaccaataaattatttgataaagacattatagtattttatttttttcaaatcttaatatgtttaacacctagaaatatagatatagccctgctctaacaaagtgaggaaaatggcgatgaccaaaatgcccccgttccccttccatctgtcgtctccttcccctctctctatctcccctcgcctc

SEQ ID NO: 26104 - DNA, 313 bp, Oryza sativa
aatatcagtgagatctttttttttttcagaattcactaaagttattaatgacacagtttgcaaactttaaagctcaacacatcacgtgtaacattttaacttgattttctatcactatctgatctctctattacctttttgcttccaagataaggaggatctgctgactgccattgcagatattttttagtggttgcaactgctacatcatcttaagttggtgacaatgacatggggcttaaaatggtagcctgtgttgtctaatttttgtgttcttttagcatgacaagtgattccttcaatctgattccca

SEQ ID NO: 26105 - DNA, 1501 bp, Oryza sativa
ttgagcatgttgatcctatatttaaattctctatttatttcaactgtgtatttattttcgaatgtcaccggtggtgtgaacttatacctttgctacggccaatttgcattgattaccttattccttgataccttgggatacaatttgactagttggcctcatataatggttcaattagatatattagtatagttacttagatatgcttagaaacattagtgtggctgtgtttgcaaccccatgttcccagcccctctccatcgttttccgttttccgagcgcacgtttttcaaactactaaacaatgtgttttttgcaaaaagtttctatacgaaagttgcttaaaaaaatcaaattaatccatttttgaaaaaaaatagctaatacttaattaatcatacgctaatggatcgctccattttccgtgcggaggcactatgttcccaagctgaacatgcgaacacagcctaaagcttcactattacctaaagctggatatttaaaggtagctcacgatgataaatcgtgttatgataatcaattgataattaaaacttgataatggtgggttgtgagcgtatagttttgatggtcgtgctcatgacaattaaggatcggttcgcgagctactgttgtgaaacattaaccatgccaaccacaagctagcatgggtaacggcatttccttttgtatagtataattcattatggggcgccagactgtgaagtggcgagaagtccgtgggggtcgctggggagtccatgcctctggtaattgagggggtgattatgatccaggaacggtgcgttgtggtggattgtgttatgcgaggggtactgtcacagctcctttccgaggtatcgtggtggtattgaggcgcatggcaacgtgttgtggggctgtcttgtgggtacagtgatacattggcaacgtgttgtggggctgtcttgtgggtacagtgatacattgatacatctctggccagagtaaaactattcgaatagccttgcccgtagttatgggcgggtctaacaatgttttcgtgattagtctcacactgatgctataactggtaataatttgcttagatcctggtttggaatggtacattcctggtttggagttagatctgtacagccgggtatggttgttaaggatggttgggcctgtgcagcatgggtgtgctgtacagtgttgattaatattgatgattaattactctactgttttactattctcaaatatttgctaaatgctgcttttgcaaataagccctatattatgccatcctttggtatccttgtgcacttgcatatttgctgtgtggcatgcggagtattccatgtactcaccttgcaataatcaatcaaacctcaattgaggaagttgcgaaggagaagacgtttggcttataccccagttgagctgcctgtgggagtggagctaaagccatcgctagaccgttaatccgctgctgttttcttttcttttgtaagtatgt

SEQ ID NO: 26106 - DNA, 1501 bp, Oryza sativa
atcggcggcggcttgcggctacagtcggcggttggtggctggaggaggaagacgacctgacaggtgggtcccacctgtcagcggctgagagagaggagggagggcgcggcggactgggccgaacgggccgagcacgcgcaggccgggggaagggagagagagacttgggccgactttcggcccaaagccaaaagggagattttaaaacctttttctatttaaattattcatgaaatgatattccattgattaaaaatacttccttggctcaaataaattccagaaaaatctaggaactatagaagcaagagaagtatttaacaaaattttatctagcccacttttatattgagatttaacaaattaaaattagatcttctcttttaggcttttaagatcatttctaataattccttttaaacaacaatttataatttaaggatttttaaacaagaaaagcacttaacataattataattagatcattaattgattaactaattactgaactgttctttgtatcatttaggaattgagctctgaaaaatccgagaaaatttcagagggtataattaatcatggagaatttaataaaaattaaatccagccatgctttatatttaggaaattttatttcccacatttaacttcacttgtaaattaatgaacatttaatataaattctaataataatttattaaataatttataaatcctgaaacggaaatcaggctgtgacatcagctaccggataagtcggaaatggtggtcgagatggaaaagactatttgccatggaaaagacccgtagtggtggaaaagacccttagtcgaggagaagatccatgttggtggaaaagactcttggccatgaagaaggcgacttggacaataaagatgccaagagaatattcccagggaccactcaaccactccatctagctggcaccaaaagactataatgacccccataatgtaccaaaatgcccttagggtctgttgatatgcaggggcacgattgtaatttcatgtgggcccaacaaagagcacaattgtaatctcacatgtaaagctgtgtactatatagagcagacaaaaagcctgtagcagacaggacatcttggaatactaaaaatcttgtcactcagggtgtgatcatttggtattcgggctcatttctcaggataggcaggaaaagggtgttttcctgtctatccccaatcttgtccgtgaccttgtgtcacgacaaattattttcaggatttttcttgaaattatttgagcattgtaattatttttaacaattcaaagatcatttccatgattaatttaaatggaaaagtaaataaaattcccttttccttttcgggccagtcttcagcccattcttcctctttgcctgcttactgtctccttctttcccgaagaagtctatttcttgtccctcgcctcttttcttttagcccagacaaaagtctgtttcaccttcctatcgctacagt

SEQ ID NO: 26107 - DNA, 1501 bp, Oryza sativa
gtagctaggggtcaccaccgttcctctctattcggcccaaaacactgtagaggaagagattgggtaagattgagtttttattctaagtatccgagtggcaaatggtcattcgaacaaggaaatggtaaaatgttgttcgagttggaaaacactattcgagtcggaaaataccgttcgagtgagtccttgtcactaagtctcattatccgttttgcgtatttcctgagttaataacaggtcagctgtcacgcccagaaattaactagcaatttccgaacttatttgtgcattaaatcctcgtccaggaatcagccgaggtacacaaactgacaattaatatacagattcatcataataataacgtaaatacttacaaaagaaaagaaaaatagcagcggaattacagtctagcgaagctccggctccactcccacaggcagctcaactgaggtataagccaaacgtcttctccttcgcaacttgtcttcaactgaggtttgattgattattgcaaggtgagcatatgacatactcagcaagccacacagcaaatatgcaagtgcacaagaataccaaaggatggcataatatagggttcatttgcaaaagcagcatttagaaaatatttaagaattgtaaaacagtagagtaattaatcatcaatattaatcaacactgaacagcacacccatgctgcacaggcccaaccatcctgaacaaccatacccggctgcacagatctatctccaaaccaggaatgtaccattccaaaccaggagctaaattaattaccatcaattaccacattattattaatgagtagtgtaggactaatcacgaaagacattgttcgacccgcccataaccgcgggcacggctattcgaatagttttactctggccagaggtgtaccactgtacccacaagacacaactccacaatatgtcaccatatcatcatgtgcccatgctaaacatgtcaccatttgtgtagttgtgacaagacccctcgcatatgtcaactcaaagcagtgcaccgttcctagatcgtagtcaccccctcaaaaaccagaggcatggactccccagcgacccccgtgggcttatctctgccacttctcagtctggcactccacgatgagccttgctatgcaaagtgtccagccgttgcccattctggcttgtggttgacacggttaatgtttcacaaccgaaactcgtgaaccggtccttaattgtcatgagcactaccatcaaaaccatgtgctcacaacccaccattatcaagttttagttggcacattaattaattcaccaatcacgattaaccatcgtgagctatcattaaatctctaccattaagtaatagtgaaacattagttatcccaattatgtgctaatgtttctaagcatggctaagcaattatatctaacatctagctgaaccaatatataaagctcaactagtcaaattataataacccaatgtatcaaggaacagt

SEQ ID NO: 26108 - DNA, 1399 bp, Oryza sativa
cttttttttcattaatgaagagccgattagcttcgattgttgcttccagtttagctctctcgcgcatgtctgctattctttgttgtgccctttccagcttgaaacgatgttgctctagatatacagccagggaaatgatgtcggcttcatcttctgggatctggtggtggatctcttcaaacctggccctgattgacccgcagccagtaaccaaggaatccaaggaactccctagccgttgagcaatatccatgagtttggtcttgagatcatcatcaagagggaccaaggctccactggtggtttcctcttcttcttcatctaggaactgtttaacgtcaaaggaaaacatattggccaagacctggagaaaagataaatcgggattattggcaaagaaaatatcgcagccgatatgagaagatttaatagtactaacaggcacaacaagaggtggatgttctggtgttcccaagtgatgactgtccacagccgacggggtgtgctcactagatgctagccgacgaggagatggagatcgaggaggctgaggcaaaaaggggaggagattaagtttttgtggcaactaataggagtaagaacacaagtttaaggttaccaatggaggcggagtggatttcttcttcttagcagcccttggcttcttcgtctgctggaaaaatggcaataaattcatatgatgcacacttaatcggatgataatgtgaagaaagatgcataccaccacttttaggggccggtgttggagcatctggcgtcttgttgggacttggtgtaccagctggaggtgtcccagctcgacccgtagggcttgcggataaggccctggtgtcactcatgccagcagcagcattatcaatggcctcctctatttcttcattctccaggacctcctctacatcacgatccaaaggaggtagatcatcggcagcaaacttttgcttctttgctacctttttcgaggcggcaggaggtttagcagccgatggcttgacatccgattgcttagtgcttttccttttacaagtttcaactggaatcggttcatgagtttgcccatatagtaaattagttgtcttgggggccatatagccgatcactgaaggagctagtccaccaccatttgggataatccctgcagcatagttaatcggcttcccactttggctagtgtaaggcagtgaggaatctgtggtctgcgaacaaggaaaagagatcaagtatcgattaaacatttgctcaaggttagaatttttcaaaaagaaaagtgtacctgaggcatcgagtccgagaagattatcgtgaagaacattgaggctgatagatggaataaatgcttcttccactcagcccaccatcgatcgaagagtgtgctcct

SEQ ID NO: 26109 - DNA, 1501 bp, Oryza sativa
ttgacatccgattgcttagtgcttttccttttacaagtttcaactggaatcggttcatgagtttgcccatatagtaaattagttgtcttgggggccatatagccgatcactgaaggagctagtccaccaccatttgggataatccctgcagcatagttaatcggcttcccactttggctagtgtaaggcagtgaggaatctgtggtctgcgaacaaggaaaagagatcaagtatcgattaaacatttgctcaaggttagaatttttcaaaaagaaaagtgtacctgaggcatcgagtccgagaagattatcgtgaagaacattgaggctgatagatggaataaatgcttcttccactcagcccaccatcgatcgaagagtgtgctcctgtcacgcccgaaaattcactagtaatttctaaacttatttgtgcataaaatcctcgtataggaatcagctgacgtgcacaaactgataatttaatatacaaatccatcgtaataataacattacatacttacaaaagaaaagaaaacagcagcggattaacggtctagcgatggctttagctccactcccacaggcagctcaactggggtataagccaaacgtcttctccttcgcaacttcctcaattgaggtttgattgattattgcaaggtgagtacatggaatactccgcatgccacacagcaaatatgcaagtgcacaaggataccaaaggatggcataatatagggcttatttgcaaaagcagcatttagcaaatatttgagaatagtaaaacagtagagtaattaatcatcaatattaatcaacactgtacagcacacccatgctgcacaggcccaaccatccttaacaaccatacccggctgtacagatctaactccaaaccaggaatgtaccattccaaaccaggatctaagcaaattattaccagttatagcatcagtgtgagactaatcacgaaaacattgttagacccgcccataactacgggcaaggctattcgaatagttttactctggccagagatgtatcaatgtatcactgtacccacaagacagccccacaacacgttgccaatgtatcactgtacccacaagacagccccacaacacgttgccatgcgcctcaataccaccacgatacctcggaaaggagctgtgacagtacccctcgcataacacaatccaccacaacgcaccgttcctggatcataatcaccccctcaattaccagaggcatggactccccagcgacccccacggacttctcgccacttcacagtctggcgccccataatgaattatactatacaaaaggaaatgccgttacccatgctagcttgtggttggcatggttaatgtttcacaacagtagctcgcgaaccgatccttaattgtcatgagcacgaccatcaaaactatacgctcacaacccaccattatcaagttttaattatcaattgattatcataacacgatttatcatcgtga

SEQ ID NO: 26110 - DNA, 1501 bp, Oryza sativa
ccttttcccactcttgcgatttttctttttgcttgacttaggtgcgtccttggctggtttcttctctcctccggtcttcggtttgtcgttcttgcgtctcaatgcgtcatccgcatgagcgcatcagtcgacaattttgaataatctccgagtagtcgtgatgcgcctcgttgccaactcttgagtagtatagcaatctctgacatcggatttgaaagcgcgaattatagaagcattggtgatctcggggattgtgtttctgcactcgttaaagcgccgaacataatccttcaaggattcgcccgggttctgtgtcaacgcatgtaggtcgtcttcgatcgcgtggcgtttgtaagttccttggaagttggctacgaattgctgccacaagtctgcccacgaagagattgagtagggggggaagatgcatcagccatgaacgtgtagagcctttcaatgcggttggcaagtaattcgccaacgcgttgtcgtccgctccggcagcgtagagtaccgtggagtaaacctgaaggaactcttctgggtcggtgctcccatcgcatttctctattgctccaggtcagaatctttcgggccatcggacatcccgaagtgaacgaccgaaagctctacacccagcgctgggagcggtgggttgtcggcgatcatgcgtccttcgtggatgtctatccgatgatgaagatgacgaggatgattgtcacgaccggaaataacccaacgggcgttccttacgtgcgtgtattattccttgtcccaggaggcaaggtacaccaaaagttgatacaattcagagtttaacaagcggaagcgtaaatagataatttattacatgggcaacgaaggcccagcacacacaaagacaaacgagaaacagcggaagactagggcgacgaccacaggcgcttgacggcaggcacgagctagacaccaaagccttcatcctccaggaactcctcttctgggtttgggaaaaattgagcaagactgagtacaaccaccgtactcaacaagacacacccacaagtgcagaataaatgcaagggagtacaaaggagttataatataaagggttagggttgcagtaaatagcatttaaagacacttagttgcgcaaagctattttggaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatatttacccacaagacacatcttcctcacgtgtaaccacgtgccacataccaccacggtatacggacggaagacgtgacatagt

SEQ ID NO: 26111 - DNA, 1501 bp, Oryza sativa
aaccaataaaaattttagggcttcgtatctaataaatcaaattgattgaaaaagaaatagatgaagcatgttttcttaccttggctctactaacgcacagtgtggttgtgtgctgatcagttggtggagatggactgatgtcgttgttggcttgtgacgctagctcctggttgcctagctgtcggcttcctgcccgcggcggtcgccaactgagaagagggcgaccggcgacggtgagatgccgagatgggcaagtgctgactgggattggctgattgagagcagcggtgtggaagccaaacagacgcgaggcggagttgtcaagactggcggcggcgcggcacacgatacaagaagtcgagaggagaaaacatcgatctggcttccaccctactggcctgctcatgggcttaccacgttaactggactgctgtttgggctgtgggtgcactatattgggctgaggggggtgcatatagggccgagatatgggggtaataactaaaagatattttttggggggttcatctgcacccacgggcttctactgggcttcatccctggattcctctaagcaccatttccaaaactgtcgacggtggatacccgtagaccggatatagagagtattggggtatgctggtacgaggatctacatagtacgacatcaagcaaacaggaaacatggattatactggttcaggccccttggtaggtaatagccctaatccagttgatatgcgattatatgatggaaaccacagattacaaagggaataatgaagctcgacgataccgacaagatcgtagttgagttgatccgactagatctcccggcgacttggcttcgataagctccggcttcgtaggctgtggtggatgtgttggctctgagattcgatgccttaggtcctctcggggggtccctttttttaccgtaggtcagctggtctctaagtaagactcagagacattggacccgacacgatataatgacgacccagttctatccgagtaggactctttccatctgtagactccatgatggacttccttaacctatgctgagaacgtccgtatacacacaaacataccatatcgatacgtgacgtatatcgaagggtagagggtataccttacccgtaaccctgacagtagcccccgacttctgcttaaatgaactcgtgaaatcgattgcgacttctgatgtcaaaattgtcgttgttctcggtgtggggaccaagagacaaggagtgatcgacaacgtcgagtgaagctcaacggtcatgagtgaatttaaattgaagtccgaaaaactgccgcgcgtaacggacctaaaaatttccggcggccatctctctcctttcctgggaattcgcaccggcggaggtgcgtctatttaagggagttttggggatcccatttgaggtcagcctattcaaaaaactctccagcttccaagcgtccctcgtcttcttcgctcctgcaaaaaaaccatagc

SEQ ID NO: 26112 - DNA, 1501 bp, Oryza sativa
gcgatggggtccccatccatcctcccctcctgctcggttgttttcgcttcaggttcagtgcagtcacgagcgcggacgcccccaaaaaactcgccacgctgtgtgcgcgcgcgcccaccgcgatccccctgatcccattaacgtttcacccgcgcgcgcccacctgccgctgcaatatatttcgccgcgccccgcgccacgccacgccacgccaccttgcgcgcgcgcgcgcacacacaccccagcagcagagatgagggggatgggcgacgacgggatggggccgatggcgatggcgccgccgcgttccggccacgccacggcggcggcaccgccgccgccgcagcacaagatggcgatgatgatgcacatgaccttcttctggagcgaccgcgcggtggtcctgatccggggctggcccggggagcgcggcgccgggatgtacgccctctgcctcctcttcgtgctcgcgctcgccgcgctcaccgaggggctctccgtgctctcgcgccgcctcgcccgccgcggcggcggcgccgcctcctcggatggcggccgcccggcgccggcgccggcgtcgtccgcggcgctgctgaccgcggtgcacgcggccaggatggggatggcgtacctggtgatgctggccgtcatgtcgttcaacgtcggggtgctcctcgccgctgtcgccggccacgccctcgggttcctcctcgcgcggagcagggtgcggccggccgcccgtgacggcggcggcggcgtggcctgtgagcacggtggcctccctcccgcggatggatccaagacttagtccccatcgattccgttaaacgagtatgtccaagcgccttagccagtagacactatgcactgtatcggatccaatgtgaaaatttaccttggatatctcgctaaaataattgtattttgtcgacttgcttgatatctgttcccgtgcagtcttctctagtcgtttttcgtttgtactcctatgtttcaagatggaatgatactactactagctagtattgatgtgagttctctactatgctaactttagatgaaccaatgatttgttagtactctccttccaaaaatatcctttttttaaatggaatccttccaaaaatattagatttatttcatattttgaattagctacatttgtagttttcatgtatttaaaacttaaatgaatagataaattaaatgattaatcggaacccgatgagtcatcttaatattcattggctgcgtacatgcatacactaattgatctttgttacaccttatctccacttaaattattattatttaaatccttcacccttaagatttctaattgtattgggtgcatatattgtatttattagagtgataaagatgataataattgtttttgttctttcgattaaatgtagctgtgtcttatattcgtttcatatgttgatgaaaccaaccctctagtatatgtttcatgctcatggtaacatatactagggta

SEQ ID NO: 26113 - DNA, 173 bp, Oryza sativa
acgcttccaggtacaaaagagccaataacattttattaaacattacacagcttttaagtaacttcttgcataaaaccttaactagcatttcttaaaaaaggtgactagaatcaaataagattatttttcaatggttgaattttcctttttaaatgggagcagaacaaatccaa

SEQ ID NO: 26114 - DNA, 287 bp, Oryza sativa
tactatagggcgaattcgagctcggtacccttgaccttgtactggtttgtgtgtgtcggtatttcccttacaaaatgatgagttggtgtgtgcgcgcaggcgcagcgcgctactggttcaaagcacagcagccacaccttccgcgaaccgatcgttcgatcggtccagccgcgtccggtttaatataaaccggcacccgtaaagcgattggcaattcaatcggtattggattgatcaatcatcgtcacctcgttttgcttgtctacttcgatcgccgcctccgcagc

SEQ ID NO: 26115 - DNA, 509 bp, Oryza sativa
tgattgggaagaggaactctctcaaaccactcaaggtaaggctgccgatacaagcttccactctcttttggtttaagcccaaactgttcccttattacgtcagcaatcacatcggcccacggtcgttgctgagctgctccctgtgcctgttgttgcatgggctcgaactgaccatattgagacgcaaactggggttgagccagtccccctagttgatattgggcttgcggggaaggaggctgatattgataattcaagttgccctcttagtaattatgaaggttcggctagatattacgtgctaagtgctcaggaacaacttgaggcattactgtgccatccggctgtatgtggtgaaccaagtgttctgggacaacttgatttaaaaattgttgtacaggctgaccaccaagcgttgcaaacccgggcaatgcgcttattgaaccttggtgctgaatcggctgaacgatttgctgtcttaacggcgtctactgaatcggctccatagg

SEQ ID NO: 26116 - DNA, 173 bp, Oryza sativa
tcctgcaccccgcttgaaaagtaaataatgaaagcaaaaggaggaaaaaccagtaaactatgaaagcaaagaaagaaattgtctcattgcatgaacagtgaacaataaaagtagagaaagaaaccgtttgattgcacgactggtaacggtttcttctctcttttgtttccagg

SEQ ID NO: 26117 - DNA, 490 bp, Oryza sativa
tttattgctcttgcaaaagaattggtcttgcttatcattcaaattgatactcaccacctttgaaacaatttcaagccaatcttccaagtttttccctacaattgctcttctaaaagagacattcaaagggacccttcctaacacatcggccactactaagtttttatttctaaccaagctatacaaggttggaaattccaaatgaaggggttggtttcccaaccatcggtcctcccagaatcttacttgtttcccattattcactgtgaagtggccaagtgtctggaagggttcttttgctgccataaggctagcccaaaaatgagaatcccccggttgtttttggacctgaaaaatggatttccttaccaagtattttttcctcaacaaattctgccacactccctattcattaattaacttaaagatccatttactaagcatacacttattttgagtctctaagtcctggattcctagccccccacat

SEQ ID NO: 26118 - DNA, 1501 bp, Oryza sativa
ctcagggaaaaatatcatgacatgcagcacaattaactcacaaccatgtttggtgagttgtcactataatatatagttgtggaatcttcctttctaatctttatgcaactagatagtaaaatggcaaattgaagaatccatatatactttgggatactatatttagtaataagagacaaacctttgctgcaactcttacctgatagaatttatgccttccctacctctccatggctccatgcatgtcaccatatgtaaacaccaatacatctcccaccaaacctattagtgcaaaaataaaacaaaacgaaaggaacgatccatagcaaaactacaagtaacagcttttgccacttatcttttgcaggttatttctccttttctcatacattgttcaggtgggacaggttacctatctcagtgtattctcttcccttacccatcagtataatatctaaatttatacttcataccacaacttcattattccccgattggacatatgtgacaagtggtattcatgataaaatgataaggatacatgcacaagaaattcatgagaaaatgatgagaatgaaagaaacaatggtatgggataattgttggtaaaccgaattattggcgtaggtatctagatgagaactaaatttaccccaagcaacataatgaattgagtacatatgtacagttttgttctatcacacatgtacatatatagaagcacgtctgtctaggacccatgcatctaactaaacagccactagctgaaaatacatcaaattgaaaagatgcatataatgtagcacaggtatagtacgtccgcatagcctttgttttaagagagggcaatcaatatattcatcatgaaggaagtacatacatacttttatacctgttcactgctcgtcgtatactgatacgattgatcacattactaacagggaaatggggctgatgttgcaatgatgacgatacaacatatgatgctttatgtgatcgatacgatctgatgtggcctgcagtgacctctcatcttttaagagggcccatttaaattggttttcttttctgagagagagagatctttgtgccctaaaagaatcgggaactgtgtacggcctctttctctctagactcaaagtatatggaataaagcgtccccttattgcccatatgctctctgtagactgtatgtgtgtatgcatggaaagattagaatcgctcacaattactaggagcagtaatgcataaaacagccacatgctgttcagcaaagccggggcttttcagcattcttgttccctaaaaagcagactacattactagacacaaaaattgaaacattcactaattaagtttaggcaactgctgaaggttcagtgccaatgtgccgaatctacgagtgaacagaacaaatgtttactactaatatatggcaaagatagcactgatcaagatcaacatgaatatatttgcatcattattaattgcatgattattg

SEQ ID NO: 26119 - DNA, 208 bp, Oryza sativa
gaataagtataattagtaatgtctaccaagcttttttttagacaataggcaaatttcattacctggccctttgaagaaagccaaaacataacaaggtcttatacaaaagaaacgaaaactaaacaacagggacaactagctactgaaaacaggtaaaaaaaggatggggattccagctaaccagttcaggacccgttctctacacagg

SEQ ID NO: 26120 - DNA, 1501 bp, Oryza sativa
tgtttcacctagtgtactcacaatgtttcactatatatagatctaatgttgcagtgaattgaaatattccattgtaaaaaaaactcacatatttcagaaacccctattaagggaattcgttttatttttttttcaaaactgaaacatttttcgatctacttagtgaaacaattctgatatacctggtgtaacatcgtgcaacatttaaaaataattcaataataagctaaatttttttcgttgtaatatatccatgtgtggtcttattttgaagatttaattgcaacgaatttaatggtgcaatcggatcatgatttggataagtaatttaggagaaaaatcagtttaaaatagttttgccgataattttttgctgatgaatgtcggccttggcctatctcctagatctatatcaacttcttccaaatcatcggccgacatgaaaccatgtcccaacttgccatcgagatcatccaccgtgcccttggtgtagaaatttgaacccttcacaacaccctcaaagtaataatttggggtctccgtcttccattggttgtatatcacaatcggacacttttagaaaatcttgatcccaaacttttccagacaggcaatcaataccatccatctcccaaagagctaaatcggcactagcaacattaactgacctgttggctggcacaatctcaatcttgtcaccttgccattgaaccaagcactggtgcatagtcggctcaatctgcatgaatccaatcccttccgagcaacaagctataagaacccttcccatcgatgataaaaaacgttgtaggaacagttttactgccgactgtcagttccacattcaaaactcccttggtatccgatggattgccaccaaaatttttgagaaccatgtttgtcttgatgagatcatctgcattcctacctagcttcctgaatggtagcatatggcatcaaatttactgcagccccaccatcaaccatcattttagacatcggcttcccattgacaaaacaatggtttgagatgccgattttctgtcccctctggcttctcaaaaaatgcttgttctggtgacaaaatcaacctagcagaggcctcctctacatcatcaacatcggcttgcctagcttcaaattctgtaggcaattgttaacaaccaaatttggtaatccaaggatcgaaggtgaagaagaaaccaagatagaattcgagacggaaatcgtctaggaaacagagtgaggatcgactggagtctgaatcggctacaaataagatcggcagagtttgagtcggacggggttagccgatagagcagaatccgacaatgtgacacagcatatgttgtcggtttagattgatgtacttcatggtgattgccgcacacggattgagtcctgagaagtcaattatatctattaattaggatgttttatgtaatttccttagagatatgtttgggtaaaagtctgccgcaaagacttataatatcttaga

SEQ ID NO: 26121 - DNA, 1501 bp, Oryza sativa
catctagatacctacgccaataattcggtttaccaacaattatcccataccattgtttctttcattctcatcattttctcatgaatttcttgtgcatgtatccttatcattttatcatgaataccacttgtcacatatgtccaatcggggaataatgaagttgtggtatgaagtataaatttagatattatactgatgggtaagggaagagaatacactgagataggtaacctgtcccacctgaacaatgtatgagaaaaggagaaataacctgcaaaagataagtggcaaaagctgttacttgtagttttgctatggatcgttcctttcgttttgttttatttttgcactaataggtttggtgggagatgtattggtgtttacatatggtgacatgcatggagccatggagaggtagggaaggcataaattctatcaggtaagagttgcagcaaaggtttgtctcttattactaaatatagtatcccaaagtatatatggattcttcaatttgccattttactatctagttgcataaagattagaaaggaagattccacaactatatattatagtgacaactcaccaaacatggttgtgagttaattgtgctgcatgtcatgatatttttccctgagaaaatggagaccctctgaaataatgaaaaaaatttcaggggttatgacattatgtttaccttatattcacactttactgcgcttactttgttacatggaacaattattcttgaaaaatatcattactaaggcaccttgtctgctccaatgaccaatgcacacttgtcatttcaccaaatccttctagatcaggttctaaattttatggtcgcccggctttgcgcactttgatgcaggaacgcatagaatttagctcaggtcattctttagaggcagctgatcatatacagaagactagtcacaaagatactgtgcacaatccatatgatctcctagctagctaccctctgcatgagaatgtgagaacgccttgcttgaaacttgagacttgagagagatagaggggaaagctggggggcctttgtatctgctttgtcagcacatgcattctacctagccaactttttctttcccaccacaaaatccactttggaccctaaaaattatagcccaaagagaaagaaaaaacaactatgcagccctccctaacaagaaaagcacaaatccacacaccataatctcctccttccttcaacctctgtaccttctcaccccccctctagctactcaaaagatgaacattcaccaacatataaagcagcactgcatcctcccaccacttgcaggttgcagctgaagcagcagtgacctccgtcccccttctatatctgcacatctcattccttctcctttttcttctcctcacacactaccgttgccacatcaaatcgatagattactagattagctaggttcttgtagtatacgtagctagctaggtggtgtggtgtacgtgtgagaga

SEQ ID NO: 26122 - DNA, 309 bp, Oryza sativa
aacaacaaatgctttgtattgatggattgtgtgcagggtcattacgcattgagttgatggttttaagtgatttcataagttccggggggattcccaggtttcccgccatggatattttagtattacattcgattaaaagtttgtttttatctcttccaaagagatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtcca

SEQ ID NO: 26123 - DNA, 1501 bp, Oryza sativa
atctagcatgtatcggctaatactccgataccactctatattaagatatcaaaacaagtaaaatatactaaaccaaagcctaatatacttaaaagcaacaagttcttaatataaaggacagatttaacatatcaatcaagtatatagaatagatgtagttaaaccaggtaagatcagctgaaactccgatgctaccctaatcggcaaccagaaacaggctagagactgagattctaaacacgacttaatagatcaaactcaactgatgcaacactaagtatgaaaagaagaacaatatctagacaatcaatccgctggatgtttcatagagtggtagatatcttatataatctaagccaacgttgttatttaatctaatcagctgccttctactagcagatgttagccgattgtaggttagataacgatattatcgaagattatgtaagatatatgataactcgacgaattacataaacaagattagagtatcataaagatggaagcactaatcccgagaacgcaagcagccataacaagttttacctcttgttgaagatcgaaaccgatgcagctcaacccgagagtaagaactcgtcgaaacaaaacgaaagtaaaaagggtggcgatgcgccgagattgtattgaacgtgtgttaattcgattacatggggttcgggtctatttatacccgagaattacaagatatgtccatatcggacgcgactcttgtctctaacaaactctaagatattataagtctttgcggcagacttttacccaaacatatctctaaggaaattacataaaacatcctaattaatagatataattgacttctcaggactcaatccgtgtgcggcaatcaccatgaagtacatcaatctaaaccgacaacatatgctgtgtcacattgtcggattctgctctatcggctaaccccgtccgactcaaactctgccgatcttatttgtagccgattcagactccagtcgatcctcactctgtttcctagacgatttccgtctcgaattctatcttggtttcttcttcaccttcgatccttggattaccaaatttggttgttaacaattgcctacagaatttgaagctaggcaagccgatgttgatgatgtagaggaggcctctgctaggttgattttgtcaccagaacaagcattttttgagaagccagaggggacagaaaatcggcatctcaaaccattgttttgtcaatgggaagccgatgtctaaaatgatggttgatggtggggctgcagtaaatttgatgccatatgctaccattcaggaagctaggtaggaatgcagatgatctcatcaagacaaacatggttctcaaaaattttggtggcaatccatcggataccaagggagttttgaatgtggaactgacagtcggcagtaaaactgttcctacaacgttttttatcatcgatgggaagggttcttatagcttgttgctcggaagggattggattca

SEQ ID NO: 26124 - DNA, 1501 bp, Oryza sativa
tgtgatgaacccactttttaggagtgtttggttgaggttcgagtgggttgggttgatccatatagatgaatattcctctcaaatttgggaccaagccatccggcaaaatcggccggacgaactcatcccacttggatgtagcacacggcgtcaacttgcctctgcatccgccatcgttgttcacacctgctgccacctccgcgaccgccggcactccgccatgaccagacgccgccacctccacgacccgttgccgctcctccgtctcctacgcgagcggctaccgcctctcctctgcgagcgacagccgcaacctcgcctccgtcgcctctcctctgtgagcagcagctgcctctcctccgtgagcggcgaccgcagcctcggcttctccatctccttcgcgagcagcggccgcagctgtgcctcatcggtctcctccacgtgcggcgaccacccctctgcgacccaccgcctctcctccacgagcggctggcgtcctccgcgatccgccaccacctctgctccgcgagaagcggctgccgcctcgcctccgccgccttctcgctcgtctgtccgcctgttggtcgccgctgctcctccttctgcctgctcgctcgttcgcttgtcgagtcgtcggccgcgccgtccctactccgcttgctcgctcgccgagttgctaggccgcgcctattgggatcggacgtgggttgacggtagccacaaatagcgtccatcccatcactccctcatcttttcaaccaaacaaagaatgatcctatcctatgaaccaaacatacgtgtgaaaaatcatcccatcccatctagttttagaaccaaatacatctaattctagaaccaaatatttcctccgtttcataatgcaagtcattttagtatttttcatatttatattgatgttaatgaatttttttatgggaatactagaatgacttagtgaaacagatggagtacatgtttaagctcccaaaacagcacttagatgtgcgtgtgtatgtttatacggaatcgttttattttacatgggggatggtgaaatttcctcctaacgcagcctagaccgccaacaacaaagccgcgggcgtaggataacaccaactaccacgcccgcgatattttgcacgcagcccctccatgaagaagccgtgtctcaaacccgcgcccctccccgctgccttcccttccagttccggtcttccagtccacatccacatccatccacatcttcccccctacacgtccgcgactcgactcgcgaacgcggctaaaaatttccctcccttccccccaccctcgtttcctcctcgcattctcgctcgcacaacctcgcgcttttcgccttaaccccgccgccccactccccccacctccccgcctcgtcgccgcccgccttgccgggaccctagctccgtcggacgcgtccgggggtggtgatcgcggcgcgcccgcccgattgggcgcttctcgcggatcggaggcatgt

SEQ ID NO: 26125 - DNA, 525 bp, Oryza sativa
  unsure (1)..(525): unsure at all n locations
gaatgggagatcgccattccctgattcattgttgtcataatgtgcatgtacaactcaaccatggaacctcgtaggtcgtttgcagcaaattttaaggcctgaattgcgtctttagtgacacgactagtttactagatatgcacgcctttcattcttctgatgcttagtgggtaacatagatacgatgtaacgttttgttttataaaagccatggatccattgcacttacggtttctctgatgtaacatatctcagatgctttatcaacattgcatacataatttataatatgtagttagtgcataaaactaaaagatgccttacagattgtgtataacattcaggaacttaagttttttttcttgcagctgtaagaacgttattattgtcaatgaattgtgcagaatattgtcaaatgatatacgatagcattttcatgtattatgctctaagngcttgcattttggttttgtctatatgttgcctatactggggtcactactgctacagatttcacattgaaaa

SEQ ID NO: 26126 - DNA, 312 bp, Oryza sativa
ccgccgaaagttaacggtttgcccaggctcacaactgaaagactttctacggtgtgcgcgtgcgatgcgcgtagaagactgatttatcaacctgtctttatatcaggattcattacctgactatttgtgggtaaagttcgtagtgcgctgatcgtgcaaaatgattttagttgggaacagttcgcaactctgtcccataaaaatcagcatattcccatctatcccatatccagcgcattgaccatcgggatactgaagggagattccatcatctcttagaaagatcaccatctcttttgtttcaatttgcat

SEQ ID NO: 26127 - DNA, 249 bp, Oryza sativa
cggtggggtgggcgcgggcgggcgctgatttggtgccgcaatctgtttcagccctcgtcgttcggcctagagacgaggtccagactgctcctttcagcccatttgcagaagactgcgtttgttctcttgagtacggaacatattttctccgcacggaaaatagagcgaggcattatgttccctccgcacgaaaaatagagtgaaacattttcttatgattaatttaatatttactaatttaagtagctt

SEQ ID NO: 26128 - DNA, 944 bp, Oryza sativa
gccatggcggaagaggaggtggggtttggactagggttttagtaaggtgggagtgagagggaaagaagccgccgacggcggctcagaccggagatggaatggaacggaaggagcggagaaatgaagggtgtgtttcgtaattttgacttgttacgagggtgaatatgtaaatttttgtgcgaccgttgcattcagttcgacggtgtatcactgcgataaaaacggtttaacccacggaattaacatcggagtacgaatttcgaaattgtttgtgccaaattcctgtgaagttcgcctgaattttgagcgatgcaaatggggctcttgtctatactagatcaatgttagagatggggctttgtaagaaccttggcagcacgtagctgcgttttgcattttgcaagagagtggcaaacttacaaacatgaatttgaggatcagatttcaactcccagtatgttattgttgccaatcggtttcttacaaaaagattgctttcggtcagttccatacaacgagaaatgttgccgatcatcagtttgcatactactcttaactaaaatcttctacaagtagttcatgactcttgaggatccccggatgcatgttcctcttccaaagttgaacatggcgcgtcggataatcgcatccgttgtgcagaacttcattgccaagaagctgtcagcactgtcacctttgaagatatacagacaaacataaagcacattacttcggggagccatagaaactccttgcagtatttgattgcatggaggtgcctgttgagtgcaggaacaacattaaaatgctaatattttgtcagctgcaagtcccaagcagcaaatactcctaagtatattgatgggacagaacctcaaacagcaagactgaaagactaatatatatatatatatatatatatatatatatatatatatatatga

SEQ ID NO: 26129 - DNA, 413 bp, Oryza sativa
ggatccccattcatgcatggcatcaaaatttctgttcaggaatcaccacattgcatccaatttcgcgcattttgttttcacactagtagaggcacgcgcacctatacgctctcataaacctacgttttttttttcacgaatgcgcaaaaggattgcgcgtcaatatattagaagaagatagtagagtttggttaaacattgcaaacgatcaggccgttctcataaacctacgtgatcaaccatgtcaatctagggttcttcgctagcacatccaacaacaaaatccagtgcaagatccacccctaccaacgcggggtagatctcaccaccacaggacgggacgcgcttctcggttaggatcggattcggagacacgagtgacacagacacacacacgaggagaaactgagaaa

SEQ ID NO: 26130 - DNA, 169 bp, Oryza sativa
gggggtcccccccccggggccccccctctttttgggggggggaaaggggaggcttgacaagaagtctatttctgtaatattttctctagtataatattactgtaaatattttttaaaaaattaaaaataaaaaaaatctattatcacccattttgtatttttttgcaga

SEQ ID NO: 26131 - DNA, 1501 bp, Oryza sativa
atcactgttttatctagccatgcctatttacctttgttatgaccttattattgttattgttattatctccttgttcaccctagaataaacaaaaccccaactagtggacactctactcatggtaccactagtatgattttaggtagatgcttcgctattttaattaggtaacattaggtggtttttcaactcttgactttgggaatattcatatcacctggacactatggaatggtttggttattgtggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatctctaggacaaatgaaggctacacgagctgcggcccggtaatcgagatgtcatggcacagggctggtgtcctgctgctaggggctcagtcctgcctgcctgtcccgggggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaatatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttccaaaatagctttgcgcaactaagtgtctttaaatgctatttactgcaaccctaaccctttatattataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagcgcctgtggtcgtcgccctagtcttccgctgtttctcgtttgtctttgtgtgtgctgggccttcgttgcccatgtaataaattatctatttacgcttccgcttgttaaactctgaattgtatcaacttttggtgtaccttgcctcctgggacaaggaataatacacgcacgtaaggaacgcccgttgggttatttccggtcgtgacaatcatcctcgtcatcttcatcatcggatagacatccacgaaggacgcatgatcgccgacaac

SEQ ID NO: 26132 - DNA, 1501 bp, Oryza sativa
tccttcagcgacgccgccacctgatggtccacgagcggcccgatgatatcagtcagagggagagcctacgtttcataaagtcataatgcgatcccggaagaaaaatgcaaaaggacagctaagtacacttacattgatggcagcgtcgtgctcggttgcccctttctcgcaaagggggacggggacgttgctcgccgttgtcgggccgctgatcatcagttggccgacgcggcgctccacggttgcgctattcaagcctgtagatcgagaacagaacccgataagccgggaagaacacgcgcataagagagtcaatttaactaaaaaggaaataccccgaggagaaacccgggtcgcgtcctctggcccagaataatcaaaggcgggatgggctcgagcctgaagcggttggatccgcctaccaatgaagtcggcagcaacttcataccccgacaacccccgttctcggaggtcgtcaacgatatcgatgaaagattggagggacggggtcaaggcgggtttggtggtccaagatggaatcttgtctggctgttcctcaggtaaaatgaagacaggatccgaatcctctatctgaagacagaaccacctcccccgccatttgctgcgagatgaggggcactgaaaggggatgtatcgcgacttcaggccatcccgaagtcggaaaccaacacacccggacacctttttggattccatccagcgtaactcatagtaaaagcggaagaggtcaagaaacggctccaccctaatgtaggcctcacaaagatgcgtaaaaatactcaggaaggcgatggagttggggttcaaatggagcaaggaaagaccatagaaattcaagaccaaaaggagaaattcagaaggcggaagaagaaaaccacagagaataaagtcctcaaccgcaaccatgcgacccaggacaggctggggtttagtacctcctacttccctctccgcggccccgcgaccgggaagggcgccatcctcctgcagtttcttcagtgatgcactggtggaggtagacttgtcgagatccatggccaccggagatcgccggagaaaggaccgagacgagttggctatggtttttttgcaggagcgaagaagacgagggacgcttggaagctggagagttttttgaataggctgacctcaaatgggatccccaaaactcccttaaatagacgcacctccgccggtgcgaattcccaggaaaggagagagatggccgccggaaatttttaggtccgttacgcgcggcagtttttcggacttcaatttaaattcactcatgaccgttgagcttcactcgacgttgtcgatcactccttgtctcttggtccccacaccgagaacaacgacaattttgacatcagaagtcgcaatcgatttcacgagttcatttaagcagaagtcgggggctactgtcagggttacgggtaaggtataccctctacccttcgatatacgtcacgtatcgata

SEQ ID NO: 26133 - DNA, 1501 bp, Oryza sativa
ggcagcggaggcggacgtgaaggcgggtagcggcgcgcggggacgggccaacagtcggcgcgcacgacggcagacatggcggagagacggaagtgtcggcgaggcgggcgtggcggagaggcgggtggcggtgtccactcgatggggaagagcggctcgtgcaacaccccgcgcacgtcgccggcgcctcctctctcgccgctctccacccctgagccaaagaaaccgagagggagagctccatcgtgtcctcctcgccttccactccatcgtcggccgccgagaaggatgcattgccgattgtcgtcaagccgcgctcgccattatctctttcctgttccatattctactcaccattccgaagatttctccttttgatttcatcctctatcgtgcagcaaatcaatgggaacgccactgtgtcatcgccggccttgggacgtgctctgcgcgacgtcgtcgtgatctcatcgccgttcccgtcgttctggaccaagtcaagccgagccaccacgccactagtatccccacaccatcacgaccaaaacccctcaagaaccgtggagaatgaagcatcatggacggagatcggcatcatcttctccaactctgactgccggctaccatcgttgattccgcctcctctggtgagccattgtccgattcctcgcgcatacaccatacctgtcacctcactaacctcgtggacgtcatgctagatcttggagccgtttgagctgtcaccgtcatcccggaggttcttaccgccgccgccaatgtccatccatcgccaagtcctcgtcgggcctctccaagccacagtcaatcttcagtgagcctcctggtaaataatagaaccacatgcatgcacgcatttaagcaatacatggtcgtaggcgcacatgcaccaccacccgaaaacgtcttccgctcggactcgccgccggcgctactccgatgtccactaaccgagaaaagtagaggaatggaatcacagtaacatgctcttcattttgtcttttggtcgcaccccgaaacgagccacctatcgccgccggcgagctcgccaagctcacggcctcgaggtgctggtagagcgcggcgacgaggaagagcgcgagcggtgaactcggtgagtgcatacgccggcgacggcgaggacggcgcacggcggagctcctccacagtcggagccagagctcccggatccgcgcggcgacgcagtggcgcttggcgaggcgccacattcggagccagagcggcgcgcaggcgcagttgctgctgcaggggcgggacgacgatgctactattgcggaggggcttgtttgtaaattggtgcttgcgtggcgtgtcacgttggcggtcagacctggtcagaggtcctttagagctcaatgagtcacttaaacaagatagtggatctaaatgtactcgtgcttttatatatatatatatatatatatatatatatatatatatatatatatatatatatatatag

SEQ ID NO: 26134 - DNA, 358 bp, Oryza sativa
ggactaaagatcgatctttagtaaaaggttttttcacccgggactaaagatagcgatctttagtcccggattggtagtcccggttttcaaaccgggactataggggggttacaaaccgggactaaaaagcacttctccaccagtgatggtgagaggttctcatcctcttatcccagccggagtcggtcctcccgccctggtcaaagctaggctcccgtttcccggtgtaataggagctcagaagtcttcacccattaaaagcagctgacatgggcacccctcatgtcaggcggcaagatttgacaggccccatcatcaagatgacgtgcgcttgcttcccaagtcaagagacaagaca

SEQ ID NO: 26135 - DNA, 1501 bp, Oryza sativa
agtcggtcctcccgccctggtcaaagctaggctcccgtttcccggtgtaataggagctcagaagtcttcacccattaaaagcagctgacatgggcacccctcatgtcaggcggcaagatttgacaggccccatcatcaagatgacgtgcgcttgcttcccaagtcaagagacaagacatgcatttaatgcaaaaacacttctccaccggagctagatttttgggcccatgtggtaaccccttgaggtataaaaggaggtccaggcctagtagaagggaggagggatccgggacgatccattttgacgctctaagagcaatctctagccccggatgatcaacaccacattttacttcaacaaggggatcttgtaatccttcactaaaggagcatagcacaggagtaggtattacgcttcttagcggcccgaacctgtataaatcccttgtgtctcttttgcctcgaaaacctcggatctcacccgctgcccccggccgaaccaaaaaaggggatctcacgatctcccgctagagagctcctcgacaagactaatgatcaaacgtatatctaaaaattaataatattatacatttaaaaacgaagatagtagaaagcaacaaagtcatttgacctacttactgatacttacccacaaatctttcaaagataccttatgtttgagatcggagtagggagtcgtaaagaaatggagaagttggtgagaaacccgatcaagctgggaactagtgcgtgccagcgtgtgggtctaaagccgcacaagtgacaatttttccagcgcatattggccactcctatcttggtcatctctgctacgtacagtacatccatgtctcccatgaacattcctctcagcttcagaacgtctgtgtagcctatactgcgtcttttagtttcagaacgtgctcgacgctaatcctgtcaatcggtggtttgaaacaaattgttcaccggattatcacttcgaattagctatttattactataaagataaattaagtatttaaataaaaacttaaaaatagcttagaagaaatgatctatgcaatgccgcctaatgcgatagaaaaaaaaatgcccttttaatacaaaacgtggttttagagaagttagtcaaatgatctactgcctccgatctaaaatataataatattactaaattagacacatcctagtgctattaatcacacactaaaatgtgtctaatccggtactctttccgtttctcttagttctagattataagtcattttgactttggccaaagtcaaactatttcaagtttaaataagtttgtaaacaaatatagtataatatttatgatcccatattagtttcattgaatcgataattgaatacctttttatattatatttgtcttcagttaaaaatgttactattttcttttataaacttaatcaaatttaaaatagtttaactttgatcaaaatcaaaacgatttgtaatctaaaatagagggagt

SEQ ID NO: 26136 - DNA, 1501 bp, Oryza sativa
gctatatccaccgtcgatccaaagcatctcaatgagcctgcacgattttactatcggatcccatcgaacgaacccgtttcaattttacgtgaaaaatgaattcacatgatccttaattatcccatacaactcggatctggaactaacaactcacataaatccagcggcagcactctactgccctgccatttgacatttctaggcggcggcaagatcgactccagatcgtcgttcctaggcggcgcgcagcgcactggctcgacggttggtccgattcagcgtccaacagggagatagaggcagcatcatgtacatccgttgcaccgatgggcggctaaaacgatgctggtaagtcctctcttgtagatcaattattaatccgcttgtgattctaatcagattaattgcttgaacaagttatcccgtcctaatccaaatcccacatgcagatcaaacgaggctttgcttgatacgaacgaaatcggcggcggcggcgcggcggcatactcacggggcaacccatcgtccatctaaccgacgacacgatcgtccccccagcggcgtcattggcaagcaagctttgggctttaccatgatggcgtcgtaggcagcgacctctcatcagcaggtcgatgcggtgattcataggtcacaacgttaatcaatctttcatccacggcattgatgaggcaagattgatgtggcagctagcccgatgctgcacaaaacggtagggatttttttttatgcattctttctatggcaattccattttattcttctgttagttcattgattaagcctctcagagcacccgcaatggtaaagtaaggtgctatctataaaacatttacatctcagcaatagactagattaatagtaaaccacttcaatggtatgtctacatggatatctatagctctctaatgcattgcctcgtttttctctatagactatctccaggttagtagatagctttactctctctctcttcatttaatctcttccaagtaggaaaatatgctgacatgtatctcttgtagagagcctatagataaccattgtgggtgccctttgttgcatgcagatggttgccaaccgccgtcagaacatgttaactccaatgactcaaatgcttacctcaaccctgcaacaagctacgtagagggtctgcgccatgggaaaaagcctttgtttggaaactgtgatttagtggcattattttgttttgaagtattatgaaagtcgagtatattgctccgaaaagaaaacagagctttgtgcttctcgtattggatattctgtttagacagaatcggtatacatgaagtgaatgggatatactgcctggattgtatgctctggtttatagtcagcatatggtttcgtttatatctagattagaatggcacattcaaacattttctattcttcatattcccatctcaatacatgctgtcttctgcatcttagagaatgtaccgatacttttgcatctctt

SEQ ID NO: 26137 - DNA, 773 bp, Oryza sativa
tccccaacttgccacattatatttgtagctatagatggccaaacaggcggcctggcccggcacggcccaggcacagccgtgctcggaccaaaatctgtcgggccgaccaacacaccgggccgtgccatgccggcccatgggctgcacctccggcctaggcacggccaaccagcagtcaggacttgccgtgccgtgccagcccgaaggcacgggtagcccatcgtgcctttttttaaaataagtctattttccctcctctttgggctgacatatatacatatatatatatacatatacatatatatatatatatacatatatatatatacatatatatatatacatatatatatatatacatatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaaatttgaaaaatttgagtgattttgtgcattagataccatggtgcccgggcaccatggtgccccatatgagtgtccta

SEQ ID NO: 26138 - DNA, 1501 bp, Oryza sativa
atgaggacccccaataactaacatactctcaatcacgagtaaataaaactgcttcctagcaaatgcactgaagatgactagatgaacacaacttctagcagaatacgcatttcagacgtcattcagatacattgtcctccaatttagaatcatgacagaagcatctttccgaattgctgacattatcttccaagctgctagcgactaaggtaaaacagcagtggacacatctacatgtcctagaaagtaccaaatcctattatagtaccatcatactatccaagccgacggaatgcaattttcaagtttcaagtgggtggcttggataagtgaagagctattacccagtaacccaaaacaaaaatataccagaagacagacatttcacaaagccttccactttggcgtcaataccacatgactgaatagatagattcatagacagtagtaattctaatcttcccccaaagtatttggcgactgtaacaagccgcccacgaattcacccaaatccacatgttaatctacaccaacacccccaaataaaataactggaaatgccgtttaattgaaccgccatgtcaccttgtaccgccaaatagctgccgcacaaaacctcagaaacccgcacagaaaccatccccgagaaggaaaaaaaacaaaaactagccaatcaattggtgcacacagtaaaaaaacctcttcggtaataagctcaaaaacggcaactcacgggtgtcctcctgatgacaatcccctcctcgatctcgccgccccgggacgccgccgcgaagcggtggtaatcgccgggggccgccgcgaagggcgcccgcgccagcggcggcggcagcggcacgaaccgctgccgcaccgaccgcacgatgtgctgcgccgccggcggacggcctcctcccgacgacatgcctccgatccgcgagaagcgcccaatcgggcgggcgcgccgcgatcaccacccccggacgcgtccgacggagctagggtcccggcaaggcgggcggcgacgaggcggggaggtggggggagtggggcggcggggttaaggcgaaaagcgcgaggttgtgcgagcgagaatgcgaggaggaaacgagggtggggggaagggagggaaatttttagccgcgttcgcgagtcgagtcgcggacgtgtaggggggaagatgtggatggatgtggatgtggactggaagaccggaactggaagggaaggcagcggggaggggcgcgggtttgagacacggcttcttcatggaggggctgcgtgcaaaatatcgcgggcgtggtagttggtgttatcctacgcccgcggctttgttgttggcggtctaggctgcgttaggaggaaatttcaccatcccccatgtaaaataaaacgattccgtataaacatacacacgcacatctaagtgctgttttgggagcttaaacatgtactccatctgtttcactaagtcattctagtattcccataaaaaaattcatta

SEQ ID NO: 26139 - DNA, 1501 bp, Oryza sativa
tctagtaacaaggacttatcgaccatttgctgaaacgtcggaaagtcgtgagccaaaagtttcacttgcagtttcgcgtccattccttttaaaaattttctgatcttctttttatcagtgtctacatcttctggggcatatcgggccaatctattgaagcgactcaaatactcgttgatgcaagaggatccttgcttgatatttgcaaattcttccttcttcaaatcaattatgctttcagggatgtgtgctgagcgaaaggctcctgcaaactctgtccagacgatggtactagcatctgtatgggtagcacagtagttatcccaccaatctgcggcaggtcctcttaactgatgtgcggcgtaaagggttttctcttgcggagtacactgtaccagatttaatttcctttccatatctttaatccaatcatcagcttcaataggctcatttgtttgggagaactccggtggacgagatcccaagaaatcattcagtttcgattggccatcatcttgaaccatatggggttgacgctcttgtgtgtgttgttgttgcatagcaattatattctgaaccattccttgtattatatgtgtttgcatggccatgtgttggtgaaagtccactggcgggggtcggttacctcttgagacatcattaactgatccggaaacagccatatgatcactctcagcttcttgctcatctgcctggttaactggttgatcgggaatttctggctggactggctcttcctcaaaaccaaagcggttaggggcacggatcttacgggtggaacacgtcccatctgcttttaagggctgagatctgcccacccagaaattgattaaaaaagaggggaatcaaaaccctacatctaaacggtttttgaaatcacagaagacataggtggtgtgttccagccggtaacccaattggtttaacacctgaacacggactaccaaacaaaactcacacacgcactagttcaccacaactcctaccgagcgggtggcggtactaaggttagcctaccaacaagggcttaactaagactcctaaaggcttgagcacacctttcttcaactgggcgtgaagataggtttactctaggataaaagtcaaaacgaacgactagcttttacttttggacacaaaagatttttcgcaaaactagagctaaaggggacaacgacaccttagctttcacaaatagtttttgtattcagataatgccatcctattcaggggtttcgatcctagggccaacctatgctctgataccatctcttgtcacaccccaatctgataccgccgtacaacggcacctgataggagcgtgtcgtaggaaaaacggcgcgaaccgcttcctacgaaaccgcgatctcggtaccagtcccaggacatagtgctggtacccacggtgacaaatatgaatcatagcaatccttaatataaatagaggacttatttaccttaacttaggttgcagctcaga

SEQ ID NO: 26140 - DNA, 195 bp, Oryza sativa
gaaaacattattgtccctccgagtttcttgattttctgggccaaccatgagtgttttcgagagaaaggtaaacatgtgccttcatgaaggcgaaacttgaagaattctgtgccaatgggaaagtttcttgaccttgatttatagactggcatatggagagatttcaaaaaaatatttgagagtttaccacagtgt

SEQ ID NO: 26141 - DNA, 1501 bp, Oryza sativa
ggattgtactttgggttcactacttcacttggaatgaatttgattctagctgctagctgagtacgtaacgttaacgtatatataccaagaatattgcaggaaaatgaagaaccactcaattgcatatttgcagtagtcaagtatatgtattgctgtatgagctgtgcctgtacatacgtagctagcgacaggcagacagacagtaaagtctgaactctgaaccactgatcaacgtctgcaaatactgtggatcacctgggagtacgactgccactgtgtctgctcacagaattcatgagagctctgaatgctacggaaattacgtggtacagaagcaagtaaacagtaatagtgggttttgtagttagtggtggtcagctctgaacggtggagaaaaagagttttgactaaaggatgacaacgattaacaatttgtccacatgcattgaacaaaaagctcataaatttcgtgctgtcaggaaatagaagtgcgtgcttggactagatcgaagcttttatggaattcaatgtgataagctatgggttgagatccacctaaatttcagaaatttttattgataagtcaggccacatcttgatagccactagtgatggtacgtagtagagagactacggacatgaaatggagcacatacaaaaaggtcatcgatccccctttttttttctgttttcaaatgatgcataagagttgctttacttatcacaaatgccaaaaaaagtgcttctttttgtgaaaaatgcttcagtacggctcgacttggtcggttcattaaaaaaaagtcagagagtggaaagatgtagcttgcttaatttatttacaggccatgagtcagctaagtataaagccgcacccatatatttgtaaggcaaaggacaagttgcattctacctcaaccaacaacaatgtttccaagtgaatgtacaagtcataaaggtgcacaattacaactgatgtgttgagagctactgtactatagcaaatgttaattatgagattatatataccacaaataaaacaaaccaacaattgttgatttgtacccagtgatacaaggctaattaaacttaacccggccaaaatagtctagtaggagtacttcacatttcctcggaccagtgacatgatcatgagctggcaataccgatggcatatcaacgacaacgagagcaactaaacgaagacgagtcgaaacgagaaacaacaaacgtagcacaatatatatctcagttctcgataataaatactccctccgttttaggttataagacgttttaactttggttaaaattaaactactctaaatttaaataattttgtagagaaaagtagtaatatttttaaccaagacaaatatattatgaaaatttattcaattatagatttaataaaactatggtgatgttgtagatattactacttttttctataaagttcgtcaaacttaaaatagattgactttgaccaaagtcaaaacgtcat

SEQ ID NO: 26142 - DNA, 297 bp, Oryza sativa
tatttttttatatataactattttccgatatatataagcctatgttaaacttattcttcatgctcacatactaaaaaccaacatttataaatcatgttttatacatacacaaagtaaccaacggtttagatattaagcacgccaaacggcgcgcgtattttctagtatgggttatagctcaggtgggtaagtcccgctatttggtttaatccttttgtttccgatatagcaggacaggtttggcctattgttgaatgttcctttatacatcgatgatgagtattgcagggaggaaca

SEQ ID NO: 26143 - DNA, 201 bp, Oryza sativa
gtgtgagtcttccttcaaggctggtaccgatggtgatggagggaaaggctgactaaggtgctagatctagagcttcgattggcagcttgtgctgtttgccaatccatcgtgctgctcgtcaatattgtgtgtaggtacactgtgcagcgtgtaattctcgcttgataccgataggtgccaagtctgatactcgtggtatca

SEQ ID NO: 26144 - DNA, 231 bp, Oryza sativa
gtgatcgccagagtatcaccgccagtcaccttcaaggactcctttaatctatcaaaaacactcttcctaggaataacccgctgctgagtagcttgagcataagaacgacaaggttgcctcaaagaatcagaaacacgtttcttacgagccacaaaaatccattctttctcttgttcacgactccaaacatcaaattcccactgccaatttggtccaccatttctccaaaga

SEQ ID NO: 26145 - DNA, 487 bp, Oryza sativa
tctcctacgcatgtacgtacgtgcagcatagctgcatggaatgtcttgaaaagttgccccccaagactcgtttcgagttttgacccctgaattgccggcgcattgtcagtagcgaaccaacttcgagagaggagctgcccctccatgctctcgatcatgcatgcacgcatcccctcccgctgctgctccctcctcctcctactcgcatccgtccggtcacttactaaaaaaacacaggaaactacgcataaactcccatgattccgaccagccgaacactttccccacaaaaaaaattgcgctgaagttgccgtcagagagtcgccttcacgaacgccattgtgcgagttgacgcgtttcttcgcgaaagaaaccaatgcccgcgttggctatatagaaagggtttgggttggcgttgggaagaagatcggagaagggggtcgttggattgggacccaattgtaagggaaaggttgaagaggcgcaa

SEQ ID NO: 26146 - DNA, 219 bp, Oryza sativa
gtcattagtaaatgtttattgtaacaccacattatcaaatcatggcgtaattaaactcaaaagattcatctcgcgatttacatgtaaactgtgcagttggttttctttttcatccacatttaatgcttcatgcatgtgtccaaacatttgatgtgacggaaaagttgaaagtttgaagaaaaaagtttgaatctaaacacggccaccatgctcaactgc

SEQ ID NO: 26147 - DNA, 1501 bp, Oryza sativa
ttctcatcttctctcccttcctcctctatctctcttatggttcgagcacggcgtcgtcgctaaggagcgtgggggatgggtcccctttcttcccctcgaatctccccgtcgcctcctcctccacggccgcatggatcccaccgccaagtcaccaaatatgtgaaaagtccttctcctctctcatctccacacctcttttgttgcctgtccaccatatcgcttgctggagttacatcgccgacgccatgaactggtacactggcacgacgacggctagggatgaggcgccaccgccggtagaggagagagacgagcgaagctcacggaggtgggggaggtggccattgccgtcatcaacgaagacgaggtcggatgcatggtgtgggaagaaggactctccccaactttggccgctccatttcattccttctcagcccgacaaggtcgttcaagcctagggcggcggtggcgtgccacacgcgctccattagcctaccacgctactcccacctgctcctctcccacctcccgagccacatttgctgccatttgctcctaagcctcctagcttgtccatgacgccttctccatcctcgccgacctcctcctcctcctcgtcctgcaggacacgctctaccacgccatcgtcgacgccttcctcctcctcattgtcgcccaccagggcttccacgaggccctcctcgacctcaactaggacatcgacacgtcatccctcttccaccccttctccagtgtcgtccgcgccctcccaccgctctccgtattcttcgccgagatgaacatcctgtcctaggactggttgttgcatgacgtcatggcatcgtgcggctaggtgaccgctcaagctcgtgatgccgccaccacccaaatcctctcctactggcggccgaccgccgcgcaactcctctcccgctagttaccgactggacgagaatcagaagcaattgaaagcaaagagggtgagtactgaactgaaggaagtggggcccaccgagatagatacgtcgttggcttatgtctctttaatcgtgtgttagaagatacaaccattagtatgtaagtttagtgtcacgcgtatagtggtgtataagcgtgccattgtattttgtaaaaacatttgtggatgtgtgagtatagtgttgcatatacgtgtacgcgcgtgtaatgggaaaaagaaaaaaaaggtcacttcctgtcaaatgtgtgaagaagaagggtactcgtactcgttaaatccagaaccatctgcagacgcaaactgcaaaagcacaagcggcgaaccgcgaagctaggccgtacgtccactgggcatccacgcaagcatattcccactcggatacgcgggccccacatcatttcaaagttcaaaccgccccgtgccaagtcaccacccccaccacaggtcaagattgacagggaccacatcccacgtggcagcatcccactcctctgacacctcggtcccacctgtcagtatcac

SEQ ID NO: 26148 - DNA, 1501 bp, Oryza sativa
aagcacctgatgtctcttagatctattacaaaacaggaataatacagaacattagcagaggtataggctacccaacccctgttcttcggatcttcaaagcggttgtcacatttttcaacttctctgcaaccatttccatctccacaacatccttagtgtgacaaagggctctccgcagcaaaagagagatgattcgaaaaggtaggatcagtggagagtacaacggcttggatctggaaatcatattatttctagtggtccataataaccagcaaacaaccacaaatacagcagtaaaaactctagattcaacttggttagaattgttaattagcaaaaagaactcatcaaaatctcttgttccccacccaaaagaatctctacaaatgcaccaagttaaagaggccatgaggtaggtaaaaagaatgtgggtggtcgatacaagtgccccacctattgacaaaattctgagcactcccagttttttttaattcttctacacactgcattttcacatctctcacacctctaaaggccattgcttcatagagtgactttgtggtgtatagtttattagctgataatcctcagatcatgaggtctggtgaattgactagtacaatctcttcaattatatatgtgacatcatactttctatgtcttcaaaagatcttataaaagataaacaactagcactctttgttaccaactttgagattgtgatgtctcgttggttacaaatctaaaaaatctttgggtatgtggtcttaagggggcaaggatcatgccagaaccatatatgtcttccatcctctagaagccactatgaccctagtttcatccattttctggtattcagaattctttctcgaattgtgatcccttttgaccattacattgggaaactcctctatcctaaagatattttttttctcaacaactcaacacacagactattgtatgaggactcaattttcataactcatttggccgatagaacagtgttcagcattctagttttagtcaagccaatacccccaaagtcttttgggaaagccaaatctgtccacctcaccatgtggtattttccgccctgtttgttaccagctagtaatacctcgccataataacttttgatgtaatccctcgaaaacagaaggtacttgtaatatcataaagtattagttttataagtttactttaatataaaatttatggtcaaagtttaaaaagtttggtaagaacttatctagtcaaatatttatggttggcggaagtaaaagaaatggtgcgcattagagaaattacagagcaagtttaacctttatggtgtaaacgtatgtactccactatacagtggaaaataaaaaagacatttcttacaataaaaaatataacgacataaatagatagtcccttcgactatttgagcgatggtagagagggccatggaactaaatattccacttgactagagcccgatcgagaggaacagaaagaa

SEQ ID NO: 26149 - DNA, 540 bp, Oryza sativa
ctatagggcgaattcgagctcggtacccacgtatgatttgtagcgtctatttaaaaatatttcaacataattaagtatttgtgcaaaaatctaatggtataattgaaacttagatcagatatataattttggagaaaaatatttaaaatttgaggaaaaaattaggcacatgtaataggagggagagggagagggagagggagagggagtatgcaagcagcaacgcaagcaacacatgcaggacaggcaagcaacgcggcacgggagcaacgcgggcgcacgacagtgcgggggagagcgttgaccaacaagtgaaatattaagttatatatggtgaaacaaaaaaaacagcaattgaaacatttaaatattttatgaaacatggtgaagatacacattgtaacatgtcgctgtcacatgtgaaacaataagtattaacagattgaaacatatgtttttcttttatcaaaatataatcatgcgatatcttgttgtaaagatttaattacaacgaatacaacggtgtgatcggatcataga

SEQ ID NO: 26150 - DNA, 211 bp, Oryza sativa
taaatttttcaaatttagacatgaaaattttcaaatctcgagctgaaagttttcaaatctcaagggagagagggaggagaaagaaggatagatagggtcatagggatgacatgtgggtcctataattactttttgtgtgaatgacaaataggcccatatagtttttaattctaatgctacctaagcgccacgtcagtaccacaaaccaagt

SEQ ID NO: 26151 - DNA, 1501 bp, Oryza sativa
tattctcatcacaagtttgacttcattcttgccaacatgacgatgtccttggcttggtgaccattaacccatggtgtcattcattagcctcattgtagtgggacctattccttttcacatctcaaaggagaacattagtctcaacaaatcggttgtcatccttcacttgatgaccaaccggttgcatatgaaagatatagatatgttcgttgagttttcattaacatcacaagtgtcatatactcgtatgcaagctcaagtgcaaagatccgatataaataataggtgaacaacatggatctagaacatgcacaataaatgtataggatttgctccccctaaatatatgcatacaaataaatacaagagatgcaagtgtatgcataattagagaatgaccaattggggtttatcctatacacataaagagaaggcatatgtagtaataatgtagaccaacataaaacatataccttcatgatctccatgttctcaatgtaaatgagactaaataagataagactcaagtaaacattagtctcacacttatatatcaataacatggaaatcatatatatgaacctatcaaaaagtaggagataagaagtggtacatatcattttatctccatgcatttcatccttgtcatgattaaggtccatcacaaaagaatgcatgtcttccacatctcattatcgggaaatgacctagtagacaacttatgcaaaagagaggttaatcccataaacatcggtttatcatctatcaccaacgtaacaattatacgaattgtttaatccaagatcattcaatcttttctctctttggtgatggataataacccgatataaacaaatagagagatgagatgaaagatgttttcaaatcaagatagaaatcttataataaacaaaatatagaataagctccccctcaagtgtacatacatatggatataaaggaacacatacgcacataatcaatcaggatcaatgagagagctcacactatattttggatccacaagagagaccaagttagaatatgtgaagtttaatacatacctcccatcatttttactttcatatccaaataagactagtcaaagaaaggctcataaaaacgttagtctcatataattagatttgtcattaatcaccgaaaccaaattaaggcacttgaacttacagcggtcagaccggccagtctgcggtggcgcggtctgaccggccgacgttttgtcggtttcagtttcgggttatttatttgggtatttgtggataattattgtttatgaattctagatggatattatgtgtgtgctaccatgagtcaagttggtgagaacttgtgatcgaatatggtttcttagttgatgcatgtgtaggtgaatcttgatgcctcgggagggtagtgtcgatgatggatccaaagtcaactcaggagaagatgacgtcaggaagatcaggatatcatgcgggatgcttagactaaagatcaa

SEQ ID NO: 26152 - DNA, 208 bp, Oryza sativa
aaagttagccaatatgcttgttgagaatcatgataccatgtttgatatacaatcaaggatgatttagaaatagtagcatattagatgaagagtatcacaaataagtcacatactcattgatcaatagtaagttatctatctcaaggaacacttcattataattctagacaaagtatgtttcacaatcatctctgtgattgcctctagg

SEQ ID NO: 26153 - DNA, 192 bp, Oryza sativa
aataagttagatgtgtaaatgtagctagaaaaacgtaagtatagactacgtgaaatggttgccccatgatttaaaaaaccaagtatgttttagtatataaatataagtgaatttgacttgtacctttgttttgatatatctgtggcttatctagtttactttttattttttattcctgatgcactaagcagg

SEQ ID NO: 26154 - DNA, 252 bp, Oryza sativa
agaagcagcataagggatgatcatcctgaacagttgttgtaatcatatctgataagaatatcctcacaactaggcattaccaaccttgcatcgtgccgtgaatcatataggtttctgcaaatacaccacagggtattttttttgtctctgattttttctatgttatatacaatatgttgctgggtttgccaagttctaatatgccattgcatttttctgaatttttatgatatactatagtcgtctggtttg

SEQ ID NO: 26155 - DNA, 1501 bp, Oryza sativa
tcaaaaaataacacaataaaatcagagaagaattcttccattttacatttttttactacgatttgattacatgtaacacaccgccaccaacgagatcgtcgccgacgagattaggttggagggagagagtgatgcggacatcactccatcggatacacacaacaatcctccaccggtcattcaaggaccgataacaagagctcgcgcgcgacaattgaatttagaggtgagctcgttcctatgttcttctttgtatgaatttgagaatatattgctacctaatgattatattgtgattaggaataatggagaggataagaagacacttggagaaggacctagagttatggaggatcaaggtggacgtccaaaccaagtcaacttcgagtgcaattcggagtccaagaccagtctgcactaaaacaggcgcataggtcacatacaagctcggattgggcgttctttatatggatggaaagctaagaagataatcttttcaatggttttggtccgacgtccaaattctttccgagtcaacggtaatcaaccaaataagttgacatccagaatctgtcccggtattgtgtcgccgtatttgggcctttaggctgtgtatcatgttggaacccattagggttgcgtcaagggttggttgcacaaccttaaactttatatatcagtacccgccattatctatagggtttgggttttgcttagattattctgtcgagaacagtttcatcgctagatcggtttgtaagaccccaacttgtgagcttaatcattcatctgcaattttggttgtattctaccttgttcttgtttgtgttcttctattcgcaaacaaggattagccttctcggtgaggtcatccgcgtttcaacacgggtgataactagagcagacgtggtgctgcgattgcggggctcaagagcgtgttcattcaagaagccggatcgatttgtgtcgcgactccgccaaaatcgttgattatcagaatctttcggaagatcgggttccctagtccacatcaagtggtatcagagctctaggttcaccgtcaggttcgctcagtttctttaccctagattagtttttgttctttgcagttatcctagagtctacagaaaagccaaaaaaaagttgtagtcgttagacaccttaacccagaccgtgtttagcctttgcatgatccttttcagagtccatagtgttgagtttgagtcctagtttaagttcttgttgctggtctaatgcgtgttttagtctagtcgtgtgttttcctttgtaaccctagccgccacctttcatccgtgtgttagggttcatcctttgagagccgtttccgccatcataaacacctatccagatcaccacgcatcaccagagcatcctacatactccgttgccaccatatcccaataccaccgctaaacagactaggttatatcccctctgaaaaacctagtcggaagccctaacttcaaacaaccataacttt

SEQ ID NO: 26156 - DNA, 1501 bp, Oryza sativa
gccgggggccagatgggaggctttggagctaaacgtatgctcgtggacaaggggatcgaaggtggatgaaaagattggatggcacagaagagaagccctgtagcaacgctagttgcactgagattcatcgtggcactgttggtggggtcatgaaaactaaggatcccatacgatatctaaagtcttcaaaccaactgggaaatgcagcgccctcagcgttttgcgctgccgtggccatcacggggtcacgacgcgtggacacgcgctggagagcggatggatttcacggccttacatgcgtccgcgtcgcctctgcaaattttgcagaaaagccctctcttttatagatattttgttatacgtcctctctgttcttttctcggtttaaaatattgcgtttaggcccttcgcatcctacgaaattcaatacataggagacaaaaagaggaaaaaaggactgcgccctgaatcctggaaactgaagggtattttcacaaaatttccttttctttctctctctctccccttcgcgagaatcccaggcgcgtaaaaaaaaggaaaaaactcccagccgccatgtccctctcatctctctcgctctctcctgcgcggcgcctggatttggcttggccgtggccgccgctgggtgtcctcccagtgccgtgaccgccgtcgggtgtcctccctacgctgctgccattctccgctcgaaggggatcgatgttgtggatgggtggtgtcctcgcagcaccctcattgccggtgctctccttgctacgccgctgccgacgcagactcgaaggggaggctctgggtgttggatgcggcagccgcgatttctttgccggcggatccggtggctcatcaatggcgtccacgccagcggtttttcctcagtggtgagctccagagggaaagggcaagctcacccaccctttctttcttcacaatttccctctctgtctgatccagatccaaagctgatgggaaagttcgatttaggacattcagggttgtcgggtgtgttgagctcggtggtggcggcagtgagaaattggacattatgccactgctaagagtgggtttcgccaaaatatcattccgccgaatggattcgttaaaatgccacgcacaagagatactaaacatttattttgccatttgaaccaattttctccatttccacccaatttcgcacccgggctgaccaaaatgccccttcgagctgcttcgttctccacctgccgtaacacctcctccggctgcgttgccgccgactgcgcggatgacctcgcggcgcccagcggcgctggcacggaccagtactctgccgtgatgcccgagaactcctccgtcacgttcggcgacgacgaggccgacaacgggtcgcaccgcagcgaaggcgacgagcccgaagccaagcgctagtgatattgattcatggcaggagtgttgtgttcaaaaagacatgtggattggggatcatatactagtgtgaagc

SEQ ID NO: 26157 - DNA, 636 bp, Oryza sativa
attaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaataataattagcatatgaatgctagtaaattaaaagttaaaaactctaattaacatacatatgaaattgccacctgtgtgatttaaaacttttaaaaattgtaagtatcacatataactagcatatacatgatttaaactttgttgaacctctaataatcgtgcgtaattaacatatgccata

SEQ ID NO: 26158 - DNA, 1501 bp, Oryza sativa
gattaatggtggctggtccatgcacgagttcatattcatgcataaacagagctatgtgtgctcgagcttggtggtggtgtgatccaagaaggcggtggtggtgctgcaggaggttgtcggcttggggttggcatgacaaaccttgtgaaccaaggtggagctcaataggctcaggggttcccaggcacccggcccaatttaaattttttgtgcttaaccctcctttttgtcatatgggaacccctcataagaaaggaaaaagtccacttagacttccttaattgttcaccgaatctaattcgttacccttaactataaaatcaggtaggacgactccctgaattattgaaactagtgtaatttgactcctccagcggttttggagggtggttttgctcacgtggtgctgacgtggcgagcgggaagaagcagccgctgcaggggctggaccaccgggtgatggtggcgctggtcaagatggtcgccgccaacttgttcctacctctgggcaatgccgccgtccgcctacccgtcgtcgctcccgccgccgtccgacgtgctcgacgacgaggtccccgtgatggtgctgctcccgtggatcgtgcactggtggagaaaccatctttcgtcggtcggccgatttccacaatagtcccggatgcaataaaaaccggggctaaagatgatctttagtcccggttcaaaagggaaacgggcatatttgatctttagtcccggtttgtgttaccaaccgggactaaacatcatctttagtcccggttcgaatgctgtcaggacctgtcaggcccccccgggatctttagccccggttggtaacaccaaccgggactaaagatcttaactttagtcccggttggtattaccaaccgggactaaagatcccggtgatctttagccccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtaga

SEQ ID NO: 26159 - DNA, 978 bp, Oryza sativa
ctcgttatcgaggtaactgaactcctcttgtttttatttttacatttttttttactctgatgcaatctctctcaatttttttttttttgcatttaggattgatatatttttcttgtgtagaattatgtcttggaatgttaatgatgatgagtgtttacagcttttgacaagtgatgaaaataataataaaccaactaaaagatatattatttgaagaacaagtaaatgcaataatttagttatctggatatttttttatgattgaaaatatagctcttgacttatgaatggtttgaagtaataatttaaattattaagcgtaagttattattataatctagattattagaagtaggctgaaataaacagatagttttataatagattactacaatctataaaccatattagtataatatggtaatccactttaaaggaatatttttagattattaggtggctaacagctaacaaacagctaataattcaaagaaaaaaattagctaacaacttataatccagtttatagtaatctggctcaataatctaggttataataattttaagctgaaacaaatacagtcttacttgtttatgacttttgcaattttgtggcaaaatggccttcgtcgtctccttttggtttggaataaaagtaggggctgaaaattgtgccaagtattcctttgataatgtcactatcacagctttaatttaactcaaaggttgtaaggttgttttagcgaattagccttcgacatccttgatgctaaggtcatcgactcatggttagagcttagaaccttcagcgattgaattattgcttgttactaacttattcagacaatagcgtgacacaattaaacaacaaggtaagcgattagtttatgttatggttttttaatttggttactataatttggttactataccaaacatatcagtccttcaattggttggtaggcaaaaaaaattggc

SEQ ID NO: 26160 - DNA, 1501 bp, Oryza sativa; identical to SEQ ID NO: 17832

SEQ ID NO: 26161 - DNA, 797 bp, Oryza sativa
  unsure (1)..(797): unsure at all n locations
acatagaaagcaaataatacaaacaggctataagactattgaaatagtaaacaaaaccatttttaatggattctttggttttttcttgatttactgagacttgaatgggcttaaacggagcacatatgaattttctatgaattttagaagattcactgagtttttactataaaagaaaaaggcttaattgaattattgcgcattaattaaccccggatgacatcagtgagggggggagcgccggcatgcgggccccacatgtcatcggctcagaggcgccggtccacggtggaccgagtccacgagaccaaaggaggggagcaccacgtggcgccggcgtggcggccacgtgggctgccacgcggacggcgatggacggccctgatctacccatgggtagatcggccggcggaggtggcatgcggccgggcgtacgcgcgggcggcttaagccggcctggcagccatggcgcacggcggcgacggcccgaggcggcgagcggcggcacacctaggcggcggcccaccggctaggcggctaggtggcggcttaccggcacgggagagagggagggagggaggaggggaggcctcttcgacgacgatcgacgacggcgagcggcgcgatggcaggacgggctccgggatgacctaaagaacaaaatgagggaggttagagaacgagagggaggccgcagcgagttagggcgctggccgaaggcnnnnnnnnnnnnnnnnnnnnnnngtgcaagagggatggcggattccggctgcggattcggccgactgaggggtgga

SEQ ID NO: 26162 - DNA, 1501 bp, Oryza sativa
tggttgcttgtggggtgcaaaattactaaaatttccacagttccgaatagaaattgaaaaccatgggtggaagtgatatgagagctcttacaaagcatataaacaaaaaggacgtaactacacagctagtggtagctagtttgtctaaactagctaccacttcatctataagaggcatcatccacttatacttcaaatacatttttctcttaaactactcatccgatctacgatccgattacaccgttgtgttcgtaacaattaaatctttacaacaagatctcacatgattatattttgatgaaaaatcacaaattacttttatgatatgtctaaattacttttagatttcactaagttacttcttagatatataaaagtaaattcaataaaacctataagtaatttatatatattatagaagtaacttagaacaaaacgaaggtaactttagcatgtcatttgaagtaaatccgttgtggagataagaacatgactctatctagaaattaaattaatcagcacaaattatgaaattaactaaaataataataaaagtaatcacctcagagcattatgaatgtataggatgtatttttatcaaatctaaaagtaacttatatatatatatatatatatatatatatatatatatatatgataatttgttcaatgaaaaaaaacattaattaaagttactttctttttgttataagttacttctataatatatgtaaattacttttagcctttactgaatttacttttatatgtctaagaagtaacttagtgaaatctaaaagtaatttagacatatcataaaagtaatttgtgatttttcatcaaaatataatcatgtgagatcttgttgtaaagatttaattattacgaacacaacggtgtaatcggattctaaatcggatgagtaatttaagagaaatttttttttgaagcatagatgataggaatattttccgtacttgttcaatagattaatagcaaccaaaactcctaaagtactagcacgtgggtgtctctggttaatactaattggagaggcctctccaattagatttaccgaaacaaaaaactactacctctgttctaaaaaaatagaaactttgaagtatgtccaaatacatagctaaatattactattatattcacagagatactagatctattgatctctagtctgggccaacaatccaggggcagaaggaaaattgggacgaccattagctattgcgagcagcccaacaaaggaggcgaagttgaagggcaagcgaaagaaggaacgtgtggttgggacgaagtagcggggaaccactccctccacctcctcaccactctcctctatttaatcaaaccatccacccaccatgcgcctcaccaccgcgacgaacacccgacgaggagaaagaaaccacctgatcgagcccgtatctttgcagccgcaggagaggaggacgagtcgttcgttgggcagcaggaggcggcg

SEQ ID NO: 26163 - DNA, 511 bp, Oryza sativa
gagtcggcctggccttcgggaggaggagggaaaacgggccggcccggtaaggaagggggcgcgggaggtgatgggccgacggcccaacaagagagaaaaagaaaaagaaaaaaaaaggaattcccagggattaaatattgcactttgattattctaatgggttaaaattatttccaaggctctgaaaattccactaaaaatcctgttagcatattttgacatgtagaacccaagaaaaattccacatgcctttttcgattattaaatgcctttattatattagggtttctctcatgcctttacacttgtaatttcttaggaccatttattaatttgatttaggcttgggagaagaacttcagggtgtgacagaccaccaccgccaccgccgtcgccaactgccatcgccagccgaccaccaccgccggtcaccctccagatccggccaagaggtgcggatctgagggccgtcgccgccacgaccaccaccaggcgccgctgtcgtctcctc

SEQ ID NO: 26164 - DNA, 1501 bp, Oryza sativa
cagcaacttttggttctataccaaattaccatttctccactgcagctagaatttctacggaagaacagagtaaattagcaactgattcagtaattctccatcagcacatgcgaagttgactccttgcttgtttcttgcgtggacacttgacagcatactaattctagtagcatcaatgtatcaccctgggattcccattgatcatcaccttcgagaaatgtttaatcgctcaagacagtggctggaatttagagccaatccatgatcgaaacaggaggcatgcgtgcatgatcaccatcaaataactgcctaattatctactctttggcctggatgaacactgaacttgtcatacatatacatagggagctgcgtgattgatcaccgtgagaaatgtacacgaagaacttaacccgacaggtgtgacttaaacaaatcaacggtggttgtagctgtaggtttgtgagcgattgttttttttctctttcctgtcttttgcatgtcaatgatagcttgattgttttttcatggcgaaccttcacatgttgcagggagagtgagacgacctgcttgccctgtagctaactgatcctgtcgagaatcattttcttcactgtgagatattgtctatgattacattttgttattttccgggaacgatggtattgctgcgaagttgacgtgtcatttgatctgccacgtgtgaatgtgctacgagttgacaggtcgctgataggtgtgtggattggccggaagaggacaatactgccatacacactctctcctttcgactcctatatactccttcagtccctgtgactcctgcatatgcttcttttgaatataggctttcacacaaaaattagaagtttggttaaaattgaaatgatgtgacggaaaagttagaagtttgtgtgtgtagaaaagttttgatgtgatgaaaaagttggaagtttaaagaacaactttgaaacctaaacacggcgatagtacaaatatagaggaatggcagaggatttggtgattgttcaaaggattcaacagaaggccttgctgtacaagtgcaaggcgttttagcattctcaactctttcaagaatataagttagtttataacttcggtgcattttgatctttcgtttcgtttttcttaaaaaaacttcagtttatgtttgtccttggaaaataaatgaatatttgacatttaagacatgatctgatcaattttttttaaaaaataaccatcagttttatatcatagtaagtttctaaaatcttataagtttatatagtacttttcaagataaatctaaacaattttttgccttttcttttaaactaataatttgagaagttactaatggtcaaagtttaaaatgtaaccaagtttcatcctaaacttaaatatttatgaccagtgggaatatcgttcatataaaaatatttttgttcggacgtcatgttttggaatcacacgttcaacttaaaaatcttgaatcacc

SEQ ID NO: 26165 - DNA, 1501 bp, Oryza sativa
cttagtattatcaggcaatgtatcatgtgaaaatgaaactaaactatgtcaccatattaatactaatccaattaatgtactagtcacattcctaattttctattttttcatagacgtggcactatgcaaaaatttgatcatttcttttcccaatcaatgtttccatccttgcaaattttcatcattaccaactccattataataatgaatggaagaaaggatatagctagacctcaacgcagtagatgcgcagtggtacaactctcatctaacttcttcatatcatgcccataagtggtctaacctgccatagttagtagaagacaaaagataattcaaaaatattatcccttatcagctactatattggaaataaagtcacactctctcaagcattttaccatgctcttacaagtgttcttacttacagaacaagagatgtaattggtggctaactgaggcactgtaggatgtgtagtgtgaaaattgctagaggatgtcaatcctgatcaagagtatgcttagcttgaaaggcatatataatagcaaggatgtgctaaatttaataatagagtagcaaagttgaataagtatactatatacttcacaatcactagcagagacacgtccctaaaactagtataagcaagcaagagtaatgaaaaaaggaacttaggatgctactctctcacgaagtctctcaagatgaaacaagaatggcacaaagacttccccttttttctcctttttttatcctctttttgtccctttctttcttctttttttttcttttcttctttctttctttttcttctttgtttttttgattgacacctttctttagttataatagcaaatacttcaaaacaagaaagacccaaagtggattcacaaaagaatcaaagatgatgaaaggccttaaaacaagaaagacccaaagtggattcagaaaagaatgaaagatgatgaaaggccagcaaaaaatgaattctggaacttgtaagggccaaaacaccttgcaaagcaaccttgttgcttcggctagggcaaacatttgatttcacaatctcgaatagcttacgaggaattttgatgtgatacgaaaaccatctgaaagcatacgatcataatcttttgaaaaagtactcatgggtcccaagcaaccatatgcatcaatggctaggtccgtttcatgttgatactgttaggaggaccaaatccgaccgaaacatgttgaatcatatatcttggcttatatagctcaatagttacgttatataaatggagaagacttgggagagtgttggtatttcttaacgacattactagaaatataattcccagcaatgacgcagaaatacttctggtatattatggttatggagttcatccgcaagcgcacggatataccattgtagcatttcacccgagagtattccaagggtatcatatttattttatcccgtgggaagaccatgtagagagaacttaaataataatt

SEQ ID NO: 26166 - DNA, 1501 bp, Oryza sativa
agtttctatttttttagaacagaggtagtagttttttgtttcggtaaatctaattggagaggcctctccaattagtattaaccagagacacccacgtgctagtactttaggagttttggttgctattaatctattgaacaagtacggaaaatattcctatcatctatgcttcaaaaaaaaatttctcttaaattactcatccgatttagaatccgattacaccgttgtgttcgtaataattaaatctttacaacaagatctcacatgattatattttgatgaaaaatcacaaattacttttatgatatgtctaaattacttttagatttcactaagttacttcttagacatataaaagtaaattcagtaaaggctaaaagtaatttacatatattatagaagtaacttataacaaaaagaaagtaactttaattaatgttttttttcattgaacaaattatcatatatatatatatatatatatatatatatatatatatataagttacttttagatttgataaaaatacatcctatacattcataatgctctgaggtgattacttttattattattttagttaatttcataatttgtgctgattaatttaatttctagatagagtcatgttcttatctccacaacggatttacttcaaatgacatgctaaagttaccttcgttttgttctaagttacttctataatatatataaattacttataggttttattgaatttacttttatatatctaagaagtaacttagtgaaatctaaaagtaatttagacatatcataaaagtaatttgtgatttttcatcaaaatataatcatgtgagatcttgttgtaaagatttaattgttacgaacacaacggtgtaatcggatcgtagatcggatgagtagtttaagagaaaaatgtatttgaagtataagtggatgatgcctcttatagatgaagtggtagctagtttagacaaactagctaccactagctgtgtagttacgtcctttttgtttatatgctttgtaagagctctcatatcacttccacccatggttttcaatttctattcggaactgtggaaattttagtaattttgcaccccacaagcaaccaaatttctcacccaaaatttcctcttttttccaaatttagttaaaatttattcgaattcagtcaaaattgttaaattttcaagtaatttcgggaaaaaagtttcaaaattcccaaaattattggaaatttcggtgcaaccgaaatttccggtgccgaaattgaaaaccctgctttcacctcatgttcttctcttttctttcacttcctaagtgttttttttattttgatttgccaaatatggtgccatgtcattgaatagcagtcttgttcaagaccaggaatgaaatgtgaatggtactgaaagttgatagaacaatagtcactactggttttatatatagttgaggggaaaatcagaccaaatgtgcgcctttttcttg

SEQ ID NO: 26167 - DNA, 1501 bp, Oryza sativa; identical to SEQ ID NO: 17829

SEQ ID NO: 26168 - DNA, 1501 bp, Oryza sativa
cgtgaaccgctgccgtgcgcccggtccaccgcaaaccctagccgctgacgcaataatttccttttccttttcaaaaataattcattattgcgtcataattctattaaaatccatataagtgttttaatccgatttaatctttaaaaattcataactaattcatcttagctcggatttagttggttcaagtctctaaatttttctaaaattgagatctacatgataaaaatatccacatgttctgttcatgcttgtttatgtgctgttttggtgtttttgctcttttctgtttagattccgacgttttcggagagtccgttttcgcaggagaagaatttgaagagttccaaggccagcaaggcaagtcacacagatcccaaacaaccctttaagcatgttgatcccatttaaagctattgtttctattcaaatattgcatttattttcgaatgtcattgggtggaatcaacctattgtttgttatagccttttgttcttgattactttattccttgataccttgggttattataacttgactagttgagctttatatatattggttcagctagatattagatgtgattgcttagccatgcttagaaacaatagcacactattgggataacttatgactcactattatttaatgatggcttaatgatagctcacgatggtcaatcgtgattggttaattaattatttgccaactaaaacttgataatggtgggttgtgagcacatggttttgagagtcgtgctcatgacaattaaggaccggttcacgagtttcggttgtgaaacattaatcgtgccaaccacaagccagcgtgggcaacggctttaccttttgtatagcatggttcattgcggggcaccagactgagaagtggcggagataagcccacgggggtcgctggggagtccatgccttgtttataagggggtgattatgatccaggaatggtgcgctgcggtggattgtgttgtgcgaggggtactgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacctctcatcatgataatagatgctataaatggtaataatttgtttagctcctggtttggaatggtatattcctggtttggagatagatctgtatagccgggtatggttgttcagaatggttgggcctatacaacagggtatgttgtatagcgttggattaatattgattaattattacttaactgttttattaaattctgaaatgtttattaaatgctgtttatacaaatgaaaccctattatgccatcctttgtgatcctgtgcacttgcatatttgctgcgtgacttgctgagtatgtcatatactcaccttgcaatcattcatcag

SEQ ID NO: 26169 - DNA, 1501 bp, Oryza sativa
aagctacaatacagatgtccctccaattaggctaagttaccatcatggtaatcattacaattcggtggttgatcctcgtgggctgacagtaggggcaggcctgggatttagttcccttagaggggtatgtcttggtccatggttatcattgcccttatagcctattctacagttgagtgtttgccaactggtattctttgttaataaatgaacttcatttcctttctgtacagacaaataacgttgacagggatcaggtgaaggctgcaataaaagcacagcaagatcagcagattgagaatgtaagtactggtaattgttttcaaggggtacttgccatctcaacatctgcacaaattaatcaggtttaccttgaattgttagagtataaaccgaaatatacttaattcttttcttgccggcaacatcaggcacttctggctgaaggacgactatactctgatttggagttgacagagaaggaaatagagcggatggtgatggaggcctcacgagcagagtatctaaagcagcagcaacaacaacttaacttcagagagtcatcaacatcaggggcagagccatcttcttctgctgcgagtaagcccaccattcttggcattggactacctggtagaccacatacagaaactttgataggtttgctgaaaccatcatgatttcctattctgcagttagtgggtcttctcggtcagctgggactgccgatagagttggcgaggagtgcttcgttctcccggacaccgtgctaacccgcagcatgcagctcctcctggcaatgggcttcaactacatccaggtcatggaagcctatagcatatttggcgaggacgtcgactcaatgatctactaccttgtggagatgggaggcaccggagcctctgcaggtggtagcaatcgcaggaaaggaaaagctgctgagtgatctgtgtacctttcaccggctatgacgaatcgaaataaaaatagttatgcataagccacaggagagggatggcaagactcgtggattaaatgagctgaaatgtcaatatactttccactgtatggagtgataacaaaataaaattcacttcttccatatgtggcctggcgttttcatggctgtcggcacttgtccacagatgtctacacggaaaaccctaaaacattgtactacctccgtcctatattacttgcttttttgagttttttaagtttttgtttgtcaatgtttgatcattcgtcttattcaaatttttttggaattattatttattttgtttgtcatttgctttattatcaaaagtactttacatatgacttatctttttttatatttacactaatttttcaaataaaatgagtttttgtttgtcaatgtttaatcattcgtcttattcaattttttttggaattattatttattttgtttgtcatttgctttattatcaaaattactttacatatgacttatttttttttatatttgcactaattt

SEQ ID NO: 26170 - DNA, 1139 bp, Oryza sativa
gtttactttatttacctacctttttctttgattttctaactttattcaaattaatctaaaaacttgtgctattaattggataagtgtcttaactccctcctttcacttgtctttagatgccgcgctacaagcctgagtacttgtttggagttgagggatttgtccaggagttgcgtacgatgtcctttgtcaaaggatttgggactgcccctttttatgcccagattcctcatgatcgtcatgaagagaagtgccgtgtcaaagtcaccttgaacagtaatagtgaagatatcccctcagtgatgttcgaagctggaggaagaagctacatccatacatgtcaggaggtggcaaggatcgccataggagagcttcacgatcgctacagtgatcagttggccgacactgagtatcgctaccatcctcgccaaccccagggaagtgaccgtggcagctaccttgagactgaaggaattgagatcgatgctaccacaaggcatttggttgagatgctgtgggctatggatgaaacccgtgcggagactgtgttagcagctcaagatcgtgaagaccggaatcgtggtaagatttgcaagttagaggacaaggtggatcgtttggagaaggaactagccgcattgaagggagaagcaccaccgcagaaggccagaattcgtcttaccgcaaggaagagagctctatttgtccctcgctaccaattggcgccaaaggtccgtgtggtggaaaaagaagttaccccagccccagcggatcccccagtcgtcaatgtaagtgatgatgaagaagaagaatccaagcacactcattccaagattgagtggggagctactcaagatgatgaagacgagccgaacgagccttcaatcaactccgatgcccggaagaactaaaatgccttgtcaagtcgttgtcttagatcgttgtgttagtttgtttgtttaagtttgtttgtgtgtgtctcgcatgtgatttacatcagtggtgggatgtaagtgcatgtgtttgtttgctttcgagtgttaggtagttggtgagttcagtggtgtgagagtcttcagttttgtaataatgaaactcacttaagatcaataaaagaaaaattaattccctgtcctaag

SEQ ID NO: 26171 - DNA, 1501 bp, Oryza sativa
caaaaaactcgatcataataagagatcctacatcgctggccggtctgactgccacataacccacagtctaaccagccacacccggccggtaaacaacaaccgttatttcacaaaaccaatcatctattatactccgaaatctcataacaagaaactaatctttcacacatataatatcacaaaccaccaatattattaacacataaaatctaagtcactacttcattttacatacgtagacgaagagcttgctgaagatggtggcgaagaatgagaaccacataagtaggcggtgcaggatccatgaaaatattgcttgcctcgctttcttactttttttttttgaccggactcttactcttactccaacgatgcagatgtgcaaggggatacaaggaggggtttgtggctatttgcataaaggcagttgtaaaacattttattgagcaaaacagtaaaactgttgagtaattaaagtaacattaaatctccactgatcaacgctacaccacgttgaacaggcccaaccaacccacctgaactacagtgtattgggtcgatttattaagatgggactaatcacggtgaatctggtcgaccgcccataaccgcgggcacggctattcgaatagttttactctgatcagaggtgtacaactgtacccacgagacacagccccacgacacgtttccgtacgccgacatgccaccacgacataccggaaagaggccgtgacaggacccttcgcataaccccctctagccaagcacaccacacctcaggtttcaccctcgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatctcgcgaaccggtccttaactgccatgggtgcgaccagcaaaaccatgcacccatagcccaccattcagtcgcattttagttgaataattacgaccatgaagcatggccagatgtctcgagcacgcagctcactctgatactaaaaaggtctaatactgtaattatcccatcaactgagctagtggtaattaagcatggctaagcatatagttctagctaagtcatcaaagtaacacaagctaggcgatttattacccatggttgacaaaggacagatatcaagtaaacatggcacaagcgagcagataggtaaaaccctgaccccatgtgattagcaaaacatgcatatttatttgcaaacagtaaaacatttgtaaattgggatcaacatgctcaaagggaatgtgtgacttgccttgcttcttcaaacaatcttccgaactcctatccttgcgaccgtgatcttccgaaacgacggattctacacgtaggcacgcaaaacgaggaaaaaat

SEQ ID NO: 26172 - DNA, 269 bp, Oryza sativa
ggtgaccgatctatcccaatcacttgatttaagtatatattgacataaagattatataatgttaatatctacagccgattgaacatatttagttctttattatttacctataactgccgatcgatgcatatatgacatcggctcaaagataaacgatatgtcatcggcacttagccgatcggctatcgtttatggatttaaacacagtttctttgcctttacttcttgttgattgatcaaatcaactggcacgcttgtatacccgaagg

SEQ ID NO: 26173 - DNA, 1501 bp, Oryza sativa
  unsure (1)..(1501): unsure at all n locations
aatcagattgttttattttcatttttttttctattctgaatttgtgttgcttagctaaatgggattattgttttcttcctgatttcatttattaatgctatgctcaaactgataatccccaagataaatacttgatgtttatgataaaatttgattaaaactttatttttatattaaaagataagtattaactcaataagtgtaatggtaaggtcaaccaacgtatataatttattttgtttaaaaactaagcatgagtattatttctcggattttttttaagcaatatcgaatcttgtcttaaacattggaggaagtatattgcaaatgccagatcatatatttcaagttgtaaaatcttttggaaaaccgcctaaaaaaataaaccccatcttttcgcctacattattagattacaagctgtagcattaattagcgactgaaaaaccaataccgaaaataaactacagtaaaaaacatcaaaatcaaccgtaaaataagatttgaaatttaattgttagatgtggttgataaggtgaagagcaaacgatggagctccttgttatgattttcatgaattccttgttaccatttgacgaggtacctcaagctagcttgcctttttttcctaataagaaaatacgagtaactctagagagaaaaaaaaaggtaattctagtttattggtaaaaaaaatatagaactggtgccactgttggggaaaaaaacaacgcaaatatgccaccttttagaacaaatagaacatccgcgctctgcaaacttttgggacctcatcttttcgcatatgcttatgcttatcagccaattacttttcatttacaaatatgtcgtttcccttgctacacacacaatttttccaagaacttggtgatacactgccttttgcaactgtcaatttcaagccaaactctccaacaaaacaccagtatggcctctctaaaatagactctctaaacatccatatggccagctatccatcatttgatttagcaagtcaaagtcgttgctcgctccaacagcctctctatctaccctctattacaagtctattacaaatgagacccatttgtcaatctctactacccttcttcctcctcttccacccccattttccccacccatactactgccgacctcctccccacaccctctccgatgcaacgacggcggatggcggtgcaataagcggcggcggcggggaggcgggctgcagcgagcggaggcggcgggggcggtggactgcggcggtggcggctgcggcgagcggaggcggcgccgcgccggtgggctgctgcgagcggaggcagttggctgcggtggcgactgcggcgagcagaggcggcgggtgcagcaagcggaggcgggctacggcgagcgaaggccggcggctgcggcgaggggaggcggngactctncccttctnctnctnctnctaccactcgcctccgncaccgcgtnctctacgaatctcgcgccgaca

SEQ ID NO: 26174 - DNA, 1501 bp, Oryza sativa
aaaggaacgatttgataaattgtgtaggggattatggtcggtgttagaatataattggccataacccttatgaaggggttggtgttacctccatagggttttttccacgttctattaagtgagatcaattaggactcaaagaaaccttggacggaagctacgaaacacgagaattgccttagctagactcagactcggggctttcggtctgactggccacctacagtcagactacagttcaccctccgatctgatgacggtcagctcatcctcctcgggaaagctccggtctattccaactctggcccaaacttgctataaatttgtcctagtactaaattttgttgttaacacatgtctgacccctgtcattttagcaaacttgtgagctgaaaagcatagaacacgtggtctcagggtgatgatttctatcggccatatgtgctttcaaatgcctagtaattaaatcattctctttatagcgtcccaacaaatcaacaatcttctaagaacaattcacacatttcggtatagacatttccaactagatgattacccatcaagccttttgcatctagaccataatggtaaaatcatctattcatgtcaatttttaatcttgaaacgattctaccccagttctgttattatgggctttgtctataacttcatatcatccgttaaacctctttctaatcttcaaaaatttcttggtcactttatcactattagtgtcccataacaattgaccgataaatcacctcaccaaacataggagaatcaaccggctaaatgatttatctcgcaaaccaattgataaatttcacaatgccttataaacacttcatccatagcaattttagattgagcggcatccaaacatatactttgaaagcactattatatgattcggcaatgtaactctttattaaacaaggtgtattggatgcttacgccaaactctccaatatatcttcttcaatcaactatcttgcttatatctttgaaaagttccactagtggaatcctcctattggtaccttgaattcataatagatcaaccgaatttcataggttcaattcggttatataatcaaatttgagctcatgcccctggctacataccacggctgcaatccctagttggactgatgttagagctatggtcattggtcatactggccaagaaaccgcggttagattggcattgaagcatcgaccagaccagccatgaggttgtggttagatcgacctgatatgcaattatctcacacaatttctatgcaatataccaaaattctgatttttcaaaagacatctaagctaaaattcggtaataaatttttcaaaaattgttggttagaacttagaaactaaagaaaaaattcagtacgacatgaataccatccttttaccctaccaccttaactaagtgtggcatattgtcagagttacggataaggtataccctctatccttggatgtatactgtatactgata

SEQ ID NO: 26175 - DNA, 336 bp, Oryza sativa
ggaaggcttgaagtcatagtagtagaaccttgagcaccaagttcccctacctggcgcgccactgtcgacgggggatacccgcagaccggatatagagggtattggggtccgttgatacgaggatatacataatatgacatcaggcagataaaagacaaggattttactggttcagaccccttgataggtaatagccctaatccagttggtatgggattatatgatggaaaccatagattacaaagggaatagcagaactcaatgatgccgacgagatcgtagtcgagttggttcgactaggtctcccgacgacttggctcctgcgcgctccgtagg

SEQ ID NO: 26176 - DNA, 1501 bp, Oryza sativa
tcgtagcttccgtccaaggtttctttgagtcctaattgatctcacttaatagaacgtggaaaaaaccctatggaggtaacaccaaccccttcataagggttatggccaattatattctaacaccgaccataatcccctacacaatttatcaaatcgttccttttacttttcagtaatgttttctactttaccctagtttcgtccatctttatcgatttacgtcataaattgttcgcctacgctgcgagagcccgataccctttgtaggtctgtcccgtaaaccttccgattcacccacgagacgggtgtttactaccatatctatctaaatcagcctagaggctgatttgatctctaaattaaatcggctccactggctggttttgctctttcctaaacccatcttgattgggagttttctagatcaaggtggttggtgactctgttaacaccgtaaatctttagataagtccgtgttaacccaaaaaggcaccaacactctccttcagtttggtaaaaggttgaggaggctccggaccgcagattaattgtccaatgtccatgacaaggaacaagaataatagcctcactctggtgcaagcctatgatagtgttgccctagacaaccattaagtttctttttgttaagcaccaaagcatctgtattgtggataggtagcagtgtagcacactctagcactcctatccctttttaccaagaccactgtagggaattaagcccccacagttaaatagcacccctatcctaactgtagttaccctaacaaaaaattagtagaattccacttgataaaaatatgtaggccatctaaaaactgagctagtattcttatagtcgtcctaaaaaaggcatgtattctagtggttgcagtgacctaagtagcacctaaaggtcataatttcaaatctccatatataggagcgaatttcagattaggcttgagggattaagttcataatttaaaaaggctgcatatatccgattggatgcatgtaaaggccaggtaaaaaaatacccttctcttaaaaaaaacgaaatcttatttgccatcctgagaccctctttcgatgggggccttaatcctggcccattcacatgtataagttaggagattgaattaaaatattggcccatgtaaaatcatcgggattgaattctccttaattaaatggaagagtgatatactcttcaactatatatgaaagtgaaccaaaagaaaattaaggagactgaaaacaacaatacagtgtagtgctcccatccgtcttagaaatcactacacagctagagcctagccagagcatgcagatttcactcatgcatacggcgccacgtatctgcccagacgccccatgctgaattcaccggcggcgagatggaaaacctaagcacagcagcatcagcgtgtgtgcacttacctgctcgatcgatctgcacctctatctctccatgtgctatatataatcgatcgatttgcat

SEQ ID NO: 26177 - DNA, 1501 bp, Oryza sativa
cttttaggttaactagaaagagttagccattgattagatagaccatatatactatcgtaactagaatatgtgttagatacgcaattttaaatgtcgcagaccctttcattagtttttctaaatttaatgagtggaaaattcgaaattaataaagaaatatgaagtcgtatccgtatgaaaattcagaatttagtatttcattaatgttataatttcaaattaataattagcaagttgtaatagatatggactctttctttaatttggtcaaagtttattaaattcaaccaaattttgttaaatttttaaataattttaggcacaaaagtatgaaaattcctaaaattttccgaaatttcggtccgaaacgaaattgacaaccctgatataagctagtggcgtagctaggatttagagtaaaggtgatccatctatacgtaataagtaaattaaaagggtggtccactatataatttttattatattaactagcacatatactataatttcaatctcgatcaaaattttaggtggtctatggcccacagtgccatctagctagctacgcctcttatataagcccgtgtaacgcacatctcttgacaatttttttttgaacgaatatctcctgacaatttgttcctgctaattgtactccctccatcccaaaaaaggtaaaccctgggtttccatgtccaactttgattgtccgtcttatataaaattttttaataattcgtacttttattgttgttagatgataaaacatgattatacattgtgcgtgacttgtctttttaatttttttaaataaaacggacggtaaacgttgggcacggaaaccaaggtttgtcttttttttttaaggacggagggagtatatatctagctagctagctatctttacagtacaggagaactaaaacgtacttagtatctctcctgcaaccagatggttttctggagaagtgactcaatgagttgatgcatgcatgttacttcgattgtaccatatgcttccgcggaaaagcagatgacacgcacagttgaatgaaggactcaatacattaccaccacagacacaggtccatccagattaaacttttttgaaaaacagaatctcctactgaacgtgggcacgtcttctactgaacgtttcatgtgtctttatttaattcgcacatgtcgatttgatcatacggccggtaatatcaacacgctgttcacaaatcagaattcaaaatatcactgaagccaaatctgccaattattaaaaactagacggcgaaagctcatggccaagcgaccattcaagcacacacccacatatgtcttgacagtttgaggcgaacagaaacagtgaataaactgctactacatgttactccacgcaagccaagtcgtcaagaatcttgcttcttcttcttcatcagagatatatatatccctctcgatcgagatggaggctggcaaggcttggagagtgtgtacgtacgcacgt

SEQ ID NO: 26178 - DNA, 883 bp, Oryza sativa
ttctcatcaaccgggagtaaagatcttttcccgctattttcaaattctttttaaacccggttagagttaagaaccaggactaaagattatagcactgcatattattttcgcttacatatgtgtttctaaaatagaagttaatgcattaacattatttaaagtacaaagattaatgacaattaggccgaaaaattatttgtgtctgtaataaattaagtggataaatcgtaataagcaaatatatgacttaaaattaataaaaattccaataatcatatatacttagcatatgaatgatattattaaattggtaaaaactctaattaagatatgtatgtacatactgcatgatttaaaattaataaaaattgtaattatcatatatacttagcgtaggaattatattaaatttaatgttaaaagctctaattaacatatgtaaatgccacatgcatgatttgaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgatgctagtaaattaaaagttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccata

SEQ ID NO: 26179 - DNA, 1501 bp, Oryza sativa
ctttttaaactgaaactggcataatatgaccataatgatggaaaaaccatgtcaccgcctcaccggtcttgacttcctaggaagttgggacgcttgtgtcgggaggggtttgcatcgatacctcaaatcaaacgcatcactaggcggtcatgtcagcctgcaggggattccctggtcggattgaggcgtggcgaggacggcgctagaggtggctgccggcgaagcgctcctaattgaacctagagcagcactgctagctactaagcttcgtagcaagttggattataggcttaaacaaacaatcggcagcaaaaaaactccgatcgggtcaatcggcgccactgttaaaccctacctattgactattcccgccgaaggcaccggggtgggggggaggagcatgcgaaggccatgacgagatagatacttacaaagggacggtgcaccaggtcaccaaccaattctgtcgacggagtcgggggcgatcgccgcggcggcggcgagttggggaggagaggcggccatggagcttcgcgtggtgagttgggtgactggtggtaccaagaaaaaacgtgcaataaaaaccaccaattaattgaaaacccatgaaaactatatctaaatttctctaagttcatgaaaaaaaaatgcagagatggttatagttttgaaattattttacacaaaatcttaaatccgatctccaagaggaaaaaaagggacaaattccatgtgaatattaccctgatactattcatccttttttttacactcaaacgaagttaaatttagacttgatatttagacataatgtattttatgactatacctatatctaatatttttttaaaaaacttttatgtttgattttcataggttttatttgatggtttttacttaatatgactcaagtatgaattatttaccagtagaactacgtagattggggtaatatgttgtttttcaaggggcgaaaacgactcagaaatggatggaaaccacctttaccgctttcgttttcaaatctttttaagaatcacaataaaaaaaatcctgaattcaaaaatggaatcgaatattatcggatacggaaacagagctaatacaaaatgacgcggatatgggaacggaaatatatcggaatataaaaatccctctaagtgagcttccaagtgtttttttttctaaaacaatagataaaatccaaaattttagcaactaacatcccagatcacttcgtcacaaaaccgagtaaagtttgtacttactgccacaaagtgaggtgcatatcttgatctctcattgtggcaatcacaataggaagtgcagaataatgcatcacataacacaatcactcacagagtgaaagtcacatttaaattgtagtatgtcttctgctcaggtccaaatcccccaaaaccacgaattccgcgtggaccgcgtcgaggaaaaaaccgaactttcctagtgtcccctccacactctcatcgcgtgcttcctg

SEQ ID NO: 26180 - DNA, 419 bp, Oryza sativa
ctgagatatacataatcaatacagtgtcacaagtgctggatcaaaatgggtagattgtgcagttgcatgcgcaaaaggcatctctttttcttcacagttttagaatagaatgggagttacagctgatcctcaaatggcctttgaattgagtactcacttctcctgaagcatacatttggaatgtttggtggacatgttttccacataagaaattgacagtcttatatccattatcccagcagataaagcgcttggaccaaatgggttcaatggtttctttatgaaaaaatgttgacatataatagctcaggactactacagattggcagctcattttcatgctggatgcacaatttggaaatcttgtagttcttatataactttggttccaaagaagaattcaccagagactgtcaatg

SEQ ID NO: 26181 - DNA, 1501 bp, Oryza sativa
aagagagtagtggtggtgttgggtttaccataagtccatcaccaactcctaaaactatgacatgtgaaacacatatgtccattctcaaaaccaaatataagtaatgataagtcaattgagtcagtttaaaattttttacagctatataaaacatctaatttcattccagaattaaactctaaattcaaaatagctttcttttttcaatgcgccgatgtgattttctatattctgtaacaacgcactggtattttgctagtattcctgcacattaattacacaagtgtatatactttgactatggatgtttaacctcacccattttcgactgcgtctccacatgtaatatttatagacactagaatttaaacctaagatagattcatatacccaacccgctactacaacccactactacaccgcaccacatcctcaactgcacactactacaccgcaccacatcctcaactgcacatgtaatatactgtacgcagtggtggatccagaaaaaaaatagtagtagggtctgagcaaactagataatgttacagtcccccctcctatctatatatggtaaaaaattttagtggggtcttcgtgggggctcgagaccccgccacccctatgctggatccgcccctgactggacgatgttgtcaaacgaatattgtaaagtgtacaaacttacttatcaaaagtgtactccctgtgtgtttctgaatataactatcttttagaattcaaattttgtgtacaaatataagcatttcttagagtcctactctcactactcagtctaatatctcccaattttatcttcaaccatcatcccacttccaagttccaactatccattgctttatttacagacactatagtttttatctccaatcttaatatgtactttctctgtcccaagatgtagacttttcacataacgtttaacaagtcatcttattaaaaaaaatataaatatcatttattttgttgtgtgttttatcataaaagaaactataatattaacttatacatttacatatttatactaaatttttaaataaggcaaataacaaacattataaaaaaaatcgatgacatcatatattggacagagggtacaataagcaatgtaaaaagtgcttatatttggaaactgatggaataggtagtcacgctgacaagtgacatggactagccatataagatccacttaataatacggcctaattaagccattagcatccgacatactcccatcacctctatccaattcaaacatctaagcgcgacacctcgcaagtcttcactaagcgagtggcatatcagcatcatctgatcatcagcaccacaaatactatatcagtagcacaaatatcagggcctccttcaggacgttcactgaaattcaactaactcccacgaaattcctataaaattcatgcgttccaaaagagctatcatagtattcatcaatacatacctcaaaataagacaagcaaca

SEQ ID NO: 26182 - DNA, 1501 bp, Oryza sativa
taatgataatatacatttttcatgcataaccatgttgatgacaatcaaaatattagaaaattggaatatcataaatataatagcccaacctcgatgatggcaactttacgatatttgctttaccaaaaataattggattattcatatgacaacattcatataatctaaaatatttttttaatttcattattgcaaataatcaaaatcctatactgcctcacatggtcaagtctacacaaaatagagtcaccgtgcactcttctctaaataacaattaaaatatgtttattttctaatattatttccatataatataacaaaacaaaagccgtgtaggagatggaaaaaaaatcgatggatcctatttgaccaagcgttcatcaatttagcatttttttttctgacagttttttcctcgtatgattttttttatagacgatggaaatatttttttctcgcatgtttttttacaaactactaaaaccttttttctagcgcgtttctttttgcgcttttttttttacatttttttcctcatgcgtttttttaaactgtttttgttttctcgcgcattttttcttttttaatatacgatggaaacttctctttttagttagattagattagattagatttgagatagagaagagatatatatatggaaaactaaaacgacgaatagaaattagacttttttgccgcgctttttccgtcctttttttttctcgtgcgtttttttacgaactgtttttttcgctactttcttatagagtcggacctttctagatgtttttttgggtttttttttattttttaccgatttttttttgtttttcactttacaggaatcagacttttttccctgttgtgggaatcggatctacgtttcttttttgtttttttttgccaggaaatggaccttttttttgtttttcctgttttaggtgggaatcggatctgtttttttaatctacatttcttttttttcgccagttatcggatttttttttgctttttcccgttttaggtgggaatcggatctatattttttgccagggaatcggattttttaggttgttttttcgctgttttttttatattgacggacggtggaaacaagttaaattttttaagagaaaaaaaagtagtctgaacataactaggtagaaatatttttcttagcaagtctattgatgctgcttgcacatataaaatcttattgctcctatatatattggtgattcaagatttttaagttgaacgtgtgattccaaaacatgacgtccgaacaaaaatatttttatatgaacgatattcccactggtcataaatatttaagtttaggatgaaacttggttacattttaaactttgaccattagtaacttctcaaattattagtttaaaagaaaaggcaaaaaattgtttagatttatcttgaaaagtactatataaacttataagattttagaaacttactatgatataaaactgatggttat

SEQ ID NO: 26183 - DNA, 1501 bp, Oryza sativa
ttgcgtggaacttgagtaagcggttggagacctagtatccacttttgtcatcttttgttagttggcttctattcacgagacgacttcgttgtgaggtgttgtagtctaagtacccttgttttatttggtcggtggtgttgttcttatgcaaggtgtgatgctaagtactattgacaatgtatgtttggctatgtacgtatagtttggatgtagaggataggtttttaatcatttttttaaaaataaattgacattttctccctctacatgtttatctatgttttgttagtattgttgtattgctctcactaagcctagatgctcgctagatataatgtatttttgcttacttgtactcccctccgtacgttcaaattttttttatgagatagaacacaacctatatacaataggatgtgttccatccaatcgaacaattatattttgaaacggagaaattgtaagaattacaagttgtcctagcatatctgcactcttccatccatcccaaaataaataaaagaaaacttttgcaaaaccataaacagagtaaaacggaccgagacgagaataagccagcggagcacacgcgcaacaagacaatttttttgtttggcattcctatcaaaatattcccaacatagcatagcttctagtggaaactgtgaaccactgaaccaccaccatagacgatagcgtttgtagcttgcttgcaacggacaaaccaattaaataccccctccgtaaccgcgagattctaagttttcaacgaaggctgtatttagttccatgtcaaaattaaaagtttgaaaaaattagaacgatgtgacagaaaagttggaagtttgtgtgtagaaaagttcgatgtgacgaaaaagttaaaaattcgaagaaaaaagttagaatctaaatagggccaaagcgagaaagcttccttgcaaatcctggctgtgtgcatatgtatcagtacttccttcgtctcagtaagttaatttttttttattttttttatttattccaaaataaatttattttaaaagtaataattgtatcaaaattgatgaaagtagaaaataattatattgaaaatagataaatgagaaatagttgcattgacattgataaaacaaaggtattttagttttttattgatgatatgtgaaagaagatactttctccgttaaaaaaataaatctaaaacgggatgtgacacattctgtacaataaatatgaacaaagatatatatttagatttatactagcacactgcacacgacacacacaccagcaacgggggcacacgacacacacacaccagcaacggggattagaagttgacacgactgtctatctggaatcctagctgtgctgcggtagcaactgtcctcagatgctgatactccctgatagccatagccacgacgcgatggggtccccatccatcctcccctcctgctcggttgttttcgcttcaggttcagtgcagtcacgagcgcggacg

SEQ ID NO: 26184 - DNA, 1501 bp, Oryza sativa
tctgttcccgtgcagtcttctctagtcgtttttcgtttgtactcctatgtttcaagatggaatgatactactactagctagtattgatgtgagttctctactatgctaactttagatgaaccaatgatttgttagtactctccttccaaaaatatcctttttttaaatggaatccttccaaaaatattagatttatttcatattttgaattagctacatttgtagttttcatgtatttaaaacttaaatgaatagataaattaaatgattaatcggaacccgatgagtcatcttaatattcattggctgcgtacatgcatacactaattgatctttgttacaccttatctccacttaaattattattatttaaatccttcacccttaagatttctaattgtattgggtgcatatattgtatttattagagtgataaagatgataataattgtttttgttctttcgattaaatgtagctgtgtcttatattcgtttcatatgttgatgaaaccaaccctctagtatatgtttcatgctcatggtaacatatactagggtattctttttaaattcctattttgtgatagtgttgtcatcaatcaccaaaaagggggagattgaaagatctatgcactagaattgccttgtaaggggagattggaatatctatgatcctaagagcgcggtgattgttttggtgattaatgacaacccattgttggaactaactatttccatgagttggtgagattaggttaagtttcagcatcaagttaaaagattgaagctagaagatggacattataccttgatgaggagcaagtgaaggcattgatgatgcggggtatgaaatggctatctatggcaaaccggtgaagagaaagcaaggctcggctagaagatggacattataccttgatgaggagcaagtgaagacattgatgatgcggggtatgaagtggctatttatggcaaaacggtgaagggcaagcaaggctcggctacaatggaccatgtggggggtgaagggcaagcaagaggcttggcgccgatggactgaatccggtggtgaagggcgagtgaaggctttgtcatgatggtcatgatggaccgtatgaggccatttgaagctatgagtaatccgtatcaattataagaagaccgcaagatggaatgccgaggatcaagaggatgtggttcttcgatgaacatcaagtcaaaatccaaagtgggcattgatcaaggcaaaggtataattgatttgggactaatatgcttaatgagtgtaggtgagaatagtcccaatagtgaaatggtgttgacatagacaaccctcaaggtgaagcaagaagatgttcctagtggtgtattagtcccaggttgcttaggagtgggctaggatgcttggagatcccccaaaacatcaaaatcaaagtggcgagaagactcggagccgagttagactagtttactttttcgctttgagtttaggaaaaaccgt

SEQ ID NO: 26185 - DNA, 400 bp, Oryza sativa
cagtagcccatcatatacaaccaatttttccttaaaactatagcgcatttagttcaccaacatataggattcttactacagcgtaagcatatttggatggccagcttattataggatcaacatatgctaatacgtattgcctgccttcagcatataaagccataggtaggcaattaagctaccacaaatgagaaaattttcataccataccagaactaaggaagttgtggtatctattcaaatcgtagaaagcaatctcatgggatctactatttggatggactgtcattcacaatttcacaattgcagataagcaaatcacttgtaggtataatgaaatgaagtgcaggctacatgaacagtacggacttcaataaaccctagaaaaaatcccccgcga

SEQ ID NO: 26186 - DNA, 1501 bp, Oryza sativa
aacttgaaagaggcacacaattttttagtaatgatttgtgccattttttatatatatgtttaaagcatcaatgatatggcattatgtacattaattacatagctaggtaattacgtaccttttatcgatcctaacaggaaaaagattattttttattaaaacaaaaacaagcaaacaaacttccatcaccttactgcaaagattgtctttttttttccaggccacgttgccaaagtagcaaaacaacgctttcaggccaatgtcatgtagctgcctagctaggtcgctatatatgacaaaaaaaaatcaaatcattaacttaccagttaggcctgtttgatataattatttattaatgctaaattcagatggatatattgcaataatatagaggaatatacaaactgatttcctttttcttttcttttcttttttttttaaaaaaagagcacctgctgtgagcccgtgactagattatgctttaaatagaatattgtgtgatttgtagtgatttctatctcttgaggatgtcttaaagggtgtgtttgtggctgcgtgcatctcttatataattgccaaaaaggaaatactgtctcttttgagagagatagagtgtgcgaccgcacatgtccaatatgaaattaacttggagaatttcagactagaaaaaaaatctctccttttctccccgggacaaaaattaacttccagataatcaagatatgatgtactataaatattaaagataattgcacaagtattggaaatatatatactagcacatacgtgtaaaatctaaatatctttaaaacctctaaatggagaaggcaagaaacagaaacaaccatctgttccctccactcctttccaagtctgtgcctaccacataaagaggcaacaaattaaaaggcatcaccaagaagaatatatatacatatagccctccacaataaaggagaaccccttgaactgtttggaaaaattgtgaaaaaagtaaacacacatatttagggaaaattgaagccacaagatattaacctcttgcttagattaaatcctttttgtaactgtacattttatataagcatctgctataccatgcacatgttaggtgaaatgttaattttagtatatttatatactttgtgcaaggtgacatgtacgtgcaggtgaaaacaaaattatcaacctcgaagtgaactattcattaattaataatactagcctagtggtgacaccacccattaaccaccccttttcaggtttgaccttttgatgctcgcagttagcaaaaagaggccactaatctctatcatggcatgccccgtaattaccccaaacacgcaggggcatttccgtccacgcgcctcccccacctataaatccaacgcgccacactattgcctcttctcatcaccactcgtctcctcttctcgcttcgccttctcctctccttgtccttgacctcccctgctccgccgcgccgcagagcgagcggcca

SEQ ID NO: 26187 - DNA, 1501 bp, Oryza sativa
ctcctatagacttgacaatatatttattgacaagtagaaaggcacaacctgatggggcgatgtgcgctgcgtggggtcgccctccgtgcggtccaggacttgagggacagagactgaacggagctgagacagaccatcatgaattcatggtcatccacgccaaccgaatctttaaacttgaaagcgaaccattctttccaataacgtactccggtgccaagcaaagcagcaggcaacgattttaaaattcgaaactttttacgttccgaaaaatagtttaaagaaaagatgattttaagaaggaaaaaaaatttacttgtctcgttaaccatcgcaagaagaaaattgaacagcgaaattggggacgtaaatccgctataattaatccaaaacttagaatcgtttttgaatctaaaccaagcataaccttagaccgtgttcggtacaactccagatcacaactcactcgcgctggatttagacttttcaaagttaaattagagtggttgtgttatttaaaaatataatcaaaataatttacttatccatgtaatcatactccgtatttctagatctataatttctagaatttaaaatcctgacctataatttctaaagttaaaaataccgagctgcaaaaactttggagccagagctgtacggctgatcacataaaacattagttcattaccggtaaccatttcctaaattttggatggattcgtcggtaggtcccggcgcgaagcgcctcgccgcctccggccaaagaatttcagcgctagccggcaaaacgcgcacccagcaacacagtattctctccgcccccaaaataatttattttttttccatttagcgcgtcctaataaaagaatctatagatgaagttagagatttgattctacggcacacgaaactaatccatttaaaacataactaatcgagtattgattattataaatttaaaaaatagatttctttacttttgatagaaacctttatatacttttttttatcatctagaagtaacaatttaaaaagtatgctaatagaaaacaataaagttataatttgaagttagaggatgggatagaagtaagactaagagtacgtttattaaatcttaatataattatttttatttattttattgtatttacatcttacttttataaactttgatatgataataattatttaaagaaataaatttattttggataaacgaaaggaggtactaatagtgaacttatttttggacggagacggcatcttttaaagagtttgtctcctctgtatatagagagatggggagaggcggggtgagagagaagcgcacgggtgattgatcttgcatccatggagtcgggctacggcttccgcttctccgacgacgacgtggtgggtcggtggctcagctacctgttcgtcgccggtcgccggcggcgctgccgtttcttggagctatgtttgattggattttggattttggatttgcaggagt

SEQ ID NO: 26188 - DNA, 1382 bp, Oryza sativa
ggagaaagaagaaggagaagaaaaagaaaaagaaagactgacaggtgggcccctgcacagtgacttttctcattttctagatttaattcaaatcctattctttagaagcacatatctcctaaaccgtagatccgattctagtgaaacttggacctaaattcatctaaattcaactcttcattttgatatcaaatttgctattttaagattttatttgaatttccttaatttattcaaatgccatttgaataaatatttgatttaatcttataattgaatttacaatttaaacttatatttgcttttcaaatattttcttttatttccaaaatgcccgttagccactaaaaagccgccggttggaactttacgccttccatggggacgtttgcgcggtctacggacctcaacgtcgaccgttggttgtaaagcccggcaaaaaccaaacctaaggtcgaagtgctgctcctgccaccccacgccttgatgcgtacagcggtcggagcttcactatcccctcgacctccattgcacgccgcacagttagctcttgagctctgtgtgatcctagccgctctgccgccactcacggttgtcggagtaacacttccgccccactaaacctgcacccacctcctattcttctagccgatatgttgtctatcgacacggctagaaatgataccaaacctagtcgtcatgctgtccaactctagcgacaactagcaaacacccaaaaccctagccgatatttatcctacctcgatatcggcctaaacaactaaaccttagccactattctatcaaagccaaccttaacccatattagccacatgcctatttaaccatatcaactatccagtatatttcctatcgtccaaaccacgagagcctccacataaaatatagagcctagccgagatactgtcctactccacagtcgactcccatataactaaaccctagctattatactaccaaaacctaccactagcaaatactagccccataatccctataccctataaaagagataggttataccttaaaccctagccctcttagtcgtttatcgttttcttattattttatggcttttattgaatttggttcttcctctttctcagtaaagactattgtcttttggatggcaacctatggtatttcgagaatcgtataatcaggttgcctatcttggatttatttgcgttggagcaaggcaagttattattcctccccttgagcataattatcctatattctatatctctattctatgcattagccattcatgattttgaatgcataatctgaacatatagcaaaccagttatatgctagcttttgcttagccctgcctagttagattgcataaaacataa

SEQ ID NO: 26189 - DNA, 288 bp, Oryza sativa
ggcttttgaataaattaaggaaattcaaataaaatcttaaaatagcaaatttgatatcaaaatgaagagttgaatttagatgaatttaggtccaagtttcactagaatcggatctacggtttaggagatatgtgcttctaaagaataggatttgaattaaatctagaaaatgagaaaagtcactgtgcaggggcccacctgtcagtctttctttttctttttcttctccttcttctttctcccgtcatcttcttcctctcttcttctttttcttgccggctacacagg

SEQ ID NO: 26190 - DNA, 1097 bp, Oryza sativa
aatagtgatgacctccaacttctccagaagcttggattccatcaattccggccttgttttaatggagcgggagcttggcgggcatcatggaaaatcggcaacaaaaatgagatgcacagcgacacccacaactagtctttgataccactgtaacacacccccgccgatgagattgtcgccaacgagattcggttggagggagggagattgatcggaggaggaagcagagaacgtgagagagagagagtgagagcagagttggggattgtgtttcatttcatttgccagagtggctacagtggagccacccggtgaatatttaacatgttctgaaatgagctaataggccacacgccacacgcacactaggcttgcaggcctcaattcattctaggcacgcaagataaacccctaactcacgcgctatttgcttaactccacaccatgatctatactgttaccggttactggtcatgatattacatgaaagatacataaatacatatgtacacctgctaaatacatatgtacacctgttagctcgctacctttacccgttcatctacttttttcttacctcgtacatgtgattttttttcaaggtaattatattaaacaatatttataaaaatacatatgtagacttcttagttatatacaaagtgggggcaaaatttttatgtagacttcttagttactggaattaaacgcgaaaggtgctccgttgatcaacactacattgaccactagtgtgttccgaccgattgcaaataatgttcgcgaagcctttcttgttctctcgctgtcaagaatctcctcgtctgggaccggaaatcaatgggttctgagttctgactaacgactcaactagtacctattcacttcattgcgctgccgtgttgttagctgtacatgcaaaatctaccagcaaaaagacacttgtcacgtctctctcctgctccgttgagatagccggtgaaggtatagggaaaattttcaagcttcgcctcgactgtttttagaaaaaaaaaaaccgttgtatgctcaatagcatgacaggtttgttggttccagatgttctagagagcgagtcacta

SEQ ID NO: 26191 - DNA, 1501 bp, Oryza sativa
ttggcaaaggacaaagttatggaacaccataaaaactcattgcaacatttcaattcaacataaaagaacattaagttatattgactgaaacataaaaaaaaaatcaagtcgagatcggggaggatatagttgttgatgccgcgtcgaactcatctacgtcggccacaaactgtgcgctcactgtcctctacgccgcgccgagctcgaccgcatccacgtggccgccgtcgtccactccgtggacctcggccaccgttgttgacgccgcagagctcggccgcatccgtgtgtccaccgtcatcattgacgttgggctgagctcggttgcgtccctatggccaccgtgctactgagctcctattctctgccacgagctcggccatcagcatggcggtggtcgcagagagcacgtccccaagcacggccacctacgacttgagctctaatcgcaagagaagcaggcaatcctcctccttgttttcaccggccagcggcgaggtagcaagagcagcctctcgctcccccgacgatgaggggaggtagaggcacatgtgtggggtgtgtggagagagaagatgggatagagagaaaagagaatgagggaatagataagaagtgggtggggagtaactgccctatatttagtgtgtgcatcggtcacccggataggatcattttcgtattagtgatgctgaaatgttatacctcaatggcaataggagtgaaaacggggtggatatttcccgcccgcccgaccgacccaaggcttgcgggaggaatatgagagagaaaatgggatatccgatattatccgagtttgaacccgaatccataaaaaaatatgggttatgatacgtgaatagttatatccgcccatatgttccatattatgaaacatatgtgaaaatctattataagttcacctataaacatgataaaagattagttaatcactatttttatgagctcacatgtaatattatataatttgttccttgatgtatcttttttagcactttaattgtcttcttacattaaatatccatgaattggacataaaaaaacccgttcccgaatccgattcaaaaaaagttatcggacactacccgtacttgattttgaatttaaaataaaatatgagttaggatatggaaatgttgtgatccgaccttacccaccccgtcttcacccctatatggcaataccctcggaaacctgagccgaggtccattcctgcattactagtatcctgagctgtctatttgcaaaaacaagaatacaacacatgggccataatgtaaaaggtcctgcataggcgggcgcgcaataaagccgagcgtcatttcctcgtcctctcctctgtcctccgttccaccacgcttttctctgcttccttctcttctcttctcttctcttcccttctccatcgttccaaaaccactcgccccgtaaaaccccctcaaacctccctcccgcggcggcgcaatcgcgttcatggcgg

SEQ ID NO: 26192 - DNA, 693 bp, Oryza sativa
tcattgattacatagggttcggggtcaatttatacccgcaaattacaaactatgcccatatcggacacgactcttatctctaacaaactctaagataccataagtctttacggcagacttttgcccaaacatatctctaagtaaattacataaaatatcctaattaatagatacaattgccttcccaggactctatccatgcgtggcaatcaccttgaagcatatcaactcaacccgatgttgtacaccaagtcgtattgtcggaatcagctgcatcaccaaaacaagtctgactcgaatttagccgatccgatcgtagccgatccggactccagccgattcttactctgttcccgcgataatccttatctttgattccgcttcgatctaatcttcctttccgatgctgatattaccaaatttggtcattaacacatgccccccaagtccggaatatttggtaatgtttcgaatttgccatacatcaactccgagcaagattcgcactctgccgtttcccgaccgttattccagtgctttaaatactaacctttgcacccgagaaactcacaccgttttcttccattttcaccgccgaagttaactttgtcctctctctctccggcgatttctccgacgcacaaggcgatccctaggcgatttcgtctccggttagatctccgcccgcggcga

SEQ ID NO: 26193 - DNA, 1501 bp, Oryza sativa
tgtacgacgacattgacttttgatcattcatcgcattaaaaaaataaatattatttattttgttgtaacttgttttatcatcaaatacaaatataatattaacttatacttttacatatttatattaaatttttaaataagatgaatggtcaaatgttacgtgaaaagtcaacgatatcgtacattttgaaaaggaggtagtatgtgatatgtcacattacaagcatgtaaatccaaatttaacttctataacttgtaacaaaaataacaaacataactatggactttaatttgttcttttttctacaattctaaaagttaaatattgatttcttgcgaattaagatatctcgcgcattaagttaatcttatgatttttctaatttttttttatgactagagtatttaagacatgaaaaacaaggagtaccttttatgccagcaaccgcaaggactaacaccttctatcatagtgaaactatctccatcgtcatcattgtgcgatccacgatggtcttctctttacacgacgagcacttgatcaacgatagcttcttccagcgactgtattggagaatacatgggatgccgagcatgcaaaaccacactgcgccgcctactgcctttaaccgggctgcactgcgccatcgcactgcgctgcctctcgccgctaacctcactgcgtgcacttggctgccacagccgctacctcgccgcctgcccggttccgttgctaacatcgctgtcgaaaccctagttgattgggatattttgaaggattcaggttattggtcaggttaagttatgcgagaaagtatatgcagaacgggctaagcacaaagatgttacttgcgtgtggtgccacggtgacagtcagccgcggtcgaaagacaattggattaattggggatatatagtacactaaaccaaattcacggatctaaatatataatttttagattcacggatataaatgacaccacttcatggcaccacttcgtaagttttggaacagatcatgtatttaggacggggagaaagtaaaacaattatccacaaatggacagacatcatcatcggtcactggacgctggtgtagtgtacagtggtgcctggcccgttcgtcgcattcacaatcacacaccataattaacaccaactaactatccaaagcttcacgagattcccccagctcttcgtgacaccgccacccgaatcgctacgcgccttgcctttttaccacctcttcacatgcacgcacggtgctaattaaaccgaacaaccacctcagctctcgcctgagatgattagcagctaacgacgatcacgagccgccgctcgttacacgttcgcgccgtatattaattagtcatcgtctctctcgtacgtgacaccgccgctatgcgagaccgactgatgctacaacttctgtccttgctccggccgccgctgccgccagccatggcggccgcggccggatcagttggaggcgacgaccacc

SEQ ID NO: 26194 - DNA, 1501 bp, Oryza sativa
ttgatgatgtggttgttatgtctaaagaaatagaagaccacatagccgatttgagaaaggtttttgagagaaccaggaaatatggcctaaagatgaacccgacaaagtgtgctttcggtgtatcggctggccagtttttaggatttcttgttcatgagagggggatcgaggtgactcaaaggagtgttaatgcgatcaagaagattcagcctccggagaacaagacagaattacaagaaatgatcggcaagataaattttgttagaagttttatttctaatttatctggcaggttagagccttttacaccattgttaagattgaaagccgatcaacagtttacttggggggcagagcaacagaaggctttggatagtattaaagaatatcttagctctcctccagttttgattcctccacagaaaggaataccttttagattatatctgtcggccagtgagaagccaatcgactcagtcttgattcaggagcttgaaggaaaagaaagagttgtattctatttaagtcgtcggctcttggatgcagaaactagatattctcctgtggagaagttgtgcttgtgcttatatttttcatgtacaaggttgaggcattatctattgtccaatgagtgcactgtcatatgcaaggccgatgtggtcaagtacatgttatcggctccaattttgaaaggaagggttggaaagtggatattttccttaactgaatttgatcttcggtatgagtcgccgaatgcagtcaaagggcaagctatagccatggactttattctttgatgggtcagtgtgcactcatggttgtggcatcggcttggttataatttcccctcggggggcatgttttgagtttgcttatactattaaaccttatgcaaccaacaatcaagctgaatatgaggtagttcttaaaggattgcagttactcaaagaagttgaagccgatgctattgaaattatgggggactctttgctagtaatcagtcaattggcaagggaatatgagtgcaagaatgatactttaatggtttataatgagaagtgccaagaactaatgatggaatttcggctagttactttgaatcatgtatcttgagaacaaaacactgaagccaatgatttggcccaaggggcatcggggtataagccgatgatcaaggatgttgaggttgaggttgcctcgataacagccgatgattggagatatgatgtgcatcaatatctgcagaatccatctcaatcggcttctcggaaattaagatatcaagcgttgaagtatactttgttggatgatgaactctattatcggacgattgatggggtattgcttaagtgtttgagtgccgatcaggctaaggttgcaatcggcgaagttcatgaagggatttgtggtactcatcaatcggctcatatggtgaagtggttgcttcggcgtggagggtatttttggccgacaatgctggaagattgtttcaggtattaca

SEQ ID NO: 26195 - DNA, 1501 bp, Oryza sativa
tggcacatatcaacatggttgttatgattaaggtggtggttatcacgtgccttgtttctcccgtgagatcgtcattgcagccaaatgaactctttcagaggtatgcataaaggcatttcttgtggttgcattcgatgtactaatttagttcttgtgtctcttgtctgtcctatgagctcatataattctcctttctcgttttcagtatttggtggcctcccttcgaaattttgcagcatgacttctttaggggctcttactgctccatccttcaaacacttcttgcatctaccattcgcacctcaagtggactacatgttgattatacatatattcttgaccgacagaggttgtaccatccaccggcatcgatgaagatgacaaatctaactggaagaggggatgacatcacgatgctggcaatacgagctgataaccttaatgttatcgcatttgcaaacaggagtgggaattggcatgcatttgaaaagtatgctgatctaatccctgaacctgtgacacgtttgaccatcggtgatgattatgcttccctattaggtaacggtggcattactaatctacccaacctaaatctcgggcgccatgctgcgttagacgctatccatcactggtggagaaaccatctttcgtcggttggccgatttccacaatagtcccggatgcaataaaaaccggggctaaagatgatctttagtcccggttcaaaagggtaacgggcatatttgatcaccaaccgggactaagatctttagtcccggttcgaatgctgtcagggcatgtcaggctccccgggatctttagtcccggttggtattaccaaccgggactaaagatcgtaactttagtccctgttggtattaccaaccggggctaaagatcctggtgatctttagccccggttggtgctaccaactaggactaaagttccacccctatttatatgtcttcttcctcctctagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttttctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaagttttacaaatagtttttaagaatttatttggtgtaatattttatgatttttgtatgaataaagatatcttataattattgtatgactgtcattattgtaagaataattatttgtgtacggtttttttttgactcatgtaga

SEQ ID NO: 26196 - DNA, 254 bp, Oryza sativa
tgtttggatatccgtgattgtttcatgattatggcttctagatggatactatacgtatgtaatactgttgtttgctactaatgagtcaagttggagatagcttggtctcggaatatggttttctttgtttatttcatgtgtaggtgacttgatgcctcgggagagtatttgcggtgatggaccgggagtcggcttgggataagacgacgtccgtggtggttagagatcatgtgggatacctaggctagagttga

SEQ ID NO: 26197 - DNA, 588 bp, Oryza sativa
  unsure (1)..(588): unsure at all n locations
cacgtgtgaatgcagatccnatgcncgcangccngcaggtcgactctagaggatccccactttagataagggcaaaaacaaaaaccctaaaaaacatggcaaaatcaatattaaacatcgatgtaggggtaagaacgaaattgcccccaattaattttggcttggtatttctcccgtatagtgttgagcgctcccaatagcaaatacatgcgtgacaatttttacaatatatgcagtacaaactcaacttgggtggaacttctctaaccgcttctgtaccgccggtctgaccggtgtccggtctaacctaagtttgactgcttctgtaccgccggtctgaccggtgtccggtttgactggagtcttaccgcttctgtaccgctggtctgaccggtgtccggtctgaccgccaattagtagcggtcggaccggcagtacctcggcggtcggaccggcagtacctcggcggtcagaccggcttcagacatattttttttctaaaaattctcaaattatttttgcactcggatatatgcctattcgatctacttgtcgtgtcttagtactggattcctaaatttttattat

SEQ ID NO: 26198 - DNA, 1501 bp, Oryza sativa
ttttttatcgtagtttattcttcaatattaatttgtaaatagctaagagcatatattaattttctttttcttcgtggatgaaccggtataataaacgacgagaagcatcgtcacttgtcaattgtctgaatgcgcacgtccataactaacgaatatactcctgtatgttttctttgtggcaattttttttttcaggaaacctatcaactgtactcttacttgccaccgcagcagcataactatacccatacttgtctacagtatattccttttctcaaatcggtttgaaacaaaaatccttgtaaaagaattgatacgattgacaccgtttctcccctgctttgagtcctatataaagcgtctgaatgacaccattgtgtatgcaggttccatgacctattcgatactagtcctacacaaacataacacgccatgtcaccgaaggtcatagccatttgccttgtagcacttctccttcccatcagcataagccatggtggtagaattgggccaattgaacccagcaaagcttccagtaaggtgaaggaaaaaaactgtttttctttcttttaaatttagtttcagttgtacatttgatatcatgttgcatcacgacatgttttcctttgataaatttgcatgtacgaagtagtgtaatttgattaattgaacgtatctttaaccgattttttaccatcatgttgtgggtatcgtggcacaggttgtggagaggggaaactacgatggtagagtggaaggttgcgaagaagatgattgcctagtggagcgtttgctcgtggctcatctggactacatctacacgcagggcaaacacaattagaagcagaggagtagatgcacgtttgcaatgagcaatccatgcaagaataaaccgccgagcagaaaaaagaaagcgagcaagcttgacgttagatgataatgtgtgtacaacctatatatcatgggaaaatagagccgctggatatcaggaagacaggaaggagcctgatatcaataattatgaagaaatatgagcacactccggaaatggaatcaagtgcgagaaggcgtccagctaagctaataactgagctaggcgcagttctctgagctacccattgtgtttttttctagagtggagaaagtatatataaagtttgtatgaagtttaagtgtttgtatgtatgtatgaagtttgtaaaggtaattatgaacttatgttgttcgaaacttgtaacattgctggttttacgctcacatatcaatctctgaagatgtatgtaggctgtagtgttcaaagaactttaggctgcgttcaagcctaaaacttcggaacctttttctctctgtcactaaaaccggatggctcattaacatataattaaagtattagctaaaacctttcttaaaataatgatttttaaagcaactttattacataaatttttatttgcaagaaacatactattaaccgtttggaaacgtgcacacagaaaatgag

SEQ ID NO: 26199 - DNA, 1501 bp, Oryza sativa
ttaatttgggacaatttcgttgttgccccctactttgatgatgtctaatattgattttcgttcttacccctacttttttttaaatgaatcaaccgttttcctctgttctgttaattcttgctaatggtgttaaatgcggggtgtaaaaagataagtatacccttcaatactttcccgtacttttgacataatcagatctattgatgccatagcaataatttagtttgtcaaaattttgtaaaagttagctaaaatttgggttaaatttgaaagtggtgtacaaaagtaccggaaaatatctaagggtatacttgtccttttcacctcacatttaacaccgttagcaagaattaatgaaataggggcaaatggcttattcgtttaaaaaaaatagctatttggtcgtgcgttgcacgactttagaagcctttataaaaagcccaaaatatatacacactataagtatgataattactgtgtctactttaaatttgaacttttttgtaaaatcataggatcgacatgataaaaaaatagttaaatctagatgaacatatattttgaacgaaaagttcagacgttatattcaagatcaggcctctttgttttggttcctcaacaatgctcattctaaaattaaaatataatttcacaatgacttaaacatatatctatactggaaacagacatataaagcaaggccttgcgaattatcaaaaataattcatgcaagataaaatcttggaaaaattcatgaaagtactaatcaatataatcaaatcactgtaatttttacctaattttatatgtacatttgttacatcaaataaatcggtcaaagtagtcaaacagtggattagttataaaccttaatcagctaaaacctaccatcaccaaaatgtgcattacactgaatacaagtgtataatggaactaatttattcgaataccaggttaattataatgaataaatataatttttgtagaatttatttcctcagtttaaaccaactaaaaattcatctgcctccatccaccctattttagcatgcccacaaattaaactacagattaacaaagagagagagaaataatcctgtaatattctagaaactgatcttcactcaatctctacccatactgctcaccctaaccttgattccatcggtctccctaccattgattccatcggtctaggcccactagaaagcccctctgtctcgctccacccttgtccacttttcttttccctcctcctcagcccagaacaccgagagagtgagagagagagagggaagaagggacaccgcagagcggcagagcgccgacgacgcgtgggcatgaggtgtcttcgaccgagcgcttcaccttgctgtaacatcccggcctagggcttaatagaattaatagaatactcatatcaacaagttgcaacttcttttccggaagctaatctccaaagaactccggggttaagtgtgcttggcctggagcaatttgg

SEQ ID NO: 26200 - DNA, 287 bp, Oryza sativa
ggtttctaaataaaagtatggttatgaacggtatggttttccctttcttctcaggattgaatctttgaaatatgcatgaatggttagctttgaatgaacatttgtactgctgtattatactattaacaagtgcaacttttcaataatgtgacttgggatttagaaattaaggattaaaagtttgcacagaaaaggcatagagaagatattggtagcatttagctaactccaatagagggatggttgtgcaacctataagagagtagttaaaggaaaattggaaatta

SEQ ID NO: 26201 - DNA, 1501 bp, Oryza sativa
ccgcaagcctcttggggaagatcaacaccaatgacatgtacaagttgaagaagaaggagatggaggaagcctcaccttccaagaagtgcattgctctccaagccgaagttgaagacaagggcaagggcaaggtgaatgaagccaataaggacttggaggaagagattgcccatcttgctagaaggttcaatgatctcttgggaaggagaaaggagagaggaaggggctccaactcaaataggagaagaaatagaagacccaacaagactttctccaacttgaggtgctttgagtgtggtgagaagggacactttgcttccaagtgcccttccaaggatgatgatggagacaagtcatccaagaagaagagtggaggctacaagctcatgaagaagctcaagaaggaaggcaagaagattgaggccttcatcggggaatgggactcaaatgaggagagctccgcctcatccgggtccgaggaagaaggtggtgatgatgtaaagctccaagaacaagaagatggccgttgttgccatcaaggaggctccacactctttgctcaagggctcctctaaggtaacatctcttagtgatagtgagggtgatgatgattgtgatgatgtttcctatgatgagtttgtgagtatgtttgaggagctccaagcttataatgagaaggagattgtcaagttcaaggctctaaagaaggatcatgcttctttggatgtcttgtatgaggagctaaagacctctcatgagagactcaccatttctcatgagaagcttaaggaagctcatgacaacctcctttccactactcaacatggagctcacattgatgttggcatatcttgtgatttgcttgatgatagtgctacttgccatattgctcatgttgcatcatctagcattcctacctcttgtgatgatcttgtggatatgcctagctctagctctagctcttgtgtttctatttgcgatgcctcacttgttgttgagaataatgagcttaaggagcaagtggctaatgagacaagagtttggagaggtgcttcaagggtaagaacactcttgacaagattttgagtgaacaacggtgcatccttaacaaggagggacttggattcattccaaagaagggtaagaaaccttctcaccgtgccactcgttttgtcaagagcaatggtaagtattgctccaagtgtcgtgaggttgggcatttggtgagtgatttccccgatggtaagccttctaagacatgcatgtttgattctcattatatgcttaggaaggctcatgatggtagcattgttgctagatatgtgggttcccctatactcagtggtaaaaagaatgccatttgggtgcccaaagctttggtctctaacctccaaggacccaaacaagtttggatacctaaaagagcttgatcttcttttgtaggtgaactaccgcaccggtgggagccattgggtgcttgatagtggatgcactcaacaca

SEQ ID NO: 26202 - DNA, 236 bp, Oryza sativa
tgcagcccgtctattttcgctggcggtcacttaagtgtgccgccagcgaagatggataatttttgctagcggtcgtgttatacagaccggtagggaaaatgcaattattttttctggcggcccacttaagcaaccactggcggtagaaggaccgcttgcatagatggaccatcatctattaatatagaccacgcggcccaccaccaccaccaccagtccaccacccacccgccccc

SEQ ID NO: 26203 - DNA, 1441 bp, Oryza sativa
agaaagtcttacaatatgaaacagagggagtattgaataacaataatagttttatttttattccagagatatcatactgaattattttttatttattttgtatttttcatgtatcaacaatcttatagagatgtttttatgcttttgatagcatttggcaattccaaaaatcccatgtcagactttttttgcaagttcaaaaaatgattcatgatcattcttcacattcagtcggtgaactgataatcaattgttctttcatggattattaaaacacttaactaatggtagactgattcccttttgtacaatttgctgtgcaaataattgttgaattaccgagttgctcctatgactttttcactgtgccaaaaatgattttgtgagcacctgcgggtgctggtcctcttgaagatggcaacgctatttgtcgatctggccaaattcaaggtgggtctaactgaatgcagaccatactatctctaaaagtgcctttgagcctatagtaagccaacttataataacttatattaaatttggaatgacagtgttttctttttgtgggtttattggcccgagtgaaatctagccagatcaaggccatgtgtgattttggtttctaaataaaagtaatggttatgaacggtatggttttccctttcttctcaggattgaatctttgaaatatgcatgaatggttagctttgaatgaacatttgtactgctgtattatactattaacaagtgcaacttttcaataatgtgacttgggatttagaaattaaggattaaaagtttgcacagaaaaggcatagagaagatattggtagcatttagctaactccaatagagggatggttgtgcaacctataagagagtagttaaaggaaaattggaaattatgtgtataactctgctgcttttcgatgtcatcgatacatcagaaagtaagaaagatgaccaatggttgagatgatgaacagtcattctgtgcatggtttcaaataatcaattattttcaagttatacaaattttaatttgcaatgcttttaaatcctcttttagaggaaccttgaagcagcaatgaggtgacatgcaaaatgcattttgcaccagaacaccttgaactaaaacgggataaatttctgatggtaacactaataggatgttaatttatatatttctcaagatactgtatagtaagagcaagtctccacatttcagaaaattgtgctttccttgcaacaaacggcacttggctagtgtacatctaaaatatcatttctagatcaccatctgtatcgctcgtttagtatgattacaacaatatgcaatttcccccagcaacaaacacaaaaatttggcactgatactactatatcatcctggtttcttctactgttctactcctaggattcaagaaagccaaaagaccgttct

SEQ ID NO: 26204 - DNA, 1501 bp, Oryza sativa
acatctacctttgtaagtgcaattcttgaatttgcaatgtgcccactcctgtttatagatcttaccattctcatctatactcactttttccttgttgaagtactgccagacttctgatgtcaattttttccttttcacaggacgctcatcattgtcatcaaccctattaacatcagcatcaatctcaattgtttgtgaggtacctgtggcaatggttggaggtaccgctgattcaggtgtagatgatgatgcagtcacacccacatgatgacttccactggcacttccagatgcagcagattgagattttaaaaaaatgaggaagtgattaacgattaacacaaggctcaagctatacatctaaaaaaaacatgctcaaggattaagctgtacatctacagaaatcgtgcttgcacacatcaacagaaaatcatgctaaaaaacatcaaggctcaggcattcatctatacatgtaaaaaaatcatgctcaagcattcaagctatacgcctatacggctatacctggtggtggtggtggtggacctagcaaacacaacggtggcgaactcaatgttcctctgtctctgttgttgccgtcggatggatccagaagggtgcggcgttttcctccggcaggtgccatcttgcttctccggcaagggacgcggcgaggcgcgaggatgcgacggctaggactagcaagcggcggtgtggcggcgtggacacgtggttgcggcggtggcggtcaccggaggtagaggcggcacagagctgtgcgacagtgtgagacagcgagagtcgcgagacagggagagtatgagaaggataagtgacacgccggctgacgccctagggtttttcttcccagcctaaatgcctaatgggctgctcctgctccagctatacaggcccagccggcttccttctttagaagtttgtcgaaaatttgacggaaattaccgataaaaatggttaccgacaaaacggtcggaaaaaagcccatatcatttctactaccattttcggaagagattactgttttcatttccgataccgacaattactgataccgactgaaacagtcggtgcaaaccggaaacggtagccggaattctcggatatttctgtgccgttttcacccctaatctatacgatagttgattccttagttctacttaaacaaggggatatctgaaggtataaatacaaggccccctagaaagagagggacgaaatgaaggcatatctacataaatccaatgtagaagccacaaaaaccgacatgagggatttagagctaccttcaatctcgccgagttcatattagaggaagaagactacactagccatcaaccacatgtgagagctccatgccgctaggccgatagggattagattaggtcatcccatattctgtactcgtgagatattaatatacaaaggcaacattggctttgcccaacaggaacagggctattacccatcaagtagtgggtccgaa

SEQ ID NO: 26205 - DNA, 1501 bp, Oryza sativa
gtcctagcatatgctatgtacaagttgaagactagtatatttgttgtcaaaaaaaagaagattagtattttaacaagaggacataaaagagaaataacttttctctagctatatataaaccccttcgatcatccatttataactaacaagctagacccctcaaatgtatgtctaaccatgcacatatggatatatagataggggaatgatgtagcacgggtgcaaggatatatagttccatgaaaggtttgatatctactcgtactaggagggtgacagaagagagtgagcacacgtggttggttccttgcataaatgatgcctatgcttggagctacgcgtgctcacttctctctttgtcacctccaccccttttatctctctccctccctctcatactttatctaaattatatctaatttctttgtattggaataacataactacacccttcgtaattcctgactataaatctaggtatggactattgattttttttcttgacggaagagtatgatttatatcttcgtctctctctctcataactcctcctcccctctccgttggccaagtgagagacggcgggtggagcagcatccggtgggcggcattagcggcaggcggtggcggtgtcggctcccgtggcagatgcggtgtcggtggcgtcagcggtgggcagggcggtggtggcggctgccgcggcggatccagcagtggcaggaggcgcagtggcaggaggcgcggcgtcgacggcggttccttcggctgatcagggctcccgtggcgtgcagtttgggctatgtgatttggggatgtttttttggatcgatcgatttgtgctatgtgaaattgtgttttgtaatttgtgttgtgttgatggatggatcgatggtggtttgtgctgctttggggatgtttcgggatcgatggtggtatgggtgtaatgagaagcggctcaattcgagtcgatgcatcgagctgtttttttattcctagaatctcaaaggtgccagttcctagaccagcacctttgagtcctcgaaggtgtcgcctgttgggtgcttgttgggaaatccaatacccaataaccttttttgagtagtgtgataatcaaactagcctcaacaatgttgaaaattagggatctttcttcttatctcatgctcgcccctaaacaaaaataaacatcacctttaaattatcatccttgtttttatagtaaactgaagaaaaccccacattttatagtttaagttgcagaaaaccataggtatcactagaacggataccctcatctcaatcgggcggtaaaccccatctcaatcgggcatggcgtccgtcacaggctagaagtcactgatgtgaagagctatctcaatcgggcaaacggccgttacggatgattctatctcaatcgggccctaagtaaagcccgtcaccgatagttttgacccagacgaccagtcaaatctcaatcgggtcacaactagcgcctcatctg

SEQ ID NO: 26206 - DNA, 501 bp, Oryza sativa
caactttgttgttgatgactttttcacttgatatcatttagtatttaaaaatgttgtttgaagttgtcatatttccaaattcaaattcaaatggttcaaaaaatgttatatagaaaaatgaccaaaataaaagttatagattttgatgagttatacaactttgttgttgatgactttttcagttgaagtcgttcactgatctaaaattctatttgaacttttcaaactttgaatttcaaatttcaaattgtttaaatagagtcagatggagaaatgaccaaaataaaaattttgcacctcgatgagttctacaactttggttttggtgacttttccatttgaaatcatttaattaccccaatttaacatcctggcctagggcataataggattaatagaatactcatactaacatgttacaattacttttctggaagccaatctctaaagaactttgacgttaagtgtgcttggtgtgcttggtctcgagcaatttcggga

SEQ ID NO: 26207 - DNA, 1501 bp, Oryza sativa
tgttctctctccatttcagatccatttcaggttataagatgttttgattttagttaaagtgatggttataagatgttttgattttagttaaagtcaaactactttaagtttaactaagtttaactaagttaagtttaactaagtttacagacacatatagtaatattatattaccaaattagttttattaaattaataattaaatatatttttataataaatttatcttgggtaaaaaatattaattttttctataaactttgttaaacttgaagcagtttaacttcgaccaaagtcaaaacatcttataacccgaaatggagggagtagttgctataagccgataatcattacgtgttcaatgatcgtgcgaatttgtcataagtgtggacagataactaatatgaccgcactagtttttttgtttattcggattttggtgcggttttaatttcatccgtgttgcgtttctggtttggtaaatttggaaatttagttttcttggccttttttcgaatgtatgaattgtaccaaaattatatagagctcatacacagaaattactacatcgttttgtaaacactgacctcggggtactatttgttgggaaataaatttaagagagataagtttattgtgcaccaatctgaatctcagcataaaaataaaattcaggcaaaatttactataagatatatatctaaaatttatgatctttgttggtggactctgtaagaatgtggcacggctttaacacactttaaaaacttggtaattataacgccccacaaataattagagaaaaaagaaaaataagaaaagaaaagaagagataaaaaaaagagcaaagctagcagaccagcagcagcagcaggccttggccggcccatacaagcaaaacagcagcaggaatttttttcatttttaattttttttaatatttacagaaataatctgtcggcgaaaaaaattacaagaatagaccttgacgcccctacagagggcggtaagctgacgtggcagacgggggagggacgggcggtgacggagggaaggttttttgcaggaaaacccttgccgccccaacagagggcggcaggcctcgctgcctataaaaggcctgccgcccctgcccccagccctcattcctcccctcacaactccagttaaaaaaaaaagagaagggggaggagaagaaaagaaggggcgaagccctgctggattcagacaccgatttcagataatattcatagatcctatatgtgactattaagttaactactgtgtattttttaaaactttgtttgaataaatgcattatatttttagggttttagttgtactaatctagaactgcgtattgtagatatcggtaaatacgtagatctactagtttgaaatcaatactttaccattacattggtgtacatgagaagatattacgttgtaggtgtttattgcatgaaaaaataatatgatctagttatttcattgacagata

SEQ ID NO: 26208 - DNA, 1501 bp, Oryza sativa
ggatctgtacgcacgtagaagtcatggcacttgcgccatgctgctttgcctgcttgctgtcgagtctcgcacgaaatcgctaaaaacagtctcgcagccctccgcgacgccgcgcccacgccaggtctcggtttgtcgaagaggtcaggtccccggaaaagctagcgcgcgggttggcggcgagcgttttcggatagtttagcctaactaagtgaagttattagtagataataatggtaattaagatatgattatttttcgaaagatttttttttgtactaaccgattgaaaactttcaagtttgatttgaaaatctttgaagtcaaattttaaaaaatttcaaaactcaatttgaaaattttcagctcaaaatttaaatgtgtaagacaaatttagaaaactttcaactcagatttaaaaacttttatctcgagatttaaaaactttaaagtacagatttgaaaatttttaagttaagatttgacaaaatatgaaaactttcgactcagatttaaaaactttcaactcaagatttgaaaacattcgactccgattcgaaaacttttgactcaagattcgaaaaatttcaactcgatatttgaatactttcaaatcagattaaaaaaatttcaagttaagatttaaaaactttgaaaaaaatattttgaaaaatataagtgtgctaaagactaaaaaaaagtaataaaaaaactaaaaaaaagaaaaaaatcgcaaaagaaaccacgaaaaaacaaatcgcgaaaaaaaaaagagcttatgggcttttctgagccagaagcagctggcgcgcggcaactagtaacgccctcgagtctcggcggcatgggcatggcacgcccatcacttattcgcagcgaccattcgctactgatcgccgcgcacgcaccgcgcgagcggacggacgacaggtcgaggctataatggatcggaatatgggaggctctggcatggagcccaacgaaaaagaaagcaaggcccatagcaccgcaccgtaaacttgaccgagagaacctggacgaaacccaaaggaaacccaaatcccggtaaactgatttgagctttctggatgaaataagttcatctgaggtcttttaacttgtcaacgaatccgatttttatccttcaaccaaaaaaatcagatacaacgtatccctcaactgtcaaaaccagtgcaatataggtcccatgacggtttggacggcggttttcgctgacgtgacgcccacgtgactattttgactcggtcttcacatgacgtggcaatgacatggcgcttacgtgacaatttgatttggaaaatattaaaaattgcagatccacatgttagtttacacaaaaaaaatagattaaaaatggtgggttctcaccctcctcttcttcctcctctctacccaactcccctgtattcactctctctcccctctcctctgtcctctccgacggccgaagagagatgcggcgcgcggcagccgggcgagg

SEQ ID NO: 26209 - DNA, 1501 bp, Oryza sativa
gtagggatatatttcacctgattttactttcgatggacaacataaaggataaattgtcatcaacaatatcttatcgttaaggtgatcgttgtctactacctccgtcctataatataagggattttgggtgggtgaatgtgtgtccagattcattgtactataatatgctatatccatccaaaatctcttatattataggacgaagggagtacttatctagattagagtgacatatccacccaaaatcccttatattatgggacgaatgaagtacttatctagattagagtgaaaattcgccgacacgttcaattcatcgcttgaacgggctgcggttgatggcacgaggaagtgatcacatagactcagttatatttgaattttataattaacctataggttaatttatccctccccctaaaaaagaaactctagctagagtttctttttctgttgatttatccctccccctaaaaaataatttttggattgctaatagtagaaatataaaggtttaccttaattaaaaattatttgtttgttttttttggttaataggttataaatcagccggtgagactcgaattcttacgaaagatctcagggaaccatgtcccctgaataataatgccacggtaactttctcatgctgatccattggtgaattcctaaagtctcggtacaagtttgatgaacaaccaaggaaattgaaagaaactatatttttctatatactaggtgagatccgagctttactacgaaatgcatatatagatgaattggtgttaaatattataaaataatggatggatatatattaaaatatttgtggaaataatgtgatcaaaatgatttggcatacttatacgagtcatgcttgcatgagatgagattaaaaatgctattgttttgagactattgtcatccaaacttataattaacatttaacatcatagatgagcttaaatgaaaaatttgtccactccaaaattgtatatctcgtctatatctacaactttcatataggttttatcttcatctgagattgtttagaaaatttaaatattcatttatgtaaatagatccgagacattaaaacacagtttcggatatccaaacgaccttcaatcaaaaagtcgtctactataaaattgtaggtctcatcaagctctacaaatttgatataaaatttatcttcatccgactttatatgaaaatgttagataaaaaatacacatatatgagttggtgtcatcataggtgtcatttttaattataaaccggaagaaccagcacatatgtgatgcatatatatactgattcatgataaaaatcgatacctatgacatcacacttatatgtgccggtttttgttacaaacttgtaccgagtgattataggtaccgatttattaattttatacttgaaaaaggtgaaattagttttatacttgaaaaaagtgaaaaaaaaagcttcatgggtgtccttttttggtaaaccg

SEQ ID NO: 26210 - DNA, 1501 bp, Oryza sativa
atatcaaacttcagatattttgttcggttgaagagctatgtgcgtaatcgtgcacatcccgaagggtctatagcagagcggaagaatgtttaacattctgtgcaagatttctcaaaggggttgataaatctagtctttccatgcccacaaattctgaacaaaaaagtatttgtttgatagttttggggaaacaataggctctgctcaagatgtgaagtttgatgcaaaaacacttactcaggcccatcgttatgtcttacgacatcttgatgaaatagaggattttcgtaggtatagtacctaactgaacattacctttaaaaaataaaatttataaaataatataaatatgctatttgtagagaatttctagaggaggagaagagaaaacaaaagaagtcagttttcacttcttttgaatctgacaagttgattaatgagcgattccatgattggctataccacaaggttagtataagttaggcaaaacaagtcagatcatgcatgtacttatgttttgtaaaattaatatgcctaatgtttaaaacccatgtttttattggttatgcttaatgcttgtggtcctgatccacgcatcacggaaaatatcataaaaatagctgaaaaaccgagtaactatggaaggagatttggtagattcttaattaatgggtttaaattccatactatttctcgtgagaataatctgcaaacttaaaacagtggtgttgttaatatatctgaaggtgatgccatcagctattatggccgtattacagacattatagagctgaactataatggagcatttaaggtcttcttatttaagtgtgattggtatgatgtgcaccatcgcgtgggtacgagggaagatgagtttggttttactcttttgaatttttcgtggggtatacacattggaaataagctgatggacgatccatttgttttctcttcacaagttgaacaagtattctatgtccaagatttgtttgacatgggaaaggttggagatgaagatgatgagatatgagttgtacatgatatattttgttgcatttatttgctgaaggcattagagttttagttatttacattcaaatatatttttaatgtatttgtttgttcaattgcttggtaatttctataagacacttccatttagtaactggagatatggagatgtgtgatctagagctatgtgtggtctcattttgtcattttaactggtatgcaatggttgtcttgttacttatatctttaaaattctaatccatttttaaatatagtgtgaatggctgcgaggtcccagacactacagggcttggatcttttgcagaatggagtgcaaaatcaagaaatagatataccaaggaatgatcagtatgttgaagaacagaacatatcaaatgagaattggtgcacaaactgccatgagtatcgtaagatatattgtttatttttctgcaaaattgtttcttatatactaacttttaaaact

SEQ ID NO: 26211 - DNA, 644 bp, Oryza sativa
tttgtttgacatgggaaaggttggagatgaagatgatgagatatgagttgtacatgatatattttgttgcatttatttgctgaaggcattagagttttagttatttacattcaaatatatttttaatgtatttgtttgttcaattgcttggtaatttctataagacacttccatttagtaactggagatatggagatgtgtgatctagagctatgtgtggtctcattttgtcattttaactggtatgcaatggttgtcttgttacttatatctttaaaattctaatccatttttaaatatagtgtgaatggctgcgaggtcccagacactacagggcttggatcttttgcagaatggagtgcaaaatcaagaaatagatataccaaggaatgatcagtatgttgaagaacagaacatatcaaatgagaattggtgcacaaactgccatgagtatcgtaagatatattgtttatttttctgcaaaattgtttcttatatactaacttttaaaactttgtagatcctgatggacgtattaaaagacgtcggggaccaacaaaattggcaaatgtttaaaatctttcaactggagttaagattattggcaaactggacccgtttaatgcaccttggtgacaattttt

SEQ ID NO: 26212 - DNA, 1501 bp, Oryza sativa
ctccgccccacccgccgcccatcccgggcacgttgaacccgcccatgccgccgcccatccccgggatgctcccgaaccccgggatggtcgggatgccgccgccaccgccgccgccgggattggtgcccgggtaacccggctgcacggacggcttcctccccgccggctgcttcttggcggatggcgcggcggacatgaggtcgcgggcggcgaggggggctgtggcggagagcccgagcaggaggaggaacagcgcggcggcgacgcgggcggtgctggccatggctaagctttagctagagctagagtgagctcccttctcgtcgatctcgtggagttaagtagggaaggaagagtgagggtgtgttaagtagtctaaagtttttgaaatatacggaacacgtatatgaagtattaaatgtaaactaataacaaaacatattatatattttacctataaactatgagataaatttattaagtttaattattatattattagtatcgcattgtcaaattatagtgtaattagacttaaaagatccgtctcgtaatttatatgtaaattatgaagttgactttttctatatttaatatcatacgtatatatttaaatatttgatgtgatatttttggctaaaattttttagatatagaaaaaggcaggatgggcaataaaggtggcaagatatggaggaggttggggaggccacaggcgcagcgcatcaccagcagtgcaatgtcagtggagtggagttatggcctctctttgaagtttgaagttttggtccggctcgccaccggcggtgctctaccttttgactcacaaatcttccatgtcatcatcatcatcaatgaaggatacattacgatttttcgtttggccgccggccaataacgcgactcacgtgaacgtccgtacttgacacgcccgcgaacgttgtgctacacctgtttttttttttcggataataaaagaagaatattttttattaagaagagtaaaagtatttacaggtgttgcaaaaccaagaatgaggaggagaaagaatacatgagaaaaggactgaagcctactctcacagaacattttgcgaccaaactgtcctcacgttatcggcgttggagctgccatatcaccgtctcttttgccattgccttcccaacctcctccagtttttctgttattgattaaatacatgattatttcgctctttccaaattgaccaagacgtaggagcagcgatagtgtcgaatccttggtgtttggatttggcaattttttttcctgttgtcgcacaaccaaccatgtaaggatcctttattcattggagagcattttgggtgatcgattgtcctgagtatcagccaccaaagctgtctcgacttaggacatgtatccagaatgcgatcgatgcttgcatcatgttgagcgcaaagaacacattggctagggtgcggcaaacccctgatgcacaatatgtccatcgtccaacatcgc

SEQ ID NO: 26213 - DNA, 1501 bp, Oryza sativa
cttttaattttccgctgcatgtatgtaagacttttataatgtttgtaagacgtggatctgtatgtcaactttgttgtttgtgtaccccggccggtcctggacggggattttaatgcacattctacttggaattctattcgggaatttctgggcgtgacattagattagctaaggcatctaccatcctgaaaagtgtttaattgcttgattgtctagactgtatgcttctttcatactttgagatgtatcatccctagtcgtgtttaaaaccattcaaaccagcttgcaattagacataataatgatagtatcggggtttcagccgatcttacctaatatgcatgttttactacttgtttcatgtatattcgccacttatatagatagatcattttatataagcatattaagctttagtcagtatcggctagattcttgcaccttcaagctgatttctatttgatatgtttatatagatcaatttatttatataggtttgtactggagtattaactagtacatttctttcttgttctaaatactgtcacatcggctacttttatgatattgtcttaaaccaatttatcaaacttgatagacagtattacagtcaattaggcatatttggagttcaatattcttttatatactcagtccatagccgatttggtctaactccatcggctgagattaccaacaataccttatcggcctctcggtcgatcggttatcggctgactaattctgctgttgtctttcttactgattgcaagatcaaatcagctgacacgcccttgacactctcgagtctagccttggacctgcactggaattaagcagatctcccaggccgtcgtgttttcacatcaacacttatgtcttccttatttttacttcagcattgcaagcaagttgtaataaatgagaaagataactataacttcaacgagcaatcttgtctaaaatttctttgttaaccctaaaaacctcatttctttagtttctttgcattcgtgtaaaccacattgtagtaaagaagatcatggtgtatgatgtaacgatttggctctcttgttcgaaatattatggttcaatgaacaaaatattggcataatccatggaaacataaatatatctcaaatatgtttcatgtatttccaaggttgaggtattttatcatgcctataaaaatattctcaatcatatgaagcattttttaaaattagaacaccaaagcttttgtttttttagacaaatcatgcttttgaaattctttatctattgctagctcccatttaatgtaagcatgaggtaatttccttcaaaatatgagtgtactaatgattttatgtagaacatcatcacatatcttatatgcccaatgttggtcggtcctcatatctcaatgtcctcatgtcttaatgaagatgttgaagttgtgcacaatcatctctagttgttttgtgtatccctatcatggttagtaaaaaacaagaataca

SEQ ID NO: 26214 - DNA, 1501 bp, Oryza sativa
taaaatgaatgaacaactgatgctcgataaattgtcctagtgcttcatggcttgctcattggcacttatattaattaggggcctaagtgggtagcctatgcgatctgtcgtttattcctactgcatccaatctgtttttcttcaacaaaagtaatgcaaactagggcccctacacgcagccctctctgctaatctgcgatggtcgacaagaataatgcaaattcttccttcatgctagattgctaggcgaggacttggagtttcctacacgaatattgcattcttccttccgataggattcaacatgcctcctattcctaccagtcacctagaaaacatattccgtgttatcttgatcctctcctttttatgcttggattcctagagccaacacaaaacacatttttccaattcattttgcggtggacttggaaagagatgttgctctcctttccaccgatgctctttttatgtgagaaaaagacatacgtacgagctcctgcagagatagggccatgtgtaatgtgtttctatagtagagtaaatacgtgtgtcggtgcgtaataacataaggtaggagcttggccatatgtagtgtgtttctatagtatgtactccctctgattttattaagccgttggttagtttaattttgaactaactagcaccatatattgaaggatgtaggtagtataaggtgtaggtgtgtctacccttctctatatttagacaacaagcatcccctccttccaatcgattaatttattcaaaaaataataattgtaacaagggcttattctcttgtttaatgacgacatctagttaattaaaaggctagtaatcatggacaagcgttgttgcactgcatacaagtatatagtacaaaggaaagggaaaaaaaattaaaaactgtaacatcatcacaaaaggaacaaattaagacgatttagtgaggggaaggtgcggatgtacaacagaatgaacattgtggcgatacagttgaaaaatgcaatcagaatgaactcttgcttaagaacagactttgcatgatatgcatatgcaagtacaaattatatgaggaacaacaatcttttattaaattatgaagagcaaatctagttattacatatatagagataccactctgaaatggtaaatatagaaaactaaaatatggatcaccccctcctttgcgccatcctgttcatatcctccttgattttaggatttgtttgtcatccaaaactggttctgagcatctatggtagctaggcccagggtgtgaaaaaccgccggtaaccgcgcggttaccacggttaccgcccgtaccgcgggggtacggttacccgtaccgcgcggtacggtttaataaaattcgtccaaattcaaaaatttaaaaaaaaaagaaaaaaatcaaaaaaaatagtgaaggtagtgcttgatttatagtgttttatggtgaagaaatttctcaaaaaagagtaatatttattcaaatttg

SEQ ID NO: 26215 - DNA, 1501 bp, Oryza sativa
gtcatgtgcattcatccaaatcatccttgtgttgatatcaagtatgaaccttataaatttattgattgggatgatgaggatgaatacatgtgacatatttgtaagatgattagcattgagaaaggcgggttcgagcctcaccgatctcttaataaattttgctatgagagcctttcctctcttatcttttttttaaaaaaaagatgattaacattaagacaaaggaatcatttcacaccgctgcatacaaactttctagacaacactcatgtacagaagggttcagatctcataattacttttatttatacaagaccattataagtgaacgactatatcttggaggtctatgcaaaacaacagacagttttttatcatcaagaatttttcttttaagataacggaaactttattgaaatcaaatgtctgagaacacttccggtctctgcacaacaaagttcacacaaccaaaacaccccatgcacatcgctaaagaaaaagctgtaaaaatcaaaggccatttatctgaaaactaaaacgccacccaaacattggggtgaaaaaaactccttggctacctgctccaattgaaaacaagccgcaacagtaaagtccttcaaaatgggcctttgaaaattaagccaagcatgaagccatcgtgtaatcaagaatataacctgcggattagaagaaataaagttttctttcaaaaccacatcattcctacaaagccaaatagaccagcaagctgttgccaccccaatcagtattagagttcgaaattttaagggttgactcaaaatccattgcccaaacatatgtgacgcatcccttggcgcacaaatgttggccgcaaagtggatttgagaccaaatcgatcaggcaaaccgacatttagaaaacagagaaaagcaacaagtcttgtttcctttctaattactttaagctaggttatcttctgtaaacacaacaccacgatgcaaataccacgaagaaaaaatctttactttaagaggggattttagtttctagattttttttaatattgggaacaccagtatgaagtgaagcactataatgtgatttagccgagaatccaccaatggtagttagattccatttacattcatcttgctcatttagcgatacgtgggagtaaatgattctatgccactagcttagagccaattatccagatgtggtgaaattgaaagggttggtcgaaagatatctgaaatggtggcttgtttatgtcttaccacattgtaaaaacaaggatattgctcatgcaaagttgcattacccagcaccatttatcctcctagaaccaaacttgagtgtcatcctcaatagtgaagaagccaaacttaagaaaatccggtttggccttcataagactagcccaaaagtgtgaatcccccaatttccaccaaacttgagatgaaggttgtgaacccgattgttacacaacaattgttgttgtgcttcattagttgtgagc

SEQ ID NO: 26216 - DNA, 1501 bp, Oryza sativa
atgaagaagaaattgttggatgatattggtattgataccatggtcaataacttttcatccagaaatataggaagaaaatttaagatattatatctatcaaaaatcatataaatactgattctagatggatttaaggtttgtaactaatttgttttatgttaagacccatgtttttagtttggaataagactattttgcctccctcatatcttgttactgattgaatcacatccctcattcacgagatcgggtatagcgcatcctctgtcttccaaaaccggtaaatatagactccttggtggtttcaaaagtggtttttgcatctagggcccacatgtcaatgagatgtggaaaaccatatacagtggtcccaaatgtcagggagcatggaaaaaaggatgtagggccgaccacctctcagcaatccggcattggcggctgagttcgcgcatctctccgccctacacgcgtgccgttcacgcagcgccagatgcggcgtcgtcccggcgagctgacacgcgcgaagaggcgatgcgtggtggcgactaggcctcggtgcggaaggtgaaggaggaaggaatactgagagttcgcggacacggcggtggcaccgcggagttctcgcgaggttctggaggacaaaccgagttcctccccgcgcacgcgtcgcggccggccagcgaccgctcctcccgcgcgcgccgtggccggcgagccctccccgccctcgcgaccggctagcgagacctccagcgcgcgcgacctgccggcgtcgaggccagcgagctccttcccgcgtgcgcggcgcggccggcgagccctcccgcgcgtgcaaccggccggcatcgagaccagcgagctcctccccgcgtgcgtgactggccagcttgccctcctagtgggtgcaccgcggccggcgacccctcccgcgtgtgcgaccggctggctgttgactgttatttcagctatggccccaaggtgatccaggcgatggcagttgcaacggctggatgaataattcagttttgagtttgttatgcatgcacgagagatgtggcgagctgcaggagtagacgactgcgtcaggcgtgcgttgtgggcgtgagttttgcacggcattggatccaggagttccggatcgtgggatggcgcgattgtaggcttggattcgttttttctgttattagagtataagtagcagtagctaaaatttccatttgtaagtttttcaattcagttgaatgaaagaacccagaaaattgtcccacaaattccttctctctcgtgattctctgaaactctgaaatactctgcttctatgttctgaatttcttcctatgttcttcagtttttttttgtctgttgccgtgccggacatgtgcagtgtgcgcacaaagtgttcgatcgggtgattagcagctaacaagtggtatcagagcttctcaggttgagggcggatctagcactatggcgttggttccggcgacggcggacccggcga

SEQ ID NO: 26217 - DNA, 289 bp, Oryza sativa
cagttgtaagaatggtacatttaacatgtaactacactaaatttctcatgtttagactaattgataggctcaaaaataatccaccaaatatgggcacatttggctgggatctagcttcagatccaccttttctagagctgtagtgtaaccaccaacatgcatactagttgcattcacaaaaaatgactaaaattacacatgtaactactgtttatctgaaatgtaattacagaataactataaaacagaaatgaagccaattcacacataatttacttttttttgcagg

SEQ ID NO: 26218 - DNA, 1501 bp, Oryza sativa
cgggagcagtgcgagacgactcaatcttcgtctcagcggcggcggaggcgagacctcctgtaatgtcacatcctgatctttgtttcaggatttataaattatttaataaattattattagaatttatattaaatgttcattaatttacaagtgaagttaaatgtgggaaataaaatttcctaaatataaagcatggatggatttaatttttattaaattctccatgattaagtatactctctgaaattttctcggatttttcggagctcaattcctaaatgatacaaagaacagttcagtaattatttgatcattaatgatctaattataattgttaagagcttttcttgtttaaaaatccttaaattataaattgttgtttaaaaggaattagtagaaatgatcttaaaagcctaaaagagaagatttttttttaatttgctaaatctcaatataaaattgggctagataaaattttgttaaatacttctcttgaatctttagttcctagatttttttgggatttatttgagccaagaaagtatttttaataaatggaattgcatttcatgaataatttaaattgaaaaaggtttttaaaaagtctcttttggctttgggccgaaagccggcccaaaacctctctctttctctctccctcctcggcccagtcggcccagcccgccgtcgcttccttctctctcggtgccgctgacaggtggggcctacctgtcagggctgtcttcctcctccagccgtcgcccggccgaaccctagccgagctgcgccgccgccgctgcccttccaaattccgtcgcccctctctatttccggtcaaattgattgagggcaaatgatctttgagatctcctcttccttttctcttttggaaacatcggctaattttctttggaaaccggtggatttgagttggattcggattcatctatctcctctaaccctagactttcctcctcgccgccggtcgccgtgggcctccgtcgccgcctcctagcctctataaaagcatccctgggacctcctctatccgccgccacctttgccttagcccgccgtcgcgtctagcgccgcctccgcgtagccctagccgtcgccgtcgttgccgtcggttcagccgcgccgcgccgccgttgcagccgccgtcgtcggtcgccgtcgccaccatcgggatcgcgaggtcgtcgccgtccccgtccaccgcttcgccgccgccgaagaccgccggagcaccgccgtcaccgtcgacccgaagaccgtcgccgcttcttcctcatcgccggcgccgtccgttgctcttccgccgttgttttggtcaccggtgagttcgccgcgtcgccctctacccgttggtgtcctccgtttgcgtcgtcgcgccgtcgttcgccggtgagcatgcgttgccgagccaccgccggtgatgacgtcatcgctgacgtcatagctgacgtcatagctgacgtcatcgtcgctgtccccgtag

SEQ ID NO: 26219 - DNA, 1501 bp, Oryza sativa
tcatctcctaccattaatcccactcccacatccatcctcttgttaattgacttgttcatttttgcaagctgtaggtctggagagtggagaggaagaggaatcctcctcagtcctcaccttcagatttcagaacacaggcaatcggccctagctgcaatccaacaagatgggcatgcctctgctgctgctgctgctgatcctcgtcgctgctggcccccaggtccttttctcatcacctttacttgtttctttctttctttctgcgatctagccgtctcaaatctatccatacatttcgaccagcaattcacctttttactgtacaaaaccaacagctaacactaagatccaatcaagtatcttcgattctttactggtggaatccaattgaaatttcttcttggggcaggcagattttctgccgcagatatgctccatccattactatttgcgctagttctctccttagtctgaggatggattactgaatagaaaaacgcacttgcgtgcattggaggcatctctacagccctacagtggacatctgattattgaaatggactgtagtggtgtcatagatttgcttatatcaaggagaaagatagatctgagttaagcatacttagggtcagggagacaaagttgctcatgaccagaaataggggaattctgatcaaaacagaaatatggaaagtcagttacaaaagactaatccttcacaaaataggaagctccttcaggcttccagtgttataattggtgtacctcattttcacatcttatgtgtgaggaattgtctcatgattaatgaattttccctttccgacagttcactttatttaagagtaaatttcatagaactgcaattatttgatcaaaaatatcactttgctacaactttagtcagccatttcacaaagctacaactttagcaaatgattttatcaataaactacaactttaacccaccacgtgtgtctaacatgtgggctcgatgtgtaactgtgtgagttttacataaatgcctgactaatgggtctagattcgtcaagtgtataaagctgcagttttatgataacaccgtgtactattgttgcagttttctgaaatgtctgactaaagttgtagtaaaccgatagtttcgatagaatagttgcagttctctgaaatttactttatttaatgaatttccctttccctcacaaaaataaaagaatacaagcacacaaaagcttcatgtttcctctacacaaaacaaaacagagaaggaactgtaccttgaattatgttgtgagctgaatcacatctgtatgtacacatgcacaggcaggcagagctgcaaagccaatcccaaatctccagctcatgaccaaggagggcggcagttcaagaatcatccaggttatgcctttctatttcaattcgttcttctcaccttattgtattttcttatttactcatgacatatcattcaatggtattttgttgtcacaggacgaca

SEQ ID NO: 26220 - DNA, 794 bp, Oryza sativa
ctgtctcatcgagatagtccttaatgtcaaaagagaacagatcggctaagacctgcaagaataatttaggaatagttagaagctaaatagatatagccgatctaagttcttgtatcaaagggaaacgtattgggatagcaagagcagctggttgttcttcttcttcaacatgatggctccctgtagccgatggggtttggttacttggtgattgttgtacaggggaaggaggaggaggaggaggaggctgcaaaaagagataagtgttaacataagattggctatgatcggctaatgagaaattaagaacatcttactagttgagccagtttgagagttgttgttggcgatttcttctacacagcgattgtcacgccctgaaaatcgcctaatttaatagttcattctttaatgcatttttagaaattattttaaaagtttacaagttgaactctaataatctaggaaaaatcgcaacataaaactgagttagatgaaatttcattaaatactttgcttgtttatctgtttcctggattttttctgggaattatttgagcaagggaagtatttttaatcaacgaaatagcatttcacgaattattcaaataaggaaaagtattaaaacctttctctaggccgtgggtcattttcggcccacaaagcctctctcgggctgccagccatgccagcctgctgctccattcctttcttttcttttcttttctttttccttttctctgaaagtctacaatgactccctcggcactattcttcttcaacctcaggccagc

SEQ ID NO: 26221 - DNA, 283 bp, Oryza sativa
atatcaaatggagcacgccccacttagagacagagtcgtaagtttcttgcatttgtcaaaatgatttccatttgcaccctaaaccctaatatacatcttctcatgcttttagtccagagagctccttaggagtatgaattaaatgggacatgccctctgatctccaaggggtggtgaagatacggagaacacacttcgcaatgtcttagaggtaaaaatgatttaacactttgcattacttgacttatgcctaacaaacttctatttttttaattcaaaaagt

SEQ ID NO: 26222 - DNA, 1501 bp, Oryza sativa
caaatgatataaaaataataaataattacttaaaatttttaaataaaacgaatggttaaacatgtacttaaaaagtcaataatgtcaaatattttaaaaacggagggagtccgcagcactatattatcggttgtcaaggatgcttacgtccgcgggataatcgatatcggctgtctccgtttctctactacacgggggctgctattcttctctcgtcgtccacactcgttgtagttggagtagtttattcgtttttaaatatctttttcaaataattcttccgtctaattttaaatgtaactatgagtttctgtgttttattttagttgtccgtcttatttaatttatttttataattagtatttttgttgtaacgagatgataaaacataaataatactttatgcgttacttacgtttttatatttttttcaataatatttaaataagacggatgattaaagttgggcacggaaattcatggctgctcttaaaatgggacggattagttttttcattcttaggagggattcttcttgaaagagggagtagaagaaaaattggtcagaatgatggttctcacttcaccatcgtgaaggcatgtctcatgcacaaaacgcagatcagtatacgtagtgtatctatattgttgaatagtcccatattggttgtggaagggcaaaggacctaagatataagtgggggagcccctcacctcaatggctagcttttggggtgggaaagatcatttacgatcctacaattggtatcagaaccaggctaggttaacatctctggcttgatggacacgtgtgaaggcctgatggaccgtgggcggtagggcccggatacggtgaaggggcggtgaagagctgagagacaccaatgtgtgaagggttgtggaagggcaaaggacctaagatataagtgggggagtccctcacctaaatggctagcttttggggtggaaaacgccctttacgatcctacatatgtagcactgctccgtgagtcttatgacattcctgcgatcgtgctactcttaacgttggttttcttgcactgttggatcaaaaaccaacggcacacgtaactccacgtgtccatggatcgccatagaattcaatcatctactctttctccccttctgccccaaattcccgtgcaggccccaagttggcatggatggaaatttccaacgaatagaaatccatcagcttgcctcgccggggacacgacgataagatcaattatcaaaaaagaaaatagaaaagaaatcaatccgtttgcccattcgcacagtgtggacctcctaccgttcaatcaattatcaaaaggagaaaatagaaaataaaacaatccgtttgcccatttcaagtcaattcgaagaagaagtcttccaaacaaaattaaactacacaatgatttgcaagactaacacaagggtttaacccaactttctctcacctcatctcggaatttcactatttccattctcctcc

SEQ ID NO: 26223 - DNA, 1501 bp, Oryza sativa
gggtcgccggccgcggtgcacccactaggagggcaagctggccagtcacgcacgcggggaggagctcgctggtctcgatgccggccggttgcacgcgcgggagggctcgccggccgcgccgcgcacgcgggaaggagctcgctggcctcgacgccggcaggtcgcgcgcgctggaggtctcgctagccggtcgcgagggcggggagggctcgccggccacggcgcgcgcgggaggagcggtcgctggccggccgcgacgcgtgcgcggggaggaactcggtttgtcctccagaacctcgcgagaactccgcggtgccaccgccgtgtccgcgaactctcagtattccttcctccttcaccttccgcaccgaggcctagtcgccaccacgcatcgcctcttcgcgcgtgtcagctcgccgggacgacgccgcatctggcgctgcgtgaacggcacgcgtgtagggcggagagatgcgcgaactcagccgccaatgccggattgctgagaggtggtcggccctacatccttttttccatgctccctgacatttgggaccactgtatatggttttccacatctcattgacatgtgggccctagatgcaaaaaccacttttgaaaccaccaaggagtctatatttaccggttttggaagacagaggatgcgctatacccgatctcgtgaatgagggatgtgattcaatcagtaacaagatatgagggaggcaaaatagtcttattccaaactaaaaacatgggtcttaacataaaacaaattagttacaaaccttaaatccatctagaatcagtatttatatgatttttgatagatataatatcttaaattttcttcctatatttctggatgaaaagttattgaccatggtatcaataccaatatcatccaacaatttcttcttcattgccccatttttattctctcaatttattcacttgtccttttttttttttgctgcttttctctcaacaaaaatgatgtcaaggatatgcaaaaaattgaaaaagaatatttaacatctgaactcatatttttacctattataaaaattgaagatgattccatactcaccataattgtataaaattttcgtccgtcctagttgttgggatacttttatttgactgtttgactagcaactgaaccagtcaaaccgctcaacctgtgaattgaatttggtgtataactataataattgaatttggtgtataacttgtaatttttttctaggaaaaaaaatccaagcaaattcttagaatgagtttcaccttaactaaacagtataataataataagattaaaatagtcttcaccaattgcaacgcacggatattttttctagcataaatataaagtacaaacataactagaaaagcaccagatttattcaaacaaatctaaatctcactgatttgttgatcgcgggtgtgcaaggcaacacgcacgacggctgcttcgtccaagctgagaacctcccacaag

SEQ ID NO: 26224 - DNA, 1501 bp, Oryza sativa
tttgtgaaatatgtaaaattatatgtatacatataagtatatatttaataatgaatcaaattataggaaaagaattaataataataacttaaaatttttaaataagacgaacggtcaaacgtatttaaaaaaatcaacagcgtcaaatatttagaaacggagggagtatatattactagatgaatacccgtcacgttgctgcggaaaattaagttgcataatatgtacgaataagatgcaatttgaataacaaaactaaaacaatttattacaattttaagtcaaaaaataattgagattgcgtgtttttaagagagaagaaagaagagacaatttggaccatagatctatcatccaaaggctagaaataattgaggtgatgtggcttaataagagaagagagaaataacattaactacgtttagtggggatgaactatataagtatataggatgtacgaataagatgcaatttgaataacaaaactaaaacaatttaatacaattttaagtctaaaaataattgagattgcatgtttttaagagagaagaaagaggagacaatttggaccacagatctatcatccaaaggctagaaataattgaggtgatgtgacttaataagagaagagagaaatatataacattaactatatttagtggggatgaactatataagtatataggagcttgaaatcacataagtgaaaaatgaatatcaaaagaaccgatttcttccataaatagaaacaatacatttttaaatctacaatataatattacagttacaatataaatagaagctgttatatcatccgaccacaaaagaagaaacaaatatagcttgttcagtcatacaaaagaagaaataaatgtatccgcattaatccttgtagcttgtcagcagcatcacatggatcaaggtatcttctcctcaacaaaatgtaggaaaaaaattagtgatatcatttagggttgaacaatcgagtatatgaaataacaaatagtaggacacaccagaattcaaactggctaaatgttgggcaaacaatttctttctgcacagtgtataaatatccaaagtttagtagctgcctagctggttatatgaaatatgtgaaataagctactgaacagtaaagacagattttcctctcccctaattgtcatttcatataatgcactataaaaaataaaacaaaaaaaaaacaaatgacgatgtagtgagtatagttattagaaccggaccggaccggcagtccgacggtgtcatggttatggataccacatacctaatagtagttgattaagctcgatagggcctaccatataccgtgtcttatatggaatcatatctcgtgtatagaaggggttccggataagtaatgataagtagagttctatgtcatggcggcctcccggctcacgcactcactttgacttccattctatgccccgacgccgacgcctgcggccacggcatcgtcttcttcgtcgccagc

SEQ ID NO: 26225 - DNA, 1501 bp, Oryza sativa
  unsure (1)..(1501): unsure at all n locations
taatttatatgttacttgtaataatcatagtctaagcagggattaagataaatcaaagggtagagtgacacacaagcagggagcttctcattctcatactaaaatatctaagctaagtggaaagaaaatagaaagagaatctattcctatatttctagtatacataatatatatatatatatatatatatatatatatatatatatatatatatatatatatatatatatatatatatatatatatatatatattatagttatctgattaactagctaataccctctatgcgatgccctctggtacttcgagaagccacccctaactgccgagttccttacaacaggccgtcatgaccatacaaccgaggctaaatacggaggagtaccttactcaggaaattcacttaggactatatacacgcgtggaggaatacccatactgagctgtcaccatcagcggcacacctctcatccgcagcatataaccccaaataacaatatcccgtaatctagacaccacgcctaaactaccagatactactctaatgtcattgtcatgacatatagtaattgcataagcaaacattatacccataccaatgcatctaccagataagctagcagtatgatcaatataacatgaacataatgtaaagttggcattcatatactcgaaaagtatttcaatatcataaatgtataaagaagagtattctaataaaagtacaaagcttacaaaagaggaaaggagagctactagagccatacccgaactcttccgaatgtttccggactccgatttctactatattcctactccactagcttaagaacactaaactaaacttgagagaatataagagagctttgcttgaggtgtgtgttgaaatggagagagtgaggggtttatgtagcctcctagtgacggttggaatggtcggaaataccctccaaccgtcattgggagctaatccacatcgtccagccgcaaccctgcatccaacagngcgaggangggnnnggcngaaccccntggntaggccgacacatgggttgggccatcccgacccatcttcggctgacggcctcttggacttctcttctccgcagacttgtgaattttggctcaattggtcgtgtcatttctgagttcttggcccattcatacataagtctaattctcgacatcgtccgattgatttatcgtctggtttgatatatgtcgattctcctccactttatggttattctctgcaaaaggttagtaaacctaatactagtataatattattattctaacataaatatgtattgcaagcataactagctctcctctattttggtaatattgacggtcgaaactgatcgctaacgaccgtcaacagggagaatgcgcacgggcgggcgacgccagcgctggcgttagcgtggggccgtgacgcgatcccgtgcccgccgtccgctgccgtcgacccgctccccgccccgacggagctctg

SEQ ID NO: 26226 - DNA, 1501 bp, Oryza sativa
gttcggtatcacgagttcccaactctctcttctcgttttccacgtgcacgtttttcaaactactaaacggtgtgttttttgcaaaaaaaaaattatatacgaaagttgcttaaaaatcatattgatgcatttttttaaaaaaattagctaatacttaattaatcacgcgctaatggactgctccgttttccatgcgtgggtgatagattcccaacacccaccactgaacacagccagagtcgacatccttacagtgtttattggaccaagccatgctggatattttgggtgaaaaatcaacatgcagccagcagcacatctctaagacttggagaccatatcaagttcaacaggaacgcgccaatgaaccaggcgaaaagggcaacaatgaagcagatggtgatccctcagtggaacggtgagaaccagaaacaacagagcccgagtgtgtagaaggcaaagcaactgaaccaactgaaccagtcgaagcagaggcagtgaggcgacgtagcaacgtaaggttctcctatgtatctgagcttccagtacactcctctaagaagaactaccagtactcttcggagtactcttcggagaagaacctctggtaacctgtgaagaacgaccacgtcgcaaatccttcttccaaaagcaaaacgattccacatgtccatccttatcataataagtgtaataaagatgactactggtagatagcacaactggtgaagaagtacgtgatggcaaagtaaaggaagcggctgtcggtgatgaaggtaccgaagctgtagtacgaacagccagaaggaagcactagagcacccgcttcacgaagacgaatctccggaagagcttccatcaaagtaacacgagggtgtcgagcaagcaactgtgcacgagtcgattcatactcggagcgaagacgagtgagaaagtcatagatgcgacgaagatccatgtgagaacgctgacgctgacaacacttacaggtacgacaaacatcagggaccaaagaatcaagctggcaccaaatagaggatagctgtgtagtctgtgtatagaactcatccactaaagcatccctctgctgtaaagactgctcttgacgcaccatagcaagataaagagcatcaccgatagacacataacgatcacgaaggtgtgtccacacaagatgagcagaagcaaggatgaccacatcgccagtaagatgaacctccatactagccacaagaatagcagaagcacgagcatcctcatctaaccaagccttgtacatagcatattgactctgataagtctccataacatcagcataagtctttcgcacctttgctctgtcctcatcagtaggctaacccgaaagaacaggcagaaggaacctcggggcaagccagaaaaagtagctcaccagaaataacatcccaaagacgctgaccacgcatgtgaagacgcatatgctgagtccaatgattatagttgacaccatcaaaaataaccg

SEQ ID NO: 26227 - DNA, 1501 bp, Oryza sativa
gacataaccatgccatgattagcacaaaaagaacacacaagtagttcaaactagaaagtttaccagcttatattcatattacaaagaaaataaaatacatcttgctccaaatcactgttacaaacatgccatctcagcccttttaatgggacaccattcagaattatgagttcagtacatacattgtgtatattaacatccgcacatactataatgacagcaggcctgtcagtctctcactgcagctcgtaggacgaaaaggtaaatccagaatctttctcattggtacacttcagttcaagcttctgaaacggactgtaaattgagagagcaggaaatatttatatcacttcaattcctcgatagaatttagttgtaacatcgcaataaaaagtgccagcaaaatatacattacctgctgtttggatcataataatacccgctaatggaaccgtcgctacatgaaaagcagacatagtagaaaccagctatggtcaacccacagtccactccaacattgacaaagtactgctctttccatctctacatgtagcatcagaataatgctaagttgttatggctttgtaattcaataaatggtgcacatacatgaaaggtcagatggtgcagtaccatgaatatgtaagcatagttgctgaggtccacggacttgccaccatctgtctcaatctgactctgtggaaaaacataagtgagaaatgtatccaaaaaaatcgtggcaactaacaacacgaagataggcaacagaataccagaagaggcgtaaatgatgggaacttggaccagtgtctaatatcatcctctgggctgcaaaagcagaagcaggagtaatgtttcatgagtaagtttggactgttaccatacacttgggcatctattaataaaacaagtagatgatagtatcaaggataaaacgtaaatagttaaatactcacgatgcttcccacttgccagtgaaaaatgtataatttttagcatccactatctccccctcccagaacgttaccacctatggaaattatttgcaaattgctatgcaaatcagataatgggaacaagaagtaaagcatagcatattttaaaattttatcggacaaactgtttgcctactgaattagtatacaaatgtattcttaatgaacaattttggaacataaagatcagagtcaaagtggaaaacaaagttgaacaattttggaacataaagatcagagtcaaagtggaaaatgaagtaggttgctcacaggggtatcagctaagggaacattaagtgcttccattgttccacataaataaccctgttcaagatcacagccatggatccgcacattaactttccaagcttcttctttttgtatattagagacattctgggttccagcataacactgaaagatggtacaagcatatggtcagttccataaaccacaccgataagaagatttgatccttggtcaagttccaaataacaacacaaaaa

SEQ ID NO: 26228 - DNA, 1501 bp, Oryza sativa
aaggtggttggctagacaacctgagttcgatgtctcacctcttctaattatttaatattaggtcatgccctaatattcacgtctttttttattagtgacaaaacttcatgcgaaatttaaacagaacataatttctgttttttagaactaaccaaggttgtcattatcccgattcgtatctagtatcttacgatattatgatcctaccgagacgaaacgataccgatcccacctagtatcctaatttttataatatcgcgatcctactattcattactacacgatcctacaaaatcttatatggtatcccgattctacgatccctacaatactacaatattatttaaaataacatggtttaaaaaataatgtaactaaatatactcaaatttatatgaaaatcagttcaatatatcaaaaccaacgtggtttctcttgataaatgtctttatttgcatgacatatatcattactatattttttatatagaatggctatatataattaatataaatattaattaaaattaaaaaaaatctcatagtatcccgatactacgatacgatcctacgattcgatattactttgagcaaaatgatactcccaccatctatttttgatagtcatatttccaaatctgaaaattttatttttgataggcatatttcaatccaacaacctatcatcttaatgattttctcgaatttaatgcgtgactctccattcttccacacatgattggctatatgggctttgagaaatgtaaatattaatgaatcgcttgtttacgaggaatgactagtagcatgcttaaatgaatgataagtagaattacttatcattggtctgtgtatcaagatgaaatatgactatcaaaagtagatggagggagtactacttagtatcccgatcctgacaaccttggaactaacataatttctgttgagttactcacagttaacccaagtgccactccttatcagatggtctcaatcccaattaaacaaaccaacatgaggtaaacatgtaaaagctatacttaaaaaaagaagagaaccatcctaggcatgattaattacactcccttccaatagcatcaccacttgcaaatctttcttttttaccctaaaatagcatactatgcgctacttgtagtaaaaacgccaaacgtgccggtaatcccatcctcacgcgaagttaagcatttaacccccttccattaatcacgcgtcctctctcaaacccgtttagtaccactcctgtacgcgtcacgtgtctgaagtctgaacacgctttcccccctcccaaaaagcctttgacagtttgaccccccagtttgacgcgcctctccacgcgccgcgccacgccacgccacgccacgccacgccacgccacgccgcgccgcgccgtatataaaacgcgcgcgcgcgcgctctcctctcagtctctcacacgcaaacgcgaacacgcgaggacatggacgacatggccaagctagctc

SEQ ID NO: 26229 - DNA, 781 bp, Oryza sativa
tcacagggggatttcaaaaccatttgtcgaaactcaaaccgcacgaaaaagaaatttccctgattttctcactgatgatttcaatcatacgctcaacttaaatatcatattataaactatgcaaaaaagttgttgtctgatatttggaatttttcatccaagcggtattttggtcattataataaaattgtacaattttaacaaagacaaaccagacgactatagtatatcataaaaattcagaaaaatgcaatggcatattagaacttggcaaacccagcaacatattgtatataacatagaaaaaatcagagacaaaaaaaataccctgtggtgtatttgcagaaacctatatgattcacggcacgatgcaaggttggtaatgcctagttgtgaggatattcttatcagatatgattacaacaactgttcaggatgatcatcccttatgctgcttctgttggttttgaaagatttcgaattcaatctcttttttttttcaggatgtaatcccatagatttcgaatttaatatttttttctgcaggccgaaaatgcagttgaaatgggccggagagtgaatttccacagcccaaaaggcccaaaccatagggagaaattcactctcctcctcgactccggcgacggcgataagcggctccttctcctcctccgcgactccggcgacggcgacggctgcgcctcctcctcgtcctccttccactccccatcgctagccttgcgctagacaaagcgcggaaggtggtggctgcctcgctgca

SEQ ID NO: 26230 - DNA, 1501 bp, Oryza sativa
gaatcttaaactcaaggtgacaaggagacattggaggtggtttttcaaatttacatggtatttagatgatacaaagcaagcaagataaagatacattgttgatatcaaataatcctgatttcgcccctcggccggcgtgacaacgctgcgtccaaaaaagttccaattttcgcaatgagtttggaagagattttgtttctaaattcaaaaaaatgaaaaagaaaataaaaatgttggatcactgccatgcatgggaatgaaaaagtccgatcctgcatgcagccatcactggttggttagtggttacgttacggttggtggatggcaatgctagggaaatgaatcgtgcatacgtgcacgcatcatgtatctctcggctctcgcagtggtggcctggtgggtggggaggatgtacttacagtgataagagtatgttatggtggtgtttgaaagttctgaagatgaagatgaagatggagattaagtgtttcacgcaaaacgtggttgtaataacatgtgattaattaagttttaattatttcaaacttgaaaaatagattaatatgatattttagagcaactttcatatagaaagttttcacacgaaacgcaccgtttagtagtttgaaaagcgtgccacgagtatccaaaatttaatccaattttagttggagaaaagaacagggccatagtctccaagtggaaaagaagataattttgagttgtgcccacacatggcatatggtgtggtgctcgctttcatttatcactttcctcgattagtagtgcccatcctatgggaaagcggaagtacgtacctacatagccgatcctgtgggagaaaataactttttgtcgtgtttttctcgactggtttctgcttttattcgaacgagtagtcaagtaggagtatatatagcatccttgtattgttacacgctacacgggtgacacagagaaatagttttttttagccgggccggcctaagaaagacggaccaaatttacttaataaaaggagtatttacacatatacaagtttcagtatcgaagtgaaaggatgttgccaccgcagcaacttcctaaaagaaaaaacaagttacagaaggttgttactctcctaaaacattgaaaaccccagcttctttccagattaccgcttcatctttaattgcgccaaacaggaaccccgttgttcggctctgattctggaatactcgcgcgttttgcagcaaatagttacacacaacacagattacattaagcattctattgcaaaaagaaaaaaaagtaccgtatgtaaccaaattgagaaatgttatgggccttcagcaataggagaattatcacgagtcattagtttatttgatttcatttacctgatacattctgcaattccatagcaaagatacagtatacatgatgcaaatgaggaaattatatacccccagaaaactgctccatgacttgtggtaactaaaagaaggtcgttcttggcagg

SEQ ID NO: 26231 - DNA, 1501 bp, Oryza sativa
  unsure (1)..(1501): unsure at all n locations
ccgtctgacgagatgatatgattggagatgaatccacatagttgttcagcaaggccaaagcaagcatgtggtagcaatttacttgttgggagctttaatttttgcaaatggaaggattgaagatgtgaaaacgtattgtgtgtttagaaatttggatttacgtcttaagaggatgggcgaacatcgcatncatanatgtcccgttgttgtcatccatgaaaatctacataaatttcattaggtagaatccacatgtactcgtgcccggatcctggcgtaagcaataagggtgggcccaaacctggaatgtatttgcacacggagcgtgtcaaatacacttattcttatacctcacaagtgccttattgagagtgtcaatgatgtattggaacttggcttgcggggtcctcagtccatcgaagacaactatcttggaatccatcgtttaaatggatcgcaagaaggatccagtggggcctacatacaaggagagagagcaatcaacatcttaaagtacaaatgggaagtgcaatgatatatgtgtcgacgggggatacccgcagaccggatatatagggtattggggtccgttgatacgaggatctatgtaagacgacatcaggcagataaaagacaagaattatactggttcaggcccattgatgggtaatagccctaatccagttggtatgggattatatgatggaaaccacagattacaaagggaatagcagaactcgatgataccgacaagatcgtagtcgagttggttcgactaggtctcccggcgacttggctcctgcgcgctccgcaggctgtggtggttgtgttggcagtaagattcaatgccttaggtcctgcccagggggtcccttatataccacgggtcagttgatctccaagtaggactcgaagacatcggacccctcacgatatggctaaaacccaatcttgtccgagtagaactccttccatctgtagataccacccctatcacgtgatagatttccttaatgtatacggaaactgtccatatacgcgcaggtataccgtattagtatacggtatacatccaaggatagagggtataccttatccgtaaccctgacagtagcccccgacttctacttaaatgaactcatgttatcgatcgcgacttctgatttcggaattgttgccgttctcatctggtcgatcccggtgtaaaaatcataaagacaaagagccatcgacaacaccgcatgaagttcaacggtcatgagtgaatttaaattgaagtctgagaaactaccatgcgcaacagacccagaattttccggcggcaatctctctcctttccttggaatacgcaccgtcggtagtgcgcttatttaagggaattttggggattcacttgaagtccgcttgccagaaaactctcctgccttctagcgctcttcgtcttctccgctcaccgcaaaaaccataactcacttccttagtcctattctccggcgatcct

SEQ ID NO: 26232 - DNA, 1501 bp, Oryza sativa
agcctggtgatccacgagtggtccgatgacgtccgtcagagggagagcctgcacaacatgaagtcacgacgcgatctcgagaagaaagatgaaaaggaatcatcgagtacactcacgttaatcgcggcagcgcgttcggctgagcccttgtcgcagagtgggacagggatgttacccacctccgagggtccactgatcattatctggatgacgcggcgctgcacagtgtcactgtccagacctgtaaatcgagaatgagaactcgataagtcaggagaaacagatgcacttaaaacaaaattggaaatgcgaggataaataccccgagaagagacccgggtcacgtcatttggccctgagtaatcgaaggccggatgggtgcaggcctgtagcggctaaatccaccgacctatgaagtcggtagcgacttcatatcccgacaacccccgttctcggaggtcatcgatgatgtcgataaaggattggagggagggagccagggcgggtttagcagtccactctgggatcttttctgactggtcctcaggaataacaaggacggggtccgagttctctatctggagatagaaccatctcgtccgccacttgctgcgagaagaagggcactggaaggggatgtaacgcgactttaggccatcccgaagtcggaatccgacgcatccagataccctgttggattccatccaacgcagctcgtaataaaaatggaagaggtcaagaaaaggctctaccccaatgtaggcctcgcaaagatgagaaaagatgctcagaaaggcgatggagttggggttcaagtggagtaaagaaaggccgtagaaattcaagacaagaagaagaaactcggaaggtggaggcagaaaaccgcaagaaacataatcttcaactacaaccatgcggcccaaggtgggttcaggttctatacctccagcctccctctgcatggtcccgtgaccggggagggcaccatcgtcctgtagcttcttcatggacgcggtgtttgaggaagacttctcgaggtccatcgtcgccggaggatcgccggagaataggactaaggaagtgagttatggtttttgcggtgagcggagaagacgaagagcgctagaaggcaggagagttttctggcaagcggacttcaagtgaatccccaaaattcccttaaataagcgcactaccgacggtgcgtattccaaggaaaggagagagattgccgccggaaaattctgggtctgttgcgcatggtagtttctcagacttcaatttaaattcactcatgaccgttgaacttcatgcggtgttgtcgatggctctttgtctttatgatttttacaccgggatcgaccagatgagaacggcaacaattccgaaatcagaagtcgcgatcgataacatgagttcatttaagtagaagtcgggggctactgtcagggttacggataaggtataccctctatccttggatgtataccgtatactaata

SEQ ID NO: 26233 - DNA, 1501 bp, Oryza sativa
ttcttgtcgtgtgcgttcttcttccgcttctcgggctcagcactgttctgccgtctcgttgttggccatgaatacaccgaaaaagagaggcgtgtagtcgtcctcgtagctgtcgtcgaagttaccgtagtcgtagcgatagccgaagtcgtcgtactcgaggatctccgttggtcgagaactgacgccgggggagctgaggtagcaatccaattcttccgtcgagaccgtcccgagaggctgaaatataacgcctacctccctagaactagattggatcgaagccgaagccggatcccgtctaggtcttcgggtgggagatgccttggtcgtgaagacagcagccagatcatcgggaagtctcatcaggattgggggataggacccatcatcttgatctggtcgtgtccgagtagattggatctcgtacgagtggtttgaagccaactcggcagagatgatcttggggtagacctcggccgagttcggggtaccgaacggggcggagatctgacctcttcccgactggttcgaatccgagtcgaggagagaaatcttgccgaagtcgttggtgatgaagtcgaggctgccgaaccggaacgcctgtccgggagggaagacgaagtcgtcgatgccggagacggaacccatcacactagtcggcgaagaacttgacgctgcccctacctggcgcgccaactgtcgaaacaagatttcggcaatactaaaagggggtggctatcaagctggaaaagtggatgggttcagagacaagggattttatacaggttcaggccttcttaaccaagaagtaataccctactcctgtccggggattgatccgcagagtgtattattgatcgtatgatctgggagaaaatcgtgcccctagaggcacccggacccctccttatataggggaaggggtccgtattacaaagtacaaaccatatccctaacggaatagataattccagataaaatacaatcgtaaccgactaggatcccgggtatttccttgacatacaagtttggtaattaacccgagtccttttaaagatattctatctatacagggcaccccatacccagtcggatatacatgccgtgtaggtatggggtatccataatctccacacttttcgtcggagatcgaaaactatgcagcccaactcgaaagcaagaactcgtcgaaacaatgaaaaaagggtggcgatgcgccgaaagtgttatcgaactgatgttgtttgtttacagggtcctgggttatatttatacccaaaatacatgatatgtccttgccgaacacgactctatctctattacaactcaaaaatacgaacaagtcctgtggactcttactgaaaatatctataaggaaactattagaatatcctaattaataggtacaattgccttctccggactcaatccacacttggcaatactggtgtagcacttgaaccgatctagacaacaatctcctgatcgccttgccggg

SEQ ID NO: 26234 - DNA, 1501 bp, Oryza sativa
ttaaacaagtcgatggcaaccttttgaagatggtagatgcactatgtaatctaattcgaagtcagtatctaaccatgtcgactgttttcgatgatagaggctagccgctgaggttaggtagcaagatcgacctagattacatagcatatatgataactcgacgatttatataaacaggattagagtgtcatgaagatgtaagcactaatcccgagaacgcaagccgctataacaagctttacctttttgtcgaaacaagattttggcaatactaaaagggggtggctatcaagctagaaaagtggatgggttcagagacaagggattttatacaggttcaggccttcttaatcaagaagtaataccctactcctgtccggggattgatccgccgagtgtattattgatcgtatgatctgggagaaaatcgtgcccctagaggcacccggacccctccttatataggggaaggggtccgtattacaaagtacaaaccatatccctaacggaataggtaattacagataaaatacaatcgtaaccgactaggatcccgggtatttccttgacatacaagtttggtaattaacccgagtccttttaaagatattctatctatacatgacaccccatacccagtcggatatacatgccgtgtaggaatggggtatccataatctccacagtagcccctgagacctttacagtcgacggaataatcttctctcataatccgaaaagacaatccgagtgctttagcttcatctgttttgatctcccgagtaatataatcaaagactgtgaagggctgaaaaatagaaaaaatcaggtgcatcgactagatgcacctaattaggtgtagccctcgactatatggttagttgaacaaactaagcatatagtcaaggaataaataatccaaccaaccgagtggtttttgataattgttatcaaccaagtgacttgatatcaatatatagcatatgcagtgtgaatcccccaaataatatgatccaagtgatataccgactgctttgcagaatatgatgcgtgcaacctaaagttgacaacatttttggaaattcacatagcaaaacagctataaagaagagcttgatgttgtgaataaagaaatttccaaagtattgggcatacaccatgagcacacttctttaacagatgtgcttaagtccctaaaagacacatgatttcaccacacctgaaaatatatggcatatgtggtgtaacatccgagtaaataaactcgtaaacgatttaccaaccgcctggaaaatgaccacaatatataatcagccaaagccataatattagttaataaaaatgcacacttacgtggcaaaaagcaatgatattatatccaatcaactgctttataaacccaaacagcaccttgactatataaaaaagtcagtagggcagctatgtaaagctttactgtttgacaccttttaagatgcattgtaccaactcctaaaaagtt

SEQ ID NO: 26235 - DNA, 1501 bp, Oryza sativa
attcttgcgttacacatatagattgcataatggattagaaacagcaataaacccaatgctggaattgacggatcatcgacaaatcgacagagcaccaaaccaaatgcatcaagaactccgcattcgaagaagattggttcgatcataccccacaaaatcatgcgaaattaccctcagaaacatatttttttcgggcatcaagatttaaaaccaaccacccaccaaagcagaagattcttatggcaaatgcccgcaaaacccacattagcaatgcacatcaagatgaaaaccaaccacccatgaaagcagaagattcttgtggcagatgaccacaaaacccacacccgcaatgcaaatcaggatgaaaaccgatcacccatcaatccagaaaattctcagaatccaaaccaacctacaaaaaaccctcaagaacacgatgcctgccacaccaaaaccctaccctcccagaccctaaagatcaaagcaagattcatcaactgaacggagaaagatcgtcggcgaggagagcgggtggagggagaggatacggacgggcattaatccgtcgaactgcgtggcctggaccatcttgccgagccggagctggtccttcccgatgggggacctgcacgacttgcacgaggaccgcccggacttggcgtactccgccttcaaggccttgggcggcgccgccattccgccggccggtgcggctggtgccctcttcctcccttcccctccgccgcttcttggcttgtcctagggcctagaaagaacccacacaacgagaaaggagaaagggaagggaaaggcctgatgatgatgaggtgtaaaaacgttaaaaaggaaaaaaaaaatctcccctcgaaaatttggggcgagttgagttaatttgatggtttttcttttaaaaccctgtgccatatcctccccgaatgtgtattctcatatgccatttttcttacgggctttacggactgtttggatgggttaactgtatgatttctcacgttttgccacgaaaattactaagtatttctcaatatttttttcgacaattaagctaaaagtaaaagaaaaaaaataataaaacatcagagtttatcagtacttatcataaaacaaacagatgatacctgcgttttaatgtgaaacatattgataactatatgtttaatactataaaaatgatagatagatttgtgagaggtgataactggatatgattgcatgttgatttgtagaattaaataaattgtaaatgatgttgtatatttgcatgaggttgaatatgtaatttttggtagtgggtaatgatgtggcgtggtagcatgttgaacttagtggactataactttaactttataaaaagtatagattggatccatatcatcgtaaattttctatattagaaaaataccactactattcgtgatattggctgggtgccactgaaattttgtaaaattagatctatgacatcaccgtcacatttttctaa

SEQ ID NO: 26236 - DNA, 1501 bp, Oryza sativa; identical to SEQ ID NO: 25849

SEQ ID NO: 26237 - DNA, 1501 bp, Oryza sativa
tcctaagcataaaagcagaagtgaagcactgtaagatatatcatcaccagcatcgatctgttgctcgctctttggcattatattctgttaaacattacccgggcttttgatcaatatttttctgttttgagattgggagactttgggaatgatctgagcgcagtccgatcgactgtagagttaggctttgcaacgttcttttgtgaattgccatagcattgattggagtagcatcaagaggctacttggggccgtctgcatcttcctgcaccagcccaatattgactgagggatcgattggagccactacatttgtttggattggagcctggatcaaaggttggaataggtcatatatagcttggctaaaaacttgtatatgtgtatcacgtaacaagttttgtgtgctttcctcctttctaacatgttgggtttgttttaagttaaattctttaagttcgattaaatttataggagttagcaatatttctaaattaaaaacaaatatactataaaatacatatttaatgatgcatttaataaaactaatttaatattgtaaacgttgatatttctctataaaaatggtcaaacttgacttgggacaaaactaaaaaaagagtgctaagggccggtttgtatcaaccatattggtatggtttagtattggttgtaatacaaatatacactctgttttttaatgtatgacaccgttaacttttgatgtgacgtttgatcattcatcttattaaaaatatagaaatatcatttattttttgtgaatttttttatcataaaagaaactataatcttaacatatatttttacatattataataaattttaaaataaaatgaatgatcaaatgttatgtgaaaagccaacggctatagtagctagcaagtattgttgaagcaactagaaaaaatggcaagacaagtttggtattaaacaaaatggatctgatagatcttttaaaagttgcatgcagaaagcttgagtcgatggttatgtagctttttaccaattatggatggagattcataaatagacttcaataatgtgttctccatatattttattggatatttttatctttatatgctggttgatattatttttggactacacttattttgagtgctagactgtaatattgggttgtagctttttttagcaaaggccgggatgttatattccatctatctattatattattaaaggaatagaaaaaggagcctacacattcgctctcatagcctagaaattctcacattaatcggacccacaataatttcaaccaaattttcaataaagctttaggtaaggggccaccggtcctattactcatagtagctttattggtttgttgaacattgttctaatttcaaccaaattttcaattttggtgtgaactaaacacaccctaaattaaatgaagcaaaagggctgcgaggaatgaggagtggaaattaaatacagaggcattcacgacacaaca

SEQ ID NO: 26238 - DNA, 1501 bp, Oryza sativa
gagaaaagtggtggctaacggccgcgtcatgcacatgcgcgtgcaaagagcggccgagctcggtgaagagtgcggagaagcgaagtaggaagggctcccggcacgtcgtcccctcagggcacaccgccacgccgttgtgcggcagctcgcgcgcatctgcgtcttggtcacgtgtcagccacaccatcgggattggtgagaggatctcctaagagacgggagatggagtacattgagatgcctgagcacggtcacgagcaccaccggctccatgagtgtccgtgcgtgcacatgaagaggacgtcgaatgttgaatcaagggagagctactcggtggccggcggcggtaggtagaagctcgacagcgacgaccaacgatgggcggggagaaggctggcagctgtcgagaagcttgatagtggcgggcgacagggagaagggcgtaggcatcgaggatgatgtaaccacatcgtggtgtaaatggagttgatctcgaagatgatgcggcggagccgcgcgtgctcctccgcggaggagaggcagagctcggggacacctgaacacatcgacttttgagtagctcagcagggatggccctgagctcgagggataggagcttggccagcgtgacgaggcggaagccctagccctcgcgcacataggtgaagacgacgttgctgttgtagttgggacctgcccgtaccacgcgtgcacaagtccatgacgcgagcgctccaggccgttgggagcttttccccaccggctaacaccattctccccaccgattcacggctgccctagaggtttgggttgagatgggaagaaaggggagtgaggtggaagaaaattgccggctgacatgtggtgtccacgtgggtaccatactgactcagccgtcacgttaacaaaaccggagagcataccttgagatcaaatgtgacccgttttacaatattagggatacattacatctggtcttccggttagggacagttttaaaactcgacgacaagataagggaccttaggtgaacttcttccgagatgaaaaatttccagcctcatgggcctgtgcatatgatatgacccataggcaagcgggcactgcggcagcagagcgctgcacaatcgacctccgcctccccaatccatcccgtctcgtcgcccgccgccgtcgacgactcccgtctcctccgcctgccgccggcgccgatctccatcctgctagcagaggtggcgccggcgttctcctgctcccgccgcatcatcgctcaccggtgagcatcctaatccatcccgtccggcctcgaatttcggtctcctcgcccgccgcttgtgccgaaccaccccaatccggcgagcagaggtcggcgcccgtggtcctcctgcagtcctgcttccgccgcatcgtcgctcgcctgtgagcatccttcataaggtattttgtgtttttctcgagacatcgaaccagcctcgtcgtcgccggcgaccgccgccgagga

SEQ ID NO: 26239 - DNA, 1501 bp, Oryza sativa
tttgcaagtggtgatgctattggaagggagtgtaattaatcatgcctaggatggttctcttctttttttaagtatagcttttacatgtttacctcatgttggtttgtttaattgggattgagaccatctgataaggagtggcacttgggttaactgtgagtaactcaacagaaattatgttagttccaaggttgtcaggatcgggatactaagtagtactccctccatctacttttgatagtcatatttcatcttgatacacagaccaatgataagtaattctacttatcattcatttaagcatgctactagtcattcctcgtaaacaagcgattcattaatatttacatttctcaaagcccatatagccaatcatgtgtggaagaatggagagtcacgcattaaattcgagaaaatcattaagatgataggttgttggattgaaatatgcctatcaaaaataaaattttcagatttggaaatatgactatcaaaaatagatggtgggagtatcattttgctcaaagtaatatcgaatcgtaggatcgtatcgtagtatcgggatactatgagattttttttaattttaattaatatttatattaattatatatagccattctatataaaaaatatagtaatgatatatgtcatgcaaataaagacatttatcaagagaaaccacgttggttttgatatattgaactgattttcatataaatttgagtatatttagttacattattttttaaaccatgttattttaaataatattgtagtattgtagggatcgtagaatcgggataccatataagattttgtaggatcgtgtagtaatgaatagtaggatcgcgatattataaaaattaggatactaggtgggatcggtatcgtttcgtctcggtaggatcataatatcgtaagatactagatacgaatcgggataatgacaaccttggttagttctaaaaaacagaaattatgttctgtttaaatttcgcatgaagttttgtcactaataaaaaaagacgtgaatattagggcatgacctaatattaaataattagaagaggtgagacatcgaactcaggttgtctagccaaccaccttgcgaagctagtcggaaaacccctaaatgtttctcgagttttgttcctagtaaatggtttaattttttcacatgactattttgttcttcgttgccctcaattataaggaacaacatcacacattttgccatcggttctcttcctgcgcttctagggcttctttaccacagttgcaacatagaacatacctgttctcatgttttttttactttgaatcaggtaaacttgcaatccctttgtctctagttaggctacatttgtcctttttgtcatcactatttcaagccaaccaacgaccaccattgcaagctacctgccacaaccttaggccttgtttagtttatgaaatttttttgggtttggttatcatatcggatatacaaacacacatt

SEQ ID NO: 26240 - DNA, 1501 bp, Oryza sativa
cggtaaaatattaaccatccagatttttccctctttcattccttctttctggttcttctgttttcacgttttagtaaaatatttaccgtctattttttctttggaaattttctgttttcctagtgtctccccacgtttaaaaagtaatgaatttactttgtggagttttccatttactctcagcctcccacatctgcccattaaaaagtaacaaatttactcgcatgaatgtcccattcaaaagtaacaaatttacttgcatgaatgccccccattgtacaacaccattcctagacggcagtaaaagaattactaccagcttacaatactagtaattcttttaccagtattataaatatttagacttcgtggtctgtgagtaaaacaattaccactttcctctcgatatagcccatgatctcgtagccaccgtgtagtaatatgtttattgatgtgttcaatatatagtataagagcaaaaactgatactaagagtattgttaatctgttcacaaaatggtcgtacgaatgaaaaaaattacaggctcaattacacacgagtgataaaattactcacaggtgaatcaaactagaaaagaagaaaaatgattcagccaaaaatccatggtgaagttgggatcctggtggctttgcttgatcttgctataaggatgtaaatgctggtgtgtgtcttgtgactggtactggagattggagagggcaaccgagtggcgagcggtagtcgacgatggaatcatggaaggatgtagcggcatggtatagacatgagctcgacgttatgcagtagcagccatctatcatctagcaagcacgaaaaaaatgtaaaaacattcttgttcatgtcatacagacgacgagaaaaagaaaaatagctaacaaccttcatcacaggcagactccaccctatcctttgcaaccagccacatggagcacgatgtgcaaatgtaggacttgtgcagcccatcagttcagatcgggtaatattggagattgcacgttaatttgatttgcaaaaagaaatttgggcttcatgcgtgaaggtgaaggagagtatgcagatgcaaattggagtttcgtttccttacttgcttgttttgtcaatgtcgccgacgtggaacagccgccggttgttgctcttggcccaggtgaacacctccttgctggttaaggtgttgtccggtgttcggtagcgaggcccgaagtagcgccttcgcctcaaccgccgctggccaccgccatcaaccgccatggtgatgtcctcctcctccatggtgcgtcaccaatctgtgggttgtgatggtgggtcgattcagatccaagaaaaaggaaaaaatgaagtgggggcaagagtggttggtttgtacggaaaaaatagaatatatactggaaacagggaagttgtttttatcaaagtaaatcgtttacttcgataatggtgggagcgggatgacgggacgtggcgtaggatcggaagcatgga

SEQ ID NO: 26241 - DNA, 1501 bp, Oryza sativa
gatagaaatacaaaggtggaccaaactgacctccaaatgagcaaatggagtgactacgactcggtggaacaatggtggagccttgtggtagactcccttaacaattcccgcattcctttgcgaatattggtgatcttggtttcctaggaaatttggtgcaaacgaaacacaaaaatcttccaaaacaccgcctcaacgccgatttccatcatcgccaagatcaaggaggaagctcgagcttgggtcaaggctggagcctcaaagcttcaagagtttggaatttttcgcggattcttgcgggtttagctttcgaggcttgccctgtacatattactttgatctattttttctccatctctattaatatacgaggcaaagcttttgccctcctttaaaaaaaacaaagaaaagatgcaagaaaaaacacaaaaaatggtaattgcttattgggaaggaacatcaaaccaaaatagattgaaaggggctgtttgcaacaaatcgttttataataagaatctcaaactcaagctgatatttggggtgttttttttttcaaatttcccttgatttcatgccttcctcatcttaagctggcactgaaggtgtttgatgagctgcttgatgtggtcgtactggtcgctgcaaacacttcaggagttgctcttgtcgatggatccttctttccacactccacagcaagcagcgaggcgaaacgtggcacaccatcgtccttctcagagcctcccattcccgcagcttagctatcttgtggtcatcaagcacagagaacaagtttggaccaaagcaaatgcgtcaaaagtgtagttcactcaacctctctgctcaagctaatgttgagtcgtgtttctttcaaaattttgggcttgggcttacaggtttccattacttggaaccaatactcctagtgtttccttcatcttgtattggatgtatcatgtatggctgacaaaattttggggcatttataacaaagtaaatttaagtagcatgtactgtatatggactgaaagagacaattacaacgatgtacttttgtaatatataattcatttgttgtaaaacatacatgaattttgaaaaatttatgatcaaagataaaagtatatgacataggacaaaactagaatgagaagtaatgtgaaatggaaggaatatatgatacttgattttctttcaaactttgaccaataatattgatggtggcgctaatactcgcaatgcgcgcataatattagtttgagcgttgcacaacgtttccttcttctggtttttccctttttttaccacccaccttaatttcctctgtcgcgtttcttttgttttttaccaccccaccttccatgtttcttttttttttacttttccatctcatccgtgctccatcaaagggcccggtaaaatattaaccatccagatttttccctctttcattccttctttctggttcttctgttttcacgttttagtaaaatatttaccg

SEQ ID NO: 26242 - DNA, 286 bp, Oryza sativa
ctaaataagggcctttaaacaactctacttttcttaaacaaaatgcacgggaacttacgttcactaactggatactaaaacggacaaaggaagtggagatcaggcgatgtagactcgaaatgacagcttctcgcacggtttgcaaggccgaaacaacatgagttttactattatcgtcatcattagaagtatgttcctttacctgtcgctgctagttgttttctattttaatgtaatctactgtatagcttatcgctcacatgtttagtacgtaatgctatgaaat

SEQ ID NO: 26243 - DNA, 1501 bp, Oryza sativa
ccgtcacctccgataatctccccggccgcttccgtctaatcggcctgatcaaaaggccgaaccaacccacaacgactatcccagcatatttgttgtcctctagtataaaggctagctgtaccagtacgttgttgattacccttctaaattcctctgatgtcgctgcaacctgttagggttagttctttccatctaatcctctttcaaatccaatctaccatattttcttgatctcaaaattcattttgatgtttcatgtatatctcaaatagcagttttgctatacatttatcaacaaattctccaattttttttacaaatgtaaatatagtgtaatggtagtgtaattacgtacattgtaacttgcatataacacagtataatttgtatgcaactttcaaaaatcttacgataacattgctattttcatgaagcggaggtcacgagaccaaatcccctcacttgtgtgcgttgcgacttttatatatcttctcagcttgcaccaatcttaaagcaaatctaacgatttcaaaattacgcgaaagttataatatcagttacactgtagttattacatgtaagttagttagaatgtaattatagtattgttatactatatttacatctgacaaaattttagaagaaaatttgttgacaaatgtatagacaatccactcaaatagaagaacagaagataatccatatatatttttttaaaacaacccatacaagatagtgcgacatttatattaataaagtaggaataaaacacaagtctataatcttggaagactatagtaagaaaaaagaaaatatgcatccacaccactcgtctatgtctgatcttactgctaaatacaggacaagcacacaatacccctaagaaataagtcttctaaacgacgcctccaaggaggaaacgatgccaatagcttcgtcaccgcctgtcctagagatccaggacgtggtttttgttggtatttcttaacgacattactagaaatataattcccagcaatggcgcagaaatacttctggtatattatggttacagagttcatccgcaagcgcacggatataccattgtagcatttcacccgagagtattccaagggtatcatatttattttatcccatgggaagatcatgtagagagaactcaactaataatttatatattacatgtgataatcatattctaagcaggggttaagataatccaagggtagagtggcacacaagcatttctactcatccttataataaataatctaagctaggtggaaagaaaagagaaagagaatcaattcctatacttctaatatacatagtatacatacattctagttaattgatatactagctaataccctatatccgatgctctcctggtacttcgagaagccacccctgactgccgagttccttacgacagcccgtcatggccatccaaccggggctaaatacagaggaatacccccctaggaaattaacttaggat

SEQ ID NO: 26244 - DNA, 405 bp, Oryza sativa
gtggttggggtgccagcttcccgcccgaggcagaaggttagggcttggcccctacctaggaggagtgcgccaggcacgctggcgccgtggtatgagggtcggcgccagtgtggttggcgcccccctttgccacgtcaccctctccacgctcgcccttgtgccacggtggcacggtcacggcgccagggtggctggcgccgccatgttggagtacggcgccagccactctggtgcaccagaaaggatcattcctgtaataagtttttcaaggggccatttgtaaaataagttttaaaaaaggaccaaaaatgtaaaaatttcagtttgtgtcattggtgctttggtccagtttccttgtatgtctgtaacttatgaaaccattgacttgcatttgcctatcattgt

SEQ ID NO: 26245 - DNA, 1501 bp, Oryza sativa
aggactttgttggtcttggcattgataaactgagtaggatctgtgtcactgattgggtccaaaaagaattggtgctggttttgcaagctaggaactgcaacttgacgggataggtgctacaatagaaggaagaagagatcagggaagggagcacaaagtggtaaagagacagaaagggcctagccgatggtgcttacctcggggaactcgaccaccggagcgcttgagggattggcagaagacattgccgaagtcgggccgccgccgaaacaagggatcgcctgcagagtcgctgagcgaattactggagtgattgggggaagtttttggccaaggcaattgaagcgggggagacgccgtgaaattttcaaggtggttgacactatttaaaagggcgcgttgacggccgaaacagaaaagaaaccctagatgcaagcggaaacaaaatcgagcacatccgcaacatcgcaaatatcacggacttgaggggcatgtgttaatgatcaaaattggtaaatcaaagattggatccgaagtcagaaccaaagtggatttggtggaaatctgtagcctcagaaacagaacccacatcagctacgggttgcatcggctgctaccaaatcgggcaaggaggagccgatataactgatcccggcaaggcgatcaggagattgttgtctagatcggttcaagtgctacaccagtattgccaagtgtggattgagtccggagaaggcaattgtacctattaattaggatattctaatagtttccttatagatattttcagtaagagtccacaggacttgttcgtatttttgagttgtaatagagatagagtcgtgttcggcaaggacatatcatgtattttgggtataaatataacccaggaccctgtaaacaaacaacatcagttcgataacactttcggcgcatcgccacccttttttcattgtttcgacgagttcttgctttcgagttgggctgcatagttttcgatctccgacgaaaagtgtggagattatggataccccatacctacacggcatgtatatccgactgggtatggggtgccctgtatagatagaatatctttaaaaggactcgggttaattaccaaacttgtatgtcaaggaaatacccgggatcctagtcggttacgattgtattttatctggaattatctattccgttagggatatggtttgtactttgtaatacggaccccttcccctatataaggaggggtccgggtgcctctaggggcacgattttctcccagatcatacgatcaataatacactctgcggatcaatccccggacaggagtagggtattacttcttggttaagaaggcctgaacctgtataaaatcccttgtctctgaacccatccacttttccagcttgatagccacccccttttagtattgccgaaatcttgtttcgacagttggcgcgccaggtaggggcagcgtcaagttcttcgccgactagtgtga

SEQ ID NO: 26246 - DNA, 1501 bp, Oryza sativa; identical to SEQ ID NO: 25878

SEQ ID NO: 26247 - DNA, 1501 bp, Oryza sativa
tacaccgtctgcacggcgccgtccatcttggtggcctccttgggcgcgtagtcgtggtgcacgcacagcaccgcgtagcgcgggtcggccatgcgcgccagctccgcgacgtcggcgacgaagaggaagtcgcagtcgacgaagagcgcccagccgcggtagccggccaggtggggcgtcaggaagcgggtgaaggagaactcggtgctctccgtgggcccgcgctcccgccagtacagccccgcagaccggagctcctgctgcacgatcgggatcacggccaccggcacggaggagcgctgcagcagggagcgccggcacacgcggtacgcgatgtcctcgcgcgagtcgtacccgacgaacacgcggaacgtctcagcggcctgcacgtcgccggcgccagctacagggccagtcatcacgacgtcgttggtaggcgtgaccgacatagtatttgttggtgatatataagcagaaggttagtagtactgtttgctagcttccccgcaaaaaaagaaaaaaagagtagtgtttgctagctcctggtgctacgtacgcataggccgtgcgagttatcacaaactcctccgcctttttaataagagcctaagagccctttgtcctttgagtgtggggagcgaattgaaacgaggacatgcgtatatgacgacatgtacgtcaacagcgttacgcttgcattattaggcccagggagatcgatgtccagaattatgcatatgtgtttctcttcttttgttgccaaaatcaacaaaattagataaaggaatcctatagctaaccgattgctgtgtggtccggcgccggcggatgcatggcgacactgcactgtggtgtgggcagcgcgcgggcgggaccgacgacagcgcgcgcgcggttgctaatttgtacgggtaatacgtggtcctgtcgtgtgaactaccacagcagcacggcaggaacacgcgcagctgcatgggcagttgggcactctgcctccctgcgtcgattgctccacagtcgtcgtcatgtcccgatcctaattatcacgtcaaaacagctaggcaagtgttgcttgtttttttttttagataataagtgttgcttgttgctccatcgttttcctttttcaattatatatgttattattcacattttcactcagtattttattactaccttgtagaagtttatcgagaatgcatatagtcaaaaatgtcttattttggatgtccagaaatgtttataatttgagaagatgtagtaaaatttacatccaaaatggacaattataccttcctttcgtggcttcacttccatgtgtataccttatggttgtaaatatttaacatttagaaaaaatattggttaaacctccaattttacaatagcataagtttataaaatatactacatcctattcttttttacttgccgttttagacattgatacggatataatttacatattttatcattactttttctaaacatattttttaca

SEQ ID NO: 26248 - DNA, 1501 bp, Oryza sativa
aagaaataccaacaaaaaccacgtcctggatctctaggacaggcggtgacgaagctattggcatcgtttcctccttggaggcgtcgtttagaagacttatttcttaggggtattgtgtgcttgtcctgtatttagcagtaagatcagacatagacgagtggtgtggatgcatattttcttttttcttactatagtcttccaagattatagacttgtgttttattcctactttattaatataaatgtcgcactatcttgtatgggttgttttaaaaaaatatatatggattatcttctgttcttctatttgagtggattgtctatacatttgtcaacaaattttcttctaaaattttgtcagatgtaaatatagtataacaatactataattacattctaactaacttacatgtaataactacagtgtaactgatattataactttcgcgtaattttgaaatcgttagatttgctttaagattggtgcaagctgagaagatatataaaagtcgcaacgcacacaagtgaggggatttggtctcgtgacctccgcttcatgaaaatagcaatgttatcgtaagatttttgaaagttgcatacaaattatactgtgttatatgcaagttacaatgtacgtaattacactaccattacactatatttacatttgtaaaaaaaattggagaatttgttgataaatgtatagcaaaactgctatttgagatatacatgaaacatcaaaatgaattttgagatcaagaaaatatggtagattggatttgaaagaggattagatggaaagaactaaccctaacaggttgcagcgacatcagaggaatttagaagggtaatcaacaacgtactggtacagctagcctttatactagaggacaacaaatatgctgggatagtcgttgtgggttggttcggccttttgatcaggccgattagacggaagcggccggggagattatcggaggtgacgggaattttacgttctggaatgattaacgaaggacgccgttttgcaaaaacgtgaccggcttatcaccatcaacgtttcaatggctgtatcaagcgttttccacaacactgtatgtaatcagtgggagtacgttttagacgtgctggtgctaccgaaattgcgactgctaccatcccggctgtacgtctttgatagtcatctttaattcaatttatagcccgtatgtctacgtcgtaattaattcatgaaaatcgatcggtttttttgaaccatgagctttcgatccaggcacatggaaatataaaaggaaaggatccggtcgatcgaagttttcgatataacttcatgtcgttcatgtgaatatataatcataaatcacgtacagcaaagtcctttcataaatttatgtcatgataactgcacataaggtgtagtttagacatgcaaaactttagtatacaaatagattgccatttttgtttgctttattattttaacaccctgattttatctaaa

SEQ ID NO: 26249 - DNA, 1501 bp, Oryza sativa
tttaactgaagggatgctgttttaaatgttggttccgaacttaaattgatgccaaatttcctgaactgaaagcttgttatgttaatgtgcaatcccttatcattccgtaacatcagtaacttaactttttttcatcctcaactgtatcatcaaacgtggcactgatgtggatatgtttctttgacctcatggatttggtttattgacctcatggtcatattctaatgagaaaagtttcgtctgataatatgtcagccagggattaaaacaaaattgaaggacagtctgatgatactgaaggtgcggacagggccccacaacttagtctaatgattacgatcagacttcattatataactttattatacataaaactatctttattcaaatctcaattaatttcagcatatttgaaacaatactttttaaaagtagtgcagagtgaaactatatacgctttatgttttaaaattttaagtaaattcatactcaagggtgagattttgtaaaactttaaaaacataatatctggggttggttatatgctatgaaatgtgtatgctatgaaattaaattatttttagttactttgtgtatgctatgaaatgtgctctaaattaaattatttttagttactttgttcattttttctatggcttcacatagatgaaataagtcaattttgcttcccttagctactgctcccgatcgaatcgcctctctcaaccataaaactgggtataacttctcgcccatttttaaaaaccagtgcaaattaaactccttcagttatttttaaagcggtttctactgacgtggtaagttaatcacaattgattcgttaaatcagcaagctggacccacacatcaaagactcgcgtgtaagcctctcaacgaaaaaaaaaaatctgtaggatccacttccctccccttcctctctattttcctttcttttcttttttttttccatccatcgctcttaccgatgggcgacggagaaagggccagacggcggctgttgctgctgctagcgagcatcgaacgtgttgaccactgtgccagaggagtttgtttaggtttctactgagagagccagtacacttttgttggccattttactcgttgatgaagtggagcgtacttaattggctgggttgaacatgtacgcctgatactcacagtggacagtggtggcatctgtatcgctgagccatatcgtacgtgcagccagggtttactctatcggtagaggcgtttgtatagggggtcaccgaaattctaaaatttcggtctgaaatatccgaaattttgagtaaactttagttgaatttgaacaaatattatccaaattcatgaaaaaaatgaaaattttcggccaaaataatatcgtatcggaggtgaccgaaatgaccggaatttccgaaatttcggaaatttcggtccgaaatttccaaccccaggccgaggcaaagctcagccttgtgcgcactgaggatgacca

SEQ ID NO: 26250 - DNA, 1501 bp, Oryza sativa
ggaaaagggctaagtgtatcatgaaaacataggactttaatcctgttactgcttcggttaatctagcattttcgtatatattttatttagttgtaatattatactccctccatcccataatataagggattattcctttttgggtaagattaaggatagcatgcaaatactagaatacctctattaaatgaggtttgcttatggtgagtgggtagtggggggttaaagtaggtagaaatttgaattggagttgatagacatgacaagtagtataccaaaatcccttatattgtgggataactagaaggggcaaatcccttatattatgggacgaagggagtatgtactgatgaacccatgatagtcttattgaactcaacatgataataggtggcaaatctcaaactgatgcccatcggagtatttgaacatgacatactagtttaattttacaagctgtgttaattttcaagtgtttctactttctaattgactccagtaacatgagagaaatcctaccttccatcgcttctcaaaccttgtaggaggttaaaattttcccttagtaaattggatttgttaaatagaagagagttagcatccagccatccgtagacatgacgggtggaattgttcattatattttatcttttatccttagctgacacttatctgccatcttgtttgctattgtggagcgtgtacataccatttttgtaaaccatggatagttttagtctttgccgactatctagatggcctcaacttctcaaggcttgtgtgatatgaaataccacagtgtaactagtccggtctgttatggattagtttggttcctgttggttaatctataagaaaaagaaaaggtggggtctcagtttctatggctcatgatccgaggggttagcctccaaagcttgtattattctctggaattcattgaccttatggcttatgcttgcttggtaatgaaaagccaagatgaaaaacactataatggaattgaattcactttttatcctattcctttggttggtttatgggagatgtgatcatgggagttggctgacttctcagcatgattgggaaaacctaagtacctaactgctgaaattgtagaacacttaacttaaaactgagctatttttccattcttcctatttctattatgtcattgtattataagccgtcttcagtaggtttgtggtgcattcaggtatttaatgttgctatggtgtgtcgatttctgaaatggttggcaaatataaatctgtactcaactactttatctgatctcctggtttctctgttctctctaagatgctcttgtatgcaaccaattccaaaaggacaaaatatccttgatctgaaacagctccatttcgctggttacataatctacttcacaactttagtaatgaatttatgcccttgtttccatttgatgcgtattgaatgttatgccctgcaatttcacccaagcctttttgcctggtgcagg

SEQ ID NO: 26251 - DNA, 1501 bp, Oryza sativa
tcgaggttacctctgtaatgggcgggcgattcaatattgattgatcgcgtcattacgctattaggacgagacacagagatcgacgttcagtttttccacgaattctctccatcgctggtttctcccctgtgcctgtgctgcttctgttcttcttcggttctgatcgcttgcgcacacaagtgattgggacgagcagggcctccggaaccacaccctcgcctgagatctgcacgggtaggcgggtgatcaggtttttggggagtgcttccgcacgactgctcgcttcttcgtcgtcgtacggttccgtctgcatcgcgtgatgtctactggtggtggcgcacccggagcggcaggggttggtgcgccaggagcaggaggtggcgcaccaatcgacaacaccaatggaggcaattctgactcacaatccagtggagggacattcacagggtatagcattcttctgttacctttcattttgttaaagctgtcagtcgcaaatattattgcgttgtctcaatgctgatgcttattttaccttaagcatgctcatggttatgtttagttttatcactagaccacttcacattgtgcatgtcatgtttattgtcttaatattttggattaaaatatgccgattttttaccatatttccaacacttattaccttcctctgatgattggtctcaagttaatcctctaacaaatacattgagatcaaggaagccgaccttgtatcccttcgtctctgcaggatcatgctgcattctaaaaacactgaaagtaaaaacattaaaaaaggtcacaatttaatgaataaaactaatacatgaaatggtagttttattagagtaaatacaatagcagactatatgccagttataaacacatttcgaggagataaaagataagagagaagagcagcgggctacaaatatgtagccaactgaaacacggactctaagatgcacacactggtggggaaagcatttgcagtcccggttcgtaacccccctttagtcccggttttcaaaccgggactaccaatccaggactaaagatcgctatctttagtcccggttggaaataaccgggactaaagatcgagctgaccttttttttttgcatggccctgttgctacatggtttatatatatatatatattgaacttccgcccaagtctttctctccatttgccgcggaccaaatgacggaaccgataccaagccctacatggagtttaaagctatgattcatagtagcaattaattataacaagattcttaattaatgtcacgcccagaaattcccgaatagaattccaagcagaatgtgcataaaaacccccatccaggaccggccggggtacacaaacaacaaagttaacatacagatccatgtcttacaaacatcatataagtcttacatatatgcagcggaaaattaaaagataattggagcaaagccttgacttggaccgtagcgggatcaccactccacagg

SEQ ID NO: 26252 - DNA, 531 bp, Oryza sativa
acattactcttgaagaaaaatgttcagttcttctggacgattctgctgataattggagtttcagctcagatggaggaacctcaacttcgaagtacattgtaaacttaaagccctttatccatttcaataattgaattcaaattgagttattacacatctatgaattgtttgattctatatccactatttaggagacatttatcctggcgtacgctccaattctatggtgaaaatagtgcaaaaatgagggccatgttgatactctctctttttttctctttttagaggcatttatgctttgatcttaagctttcttatataaccccctttgtatacatactactcggatacttgatgattgtggtgttaaacaactttgctttttctaatttgttaagttaaattatgctacagttttcaatttgttctttgacaaaggatgcaaagtctaaaatgacttacattcagaattagaggcagtagtttgtaagaacatgccccattggctaagtaactattcttttttatagg

SEQ ID NO: 26253 - DNA, 1501 bp, Oryza sativa
atggacatttacctatatgccatgtgtggactacatggtgtttaagcatgtgtggctacatgggtaagttaagccgatggggacattgaattctttgaggggggtgtatgtgacatcttggcccaattaggatgagacatgtgtagcccatgtaaactgtgtgcacatatttagtatcaccttgctagtttagcaagggtggaaccaacttataagacatcttccctctaaccatattacaaccgggttaacccttttacacgaagtgaagacgaaagtgtaagtggagtggtatgtgtaagtgggcccgcttgttggttgggctgggctgcggggttttggaggaagggctgttacataatactcttcctatttccacattagtctactcccctgtctcagaatccacattagtctactactccatctgtctcagaataagttaatctaatacgacacgagatgtggcatattttagagtctgcttagggagcctctatcaactacagtctacttagcccccaaacaatctagattatcacctagaacccaaaaaatgaactaggccatgttggggaagcttaagattataagaatatgctagttggtagccagtttctaagaatctagagaagttgggttttccagcttttgctttcttgattttctagattctataactgcgaattctcaaaatcaaggtgtcaatctgaattgtttggaggagctgaagattctgtggaaaacgctatagcagctagaagctccccaaacaggctctaaaacccaaaagctagaaaatccaacttcttaagattcgcagaaaatggctaccaaccaacagattgtaagaatcttaaacttctcaaataaaatgtaagatatattacattccatagggaaagtgatttcatctctcaaggagatatctctcgtttcatgcatgccacctaaatagtcataaaaattttgaaaaaaattggtaagatggattaatatgaaatatatcactccacaaatacacaagttaaaattcaactttacaagttgtaacaaaaataacaagtatagctgcgaatgtacgataactattttcaatttattttattcttttgttgcaacttgtaaaagttgaatttggtcttgtatatttgtggagtgatatattttatattaatctatgttgtcgattttttttattttttttataactattcagatgacacgtaatcaacgagaggatatctacataaccaattccatactagattaacttatttaattatatcttattcggttaaacttacttttacgagatgcactgatgctgagaaaattataccctcatcattgcacattcgaagtacgtcaccatgaacagaagattctatttgacccggcgtgtattaaaaagtttttttcttacagaaaaaaaaaactttgaccactggctcgagcacttaaaagcgtctggtttaatggatcacatggacagacactc

SEQ ID NO: 26254 - DNA, 507 bp, Oryza sativa
aacatcttgtaccatgtttatgatagtggttttgattgacacgtaattggttttgttgaagttaaagtttgacaccgaattaaatccggattcacatcaacaaaaacttaatatgaactctgaaagaggttttatgtgcagctctgtatggtcatgtgtgactagaacggaaggtgcttctagaagagttactacttgttagcccaaacaatagttttgccccgaaagctaaagctataaggcacgttttggcataaatcaaagatgatgtaattaatttttgacgtgatattttgatcatttgtcttattgaagaaaaccatcgtcgaagtactttcattctgctgcaacttgttttatcgtacgtatattttctcgtgtttgtaatattcttttaagatgaatgaataaaccttatgaccaaaattaacagggtcagggtagtaagtgtagtaattaagtggggtgagaatcctctatcataatgtcagtaccattacaataata

SEQ ID NO: 26255 - DNA, 1501 bp, Oryza sativa
tattttttttctcggaatcgaaatcggaattggaaacccgaatacgaaaacggaatcaaatattatcgaatgcagatacagagtgaatacgaatcgaaacgaatacggtaacgaataattatcaaaatatcgacacccctcaaaataagtttcttaaatcgaggaagaaatatagccattagttttcaaaaacaaaacgtcagtattttcaaattttatctctatttataagggcaaggggagatagaaaatgttatgtttacttttcatacaatttatgttatcatgaaattaaataaattaatgtgtatcactgaaattttcgcagacgcattgaaatttttgaaaattggttgaatattttaaattttgggttgaacatttcaattgaaagtttttaaaaattcgagtgattatttttcagaattgaatttttttcatttgtttgtacgtggaccacttaaggacccacatggaaaaatcaatttttccatacgggtaacttaagaagccgtatgcaaaaataaatttgaaaatttgagactagtttatctcactcatatgaactccaaattagatgattcttttttctaaatgtttctaaaatcatactctatcatattattgtgttattactgctattattttggtcattttttcttgtgactttgttttatcaactaaaaatttgaatttcaaaacttcaaataatattttgaagctgtaattaatttcagctgaaaaagtcatcaacataaaagttgtagagctcatcaagacatacaacttttattttgactatttcttcatccgataaagtgatagtaacattgttcacaaagtttacatatctctcttatatagtttatagaaccagatgagacagatgtaaattttgtaaacaatattactatcactttgtcggatgaagaaacgaccaaaataaaagttatagatcttgatgagttatacaacttcgttgttgatgactttttcaattgaaatcatttagtattttaaaatattgtttgaagttgtcatattttgaaattcaaattcaaacggttcaaacaaaatcatattgaaaaatgtccaaaacaaaagttgtagatgttgatgtgttatacaactttgttgttgacaacattttcatttgaaatcagttactacccggaaaattatttgaatttcttatatttttaaattcaaattttatatggtttaatcaaactcggatggagaaatgaccaaaataaaaatggtagatctcaataaattatacaactttgtttttgacaactttttcttacgagttgattttaatgccttaaaattcattttaaagagccacatataaaaaaaattgatttttacattgaaaaaaaatccacctttttttaccccaaccttatctactcttctcttgacccttcctctcctctctctttctcagtttctactctctctctctctctctatctctcacttcctcatccacagc

SEQ ID NO: 26256 - DNA, 1501 bp, Oryza sativa
cgtggatggagatgaagggaatcctaatgagggtgtcgaaccaggagaagtcgaacgaaatttgcggttttattctttttatttttaatggttattatggatactaaatgaaaaaaaagagtaaatatacgaacttgtcattttggtgcaatttagtatattaacttataaaaatcttatttttatacacgaacttgtttggtaggtgcaaaccaagatcaaaatagcatgactaggctaattttgcccagttggatgctaattattaggacatgatatgcacgtgtgaggtgggcatgagacatgttaaacttggtttctatattatccttcttttttatccatccttgcatcttagttcttctatgtctttctttatacaatatttatgtcttattttacatttattgaacatacctatgtttatgtggcatcttctcgcatacgcgtttatgtcgtatcctcatcaacacttaaataagagaaattagccatatcgtattcttttagccttggttcgcactcaccgaacaaatttatgtattaagatgagcgttttacaagtttatatactaaattgtatccaccttattagttcatgtactaccaaaacaatttatagaaaatgattgttgtaacttaacgggataaatagtgtgtaatctattcggactctacgcaacttcaacacggggtaatctgatgagtttcaaaaataaatagagataatccgttcaatccaatgcaacaaaataattttaaagatggtttttgaaatggaggtggtgggaatgggagagggatgatgaggatggctatagagggctgggtcgacggtgaggtgctagagcagtgaggatgtagacatagttagcgggaggggaaaagatatcagagatgaggaagaaaggtgacgtggtggtgttggaagatcataaggaggagcaaggaagatggtggggagatcttggctgaagggctcatcgaagtcatcgaagccggcgcaggtgttggcataggaagaaggtggggttagggtcatgatggtatgctgagcagtgttgattttgggtaaatagggagagatgagagctcgtacgaatctttaagcaattaggctaaatgttggttcgacgatgggaaaggcattcatcaagaggtcaccataatatgagagatcaccttaggaaaaaaaggaaaacatcacactatgagatattccccgggacccaataatctccattgatcctctcacttgtgtctgtgtactaccttagaagttagaatatatacatatgttcagtactaaaatatgttatatttaattttagggtttttttatgggatgaaaggagtatatattacggtagccactggaggctccaggtgccgtggcgtgcgccttgtagcggcggcgcccttccacgtgcgcagaggccgccagccggcgaccactcgcacacccaccacaaccagtgatcagacaccacctaccgcgcgc

SEQ ID NO: 26257 - DNA, 227 bp, Oryza sativa
ttgggcgacaagtttaagccagaatctttaacaccacgccaacaccgcctcgtgcctcgctcctctccgactccagatcaaacgcctcctgataaaagcttcatctacaaatttacaggacgaattctaacacgacacgagtattcgaaggccaagttacaacataaactcctctacggttaagcaagattcttgattagaaaaaacagcacctatttaattcacaa

SEQ ID NO: 26258 - DNA, 1265 bp, Oryza sativa
cggtttcaaatttgcaatgtgaaatgtgggactaaccccaaaatctacaggcaaatcaagcttatatgcattctcattaatctttgctaatactttaaaaggtccatcagctctaggcatccattgagattttctcaaattaggaaaccattcttttcgcaaacgcaaccaaaccaaatttccaggttcaaaattcaatccctttctatctttgttaccaacaagttgatctgatgctcaatttcacgcaccggtggcagccctgggggtacgtccttgggaaacacatcctaatacttctgcaaaaaattagtgaccccaagaagaaaagagataggcatattctcaaaaggaaacaaggcctctttacaaatgagagcatagcaaatagtgtcactcgtatccaaattgacaatatcagatttagtggcaagcaaacaaggacctttcgatttaatcacattgtccttaccatgttcagatttagaatctttcttgttatgttgtacaagttcttttgctacaatctgattttcacttttagcatgctcaacatttttctctttcttagctctagcaacatcattctcaaaaacagcttcaagagtcataggatgcaacacaattttttttctattatgcacaaaggagtattgattttgttctaccatgatgcaacgtgtttttatcatattgtgaaagtctacccaacagcaaggagcaaggagccagcatgcataggtacgacatcgcaatcaacaaaatcacagtaataaccaattgccaaatttaatctcaccaattgtgttaccttaatgcggccactgttgttgaaccactgaatgtagtattagtatgggtagagatgtggttttgtgaaatttactctaaaagaaattaccttctaaaagaaattacctgctacattggcattgtcacattttctaatcagacatacgcaaattctaggatttcattttgtattcaacagtttcaaagcaataatgttgataattccttcatcaagttatactccctccgtccctaaatataagagattttagtgagatatgatacatcctagttcaacgaatatagcctatagcatgtgtcacatcttaactaactaaaagattagtatttttcctttcgtcacaaatttttcatccgtaaatgtctgactgagcggtgccctctctctccgtgtgaacgcaatcgtgtacagcggccaaagaaaaaaaattctgagaggatacaaaattata

SEQ ID NO: 26259 - DNA, 1501 bp, Oryza sativa
  unsure (1)..(1501): unsure at all n locations
ttatccctacgcctatgctgcaagggtggtaggataatatcttcacgctcaatttgtgaccattttaattatgccacaccgatcaggtttattaacattcactaaatttgttgcatatatttgtcctccattgatcagcatgcgctaatttatgttgcatgttgcattattgaacattttaattccattcgcattatacaaacctgcacattgtaagaccataaacagtgtaagggttccaacacgtcatgtaggatgaggttgctttgaggatactagctaatacaattctgaccacctctaatctacnnncgaccgtacncnnccacnctttgtanaaggtgccccttaacccttaacttttttcacctttacccctcctctaccgtggccccaaatactcaccacttccaatcccctctgtagcggcagtcgctccctctcctcggaagcatcggcgacgaagtttctcccatctcacctaggcccgtcgatgagggcgtgcaaacggagcgcccgtacagggccccacaaaaaaaattgaggccccccaaatcagagaggccatagcacaaccagccagtcgtagctatagcattgacgttctgtgtgtgttcatgtgcatgcgatataatgagaggcagcgagtcgtgtactccggcctatcactggtggagaaaccatctttcgtcggtcggccgaattccacaatagtcccggatgcaataaaaaccggggctaaagatgatctttagtcccggttaaaaagggtaacgggcatatttgatctttagtcccggttggtaaggtcatctttagtcccggttcaaatgctgacagggcctgtcaggacccccaccaaccgggactaaagatcgtaacttaccaaccgggactaaagtcccacccctatatatatgtcttcttcctcctccagctgcccgagcaagcttcaaaatttcttcaaaaaagaggggaggtcatgccaaaatttctagtgaatttattttggtgattacatacaaatcggaggtgcctaaaaggtttgcatcttcatcctccaatgtttttttttgtcatattacatttgcagctatgtttggcatacttttttgtctccaaaatttagttgtaagttgatgagggagaaaatttgtgtggggaagaaagaatatatagaaatttagttgatttgctaaagaaggttttataaaatagttgagaaggaaaactatagtgagagttaatcttgaatactagaaaacaaactaaaatgaaaattaaaagaagtaaaacacattaaaattagtttaaaactttagaaatagtaaataagaattatttggtgtaatattttatgatttttgtatgaataaagatatgtcattattatatgactgttgaaacagtttgtaattatcttataattattgtatgactgtcattattgtaagaataattatttttgtacgattttttctcgactcatgtagatggatcg

SEQ ID NO: 26260 - DNA, 280 bp, Oryza sativa
agtttccttttagagaaacatgctcgtttctagccataccagtgtaggataagagcgtgatacgtgctgaccacttacgttcctcctgaatgaatatctgattgatgatagttagctgcttcttgtttagggtggggggtatctatcgtaattcattttcagataggagaaaatttgtgggttggtacgataggttagcccaggcatactaaatttggctttggctaagctggttctatcctttcgtttgatcgcagggtgtagcttactatcatggcgt

SEQ ID NO: 26261 - DNA, 181 bp, Oryza sativa
cttggcatccaccggtcttatccaactttggtcacgcaaagctggccagggaatgggtcccactcttctctcttctccacacaagcgatttgtctacgtggattaatattaccatacgtcgtgtgtgtgcgttgtgaatggcctacgagtactctccgtgagtgcatgtctcattttcagt

SEQ ID NO: 26262 - DNA, 1501 bp, Oryza sativa
gatctacacacttacgaaccaccggatttcggcggcggctactgcggcgtcggagtgcagattcatcaccctgacgaggctgctaccgtcctcgccgtacctgatgaggtggccgtacatccgcagccagtggtcggaggcctcgtcgacggtgcggtaggtccagatgtgtggtctgagccagaggcagtcgacgaggtcaccccacgcgcctcgttttccatgctcagcacacgacaccattgaaggtccgtgacgcgcctgtcgtcggaccggataccggcgacgccaaggccgggcaagtactcgacgaggtcagccgccgaagcaggtagaggggctggagatcatcgaagtggccaccggtgagcggttgtcccgctggcttcgtgcgccgccgctccagccaccgtcgccccactccgcccgccgccctagtccacatcgtaggaaagaagagagagaggatagcaggaagaagggagcagtgaggatgacatgtggggcccacgtgggtcccacttttttttaactgacatgtggggcccactaatttaattatttttctggatcgaattgccatgtaagcgccacaccagccaaaaccgccctctaaaccgccggaggaccttatctgtaccggttttgatagttgagggacccgttatatctggttttagggttcaaggacgaaaatcggattcgttgacaagttaagggacctcggatgaacttattccccagaaaaacaaaactgaacactgcagtagagcagaggaccaacagcaacacaagagaaaagaagtcatcacatctacctgctacctaactggagcacaacaaggctaccagcaagcaggcagattgtgcaactgccatctactcaccgaacaccaaactctccctctcgcttctcttgcaaaacaacctttccagaaccaaaccaaacaaacaaacaccggttcaacagtctaatcactagtcactagtctgtctggtgtgttgttctccttaataacgtaattaatccatccactgtcaaaccaagaaacaccaaaagatggaaaaggaaaccgaaggcagaaaccattaattctcgcacagcacaatgtatctggtccgattggtgtagttagctccagaccagctggtcataaacatggtctcatcctcatacagggtgtgcaaatcacaatatcttcagtagacaattaattcaggaggatgcatatcacaattagcagtagtttagtcaattaattaatgcttcttttctacactgatgctgcaggttgcttacttagtagatccaatctagaacacagcgagtcatcttctttatattcattccattcctcccaaagacgcaacgtgcacacaccaccaccaccttcatctcggtggcttcgttcactccgcctacctacctacctttgcagttggtttgctgaaccctcctcaagaacccacgcgcctctcgcggcagcagctaaccaagcca

SEQ ID NO: 26263 - DNA, 1501 bp, Oryza sativa
ccccactacatccatcgtccgatctcgcggtatggtcgatctggccgtccgattctccggacaaaccctagccggccgtcctcgctccccaccacccactcgacgccgccttgcctcaccactgctgccgggggccgcctcgtcctccgcctctccccgccgcctccacctcctccgccgccactgtgtcgtccccgtccccggctgcctccgcctccgccttcccctcgcgcagggtgcagccgtctccgcctcctccaccgccgtcgccgtcaacgtcgctgagcaccgtctccgccgcccgcgttccgccaccgtccctccgtgccgtactaagagtaggtgtatatgcctcttcctccccctcgcgctgccgcctcggcctccccgttgcgccgtcgctgtcgccgagcaggggcttcaaggcggacgcggagaaagcgaggaggtgagtgctcctctcctcttcccttctcggttctcttatgtctgcgaggaacggtgcctcgtcgccgttgtcgccgtcgtcccgctggctggcaccgccctttcccctctccccgtcgagtcatcctctccgacgcggccccttcctcctcttcatcggatggggtgaggagctcggcagcggcaacgagttcgacctcggcagaccgggcaacgacgtatttgctattattgtgcagaagaaaggggaccgatatgtatgcaaatgcagacttgcagagagagaaagagagagagccatggcgcatcgttccccctttcatttcactttacctcttgcatttttgctgcatgtctggccctcaaggcggctgctgctgcttggccggtgcgcctctttaattcgatatatcgatcgtttctttttcaatgatgccttagttttaatattttacattgtgtgtctgttaattcatcggcgatatgatctcatggccggctgcacattggctctgccagaatcgattcattcgagtattgcataagctatatatgctatggcacttcagtaagctttctgctcttgttgattactagcacacatgaaagagtcatgaactagtgttctttacttctgattaaattgatgtgatatttgtgtaggtgatgacaaaagctacaattattcagtgttgtcgttctctcctgcaggtgacgtattatgcaatttactgtttgctgtagttttacagcgccactgctcacactctgcttttgaaagcaatatgtctaatggattacataaggaaaggtctattgcatccgtcagctaacatttcttacggtgttagggcccttttagttcatatataggagtggcaaagaattttataggactcaaattccaacagatttttcttgctatgtttccctttgacttataagactatgttcctatgctttattttcataggaaaaataccaagaggtataacctctttgtaaatctatccgcggtccattcttcatggtgccaatcctcccttctcagagg

SEQ ID NO: 26264 - DNA, 1501 bp, Oryza sativa
accagatgcaatttatgtcagttattttagcatgacttatcatcaattctgtttttagcaaatttatatttctctcactctctctctctcattcagtcatataaattccaagaatcatgattctggaagggagaaaacttgtgcacccagtgttggacatggaaacaagattaacaaggtgatgccttgctttattatttcaacttaatttctctcaagttaactttgtattgcctttgtttgaaagtatggaattgatgtaaacatttggagatggaattgatgtatgataacttgaatgtgtggagatggattgcatttatgtgtgtatgtttggaaatttttggatttggggtgatgtgaatctgtgaattgatgtttggagatggattacatatattctgtgaattgaagtgggtttttgtgtgtacggtggattgatgtgaatggacatactgagaaccggctatatttttttttgggttacatgattatgggtgccggttattgccattaacaggcacctatgtggtataataggtgccggctataaacatagaatcgtcacctataggcgtgcgagcgcagcccttggaccattataggtatcggtttttcatcgaaaccggcacctataaaacacataggtgccaaacaggtgccggtttgggaaccagcaccaatgtaaaatcattagtgccgactaattggtgccagcaccgaaaccggcacctattaggctttccgaaccggcacctataacactttatataacactttatactttatgtactagtgttagagtccacatagaaaatagaaataataaaaattcagaattaaaaataaataatattggaagaagagcctagagtttatatagaaatacccagataacgaaaatacgaaattaaaaaaagaaatattcaaagacgagtctatagtccatataagaatataatttacaaataacttaaatttgatattaaaaataattaataactaacacgtatataaaatacaatataaatattacacattagtagtttcgtaaaattagtatgaaatttaaaattatgttgtcattttaatatatttgaataatacattaagaaaacatatatgctattatatgagagaaaatataataatgctagtcgcgtaatttgtatggaccaccatgctagttaagttaatagattcaacggttggattaaagttgtactacactgctaccactaacagtagtgggtaccgtaaaagcactagtggcaggaaacttctgaagatgtcgtcagtggccgcggcgtgacagtagcatatacgcatgcatatatacgacacgagcgcgcagacaaccaactaacgccagtttgagaaaaaacttttcgttagtagtcgtgccactgctgtagaagaatacatgcgtgaaacgtggaagaatttttttattttccaagctggctaatcatttgaatgaaatagtctgacgttgattaca

SEQ ID NO: 26265 - DNA, 184 bp, Oryza sativa
gttgtgggccgtcccatcagaaggtgactcggacggcaaccatgcaaatctccgtccatttatgaaaaggtagagtaagtccccagggagagggggagaatggtgcatgcggtatccccttaagatataaaaggaggaccttgcccactgaggagggagatagattttggggagctttttctta

SEQ ID NO: 26266 - DNA, 1501 bp, Oryza sativa
atgctagagacacctgtctcatcattactcaatttactagatggcaaaaacgacgaaattcctaacattattcaacaactctgtggaaaacaactcatcttcaagttcaagctcagtgaacaaaatctgactgaaggcacaccaaactatgttgtcaaaaagacatttgtgcctgattatatgcttgagaagcaatacctcattaataaggctgaagaggtaaagcaggctactactgattttttacaacacaaaatcttgaaaattttatttctgaaatgtttccgcattatgattttacaggagttaatggacgacgatgtggataacatactaaaacaagatagagagacaaatcaacaggtatttgaacatataatacaaattttcatttatttataatatatagcacatatgacaaatacttcattgcctttgcaggaacaaaccagcagcggccctcttattaaaaacagatccatctcactgctacccgtgaagcaagagctagaggatagtgaccaggaaatcacgagtgaagatgaactcacttcgtctgacaaacctcccagttgcaaacaaataagacggaggtcatacataatagaagacgattcagaagaggagagcaatgaaacaagtatgataaaatgcgtagatgcaaaagttcgaggcaaaaatgcaaaaggcgctcatgcaaaatccacaaaggcggaaatcagaaatgacacctacagccatgaaataaacaaatcagttgttgaagaatccatcaaggcaggaaaaagataggctaaaaccatcaatggcataggcaaggaaagctctgttgaaaaacgtcagaaaacatgtgttcaatcagacaataaagcatgcaacacaaggcctcagagaacaaggaaaatgaattctaagtatacaaatagtgcttagagctcatgataatagttcataattagcagtagctcgatagaatatcctacagttaatgatactagctagaaagaatagttcatagtcaatacagatcattacatgtactgtattataatagtcgaatgttgtatatgcataaactgagatatattactatgcaatctgttattttatttatgattttttatcacatctctgtatatacagacctaattttgcaaccgattgcacatgaagcatccaaacatataattcatgcaaaggaattgaaaagaaaaacagcgtcaaccaacctttgcctgcccgccgattcccccaggctcgccaccctggccgatccgtgacccaaccactgcaccgcctccaccttacattttgctggatgccgaaatgagacccaaaatagcagattttgttatgaccaaaatttttggtgaaaaccagcaaaaggcgaatactaaaaaatccgaggacatgcagtacaagagaagaataatcttaaactttccaacgctgcggttaacagattcacagaagaaagcatatgccttgatcgaaatagaga

SEQ ID NO: 26267 - DNA, 998 bp, Oryza sativa
gtgcatggggtgcgtcagcccgcccgccctcacctaaccacatttattgtggtttggctgagcgtgtcacgacgcatgcaacgcagtgtagtgcactcttttatccggtctgtgaccagtcacagaccggtcagatcgcgggttaggtgatggcaggcggtctgacgcacacctcgccccatcccgtaaggacgagggcttctaggcactcgaccctagctggagctagcgtgttacctcccagagatggcacgttagtcttgaccagatatatgccaggcttcatcctaaccattacaagcaaaatgttgtctgaagaagggcgaacatatagattgctaagctgacacgtggtggacaagaatgaccgacgtgactggtctgactccggtcatgtcgtcagcaggcggccacaattccacgacgcgtctgctccaggcggaagtggaggtggttgtgggccgtcccatcagaaggtgactcggacggcaaccatgcaaatctccatccatttatgaaaaggtagagtaagtccccagggagagggggagaatggtgcatgcggtatccccttaagatataaaaggaggaccttgcccactgaggagggagatagattttggggagctttttcttagactggacctttccagattaggaaccgagaacaagggagaggctggctcatactttgtagctctttcatacacagatctcccaaaacacaggagtagggtattacgcttctcagcggcccgaacctgtatacatcgccggtgtcttctgtgcttcctgtctcgcgaaccttccacatacagattgggagcttagagtttcacccagggtccccggccgaaccggcaaaggggggccagcgcggtctcccggtgagatgccccacgctccgtcatctggcgcgccaggtaggggactctgcgagtgatcttctgagctcttgcactctttcgtgtgcaccaagcttttcctgttcagcctca

SEQ ID NO: 26268 - DNA, 712 bp, Oryza sativa
gggggggactaagaggagggcgaacacatcaccctcgggcccgacgtcccccgaaggtgccaggccacgtggacgattgtgtctgcctcaaacctctagtcatgatactcccgatcccatgtcaccgacagtagcccccggcgttatgccagggcgattgccctccttaagggaagcggtcgggcgtgacgccactcctaaggcctggtgacaggtgggaccggtctccacaattgggcagaaacccaacggtcaaaaatcacgcacatcggcaatggtaactcggctgtcaataatgagcggtctcttcaagactgccacattactcgagtagcacacgaatctggacatggcgattcgtttcatctggagatatggtaatgtcgcttcggttggcgagcgtaattaacgcgcgcacgatatgatctacctcgactgccacaaccgcatatccacctcatgcgccgcaagcgggtgaatgggattagtgcaagcgtgggcgcgagaaacgagggggcgaaatagtgggcgcgagaagcgaggagccgggcacagcgttggcaagggtataaaggcactgaggaagggatttgtttccttcccttcgccattattccccttgtcttcgccgcttgtgccctaactccttctttcctgcgccctaccttcgccactcgcgctcgctcttaatcttctcttccttccggcgcca

SEQ ID NO: 26269 - DNA, 1501 bp, Oryza sativa
accacttgccggctggacgctccctgctgggagcgccggcctttttctttttgtcgctcgcaggcctccccttttgggtggcccgcgaagcgccctcgacggcgaggacatgaccctcgtcgtcggaatggaccgacctcttcttcctcctcctgtcacgccgccctgtctgagcggcggatccgggggcggctgaagctgccactccggaaccggaggggttccaggtccatgcctcctccttacgagccactcggtccgcgagctaaaaaagctccgcggtagtctggggctctttggaggcgatcttttcgagcatgcggttgtgccgcacaccccccctgaacgcgtaaatcaccgcgtgtgcagggatgcatggtatggtgttgcggacttgacagaaccgctgaatgtacgatcgaagtgactcatcgtcccttcgctgtactgcgtgtaagtccgcttcctcaccggggcgcggatatgtgccttggaagttcatggtgaactgttggcacaaatcctcccaagagtggacagatgcgggtggcaagttcattagccagccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaagactcgccacaaaagctctacagccgacaccaccaactaggggcacggagggctggtccccacgtccgtgtcgaggtgacactctggacgaggaagcgccctccgttgcgtgggcagcacgtcggtcattacgccggtgctcgatgctggcgcgggcgtccggccccccatgcagatcttcccgggtcgaaggagtcgacgaaggagtggcggccgaatggcgaacggcagctgccgctcgccgcgcccttcgtcttgacgacgcggagccggtggtagcagcaccagaggccttggtggcggaggaccgcccaccagcatctaggcgctgccgtgcagtcatgatcaatttggccacatcgtccagccaacgttttgctggagactccgggtcatgggcgacgggcggatgacgtaggagcgcgcccgaagcttggagcgcgccctggggcgtgctgccgtcgccgtagatgaggaggcgacgctccccatctcgccgcccttttccacctcctgtggatgtcgaagtcgcggatccttcagccctctcgagcgccttctcccgcctaggactttggcgtggagggggcggtggagtacgagctcgacggcgtgggtttggctccccgtcgtcaccgctcatactcggggagaggccgtgcgcctttgctggctcagccatgaggctgaacaggaaaagcttggtgcacacgaaagagtgcaagagctcagaagatcactcgcagagtcccctacctgg

SEQ ID NO: 26270 - DNA, 1501 bp, Oryza sativa
tctattcagaaggttgtgaaaggctgaaaagaataaaaaacaattaaatatatacccaggtgcatcgactagatgcacctaataggtgtagcctccgcctatgtggttagttgaacaaactaaatatatagtcagataatgaataaatcaaccaactgagtggttttaagccacctaagtagcataataatagcatatgcattataaacccccgagtaaacaagactcaagtgataaaaccgacttctttataaaatatgacgcgagcaacctaaagttgactacatctttgaaaattcaaataacaaaacatctataaagaagcttgtatgttgtgaataaagaaatttccaaagtatcgagcacacaccatgcgcgcactgctttaacaaatatgcttaagtccctaaaagacagatggtttcaccacacctggaaatatatatcatatgtggtgtaaaatctgagtaaataaactcataaatgatttaccaacctattaacagcgaaattggagagatactcggagtcgaagaacagatcgaggtggattttgagggagaagtagttgtttccaaatttcggttgtgcatcggctagaacagagtcggacttaactaagccgatatggatagagtagccgatacaggtgtgtttgggttcgcaatgggcccggattggattgcaaagcattgccgtgcaaggatacagtccattataggcaattgtatctaataattaggaatattaatgtcggtttcttagagattttgcaagagtccgccgtaaggacttgtttgtgtgtttctgtgacttaggaaagtttgagtcatgtccatcatggacaagtttgtactatgggtataaatatatcccaagaaccatataagaaaacaacaaccgttcaatacactctcggcgcatcgccacctttttatttagttattttcgacgagttctttcttcaagttagagcattggtttcgatctcctcacaagaggtaatgcttgtcacagtggtttgcattattgaggttattatatcgttttagatatgttaatcttgttaatataatcattgtttatcatatatcttagttaatctatatcaatggttcaatttatctatatcgaccagatcttttctagggttatgccagtatcggctaaatcattctgttgattagattagctaagatatctaccaccatgaaaatcagtcaggggcttgattgtctagatatattgcttgttttcatacttagtgctgcatgagttaagtttgatctaccaagttgtgatttgaatctctagctctagcctgccttttgattgccaataagggtagaatcgaggtttcagccgatcttacctgatattgatgttttaatatatttagttaatctaatcatgcttacatgctatatctgcccctcatatagatatatcactttacacaaactagcatggtggcccgcgcagattgcgcggctagcattgt

SEQ ID NO: 26271 - DNA, 1501 bp, Oryza sativa
gtacataatctcttcttaaatttatactgtttgcacggagaaatcatgtacttatgtatttgttaggtctacatataagaaagtcagtggtctacattgcaaacggaaagctaatctttagaatcagccatattatttattgaattcctatcaatacattagtagcttatatgaaattatttgtcattgttgattcccgttctacactgtatttggtatttatcatgcttcgctttgtcagttggcgacctggtgtgattagaaatatttttgtcttttgatttctctgtggatggaatgacattctttgtttgtttgtttcttcaggaatcaagatttggtttaaatgagggaaagataaaaattcttgagtggaagtttcagatctaagactgacttggcatgatgtttctgtacttatctattcccctcgacgatcttccctggccgcagaaaggtccgcgcccaaatctcccaatcagtacaaggatcctccttgcgtgttttcccaagttgcttactctccctgaatttgctgattactgtgatttacgaatgctgctatcagcagtgccaacattaacatagagatcagaatctacaccaaggtcgacacagctgaatgtgcctcctttgcttgggttatttctgagcttcaccgaggtttgtgctttaactgttgccatttactatcatttgctatagctttttatatgtttgctattacgcaaacttttctatgcaatgcactatgcataatatatgattatgttgtatacgctccaacatcacgcgcccacttggcctgatgtcaatgttcttatgcctatgatgggttgatgctgtatagcgtccagctttcgcaatttctgtcaactacaaatatttttggcgtgtgctatacagttaattgggctaatatgctaacactaatatttaggcacatataactttgttactcttgcatggtaatgtttaggttgtctccatacggttcttcttttgtcaacatacctttttcttttatttacgtgtttatttctcattatacttataacagtgccgcggggatacaacctagttgagtctgcatatgcatgtgcacatgtcgggagcagcaatacgtggcgatcttggacaacggtgtatccggcctgtcaccccgagtccgaccaggccacgcgtaaagtcgatcagcatagtagtcggtttcggtccctcgaggtgtcggcgtgttgtattatttcggcaacatcctcgcgatcgtcaaatggtcggaaataccgaacagacgcatgtcctccgcggcagcgacatcttaagcttgattgatctcgccgaatcaaatagctgatgaagatgattccaatctcatcgggagacgtattctggctgggttggatctttctggtccgaagtcaacgagtagcttcttgttgaagaatccatcttttgaacacatctcgtcggaatcctaaagcaccaaaaccccctacctagc

SEQ ID NO: 26272 - DNA, 1501 bp, Oryza sativa
tagtggcatatctttttctttctctcttttctctctagttttttatgtgaggataatgatcgcctcttctcgtctaacagaaagggcctacattctccgtttttaaacaactgtcagcgttcactatatattattatttcatgttgaccactaataactcaaatggttttccttcaaataactctccaacggttggactaaggccccgttcgatctctccaactggagagatattttccgtgcacgtgaaacgagaaaagctcattagcacctgattaattaaatattaattattataaacttgaaaaataaatttatttgttttttaaataatttctatatagaaatattttttttaaaaaaatacaccgtttattagtttgaaaaacatgctaacagaaaacgaggaaactgaagtttggagttggagtatggaacggggcctaagatgcacaaaactttcacgcccacaaacaaggtttgctattttgttttgcaaataatttttgagcggacggaattaaatttcgaacgaaatttctaggccaatcatgaaatttaaacaaaactttgctagttttcgctaaatccaaacaaattcgaatattttggttaccggtacccctgatgagacgattttctggtagcatttatcacccatgatggattcttacactggccaatctatgagaatacttcaccatcgttgcaagaaccatacatcctgacaagttatgtgtgtaattattaagattcttgtgcgctttgttctctcttctgaaaaaggggtatgcacgtgttaattcgcctttttttcccctactgcagcactcagtaaagttattctgatattctctatcacgaaatgacggcaccataatagaatttactttaaaaaaactcattgaacaaaccaaagatgcctcattatcctaccgcgtaaagaataaatagttataaatataaacaccatgctgagttgaagactcgaaaccggtagacagagtccactaatgaactgtgtaaagctcagtttgcgacaaagttcgtgacaagagaatttcgaaaaccctcctgcttggtcgcccgggagagggagaaaaatccggagctccctcccctgctcggcaggaaggtgtggttttaaaaaaatttcaaaatgttttttcttctaaattaattatccaatctacgatccgatcatacatttctattcgttgcaattaaatctttacaacaagaccacacatgattatatttcgacgaaaaatattttagctctttttattgatattttttgaatattgcatatggtctttttgatgtttcaactagtagttttacgatgtttcagctagtatactcgtaatgtttcactatgtacggatcaaatgttgcagtgaattttgatattatggaatgcgtcgttgcaacaaatatatggaaaccctctattaagggaatccatttcatttttttgttccactaaaaaaatgtttct

SEQ ID NO: 26273 - DNA, 885 bp, Oryza sativa
cagtgaactccgcccaagtgattggttgtccttctgctctgttcatccggaaatgatcccaccattctgaagcagatccttgcaactgatgtgaagcgaaaacaactttatcctgatccgtgcactggagcaattccaacttctcctcaacagcgtgcaaccaatcacctgcttccactgggttggtagtgctagagaaggtagggggtctcacacgaagaaaatcagctaacttgttctgcggcggcggaggattgacattgttgttcccttgctggttctgcatttgttgcactaacatgttgatcaattgggtctgttgagccagcacttgagcaagggttgggttctcttcattgttattgtttccacttccactggcgcgagtgttcaccatctgttgcagattagaaaagatagtaggagaggggttacactaaagataagaccttaaccaggttaacactgatctgatgtgtgtagaccattatattgttcaagttgattaagcaaacaacctagtacagttgcacgctcatcactggactacatcaatgacgggaatgcaaccatacctacacacaaagcaaacaacagcgttctaccctactaactattcttcaaagacactttggcggcataggttctaaggtaggatgccaacttcattccatcttgacatctgggcacttcagttcttcctcgatccactttacttaacctccataagtagacctcattggcgtcttcaagtttcaatgtctcagaactactcaagttgaaagcaggaggggagaggatgataaaatgatttatagagaattctagagaaggaagaaaggaaaaattttcacaaatcatttttgtcgaaaaaattcgtcctta

SEQ ID NO: 26274 - DNA, 1012 bp, Oryza sativa
attcgttgtcttagtgtgggctgggccctcgctgcccatgtaataattaactatttacgcttccgcttgttaaattttgaattgtatcaacttttggtgaaccttgcctctggggcaaggaataatacacgcacgtaaggaacgcccgttgggttatttccggtcgtgacaacctctgctagctcgttgcctgccatcctgtacggtttcttgtaaaatggaacagtccccggtggcaaatccatttggaaatccatttttttttttgggtggaatggagtgagttttccgggaaccatttttgataattccagactacggggatatcctcaatttctgtgaacttttctcctcggtggtcacagggttttccaccttaatctgatgtaaggagattctctgcttcggtgagactggtgacttgtacaccacggtttctaccttctcattggtcaaggtgactgtgcgattcgcacaatcaatgactcccttgaacttggtcagccaatccatcccaagaataacatcttggtctttggattcgtgaaggatgaggttggctagaaatggtgatctttgaatttctattagcattgaagggctataactgaccgaggttgaactatttcccggggtatgaaccctcattggtgtactaagctcttcttttcttaacccatgcatccccacaaatttctttgaaataaaagaatgcgttgcaccagaatcaaaaagtactgtagaagggactgagttgacaggaaacgtacctagtacgacctctggtgctgcttgcgcctcctctgcggatgcgtggttgacacgagcttgggcaaaccttgccccggcacggcttggcttcgggcacttgtcagcaaagtggccatgctcaccacaattgaaacaggaccctggctttgctccagtctccttcttggcttgggctgatggagctgactgtgctggtgccatcggtgggcgcggagctgtactgcggttgggctggcctccc

SEQ ID NO: 26275 - DNA, 1171 bp, Oryza sativa
ggtcctcccaggaaggtgatatggtacccgggacccgggtcctctgacgagtctgtgataccgggctccctctcaacctcctctggctctgtctcagctccaagatcagtatcctcctctaactctgagtcgatctggatcggagtctcctcgctagaacccagctgagacgggggtgctgcgaccgcctggataggctcggccacggtgactgtagactgctccccactggggtccaccaagcagggtgcaggctcagtgcccagtatctccgcgctctctaagatagtacggaaggcagtcaggtacggtggagtgaggaacagtagtagtcaaagtggtggtcgcacactggcgcaggtggcggtgggggaggtgcggtggaagtagaagctgctgtcgtagtggcggtggctgcaccgagctgctcctccaactccctgacctgctgctgactactctgcagctgcgcctcaagtgtggcgatcctatcaccacgggtgtcgtactgtcctgagagctgtgcgtactgcacatcacgagcctgaagctgggccagcagcaagtcaatctcgttgccccacgcgtggtgctgctcctcaagctactgtcggtgctgggtgagactggtgatctcggtctcaagctctaacaaacatctctgctgctcgtctatctcaagcagtgcctcctcgtagctgtcgtctactgcctcagcccaatgggacaagtgggtcaccatcgggttgtagcagcacggtgaggcctggacggagcagaaagtgtagtcctctcccctgtacgggtggtgggcaaactcagtcctcatcagctccactcggtgtagtgagtgaaggcgaaggaatgcctccctagcagcgtcctggactgctgactctgcaaagtcacggcggtagcgtgcccggaagcgatactctggctcaacgtcagtgcgtggctcaatcgtcacccgagcctcccacttggcacggtctccgacaacgaacctcctcctccaaaagacgggctgtcttaataagaatttgcttgctgttttaagtgttttaattcagatcagaacaattgcagtttaaattcctttataataaagcttagttcctgagcatctgtttttcttctttcccccccctccgtctgccctcccttcaga

SEQ ID NO: 26276 - DNA, 260 bp, Oryza sativa
ggtgtatacttttgcatctatcttgctcttgcacctccggagcagataaatactttcattactttctttttcagatccagcttattagagtccttttttattcaacatggtcatgcatggtggatgtatgtatggtttcagatcgtggttttggatgaataaattgagccgcccccttgcgccgcccgactcccgtttggattctgctgaatgagactcttatacatgctctttgatgttattttccttttggttgcaga

SEQ ID NO: 26277 - DNA, 1501 bp, Oryza sativa
ttccatttgcaaaagcagcatttagcaaacatttgagaattttaacaaaacagttaagtaattaaacaatattaagccaacgctatacaacataccctgttgtataggcccaaccattctgaacaaccaccccggctgcacagttctatctccaaaccaggaatgtaccattccaaaccaggagctaatcaaattattaccagttatagcatcttttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaacaaggcatggactccccagcgacccccgtgggcttatctccgccacttctcagtctggtgccccgcaatgaaccatgctatacaaaagataaagccattgcccatgctggcttgtggttggcacgataaatgtttcacaaccgaaactcgtgaaccggtccttaattgccatgagcacgaccatcaaaaccatgtgctcacaacccaccattaccaggttttagttggcacattaattaattaactaatcacgattgaccatcgtgaactatcaataagctatcatgaaataatagtgagtcattagttatcccataagtgtactaatgtttctaagcagggctaagcaattatatctaatatctagttgaaccaatataaataaagctcaactagtcaaattataataacccaaggtatcaaggaataaggtaatcaagaacaaaagggctataacaatcaataggttaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgtgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaaggattattgcgtcagcgggctagggtttggtggaccggcgcatgggcggcggttcacacgaacggacggccgagattgatccgatccaaatcggacggccgagatcgattggtccacgaccggctcacgggagaggatcccgatgacgtcaacga

SEQ ID NO: 26278 - DNA, 1501 bp, Oryza sativa
ctgcgacctaaggatgtgttgcctgtcgatgcactagtctaagaagggtctctataaggtccttatggttgctgaggtagatgttttagcgttcctgggagtttatgaggtggtgtttcgttctttaggatccataagtctcggtgccccggatggttgctggtgatcctagctttctgtgtttttttttttagattatgggtacctcacacccacacggtatggttatccgactggttataggggatagcttatacctatcaaatatgtaacggatcatgttttgggtattacgtttccttgtatattatggaacagcctaaagtcctggtttgataatattgtaaattagatttaggaaaccgatgccatattggttaaggtttctatcttgtaatcctgcccgacacaacctgatcgtcaaatctatactacacctggcggattcaaatccccaaacaggagtagggtattacttctcattgagagggtctgaacctgtctaaatccttgtctccgcatccatccacttttaggtctcgtacgctacctcttttattattgccgaattcatgtctcgacagttggcgcgcagtgcgtcgagttccctatcaagaagtgcgatggaaccaatcttcaatatcgtcgaagccaactgatttgtggtggccatcgctggtaacaacctatcaggagaaaaagaaacgcagcagccatcgaccacgctgcgccgcctgcgatttccatgccgatcatcgccgacgaagaggttgctgccccggcgtctccctgcgattttcctgcgggagcaacccaccccggaatcttcgtccatggaggccggagccgggcttgtcggatcggtgcaaattggccctttcgctgacggcaagcatgcattggtggacctagcatacgtctctacgggagatcgattttggattgctgctaaccagattgatcaactaattacatggatgctgcgcgcatgcaccttaattatatccagatcattaattttctattgctaattggattgatttctaattacaaattaattaatgcttttttggctattttgttggcatgtattcatgtactccgtatcaaacaaggaccatcgtgggcagcttgttcgacttcatgacgtcatctcccgagcagatcagatcaatccacccgcctgatgcgccccacggcagcctccacgctgcaactggtgctgctgccaaggcgtcctccctgcgattttcctggagtgaatacatgcatgagttgatccatcgatcaacgtgcacaatttactatataatcacgcatatatttgcatggacttcttttgagctgaccgcatggcaaatatcgtcacggccacaactagaaccgtcaattcatcggtttctttcctttcaacttattgttgttttagattgatctctaaatgtcatattaatctcttggtattttctgttgtttacatgtaatgctacggcaccattgt

SEQ ID NO: 26279 - DNA, 310 bp, Oryza sativa
cggattttcgaaaaatttgttcgttagggtcactgccatatcgcttaaataagcgaatgcaaaatactcgcagatgagattggccccgatggttggactgtagagaatactgttggtatttcttaacatcattactagaaatataattcccagcaatggcgcagaaatactcctggtatattatggttacagagtttatccgcaagtgcacggatataccattgtagcatttcacccgagagtattccaagggtatcgtatttattttatcccgtgggaagatcatgtagagagaacttgactaataatt

SEQ ID NO: 26280 - DNA, 1501 bp, Oryza sativa
cgcggtggcctgagcatggcgttcctcttgagcattccgccgaataggctgcacgcgcctcctcgtcgaactggttcgtagtaacctgcaacctccattctccgattcgaatctgccaagacaaaagaaatcgcaaacaaatatttgaagaacaacttgcatatgaaggcgataagggagagtgaaggaagatgataagagagagcaaaaagaagaagatgaatctaacactgggtcccacgtgcatatggggaagaaaatgaaaaacgtgacggcgatgacatagttctaactttgtaaaatttcagtaccacggctacgaatagacgaattgtaatggcatttatctaaatagacatatttgcaacgatacagatcaaattaacccccccccccgccgtgttttttgtgacaattttcttattatctccacatcttcacatacttcggaatttcccaactcaaccgcatatgcaattgcaggggagcaacagagttgagattctcaagatctgaggaatcgggattagcacctgcagactacagcctgggaacagccactgggatatcaggaagaaccatttgattgcagtgtagataaagctgaggttgctcctcaccgatgcttctaccacccacaacaagcacaaagggaagcttccctttcctgagcggtttcctcatcgattgttcgtggcaggggaagaggcatccagttccgatgcgcttgccgtccatacttgtaatccccaacaaattggtgttccaagaacctctgcgcagtgaactaagtgctgcgtgggttcaagtagaaaagggatcaagattaagtggttaatatgattgtgatatcatccaagcagtcaaatggaagtcatgttgttcagagataaatccatatttaaattacctgatgctttcttccagcacgaggaaatagttaggaaaaactctgacggcccaaaatatatgttgataagagatagtgccatatttgaagtcatctagagtattaaatatatgttaaatgattcgtgtaggcatagacaaaataatactaccttcgtttcagattataagactttctagtattgtccacattcatatatatgttactgaatctagacatatatgtgtgcctagattcattaacatctatacgaatgtgggcaatgctagaaagtcttataacctgaaacggaggaagtaacacttaatgagtaaccaccgtgtaccggataggtgagttggtaaggggaataggggggagaataggagaataggggggagttcggagggtgtggagggagtacgtgtacgtgtgtgcgtacggtggtgggataccagattttttttattttaatggagatttaattggcaaaattaattagtgggtccacctttttttttcctaatttattagaacgccatgtggcggcttataagagtttgtaggatgccacgtgacagcttgggagcgtttgtagaaaggttaatggac

SEQ ID NO: 26281 - DNA, 748 bp, Oryza sativa
ttcctgcagcccaaaatcataaaatattacaccaaataattcttaaaaactatttgtaaagttttaaactaattttaatgtgttttacttcttttaatttttattttagtttgttttctattatttaagattaactttcactggagttttccttctcaactattttataaaaccttgtttacaaataaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaaaaaattttgaagtttgctcgggcagctggaggaggaagaagacatatatataggggtgggactttagtcccggttggtagcaccaaccggggctaaagatcaccgggatctttagtcccggttggtattaccaaccgggactaaagttacgactttagtcccggttggatcccgggggggcctgacatgacctgacagcattcgaaccgggactaaagatgatctttagtcccggttggtaacacaaaccgggactaaagatcaaatatgcccgttacccttttgaaccgggactaaagatcatctttagccccggtttttattgcatccagg

SEQ ID NO: 26282 - DNA, 1501 bp, Oryza sativa
aggacacattgttgatggatgttttttatttgaactatagagatagacatagcaaaactcattgaattaaagtagcaattctgaaatgcaacatcaatgcagcaaaaaatcagggcatttcaggaaaaaaataacctagtcaagcattaagtacttgcatttatatgactgtagaaaatctcccatcgtgcttattgccatggacaagaaagctttcatatcactgcaagaagaaagaaaaaatatcgccataagtagctgctcttctctctatgtgttcagatcagatgactagaaatacacccaacacataccgtgcatgtgttacctagctgaaaccatatcaaataatgcaagttgccatctctaggcatgaaaggagtcaggcatgtcgccataggactctattggagcaaaggtcaggtgttatcaattatctggacaacatgccgccatagcaggataggatatgggttgttcgatgctgctttggatgagtacaagttagcacgatctcccagtcagtgtaggattcgcaatttcagactcaattttgaaccaaatgataggtttttgtaggattagccagacagtttgccgagtctctcaatttggattttttttttggttgatgttcagcaaacaacagttccaaatctgaaaacgtgttctacatattgtaagagtggcattcatgcattggtcatggtcatgggaggcaccggggatctctacagtttgcaatcaacgttgcatctgcaagcacagcaatttaatttggctattgaagctacattagtgagtcccttcgatcaaccagcagaaagccagaaaagtacacagcaatttatatttccctgaacatgaagtaaacgtgcaacacacaaccagcaaattctttttcctttggcaacgcacaggcgactactggcagtactctggagtctggacaattacaactctgcgatcttaatttgttaatttcaatgaatgatgcagcaaggtataaaattctgttcaattatatgattagattattattattatcaatctaactgcgtctggggtcatccgtctaaactggatatggcgaacatcctcccaaaacagtttatgataagcatggtaatttcatcggattcaaaattttcttgatttggcactgtgaacaaacagtttatgctctgtttaggagcaaaataatctttaggagcaaaataatgtcttgtttatgagagagaattgctacatgatgtttcccaaaatcaagtgatggaaatatgccttttgatatcttagttcagccatcctaacaaaattaagctttgcaatcgttcgcagcactacttttttcacacacaactaacacatacagctttctcatgacaccttaggatcaacacacttgcgttaaacaaatacacctgatgaaatatttatcggaatattgctaaccttcgtgcagattttgggtcacttgatgtacttctccattagtgct

SEQ ID NO: 26283 - DNA, 472 bp, Oryza sativa
tgtgtaccactcatatatatatatttggccttcctagctccacatattacttctggatagcacaagttcttgatccttgcaatcgctgactacgccttctaggtatcctttgctttgctggtaagaaccttataagagcttagttaggaactccatattgctgagaatcgtcgagaggcaccactacacctgcgtagtagattattagggataaccttcaccgttttgtttctgttttggtgtttcaatgtcaagtaacgaaggtgagaagagtccccaggattttgctgtctgtgtcagccaagagcaactacgaactctccaacaaaatactcaaaaggacatcacagaggccgttgcaaagtctttccaagatgccttcattaaaatgaggaagtggtgagtggtgacgacgatgctcatcctgaagacacggtgtatgattccagtggctatattgacgcaccggcta

SEQ ID NO: 26284 - DNA, 1501 bp, Oryza sativa
atatatatatatatacatatacatatatatacatatatacatatatacatatacatacatatacatatatacatagtaaatttgtttggtgctccatggtgcccgggcaccattgttgaaattgagtatataaccaattcaaatgagtatgaaactttttcaattatttaggtattaacattaactactttactaactagttcaaagcaagtttgaactgaacttgtttttgttagattttgattctaggtatatagcatccatacatataattagttaggtatgtaatcatgaattgtgaaataaagttaaatttgagttgttttgttgatagatatatgtatgaatcgaattcttataactaggtatatactcacaatttaaaaattttgaaaaatttgagtaattttgtgcatttgaaaccatggtgcccgggcaccatggtgccccatatgagtgtcctatatacatatacatatacatatatacgtatacatatatacatatacatatatacgtatatatatgtatatacatatatttatacatatatacatatatgtatatacatatatttatacatatatacatatatacacatatacatatatacacatatacacatatatacatatatacacatatacacatatatacatatatacatatatgtatatatatatacatatacatatatacacatatacatatacatatatacatatatacatatatacatatatatatatatatatatatatatatataaggtcacgctacgtgacgcgagacacaggcgatgcgcgccagctaaaccgtggcgccactcagagcgggagcccgcatccccagcgtacagacccgccacccatccccatcctgcaggtgcaaacagagtaaaaaaattaccgtgggctaaatcagttacagtagttggtttatgagagaaacacgtgattatcgaccaccctgctcccctcccacagcaacagacaactgagtaaaaaaattactcattataaaatttgacttggagcgggcgtaattgaagttaaaaaattactcataggggttggctgccgtggtacgtactagctccgtcccaaaataagtgcagccgtggatattcatgcctaacgtttgaccgtccgtcttatttgaaaattttgtgaaaaaattaaaaatatttagtcacacataaagtactattcatgttttatcatctaatagcaataaaaatacaaatcataaaaaaatttcaaataagacgaacggtcaaacgttgaacgtgaatagtgcaaaactgcacttattttgggacggagggtgtacgtttcaatgaaatatacacgtgacaggcgatccttccagtgaaaaaatcttcatgccgttggtgaaatttttactaatgggtatttttgttcggtatgtgatagtaaatttttaactgatcaatatttcttctataaacgtaatatctagagcaatttattaactcaca

SEQ ID NO: 26285 - DNA, 583 bp, Oryza sativa
gtgcctcggctgattcctggacgagggttcacacacatgtaagcgtttggaattttggatagaaattccgggcatgacaagttggtatcagagcctctttgaccctaggttatgccaaatggttatccatagaagccctctaaaaatattggaaaagtagaactgttctcctccctttctcttttaattaaaccaaactaatggcacatgcacttcataatctcttttaatggttctcattaaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaaagcttggtttactttatttacttacctttttactctgattttctaactttattcaaattaatccaaaaacttgtgctattaattggataaaggtcttaactccctcctttcacttgtctttaga

SEQ ID NO: 26286 - DNA, 1501 bp, Oryza sativa
gcttacagatctccgacgcctcgtcgctggcgtcgaagtagcccgccatcgccagctcgatctccgacgacgtcctccggtgcatcattcgctgcaattccgcgggaacgacgccttcagtgcagcgtgctgatgtactcctcaatgctcattgattccatggctgtgttccaatacaaaccagaatttctcagcattattgatggcaaaatgaactgacacacaataacatataaacagatgacgaaaagctcaatgatctatctctttttttcttctctactgatctcaccttggtgtgatgggcacatgaattgccctgattccaaaactcaatttcttcgagtttcttgatcttctgggacaagcactgtttgctttcttggagttccttgatctttttgggataagcactgttgaattgcctctcttatccagatgtggctttgggaggcagtcggcgcggatgggcggctccggctgcgtcggcgggagcagcgacgacgccggcggcggcagctaggcatcggctccgaggtggtcacgcggtgcctcgccgggcttcttgggtcgctgccccatcctacccgccggcgagaggctgtcctgggagaggctcaagaaggcgatatgcgacggcgaggcgccgtcgttgccggcgagcgcggaggcatcggcggagctgtgcgggttcgcgaaggtgacgacggcggcggcggtagtcgcaaggccggcgaggcggcgacggtccatgacgaggtcgttgatgcggctgcgggagcaatttgacacggcggccaagaggacgtacgtgctggggcgtgacctcgacacggtgagccacctgccacccctctgctccactcgccgctcgccgccgcccctctgcgccgcccgccgccgctcgccgctcgccattctcaggggagagagagagggggatagagagaggatagagaatgagaggggatagagagaagagtagtgagtatgacagatggggtccacgtgggccccaccattttttattattgtgtgggtgaaactgacatgtgggctctataggttttattatttttggaatcaaattgccacataagcgcgccacctcagccaaaaccgagtcaaatactactgagggatcttagttaaacggtttcgtaagttgggggacctgtcttatccggttttgcgatcgagagacgaaaatcagactggccgacaaatagggggaaagctacggatcggacgtaatctccggatgatgtttcactgtatattaaataatgttgcaatgtttcatcgctcaaaaaatgttcacagtatgttgaatgaatgttgcaatgtttcatcgctcaaaaaaaatgtttcaacacgaattgtttcttgatgttttatctttgaggaatgtttcaccgctttatcgaagatgtttcaccgcattatcgaacatgtttcaatcgaatgcaacactaaaaaacattgtctacaacaacaaaaa

SEQ ID NO: 26287 - DNA, 844 bp, Oryza sativa
cttccgcttatttaagtgcaaggggaaaatatattcattatataattcatacattaaacagaaactgttaaaagtttccacattaataagaaaaaatatcacatccatcgagttgattttagtccccaattagtatgttgagttccgttcaagttctatatactccctccgtttcacaatgtaagttattctaccatttcccatattcatattgatgttaataaatctagacatatatatctatatagattcattaacatcaatataaatgtgggaaattttataatgacttacactgtgaaacaaaggaagtacatatttctatccaaagtgcacaatatggttaacaaagcaaataatcaaaccaacgtacatgcagtgcactctgagttggtctcacaaaatcttgaagaaacctaaaaacatatatatacgttacattacctggttagaatctactccctttattccataatcaatgtagctaattctaacattcaaattttatttcaaaataaaactacttttctacctagtttaatcttttcttaaccaatcacaaccatctttcatttaatttttcttcctgctttctcatgccactaattccctatttaattttacttttctcttaatcctgtgtgaaatactctacatatcaaaaaagtatgcttgatacaaattaaattacccgtatgcgcatggggatgcacgggttgatgcaaatttgccaagtagtacaatataataatagaagatgctcgccccatctctctataaaacgggccatatggaggagtttgagagcaggaaatctaatagggtcaaacagccatacacagcc

SEQ ID NO: 26288 - DNA, 1501 bp, Oryza sativa
aaaagcagcatttagcaaacatttgagaatttgataaaacacttaagtaattaaacaatattaatccaacgctatacaacataccctgttgtataggcccaaccattctgaacaaccaccccggctgcacagttctatctccaaaccaggaatataccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataatagtgagtcattagttatcccgaatgtgtactaatgtttctaagcagggctaagcaattatatctaatatctagttgaaccaatataaataaagctcaactagtcaaattgtaataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaacttttcttctgcgaaaacggactctccggaaacgacggaatctaagcagaaaagagcaaaatcaccaaaacagcacataaacaagcatgaacagtacatgtggatatttttaaagtgtaaatctcaattttagaaaaatttagagacttgaaccaactaaatcggagctaagatgaattagttatgaatttttaaagattaaatcggattaaaacacttatattggttaaaattgaattatgacgcaataatgaattatttttgaaaaggaaaagaaggattattgcgtcagcgggctagggtttggtggaccgggcgcacgggcggcgattcacacacacggacggccgagatcgaaccaatccaaaacggacggccgagatcgaacggtccacgaccggctcacggcggacgaccccgatgacgtcaacggtgacgtcac

SEQ ID NO: 26289 - DNA, 433 bp, Oryza sativa
cctttttctgtatttttgggcatatgtttcctgaccacttctttacacactcctcttgtttggtatgtatcctattcatgatttggctcctaatcttttcaagcatggataaaattggaagctctctggcttcaagaatgtacttgttgaatacctcggaattgttgttgagtagaatatcacacttggggaaatcactaaagaatgctctgcaccactggttgggtggtatttcctccaggtaggcataagcatctttgctaagagacttcatcttttccatgttaaattcccactctggtatagtacttgaccttgcaattgcccacaactgattctttagagtctcccctttgtatagaacatgaaaattttggtacaaatgcctaacgcaaaatctttgttctgaatctgagaatttatccctcacagc

SEQ ID NO: 26290 - DNA, 1501 bp, Oryza sativa
cctattttaaaatttataaattcaaaaatcgcatcgttgcatggctcgtgtgaccacagaccatccccatgcgcacgatagaattgatatattttttataagaataaattatatatagttcattttaccttcgacctagtttgatactatatacgggatggattaatattgcatgctcttggaaaataaaattgttgcacatgctcctgttgtacggcaaagatgtaagtacccatgttaaatactttatccgtcctaaaatataattaataatttaagattgaatgggacgcatcctagtaccacaaatctgaatagctcactaatttggtaatataaatgttgctatatttttttataaacttatcaaaatatcaaaatgtttgacttacaaatgatttaataatatgaaatggaggatgcatgtgaccattgcagagcacatacatgtgacgacggcttgcctgggaaaaaaaatgttcttatagggtacgtataaaatattcagatagacatgcatgttatatgtaggcatgtagcttgaccagtaccgagacattaatttggtgtcatgtcgcaggtgtactcgctggtggaccaaggaaacaaccaacgtgcagtctctaaataggagaggaacgggataggtacatgttgcatcccattagaacataatggacgtgatccatcctgataaaatgcatacacgtggcacactgatgagcaaggagcatatgaaccgtggttcatattatctatctatctatctatctatctatctatatatatatatatatatatatatatatatatatatatatatatatatatatatatatagacacacacgtgggataaggagaataaatgataatttggtcaacaactaatgaattgtattaatttgaccggtgtattaaaaaactaaaataatagatctgccctggagaaaaggatcggagaggttaggaaaacgtacagatgggttgatgcatgccttttcttccgccgtttaaagatccaaacgcacctcctgtgctctactcacaatataattaagattgattatcccgccgattcatcataatataattgagtagtacttctcaacttccatccttttttctgtttgctggtcggtgaacatgcatgcgtgacatgcaaactcaacagtaggccgtgcagatgcaattcgaattgccgtctgagcgagcgactcccggctgcgctgaagtttccgatcgtgttaatggaaatggcaaggcgaaagtcgctcgcgttcgatctactcgcggccttccgttccaatatgctatctgcctctctctcgattagatatatttacatgcctcttccgaatacatttgactgaggaataagttcactttgggtccctctatttgtggaaaacgcttcgattaggacgtccgagacgagcgcaaatatcggacgtccttatgaccttatccaaacctctcgaccgcctctccccaccattccc

SEQ ID NO: 26291 - DNA, 1501 bp, Oryza sativa
ccctcggagggtgatttgtgcattttgttgcacaccacatgtttttttttgttgcatatagtgtgtccgtgatgttgcaatccgtaattttctggatgtttcttaaatcaatactggatgatgttgcatttggtctcttcgggatgttgcatatattggttttttgttgttgtagacaatgttttttagtgttgcattcgattgaaacatgttcgataatgcggtgaaacatcttcgataaagcggtgaaacattcctcaaagataaaacatcaagaaacaattcgtgttgaaacattttttttgagcgatgaaacattgcaacattcattcaacatactgtgaacattttttgagcgatgaaacattgcaacattatttaatatacagtgaaacatcatccggagattacgtccgatccgtagctttccccctatttgtcggccagtctgattttcgtctctcgatcgcaaaaccggataagacaggtcccccaacttacgaaaccgtttaactaagatccctcagtagtatttgactcggttttggctgaggtggcgcgcttatgtggcaatttgattccaaaaataataaaacctatagagcccacatgtcagtttcacccacacaataataaaaaatggtggggcccacgtggaccccatctgtcatactcactactcttctctctatcccctctcattctctatcctctctctatccccctctctctctcccctgagaatggcgagcggcgagcggcggcgggcggcgcagaggggcggcggcgagcggcgagtggagcagaggggtggcaggtggctcaccgtgtcgaggtcacgccccagcacgtacgtcctcttggccgccgtgtcaaattgctcccgcagccgcatcaacgacctcgtcatggaccgtcgccgcctcgccggccttgcgactaccgccgccgccgtcgtcaccttcgcgaacccgcacagctccgccgatgcctccgcgctcgccggcaacgacggcgcctcgccgtcgcatatcgccttcttgagcctctcccaggacagcctctcgccggcgggtaggatggggcagcgacccaagaagcccggcgaggcaccgcgtgaccacctcggagccgatgcctagctgccgccgccggcgtcgtcgctgctcccgccgacgcagccggagccgcccatccgcgccgactgcctcccaaagccacatctggataagagaggcaattcaacagtgcttatcccaaaaagatcaaggaactccaagaaagcaaacagtgcttgtcccagaagatcaagaaactcgaagaaattgagttttggaatcagggcaattcatgtgcccatcacaccaaggtgagatcagtagagaagaaaaaaagagatagatcattgagcttttcgtcatctgtttatatgttattgtgtgtcagttcattttgccatcaataatgctgagaaattctggtttgtattggaacacagcca

SEQ ID NO: 26292 - DNA, 780 bp, Oryza sativa
acactaaaatacgtgcaagaaaaattcgaacgtggcccggagaatttttgttaaattctccttggtctaaaaggagccctcaaattttacttgaattttcagagcaccgaaaataattattaagcaacaaaaacaattatcaaagtttattaaaaagaaaacctaaaaataatcctccttttcctttgggccaagtctggcccaaagcctccctctctctccctcggcccgcggccaaagtcctcccttcctccctctctttctctccctctccttctctccctcctcttgggcctccccctcctggcccactccctcctcctccctctctcccccgggccgcctctccctcatctcctcctgggccggccgcccggcccaagctgagccgctcccttcccgcgcacgtgcgccgcacgcgcgttgagcgcgcctcccgcgtgggtcccgcctgtcaggcgtgtccccgacctccagccgccggcctccttcctctttctcccgtaaaccctagcgccattcctccctcaaatccgcgcgattcaagcatgggattccaaaattaattggggggaattaatcccctttcgttcctctcccttttccccctaatctcccctttaatcgtgcactattttgaccggaacggctgcgccattcatggctgccttccatggccgccgggcgccttttctgccgccgttccccgctcctcccgtggccggctcattcccttccgctataaaatggaaccccctctttgcattctatcgttttagc

SEQ ID NO: 26293 - DNA, 1501 bp, Oryza sativa
gttgccagttcggtctgaatcatcgtaggccttgggttaaggcaggttcgtgagggttcacggccttgtttaataatactgtgtagctctaggatcgtctttataaaatagctttgggcaactaagtgacttttaaatgctgtttactgcaaaacttaacccctatattattatccccttgtactcctttgcattaattgtgcatccccggtgtggcttgctgagtactgtggttgtactcattcttgctctatttttcttccccccttcagtaagagaagctttggagaagaagtcttaggtggagtcctggcttataccccagttgagcgcctgtgaagatggagccgtaggcccgctagtccgctgctgtttatttttgattgtcaggccttaagcgcctttgtaataatgtaaatattatcgatataataaagatgtgtcttttatatcatgtttgtgtggtgtaacccggcttttcctgggacggggattaatacactagcgttcgggaaaaggcaattttcccggtcgcgacaactaccaggccaggccgcttccggaacaggagggtgacgatgcggagccccgcgctggttgggaggtcactgcagtgatcctcgctggctcttctgagcggacttcgctgacagtcaccgcgggtggcgattccttccccgccgcttgccagagcgccgctctcctcgccatcggcactctccaccagcgctacccggacgagttgcagcactcgccctaccgctaccaccctcgccgcggaggagcccgcgactacgccaccttccgggatgctagctcggaggatgacgctaccatcgtgcacctggcacacatggtggaggcgtacgacgcggctcgtatcgacttccatcagatggtgcgccgcgggatggtcgagaacaacatgaagatcctggagctgcgtcaggagaacctgcagctcaagaaggacctagacgcggtggaggcgcagctgcatcagctcaagatcgcccagggagagatctgccgccccaagcgccgccgcgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctcctgcgttggtagcacggaggatgcgctgttgctcaccttccgccctggcccgtcgcagcggtagacgagcagttagtaggcttgcgcgtgtgttccttctcgtttgtcttcttgttgggttgtgtggggcatggtttatgccggtgtgtggcataactgtgtcggagcctgtcttattttatttgcctaagcaacttgaaccttaatgaaccaatttaatagcagtaataaattcaagaattatggtagtcgtgggtggttagctttaattgtcagctctctctgtttgctggttctgtgtggggttttcaga

SEQ ID NO: 26294 - DNA, 635 bp, Oryza sativa
cctcccacaacatcggcgcgcaggcgctgcttgtggacgtggtggccgcgctcgtcacgtcggtgctcggccaggagctgttcccctcctcccccttcctcggcgccttggggacgaacgaacgaacacgttggcaagaacgcctaatggcaactaagtcatttagatgcgctgttttctaccgttaggacaaaaaggacggaatggtgtgtagggcgctataaagttcgacgatggcatagagggaggctcgaacttttcagtggcacagaggccagcatcatctttcttaatggcatacgggtaataacctcttaattaaattctgaaaataattttcatatgtacaacgtgcgttcatctactgtcccacaaaatttccagtccagtgacagttggatgttgagtgacagaacatgtgctgcaaaacttttcaggcgtcctccctttagggattaaaagagtttcgaaataaatcagctcataggggtacttgcacaagtgcatatgtaggcaccaaactaggttaatttattacctgaattactctacaacttatatgtattttatacaaagcagctacactgatacaaatctactctgttatactgaattttcttcaattcaatgccagg

SEQ ID NO: 26295 - DNA, 1501 bp, Oryza sativa
tctctccctcggattcgtccgatttacacccgcgatcctcgccgacgcaatcaatggcggccgagatctccgcgcccgtttcctccctctccggccgctatctccccctcccggtgctatataatcgctccccgtgcctctctcctccgtttccgccgttcgccgctcgctctcaccgtcggaatcgcgctcgcgccgtattcctctctctccgccgtcgccgacgagctccggttcgccgccgccgtcgctccggacttcctcccgtctcggcgtcgcctccttcggcttcgccgcgtcgtcgtcgaccccgtccgctcctccgattcgctcgccgaccgccggagcaccgtcgccctcgccgtcccgaaccgcgccgccgccttcctccgcttcggccgccgttcccgtcgtcgccgtcgacccggggtgagccgaagaccgccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccgaccgtcagccgcccgcgcccgcgggtgcggctgacgcgtgggacccacggcgccggccgccgccagccgcgtgctcccggtccaccgtggaccgaggggctgacgcgtgggccccactcccgtggacccggtccgcgcgccctctctcccggctgacgcaataaatgggtttttaattaaattttaaatgaagaaattcgcaaatatccatttaaagagcatataaacttcaaatggccatatcttggccatttgaactcagaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattattgttattgttattatttccttgttcaccctagattaaacaaaacccctactagtggacactctactcatggtatcactagtatgattttaggtagatgcttcgctgtttaattaggtaacattaggcggttttacaactctagactttgggatattcatatcacctggacacactggaattgttggatcattgtggaataggtttcacacctccccctctattcaaaatccccaaaaatggttttaggctgggctcggggtgcatggttttgatggtagcacctcggccatataaggaccggt

SEQ ID NO: 26296 - DNA, 1043 bp, Oryza sativa
  unsure (1)..(1043): unsure at all n locations
tgttagatatgaaccgtgctagaactacatttattttgggacggagggagtatatgacagttgagtcggatgtataacacagctcgtgatgaaaagtaactgatgggctggggctagatccctacccacgcaagggccccatgaaagcaaccgatttttagtgtttaaaagatactcctaattaattaagttcaggaatagtcctgccagattggtgccctgtgaccgtcttagaagtatctgtcgtttgtggtgccaaggaagtgctaagtactcctagatcagtccaacaagcttctgcaaacgatgttatattattaccatctttaaactatccaacggtttctgtgatgattagatgcaactgatcacaaacatatatggtacacgtgttggcttggaaacgaagaagggaaaagaagacatttaacattgctttcgtctcaacttagtggagctatattttcataatacatatgattgagtataaaattacaatgaaattcaagtatcctttagatcagagccacattgtatctctgtttcccaacaaaaagtacataatttcttttgtgtgctgaatcaaaatttttaacaatagcaccagcaacatattatcactatattggtacaaactaatacgtacatataagtcatacgaatatttatgtaccttcagttttcattcgtatgactaaaaatttatagttacacttatacatgtaattaagcataatcctttttctttctatataagtgcatccttaatgttgagcaacataatcaggacagttttggccatctcaagtgaatcagattattggatacatcgtctcaaaaaaaaaagattattggatacatgccacaataaatttactactttggaaaatatagcttactagttacaattctctatttataaccattccattgcaacactcgtgaaattagatctatgccatgttatacancttgatacatgttttgaatcttttttggtatatttttttttgtactcctgccaatcctctcttaaccataga

SEQ ID NO: 26297 - DNA, 1501 bp, Oryza sativa
atcagcaacttattgttattgttctgaacaaaactaaaaaggtgaagttttgacaaaacctgaaccaaagcacgctgttcaattttctaagcacgctgttgacaatgaaacgactaggcacatatggtgtaaattttctaagcacgctgttgaatttccatttttttttcttctagttactttgagtagggagtttcctcgcaaaaaaataatcatctgcatttattgcagagagcgacgaatttaacaccaaaatgtctcttttgccatactaaaatgcattatttcactgatatataggtactacatccattttataattttgcaactactaactatgtatttggataaaatatattcagaatatagacaaaagttaatcggagatagtattcgggtgcgctacagttaatctgaagcacacttactaattagatcaaacttaggatattgaatctaatctgaacgctgtagctctgtgcggtaaggatccaattccgtttcttacttgcatccttatttgatccaagttcacatacttacggagtgagcgatgatccgatgctatctaccggtgatagatctgaactgttcactattattaagaataaattagtaatttactaatatattgattagtaatttgttaatatagtgattaaaagtaacttttgttattttatgtttttcaccctatctaggtcgatttgtggtcatccattctacaggcattgctcatgttgcatccaaataaaccaaagaaagagaaaacaagtttagtcatggctaaataacgattatacccatccatattttttttaacaataacacgcttcacatttctaccaatagatctaaatactttcatcatatgggttgggtgagggtgcgcgtgttgtgaacgttgattgctttgaccgatgcattgagttgtgtgtttaaaggtcaggcttgaaggagtctatggttggtgctgcgaaatcagttaatcttttacctcttgtcataaattattttccagtcattattttggttacctatgtgattcatctactttatatattcacagaagccaacagttttggagttatcacttcagataatggagatgcatcagagtatcacatcaacactttgtggttgtcaatccaacacttgttatcttcacaacagataagacaaggctattttccttttgttaaacaaattttactgtttctcgctgtatttcaaaacgaatatagtttaatatttgcacatatggatttcttaagtagttaaaactgtaaaggtggaatttctgaagtaggtataggtagagtggtggaccgtctcatttgtctgacagtgcacaaatttccaaagtggccaagtcaaatactggggcaaaaaacaaaaaaccagtcaaatgatgccactgatgaaaactgcaaggttataagtaggtaatcagatagcttagcttcacaaaagagaagagaaagaaactgaatcatggcca

SEQ ID NO: 26298 - DNA, 1501 bp, Oryza sativa
tagcgtgaactaaacacacccaaaatatgaatgcaccaagttaaactgtcaaacatcaaaattataaaatttatatgcgctcaagtcagacaactaggtagattggttccatgtgaaacccattttttttacacaaccttcaagctgactctatttagcgagtgattttataatacttgagaaggtacctgcaagtatcatattttttatataaaatttggtcctctcaatacttccagtagcaagaggtatcaaatttcaactaaaaattttaatatctcttggtatctcttaagtattgtaaaaattctcctatctcgaacatacctcgatgcatctagtatcatagttcgaaaaaatggtgcaatattccgttacattaaaattggagtatttaatttgaacaagtgagcatatcctagcttactataaacttatcccccactaactccttaagcttaatatgcaaagatgccacataatcatccactaacaagatgccatataatcatccactaattaacaagatgccacatcatcatccactaacaatcatcacatttaaacatcatgcaagcatgctatatctttatagtttttataatttaagagcttttcaaacacaaatatgttaaattatcatctaacataattcacataatgtttcaatgtatatcttcatactaaattcccgcagcaatgcgcggggtttcacctagttcttaaaaaaattgtcccaagtaaacatagttatatgatcattttgggtaaatagccaatacggtcccttaagtttcacttcggactcaatttagtcctcaatgtttcaaatcgttcaaacgagtcctccaaattaattatttgggttaatataatccttggaccaaaaaaatatcacgtgagcatgccaagttatcctcgcatgtagcggtatgaataaaatgaccattctaaccttatataatatatagaaaagaaagaaaaaacacaaatagaaaaaaataacaggctagccgaggcccaacgatcggtgcttgactacagcaatcgtaagtgacaattctaaaacgatcatacacctgtgaaacatttgtcttcttttcttttctttcttttttatatggtatataaggatagaatggtcatttcattcataccgctgcatggcaggatgacttggcatggcatgctcaagggacacttttttgagttcaaggactatattaacccaaatgattaatttggagaacttttttgaatgatttgaaactccgaggactaaactgagcccaagcaaaacttcagagaccatattagctattcagccgatcatttttatataaacatttaggccattaaaattagcttccaccatattaatggcaattcctttccttattttgtcaaaaacaggtgaataagattgcattatgaccaaaataaatccatttctctgttttttggcaaatatcaaactgtcatcaatttttgtacaatagac

SEQ ID NO: 26299 - DNA, 1391 bp, Oryza sativa
ccaggtgcacgacggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagagcggcgctctggcaagcggcggggaaggagtctccacccgcggtgactgtcagcgaagtccgctcagaagagccagcgaggatcactgcagtgacctcccaaccagcgcggggctccgcgtccccaccctcctgctccgggagaggcctggcctggtagtccactccgtgtggataccccagggccacgcacatgcctcggagctccaagacgaagccagtcatgtccaaaccacgacgggtgacgctgccggccatctacaaacaaaaacaaaaagaaaagcaacattttcaaaggtcagattttggcgataaatgaagcagcaagacagagagagactagaggattttcacaaataaccaaggatttttatttttgaaaatattgctaaggcttgggatctacggctcgtcctagggtcaagggtggctctgataccaacttgtcacgaccggaattaacccaacgggcgttccttacgtgcgtgcattaatccttgtcccaggaggcaaggtacaccataagttgatacaattcagagtttaacaagcggaagcgtaaatagttaacttaatacatgggcagcgaaggcccagcacacacaaagacaaacgagaaacagcggaagactagggcgacgaccacaggcgcttgacggcaggcacgagctagacaccaaagccttcatcttcaaggagctcctcttctgggcttgggaaaaatttgagcaagactgagtacaaccaccgtactcaacaagacacacccacaagtgcagaataaatgcaagggagtacaagggaattataatatgaagggttagggttgcagtaaacagcatttaaagacatttagttgctcaaagccattttgtaagcacgattctaaaactatacaatattattaatcaaggccgtgaacccacacgaacctgccttaacccaaggcctacgatgattcagaccgaactggcaacccaaccctgggtcccagctcgtcctaagccaacccaggccatccattccaccttttagttgttaagcaggttttaagaattaaagcactaacttgggtacattgctcggcttgcccataaccgagggcgcggctattcgaatagattctactctgatcagaggtgtacatctttacccacaagacacatcttcctcacgtgcaaccacgtgccacataccaccacggtatacagacggaagacgtgacatagtttccaacccatcc

SEQ ID NO: 26300 - DNA, 184 bp, Oryza sativa
atggttgtaccggtgtgtggtatgactgtgtcggagcctgtctttattttattggcttaagcaacctgaaccttaatgaacccattttatatcagtaataagttcaataattttggtagtcgtgggtggttagttttaatagtttgttctctctgttggctggtttgttttggggtatttcaga

SEQ ID NO: 26301 - DNA, 979 bp, Oryza sativa
aaatatctttagtcccggttgttcacaacaaccgagagtaaagaaaagatctttactcccggttgttgagaacaaccgggactaaagatatttcgaaacaaccgggagtaaatatcttttcccgctatttcgaaattctttttaaacccggttagggttaagaaccgggactaaagattatagcactgcatatgattttcgcttacatatgtgtttataaaatagaagttaatacattaacattatttaaagtacaaagattaatgacaattacttcgaaaaattatttttgtctgtaataaattaagtggataaatcgtaataagcaaatatatgacttataattaataaaaattccaataatcatatatacttagcatatatatgaatgatattattatattgataaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccata

SEQ ID NO: 26302 - DNA, 1501 bp, Oryza sativa
gattgcacgaaagtgtattctatcagggaatcgaattgatgaattgttgcatgatattgcactgcgttcagtttatccttgtttaaactttaatgtgttacgaacattacggaaaattgatttgtacattccaaatccattggttgcactagccgtcaacccgtgttttgcacggactatattaaaattttaaaaatcttaatcatattctagaatattggttatttattttcaaaaatatctcatacaggaaattagtggattccatattagcggatttgcgtggagatagaattcaaaagaatctttatttttacatagaactcttactttttatttccatatatatataatatgtataaattttatttttttaaacatagaattatatttttttaattgacagatagattaataaaaacaaagtaatttaattttcctattgaaaataattgtgaattttgataataataataatatgtacaaaatcttactccacaccgacgttcgcttttagcatccaatgcttccactgaaagatactctgctcatgcatggtggcctaggcatcttccccggaaactcaaaatgtcaataattatgcaattgctatagaaatcacgtccaaatttactttttgttatctattttgtttattaataattctacacattaaaatatcttgattttatatttttattaaataattttaaactgtagaattgatgatcaatgcaaagtgctagagtatcaaatgcgttctttatgcttttctataaccttgttctagttttttattttctaatttaatagttctcaaaatagaaaaatcatagataatgtggcctcacagttaatataaaaaaatgaactcgccttggaatccaaatttttttatttaataattctgaaaattataattgaaaatatgagattgtccctcctcattgggggtctgaaatttagtatttcatttatttattgatgtaaatttaacaattaggaagctccgctgtgtcttgactgttcttttatatatgtcgctcctaatttgatgataacacctagatagatgatttcggtttaactaattacaaaatccgttagtaaaccgtgagacaaatttattaaccctaattaatccgttatttgcaaatgtttactgtagcaccacattgtcaaatcatagagtaattagtctcaaaaaatttatctcacaaattagtcgcaatttaatgcaattagttattttttagcctatatttaatactttatgtaggtgttaaacgttcgatgtgacagggtataaaattttagggagggataacatgccttaatgtgaggatacagcgagcaattagcaatttagcatgggcatcgatttgcatgcaaacgcccacaatcatgatatagaaatctaatgtaattatatatatatatatatatatatatatatatatatatatatatatatataactactatacaacaccctaaggtg

SEQ ID NO: 26303 - DNA, 1501 bp, Oryza sativa
  unsure (1)..(1501): unsure at all n locations
actccatcccgctcgccggcgtgcaccggcgatcgggagagcaggtctccggaacctctgccttcgacgtcctgcaccgggagaagggggcaataaggtttttgggaagcgcttcgcgcgactgctccctgttcgtccacgacggctcgccttcctctccgctcgcgtgctgcgcgccttcgtcgacgcccgcaaccgcgagtagttcctgccgagcaaccggtctttccgccagctcggtacgtgttcgacatgttacgcatatttcatctgttcatgtnttactgcttagtttacatgtgtagatctaatgatgtgttaatgctactggtatgccatganttatttatagaatatattaaatcattatatgcctatgatctcaacagaaaggaactcagaattaggtttgtctgagcacctgatgtacactgagataaccatttgaccctctgggccttcaggctcaaaaactgcttgaaatccttcttaaactgctgagcataagcatctgtgtgacgatttgacgccttgatagcctcaagctcttagtctccttaagatcatcagtgcctccagttacaagtgcacaattaatactgaaaatatattctgttcgtacatgagcatacatattttttttagttagagaaattttcatagagataagaattttcagcaatccttccaaaactgctgagcataagcatgaaaaagtttcatgcttcatagggatttttgctgttgcttctgtctcagccacccatttagcaatcaatggctgcatgcatgagccatacaaaaatgattaattagcaactgtgtactagagaataaggtgttttacctgagaaaaaaatcaccaaaaaaaaaaatcttcggcgacaaaattagagcacgcattaaaaaaaatacacctcgatttgactaagcgctaaaaaaccggcactacgaaatttctcgcttaagtgagtacggtttttctacaaatgggaaactttttacttgattttaaacttttcttttgcgtaaaaaagcacaaacacaaatgcttatataaatttatacacacccatccatttaaatgcatatgcgcttgagaacgagcaggagagcaggggcctgggctagtccacgctgacgcacgttgcgccgtctgagaagataatgggctccgacatgcacaacaaggaataagtcctattgccgtcccttcacactattaatcttcgcccctaaactgtataaaaccgaattatgttctgtcggttacggataaggcataccctctatcctactacttatggaatatatcgataagatatatcttcacgtatacggtcagttcccgtatacacctttagaaattcgtctcagattatggaaaatatctccatgagttaaggaattgtagaagtcctattcggaaaggtcaaaatttctagtatgccgtgttggtttacatatccccaagtcttacttgagggtcatggtattccac

SEQ ID NO: 26304 - DNA, 279 bp, Oryza sativa
gggaaaaagtgtaccggaggtccctgaacttgtcaccgagatacgaaaacgtcctccaccgcaatacgagatatggggtcccctaactatacaataccggtcacccgaggtcccacggcatgatttctccccgatttgtccgatgtggcgacggttttgtccgccgtggcgctttgacctcagtcgtcgtcgctgactcaggagcccggtagttaggatataatgaaggaaatgtttggcgcggcttgcttctcccccaaacaccgaaaccctagcagg

SEQ ID NO: 26305 - DNA, 220 bp, Oryza sativa
gtgtcctagtggagtgtactactactggagtagtgatttgcattgcatgatgcacaattcagagagagctaaagaaggcagcgttacagctgctttcatgcgagagagacaaaccaacagtgtcagtcacctccaagaaggcaaagaacagcaaagccattgtgagaaatagcaaggcagggtgatttgatgacgcggcacaaaggcaacatcagaaagg

SEQ ID NO: 26306 - DNA, 1096 bp, Oryza sativa
cgcttgcgcagcttgagactccgatgctgtggcgtggagcttgggtccatccaggtgcatccccagttggctcccaacttgcctcatacatttcacgggtgttgaggatgatgaaccttctcgttcattacttgccatgttgcgtgtctccctgtatgttccacctgcacgagattcttctatggtatgcaagggaatggttagttcatggtagttgttcaaataatatcccgcattaggcaacaagatttcatatgtacaaccggggaagaagtaaatcaaagatccatctactccatgtttaagaatgttcccttgcactagataattctcatctatacagggacaagcggctaagacataagcaatctaatcattgttaataacccctagtccctttgttatccgagtaatcaaggaagtgcactccacaggagtagaaaatcttatactttctagcctttgccttatcatacatttcacagcagcaactttgatcttcctaaccatgacaaacatgacaattaattcatcccctctaatgggtcgtagatcacctctaggaaacaaagttatagcaatccatttatgcataagcctaagtgtaggattatggttatcattcgtcctagttttcttgcaaattggagcattagaaatgtcttcccaaaacctatttttctcgaacctagaaattcctttctggagatcgattttacaggaatcgtgaaaaccaagaagtgtacataatccttcccatgaaagtgtatatttcttatggaaaaagcgaaaagaaatcccatcttgtatttctttcaaagtgcacagaaattgcaaagcaagtgttgtcgaattgataactgtgtcacgtcgaaggacctagttcttttaacagtggttggaagtaaagacaattgtattgcttagtaaaaattttttcagatccccctgttacatggccctagactctccattagggtttaggctctacagaggaatttacgtggttgcccttatgatagggacatctttatgggcatacaatgtcttttgctcgtatgggctcctaatgggccaagtgactcggcccagtcca

SEQ ID NO: 26307 - DNA, 544 bp, Oryza sativa
ctagttttcacaggttagcaggtgagcatgtcttgtatctgtatatctccaccatggtatagtactagagctggaaattgagacccaattggttcaagcataagtaagagataaatttccgactaatgaaattcttcatgtgattgatcttgtatattcattattctcagctgaactttgcttgtgaacaaccatccatgttttgggaaccttatacatctaagtaattgctttatgtgagatgattaagatgaaaggaatccttgcaacatggttatgactcttgggaatttattttcaaaaataaaattattttaagaaggctcaatcctccaattgactttaccttatacctaccaaggccatatgcaagtacattaatgatcaaccttatcatgcatatgactgcttgacattatattgagctttgtcaaaattgtgtgacttgtgttaaatatctttcatactctcatgatcaaggggtcactatcatttccactttccagttccacatataaaaaaaattggctaagcttctacactg

SEQ ID NO: 26308 - DNA, 765 bp, Oryza sativa
tttcagctcgttggtgaaacgagccgagcccgagctggctcgcgagccgtttgatttggctcgcgagcttaggccatcatgtgtttatatcgattatttatttttttatggagttattatttgccaacttgaaatttttctttaagattttgaagaattgaatatataaacttatttaaattttacaagttgatgatttgttcttgtttttttaatagttacaaaatatatatgaagaggtgtttcaacaggaagacttgcatgccagctcgagctggctcgagccagaaaacaagccaagccgagctcaagttttagcttgtttccctaaccgagccgagccaagccaagccaagcctagttttgttgcgaaccactgcaagccgagccgtcgtttccacccctagtgcgagtattactgaaagtatatacttcaaatataaatatacgtaaggacagtattggggttatttactcgggcaacaaacaaacaaacacccataatattttaaagaatattttttgccgacaggtagttttgtggagcatcaatatctaatcacattttaatcacggatgttttgtggaactgctggaacctccgatcatttatttttcagttctcaattatctacatactaatgggatttgaatacttgagtggaccatttacaattcacttctcccttatctacgtactccagctgttacaattctggaggggcaagtagtagtgttcggagacttggagtagctgctctgcaa

SEQ ID NO: 26309 - DNA, 316 bp, Oryza sativa
aagttaactatttacgcttccgcttgttaaactctgaattgtatcaacttttggtgtaccttgcctcctgggacaaggattaatgcacgcacgtcaggaaagcccgttgggttatttccggtcgtgacaagttggtatcagagccacccttgaccctaggacgagccgtagatcccaagccttagcaatattttcaaaaataaaaatcctttgttatttgtgaaaactgtctagtctctctctgtcttgctgcttcatttatcgccaaaatctgacctttgaaaatgttgcttttctttttgtttttgtttgtaga

SEQ ID NO: 26310 - DNA, 1501 bp, Oryza sativa
tatttagcattactatctgtcattggattgtgtaccactcacatatatttagccttcctagctccacatattacttctggacagcacatgttcttgatccctacaatcgctgactacgccttccaggtatccattgcttggtaagggcttggtaaggttcttcatattgctgagagtagttgagaggcaccactgcacctgcctggtagattattatggataaccttcacatttgttgttgttttggtgtttcaatggcaggtgacgatgatgagaggactgcccaggactttgctgactgtgtcagtgttgacggtcgttatcgatcaattttgaccgtcaatattaccaaaatagaggtgaactagtgatgattgtaatgcatatacatgttagagtaataatattccactagtacttggttcactaaccttttgcagagaataaccataaagtggaggagaatcgacattgagtcaaacgataaatcattcggataatatcgagaatcagacttatgcatgaatgggccaagaactcagaattgacacgatgaattgggccaaaattcacaagtctgcataaaggagcaatagaggaggccgccagccgaagatgggctggggatggccttgcccatggttcggccgaacccatcctggtgtcgttggatgcaggtttcggcatggacgtccaggattgcatcccaatgacggttggagggcacttcggacaattccccttccaaaaccgtcataactacctctatataaggacttcaccttctcccttcactcacatacctcacgcaaagctctctcatattctcttaagtttagtttagtagtatcaagctggtggaataggaatagagtagaaaatcaggagtctggaagcgttcggaacagttcaggtatggctctagtagctttcctttcctcttttataagctttgtactattattagaatactcttctttatacatttacggtattgaaatactttccgagtatatgaatgccaactttacattatgttcatgttatactgaatatgctgctagcttatctgggagatgctttggtgcgggtataatgtttgcttatgccattactctatgtcatgacgatgatattagagtattatctggtagtttagacgtagtgtctagattacgggatatcattatttggggttatatgctgcggatgagaggtgggccgctaatggtgacagcttagtacgggtatacctccgcgcgtttatattgtcctaagttaattccctagggagggtactcctccatttttagcccaggttatatggtcatgacgggctgtcgtaagaaactcggtagtcaggggtggcttctcgaagtaccagaaggggatcggatagagggtattagctagtatatcagttaactagaatgtatgtatactatgtatactagaagtataggaatagatgatctcttttttctttccacttagcttagat

SEQ ID NO: 26311 - DNA, 928 bp, Oryza sativa
ggtgacagccctcgagatcactgaagtcctccctgtccgggtacgtagtagagcgacatctgggaacagcgggttgccagtgcctgaagtattgcgttaggattaaaattaagctttccctagacaccatttctcactagtaaatcctctctatcctagcctatcaattgcttggtgtccttggatgaaccggaggaagtctgatcacacacgttcccttggattcgatacccttggaatactccataggggaagtgctacatcggtatatccgtgcgcttgcggattttatctgtaaccttattaattaccaacaatcccccctcctgaccgatgatatgatgggattaaaaaagggttacaaaatcatacgtgttattactcatacgtatgcacgggtctaaagctaaaaaaacaactcaataagcacaacccacccaataaatcacgcagtaatataacgcggctaccgtacataagtaaatatttaactctaattgccatcatagcatcatctataatatatctttattcaaatctacacctcgaaggtctcatgtcacatggtttaactacaatgtagttaatttataacttgttacattgtagcaacgtccaatatcgccacattgtttgttacagaacatttcattcggtaccaaaaaaaaaataaacgggctgagcattaatcggacaagccgttatcacacaattaaccccacgatccgtttttttttaaaaaaaaaacccaaaaaactgggcgtgcaacacatgtagatccatcattatcgccagtgcttacgtccaaggcgtaactccacacagaaagcaaaaaaaaaaaagaatcagcaaccaagctagcttcaagttagtgggggctctcggagcacatccttccagtcactccttcatcttccttggctgctca

SEQ ID NO: 26312 - DNA, 197 bp, Oryza sativa
ccatccgagtggaaaagccccattgtcagtagtcatgcagtccaatagcatccaaagctatgtaagtctctttccctctctctgttagtaatttttgttagtagtttttccagtgtaaataaacctaataccatcctttatatgtttagtatttcttgtaaaattaagagaacattttaaacttcagtttaaatgat

SEQ ID NO: 26313 - DNA, 597 bp, Oryza sativa
gttttttttctaacttctaatcttcaactaaactaccaatcatctatcaattcccaccacctctaccaaacaaaagattgggactaaaaatcaaatttccatgttaatctcaccatcaatttactcgttgaaactaccaatcatcttccctcgagttttcaaacaagtcgtaatcattttattccccattccaccactacactgagttgcttcatacactgaattttttaatacatttaggtcattgtaagtttcgctatgtgagtaacggttttgataagaaactttcatatgcaaatgttatcaggatttaggaataattcctatttctagcgtcttcaatgtaagaaagattgtaaatgttattaaatttcatgcaccaaatagttcaacctaaaagattataaactgatgagaaaacacgtgatgcggatatcactccttcggatacacacaacaatcctccaccggtcattcaaggaccgataacaagcgctcgcgcgcgacaattgaatttagaggtgagctcgttcctatgtgctttttttgtacgaatttgagaatagattgctacctaatgattatattgtgattagg

SEQ ID NO: 26314 - DNA, 627 bp, Oryza sativa
accgccactctgacccattgaacaccatttttgcacgggacgctcaaattgaaccagacatgatgttgtgcatcaatcaaacctacacgccttatgagtttgaaacatcatgggatcaattcataaagagttatgatttggagggctgtcccatcatgaaagctttatatgatatcagggaaaagtgggtgcctgcgttcttcaagaaggaatactgcaggaggatgacgtcgacgcagcggagcgagagcatgaacaagttggtgaagcacaagtttgctgaccaccaaaccgcgctgcaccgttttgctcggagaatgttggaggttataactgacaggaaggagaaggaggctgccgagacaagagcatgctcggttagtgatatttttactgggggaaacggtctgacatcactcctataattctactaaattttaactcacaccaactaattatatttctttttgtacatggaaagccaatgttggctgtacggtggccatctgttatacagatgtcgagactttacaccagggcggctttcagattgttcgaggaggtgcttcaggacagcactgacttcaggatcacacaagacgacaatttccgcaacgggtgggtagt

SEQ ID NO: 26315 - DNA, 503 bp, Oryza sativa
atagaatcaatgcatcccattgtatgtctgaacagctctgaaacgcacctaactttttcccaattcttcccattgcatgtctgaatagctctggacaatatggcagcctccattgatcagctaaaagctaaaacaaatggtatggtttccactctccatttgtttctacgacacgacctacattttagctgaaatggagaccagctgcagaccacgttcaatgacttcaatcagctaatcaatgaagacaatcaattatataattgtgagcattgttcaatctatccatgtcatcctgattttgccaaataacaagcacaatcagatatccagacaaaagatcaaaacttttgccaaatcagaagcacaatcagagtccaaagatcaaacttttgccagatcacaagcataatcagagaccaaagatcaaacttttcccaaatcacaagcacaatcatatatccagtagataggaaatgcatcacgaaggttcatcgcaaata

SEQ ID NO: 26316 - DNA, 1293 bp, Oryza sativa
ggagaggagagagagggagggaaagttgggcgagccggcccaagaagggaagggggggaaagaagacttttagggatttttctttttataaaacctttttaactttgtttatttcttctcaattattatgtgtgctctgaaaattccactaaaatttatttacgcattttaggcttttaggaaatatacaaaaatcctccaagccttatttgacttttaaatttgcacattttaattgttgaaggctttcacatgaattttaattattctcggcacaatttcgaggatgtattttagggtcgttttgggacgcgacaactaccagggcaagcagctcccggagcaggagggtgacgatgcagagccccacgctgcttgggaggtcactgcagtgatcctcactggctctcccgagaggacttcgttggcagtcaccgcgggtggagattccttctccgccgcttgccagaacgccgcactcctcgccatcggcacttttcaccagcgctacccggacgagttgcagcactcgccctaccgctaccaccctcgtcgcggaggagcccgcgactacgccaccttccgggatgctagctcggaggatgacgctaccatcatgcacctggcacgcatggtggaggcgtacgacgtggcccgtatcgacttccatcatatggtgcgccgtgggatggtcgagaacaacatgaagatcctagagctgcgtcaggagaatctgcagctcaagaaggacctagacgcagtggaggcgcagctgcatcagctcaagatcgcccagggagagatctgccgccccaagcgtcgccgcgtctgccgcagccagaagatcaccgcccgcaagagcacctccaggcctgagcttgttcgtcagtccctggcgtggacttgcttcgtcgagacccctcgtgccgagcctgcgcccgtggttccccaggagggggaagcctccggcgttggtagctcggagggtgcgctgttgctcaccttccgtcctggcccgtcgcagcgttagatgagcagttagtaggcttgcgcgtgtgttctttctcgtttgtcttttttggtttgtgtggggcatggttatgccggtgtgtggcataactgtgtcggagcctgtcttattttatttgcctaagcaacttgaactttaatgaaccaatttaacagcggtaataaatttaagaattatggtagtcgtgggtggttagttttaattgttagctctttctcggtttgctggttctgtgtggggttttcagatggtgacgaccagga

SEQ ID NO: 26317 - DNA, 1501 bp, Oryza sativa
cagtcaggggtggcttctcgaagtaccacgagtgcatcggaaagagggtattagctagttaatcgtataactagaatgtatatacactatgtatactagaagtataggaatagattcttttctattttctttccacttagcttaggtaatttagtacgagaatgagtagctccatgcatgtgtgtcactctacccattgatttatcctaatccctccttagactatgattattacaagtaacatataaattattagtacatttctctctactatcatcttcccacgggattaaataaatacgatacccttggaatactctcgggtgaaatgctacaatggtatatccgtgcgcttgcggatgaactctgtaaccataatataccaagagtatttctgcgccattgctggagattatatttctagtaatgtcgttaagaaataccaagactccttcatcagtcttgtcgaactctatgctactcaggcacaagatgggcactaaatttttgctccactgtcatctcccaatcatggtatttctcagcatcataataacccgaaaaagatggtattttaaacttaaccttagcataagggtcatcgggcacacgattattattaccttgttggtggtggtcatttgaagtgccacccatacctgtgcggtatgtgcatagacgacgtcgtagtcgtgcttgccttgtagcttctgcatcaatattgccactaaatcatacatcgtgtcctcaggatggccaccagcgttgctgccactcacttcctcactggaaggttcttgtgtctccaacgcagcaacccgattagctagcgtggatatccgcttgtccagcctctccatgtggtttaagaagccacttttattgatggcatcttggacagcctttgtaacggcctccgtcatgtcattttgagcaattttctacactagttcgtagttgctcttgacagactgtcgatatttcttaacgacattactagaaatataattcccagcattggcgcagaaatactcctggtatattatggttaaaaagtttatccgcaagcgcacggatatacaattgtagcatatcacccgagagtattccaagggtatcatatttattttatcccgtgggaagatcatgtagagagaacttgactaataatttatatattacttgtaataatcatgttctaagcaggggttaagataatccaagggtagagtgacacacaagcatcagctactcattctcataatatattatctaagctaagtggaaagaaaaaagagatcatctattcctatacttctagtatacatagtatacatacattctagttaactgatatactagctaataccctctatccgatccccttctggtacttcgagaagccacccctgactaccgagtttcttacgacagcccgtcatgaccatataacctgggctaaaaatggaggagtaccctccctagggaattaacttaggac

SEQ ID NO: 26318 - DNA, 1252 bp, Oryza sativa
tatatattcatattaaaattccgtatttttcatgtatatcctacaaaattcctaagaaatgacttaatgcctataaattttgaagaaagttagcaagagcttcattttttgaaaaaaaaatttagtctatctatgttatctgattttttttctttttgttttttatgcggactattcaaaaagtcgctcatagattttcctatgttttccacttatatattcatattaaaattccgtatttttcatgtttctatgttttctataaatgttgttggcgattctagcaaccacgctgctatggctacttaattaagattaagaagagcgcacagagagttagagctaggctgtgtttagttccacaccaaaattagaggtttgaagaaattggaacgatgtaatagaaaagttgaaagtttatgtgtgtaggaaagttcaatgcgacggaaaagttagaagtttgaagaaaaaaattggaatctaaatagggccctaattgcaaatttgcaatgtaagtgctgtaccgcatgcattatctaatctgtcaatcagatcctaccctacagaatacactatcggtctattttggaaacaatgtgtactaactttgtagagttttaatcctatagaaaaattttctacctagtcatttgaaacatagggttgaagcttcctaaatcctatgaaattcctcagaaatatctcagtagaggttcaacctattagaaactttcattctagtctgttattctcttccggttcctatattttttttctatattctatttaaacgggtatttcttattcctatgttatcttgttgtgttttataattttctgttttgcatatacatttctattaaaatcacgtgttttactatttcagtgtttaattgcaaatggggcttgctatattatgtgatggttaattcaattacaaaagaaactgaagtacgactgtactgcttgctagttgcagagacttgcagtcattgttcagtccggcatgcactgatcgatctgctacctgccctcactgatgtatcatggatcaatccaagcaccaaacggttacagtagtatatgcatcctatgaccatcctgtcagtaactagggaccatgcattactacggccagttccctcccccatttttccatcctaaaacttaagtgcactgcataaagcgcatatggttcccgtagactgtgtttccatatttctaactccatatatcgtcttctctgttcaga

SEQ ID NO: 26319 - DNA, 1100 bp, Oryza sativa
gagtaaagaaaaaatctttactcccggttgttgagaacaaccgggagtaaagaaaagatctttagtcccggttgttctcaccaaccgggagtaaatatcttttcccgctatttcgaaattctttttaaacccggttagggttaagaaccgggactgaagattatagcattgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatcgaaaatagtttacatcgtgtacacaataattacggcattacatcggcggtgacggttgaccgcacgtactttctcctcactattgttccctccttgtgatcgctg

SEQ ID NO: 26320 - DNA, 1059 bp, Oryza sativa
ttcccccttccctcccctctctcggccgccgctccgtcgcgccggaggtcgccgccggtgaccatcggggcgcgggcgtgccgcttcccgtcggccgtgccggcgaggccgccttcgggcgcgccccgcggctgccaagtggggcccggccgtcagccgcccgcgcccgcgggtgcggctgacgcgtgggacccacggcgccggccgccgccagccgcgtgctcccggtccaccgtggaccgaggggctgacgcgtgggccccactcccgtggacccggtccgcgcgccctctctcccggctgacgcaataaatgggtttttaattaaattttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagcctttttcttttccgttggtcgtgtagacgctgcagcttcggaagatccgctcttcgtggaagtcgaagccgtcggttgggaaagcgagcaaggctagtcacatcatccttgagcatattgaatccccgtttacaaaattatctttaatttaaattaatgcattatcgctttatttaaattcccgcgttatcactgttttatttagccatgcctatttacctttgttatgaccatactattattgttattgttattattaccttgttcaccctagaataaacaaaaccccaactagtggacactctatttatggttccactagtatgaatttaggtagatgcttcgctgattaaattagacaacattaggtggttttataactttagactttgggagttctcatatcattcggacactatggaattgttggttgatggtggaattggacatacacctctcttcctctttcaaaacccctaaaacctgttttcggtggggtttgggtgcatgccagttgtgggaagtagcaccccggccactataaggattaa

SEQ ID NO: 26321 - DNA, 1501 bp, Oryza sativa
acccagagcggagacttggcgatgagccctcccggcttggtggcgaacccttcttgcttcttcacctggatgggaaacttgatggtgagcccttcgaacttggtgacgaaccctcctgacttcgtcttttggcttcgcttgagaggaacctcgtggactcagttggcgtctcgctgatttgatggtttcggcaggttcggctgaaggcccttgtgacatgtctacaacaatccttgttgcgagtattccttggcaattatgccaactgattttccgatccaacaacgcacttattttcatagatgatcattcacagtgatatgccttccgaatggtctgaacgaacgtaagccacttcgtcttcgggatcatcgtcaaggtctatctgaggtctgacatgaagattcttgttgtattcttcttcatcgacgacgttgttcacccccacaattctttgcttgccatccctaatgacgtgtatcttcttgtttgcggggtcttttatgtggaaaatctgttcgacctgcttcgctagtacaaatggttcgtttgcatatccaaccttggccaggtccactaatgtgaagccttccttgtcgaccttgacacctgtgcggatattcacccaactgcaacgaaacaaagggactttgaagttcagatagttcagctcccatatctgctctatgcggccaaagtatgtgctcgatccagcttgatcctgatatgcatctatacggactccactgttttgcactgtgcttttctcatcttgtgtgacggtgtaaaatgtgtatccattgatatcgtacccttgccatgtgtcaacatcccaagatggaccccttgccaacctttgtaatatctcacttgggccatcggtcgactgtgctacacgatccttgaaccattcgttgaagcgagcaccatgttctctgttgatccaaatatctgatcgaccaatattgtcctgtcggaccttcgctaaatgcttctcaaagtatggggttacttcagccatatgttgcagcactgcgaaatgaacctgcgcgtaggaagcttgatcgggaacaattctttttctaccagttgtgccgacacctgccaaccttccttcgtggcgagacataggaactccgataggatcagtctcggccatgtaatcgatacaaaactcaatggcttcctcggtcgtgtaaccttcaatgatgctcccctctggttttgctctgttccgaacgtaggacttcagaattcccatgtatctctcgaatggtgtcacgtcccaaaacgaccctaaaatacatcctttaaattatgcttagaataattaaaatccgtgtgaaagcctccaaaaattaaaatctgcaaagttaaaagtcaaataaggcttagaggatttttgtatatttcctaaaagcctaaaatgtgtaaataaattttagtggaattttcagagcacaaataataattattaagaaatatacaaagttaaaatgat

SEQ ID NO: 26322 - DNA, 1501 bp, Oryza sativa
tgtgtatgtctatggtaaatttgtgggtggaagaaaatactataactccttttatcatcctccatttattttctcttttcatatttgggagagtgcatggctattttttttcttttttttctttttcttccattttttttcatcatcatgctccacacttgtatgaacacttttttcctttctttttgcatagccatgcctctctctcacttttttttaaagaactttggaggaagaggcataaacgacatggagtatttattttgtggactatggatgaaatgaatggtaaatgagaaatgctaacttccaatgtagaagtcaagcataagtgcgtgtatgtggagtgtatatgatcttgaccatgagagtacgaaaaacatttcactagggtcacaaaacttgacaacgctcaatgtaatgacaagcaacgtatgtagcaagctaatcatgactgatcaacctatggctctagtgggaataaaaatatcaatgaggagtttagcatcgttatatatttttttctttttataaaattcccaagtgtgcaacatgaagagcaggatttctatcatcagactatatctcattcatcaattgtctggataacatagggtccctattggatatatcaccacaagcaacaagtaatgagctaagaataataggcatgcatgttattttcagggagatcatgaactctaattgtaccatccctagcttgagtttaattatctttgatattttagaactgataatcaaattaaactcaagatagaatggatgtccaaaggaaaatttgtgcaaacctgcactctgtataaaacagaggacgattcatggtagaggtggttcagccgaacaggaggtttggcagacccctcattaggtctgactgcatcaattttccatgtgtggttcatcatggctcatcacttctggggtgatcttgcttttgttatgccgttaatgtgcaagatcacccccccacacttgtctttgtatctgctaggctttattggacacaaaaaaaaacaaaaacaagagtgaaggaaaaaggactcacttggttggaagaccaaggagccacatttattttgttttgttttatttttttccttttcttttcctttttttatctttttttatggcaacaatggatatgctggataccctggcaggatggagacatgagatgaggatgcacatggtgtatgagattcttaccagatatgtcttaccaaggtttgaaccgaatgcaagaatacaacaagttttgcatttgttctacttggttccctatgcatatcttttctcatagataaggagcgtgatataagtgttcgaagttattgtacactcctccttgattgtctttttatttcctgcaaaaggttagcggacaacaaatactcgaagcaatacaaagattttattgtagcctcaagattaattgttcacatccacgctaaaaaggaattggattcaaaacttaagaagc

SEQ ID NO: 26323 - DNA, 429 bp, Oryza sativa
tctccagaatcaaaatgagcagccacgcttgtggttttcagttcactacttatcattgtgtaatcgaaagtttgcagcaatcatgtagtaaataaatatattcatgtctataaacagtgagcttgctatgtttatggatgattcctgttgaggatacaatgtaccgatgttaagcaccttccctttttgtttaaggcagggctttgtattcatgtaataagggagacatgtgtaataaaagcaagttctaggagggttattttggaagatgctgatatggaattatgtgtataattgtttactgtcaaaggagacctagggtctcatttcagaggaactatgttctaacctcgagttaataaccaacctgatgatagaaaagaaaatgccgagtccgggaagatatctgttgattcaattgtcaaggaa

SEQ ID NO: 26324 - DNA, 1501 bp, Oryza sativa
gtcgctccaaaaggaaatcccaagccgcaaccgaacctgaagctgaagctacagctgtcgtgcgcacaacagcttcaagcaaacccaagaaatggaggggcgagcgagggaagaaaatgctattgaaggaagtaagtgtgctgacacggatgagtgagacaggggaacccttgtcaccggaagactcatattcgaagtatagcaaccaatgtggggcggtggtaaggaatgttgtggagatcacatggaaggattggaagaaagttctagagagtagaaagaacagctgttggacgtcactgcaaagcaagtttgaatatccagaggggacagacgacgataaagccaaggaatatgcgttgaagactatggagaagctgtggcgaaactggaaaatagacctaaataagaaatatatgtagaagggactcacgccgtttaaggactacggaaggataacacaggcccagtgggatgagttcattgcccttaagacatcggcggaagaaaaggagaagagctagaagatggctgagctagcaagaaggaatgaatatccacatcatttgggatcgaccggttaccggcaagcggtgaagaaatggcaaaacaagatgaagagatggagaaggctgggaaaccgattcctatgaaaaatcacaacccacgaagcaggaactgggtgcgtgcaagaacaccggccttcacctctgagggggatgtagtattcaaggatcagaagctccaggaggtagctgtcaagatgaagaacatcatcacgcagcaacaggcctggacgtttgtgccagatagagactgggacgagctgacctatgccttgggcaaaccggagcactctggccgtgtacggggagtatcctcaaagactagctggaaggatggattcaaacaggatgctcatacatacaagaagcgtgatcgctacagggaagagattgactctcaggctagggcagtagctcgtgacgaatgcaatatatactggagtcagaaaatgatgcacggtgctgctgttttagagcctgagctgagctatcctttcgatgatgtaacggaggatactccgtgcaagctcttgattccggtcggcagggcgggaaagaaaatactcgttgcaactgggaggttcataccaggtcgcaggtttcattgccaagacattccggatgactacgccaaggtagaggtccggacggtcattgaggcttactggatgcacgcgctcgactttccaactactgagtagattgtgtaccttggagatgccgtcgaccaattcatactatggcacaagaatgatattgaactagggtcaactgaaggaactgattgtccaccaaggatatcggtattatcatcacgtccactagtcgtagctagtccgagggatagtcctattgcttcaccccctagaccagagccaccagttgcatcacctccaggatcagagcctcctgttgcatcacctccgactaaaaag

SEQ ID NO: 26325 - DNA, 1501 bp, Oryza sativa
tcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcccgggggggcctaacaggtcctgacagcattcgaaccggaactaaggatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgataggttcccaacttcctccagcgaacacatcaatatgttttcaatctaccacatcatcaaaataggagagataggaatagaagggtcatcaaaataagaaaaataagagagatagaaacagaaaggaaggaggggccaatacatctacgtacgtacgtatggtagcatgtcgtgcgtactacacgtacaggtcggaaggagaggaatgtgggcctttcaattttttatttttttatggtataaaataatgggaccatcatattttaagaaaaataaatctaatttattagagtgtcatgtggcagcttagaagcgtttgtagttctatgtgacggtttgagagcgtttgtaggaagtttaatggacttttagtatataatagatagatagatttatgaa

SEQ ID NO: 26326 - DNA, 379 bp, Oryza sativa
aattcctgcagcccgtctacagaggtcagagtaaaatcacatctaacaacgaagcttcaaatttggccggataacgatcagacaataagaagtccagcagtaaaactatttgggaagacgtcaaagtatgtcaagtgggataagttggttctcttgggaagcataattcaaaggcaaagttatcgaccctggcatcaaatagcagaagtagctattacccggagaccgggaaagctaatatgagacagttggtggcaagttagaagtgaatgacaagcatgatattcttatgatgacaaacctggtatcctagtaatgacaagctagtgttgacgcatgacatgaagtggtgacttgtatgaggttgactccgaagata

SEQ ID NO: 26327 - DNA, 1501 bp, Oryza sativa
attcgtccggattccatcccgcaaacctcgccggaacaatcaatggcggccgagatctccgcgccggtttccatctcctccggccgctttccctctctcccgacgctatttaatccacccccgtgcctctctcctccgtttccgccgctcgccgctcgctctctccgtcggattcgtgctcgcgccgtcctcctctctctccgccgtcgccgccgagctccggtttgccgccgtcgtcgctccggacttcctcccgactcggcgtcgcctccatcggcttcgccgcgtcctcgtcgacctcgtccgcgcctccgtttcacccgccgaccgccggagcaccgccgccctcgtcgacccgagccgcgccgccgtcttcctccgctccggccgtcgtttccgccgccctcgtcgtcccggggtgagccgtggaccgctccgctcgcttcccccttccctcctctctctcgggtgccgctccgccgcgccgttggtcgccggcggcgaccatcggggcgcgggcgcgtcccctcccgtcggccgtgccggcgaggccgccttcgggcgcgccccgcggctgccatgtggggcccggccgtcagccgcccgcgcctgcgggtgcggctgacgcgtgggacccacggcgccggccgccgccagccgcgtgctcccggtccaccgtggaccgagaggctgacgcgtgggccccactcccgtggacccggtccgcgcgccctctctcccggctgacgcaataaatgggtttttaattaaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagtttagtagagtaaaagccttttcttttccgttggtcgtgtagacgctgcagcttcggaagatccgctcttcgtggaagtcgaagccgtcgtttgggaaagcgagcaaggcaagtcacatcatccttgagcatattgaatcccagtttacaaaattatttttaatttaaattaatgcattatcgctctatttaaattcccgcgttatcactgttttatttagccaggcctatttacctttgttatgaccatactattattgttattgttattattaccttgttcaccctagaataaacaaaaccccaactagtggacactctactcatggcaccactagtttaattttaggtagatgcttcgcttttaattaggtaaccttaggcggttttacaactatagactttgggaaatattcatatcacctggacactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 26328 - DNA, 1501 bp, Oryza sativa
tgagctgagttgatccatgaaactgacgggatcctgatccgttgaaattgcccctcacactgaccatctgctgcaggcacgagagagagggggagggaatgagagggattactagagatgaggtactaaaccacttgcctactgatctgttgtgagtagacttttattgttcaagttgcttaagcaaacaacctagtatggtcgcatccccaccaatgatgcaaaccatacccctacacacaagcaaacaacacacgccctagcagctaacgaaactactcttccaggaaggattgggtttaggtaaactccaggaaaactctccttgaccttcgcgggatgacgactctgggcggaccttcccgctctttgctgcatgaagcttgatgcttgacttgacttccgaacagacacaaagctgacggtttatcctccacggtttaacaactataagaattggagggacagggaggagaattttgaaaaactgtttcgcaaagaaaagccgaagggcgaggggagacatttttcaaatagggttttcagaaagcttgtccttagggtttgaccgtttggctcaacctatagtcgagttggctctgataccactttgtcacgtccagaaatttaacccaaatttccagactattttgcgtattaaatccctgtccaggaccagccagggtacacaaaacgacaagtaatatacagttcccaacgtaaataaaacgtaaatacttacagaagaggcacttagtcctcacaccgaaagagaacggcagcagcggaaaaaggcgatcctagcggggctttagctccactccacaggcaaaactcaactggggtctgagccttggtcttctaacttcgtcttcagctcagaagcactacacttctgaaaagggggaataatagcaaggctgagtacaaccaccgtactcaacaagccacaccaacgatgcagacgtgcaaggggaacacaaggacggtttgtggctatttgcataaaggcggttgtaaaatattttattgagcaaaacagtacaatagttgagtaattaaagtaactttaaatctccactgatcaacgctacaccacattgaacaggcccaaccaacccacctgaactacagtgtattgggtcgatttattaagatgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgtgtcgtcta

SEQ ID NO: 26329 - DNA, 1501 bp, Oryza sativa
taaaagtccgggcatggccggcgttgtattaataaaattgccaaagtatcaactcgatctattttgtattaataaagaattgcatagcaactaactccactgttgaaaaataagtttgtcgtaaattcaagattccacaattttggcgaattttaatttagattttatgtgttttaaggatcgttacaaacaaaatcataaccatatttcagagcaatcccaaatagatttttgagagaagtatcataggtttaaaatatgataaaaaatccaagtaaaaatcagccaaatttatacattcataaatctatctatctattatatactaaaagtccattaaacttcctacaaacgctctcaaaccgtcacatagaactacaaacgcttctaagctgccacatgacactctaataaattagatttatttttcttaaaatatgatggtcccattattttataccataaaaaaataaaaaattgaaaggcccacattcctctccttccgacctgtacgtgtagtacgcacgacatgctaccatacgtacgtacgtagatgtattggcccctccttcctttctgtttctatctctcttatttttcttattttgatgacccttctattcctatctctcctattttgatgatgtggtagattgaaaacatattgatgtgttcgctggaggaagttgggaacctatcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatccttagttccggttcgaatgctgtcaggacctgttaggcccccccgggatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtaga

SEQ ID NO: 26330 - DNA, 1501 bp, Oryza sativa
gtcttgaattatgcaacaaacgtacgagaagtgcataaaaaaatagttatatgattttagagcccatttgaatcaaagaaattatgaaagaatttcataggattgaatcctataggaatttttcctatgtagccctttaattcaaaggattgaagttttccaaatcctccaaaattcatatggaatggcttattgcatataggttttggagaaagcttagcaagaggtccaacctcttggtaagaattctttgagtctatctctctcactacaagagggttgagctatcgccaccaatttattacaacgaaaaataattcatggcaatatattatactatcacaatgatattttttctgtggcaaataactatattttgttgcaacgatttacaatcgttgttttattcagtatttttgttgcaataggaaatgagctatcgccaaaaaaaacattactattgcaaaaaaacatgttctatcgccacacatttagttcgttgcaataaaaaatttatcatctcataatttgacttattcttttcatatggacacggattaggataaattttatatgaaatttatagctctcgatgagatctacaacttaaattttttatttgaaatcttttaaatactcaaattcatgattcaaatctaagttaggcagtctcaaatggaattgtaagcatttttaaacaaaactgatgcgtaggtaagatgctcatggagagcgcgcgtaagggagagatcttgggttcgaatcctgaacatgacaagatatcaaaagaagatagttaggatgataaattaatattgagacatttaatttggtacgtacaactaatgccacacatagagtggtggcaatagttatttattacaaccatgtgaagtgttgcaatatatattttttgccacatccattttatggcaatatcaaattttattacaactaaataaaaatcgttgcaataacctgttaccacgctatttattaccacggctaacaacgattttaagattgtggcaacatgtatctattgccacaattttagcattgatgctacgatttttttcatggcaacaaattatttttctagtagtgtctcatctaattcctgtgtttttcctgtggtccaatcaaacgatcattcctgtatttttcctgtgttttgcaattctctattttatacttacattcctgtcagaatcttatgttttcctattcctccgttttttcattcctacgattacgattcaaaggggcccttagtttgtatagtcttatgggtgtgtttggcaccccattttgccaacccttctccctcgttttctgcgagcacgcttttcaaactgctaaacggtgtgttttttgtaaaaaaaaaattatatatggaagtttcttaaaaaaatcaaattagtccatttttgaaaaaaaaatctaatacttaattaatcacgcgctaatggaccactccgttttccgtgagctgagatac

SEQ ID NO: 26331 - DNA, 1501 bp, Oryza sativa
gtggtaggcattattactaatcatttccactagtgttggtgaaatatgtgtatgcaggtattttgagaagaaaacacatccgtcaagcgacaaactgcacctccgcgcattcaggacacatttacacggattggaggccccataagtcaattaaacaactccaaatgggcccaactatcatgccaatgggctgagggcctcaaaattagtgtccacgacgaaaaacgggccgaacggagccgtcccgggttcggccgaagctccagttcggccgaaccgttttggtggtcgttgatcgtcaaattttgcgtggatggccctgatcgcatcctaatggcggttccggggtagtttggtcatttcgcataggctgtaaccgtcatacctgcctataaaaggaggagctcactctcatttccaacacacaactttgggctgaattacaagaggctctattgtatcttttgtacattagaataaggtagagagtgaggggaagctctggaggagtgcctagaagtttggcgctcatccgacttctacctcgacgagtgtaacttcctaggaggaattctggaggagtaccggagctgttggtacactctgctccgggttcggggaaacttctataaagtaagcattcgtgttcctttcttatgttatttaattactttgtttaagtaagatttacatctttgcaggttcgttgtttagtatttatactaagtgctctagtactaggactccggatagagaaggaagttcctgcgcaagtattagagtagtaattaataacttagacatggtgtctaggttagagattacctttgtttgttgtgtatcccacggatttgtcagaggtaggcggcaggtggtgacagccctgaatcccatcctagtaatcctccacgttcggatacatcatagagctatagccggaaccacgctggcagaccagcaggggtcggtgcccttagcaacagataggaaattacctttgcttagcttagataattaaaacacatagaaagtcctctctagcctgcctagcctacctatagttgttgtccttggattgtcttagccttaggtagattacacacgttccctgagttcgatatccttttggggtcacccgaaggtgaagtgctacagcggtattccgtgcgcttgcggatttatttgtggacataagaaataccaacagtggttgtcctgttactgcaccgttcatacgagacgaggacaacaaataggtgaacgtgggaggaagttagcacatgggttgaccgacgtggcagtgttggtatttcttaacgacattactagaaatataattctcaacaatggcgcagaaatacttctggtatattatggttacagagttcatccacaagcgcacggatataccattgtagcatttcacccgagagtattccaagagtatcgtatttattttatcccgtgagaagatcatgtagagacaactcaactaataatt

SEQ ID NO: 26332 - DNA, 1102 bp, Oryza sativa
tcctccctagggtcggagcactgcagcggaggtggaggatggaggaggatcagggacgcggcgatggtttgttccctcttcacttatgcttagtcccctgctctgccgatggtggtggaggtcctggatagggcggatatgacggaatcgacagcggcggagaggaggccacatcccggcgtccggttcacctcctccatgcggtggctggtgcaatccgagccatcgaggtgggcgacgatgccatcaaaggggtgggaagactggtcgttgccggctccatatccacaccagtgatgcggcggaccagatccaggtgcttcttgcttcttttccccacgaagagagacaaagagggagaagaaagggatgccagtgatgctgcaatgcaacgtctcctctgtgcgcctggcatcaaccccatcgatctgatcatcttctttctcctgttcgtcttcgttttctttccttcttttctctgacacgcccattgattttgcaaagatttcactgtggtgatgcctgctgagtactgttctcataatgcattcagacggttggtggtgctcccctccaaccgagtgaccgtcagcaggagagggcggtggcatcctgcggtggctggagcgacgactggtgctgctccactcccccaagttgagacctattggaggagcaggcggcagcttccggcggtggccaggcgtaggcatttgatcagagattcataatgtacacaacagtgcatcagatctttgttgggatacatacatctgttttgcattccgttttcattgatttgcaggtttcctgatcagagcagtagaacaccacctgcaacatgcacatactctggtgtttctctgcattggctatttttgccaacaagatcatcaacaccccaccctccaggtacaaatatgacccttcacatgctttgatctctctgggtgcctgcggtatgtttttcacatgcatccaaatatgttggtaactaggatttatttttggggatttttttcctcctgaatagagcagagcagctcgactgcctcttgtattgttttcattagtcttctgagaacatttagttgatatgcta

SEQ ID NO: 26333 - DNA, 632 bp, Oryza sativa
tttcctcttttttcttttttttagttttgttttcccacacatacaatgtttccttgagtaacaaatttactaattgggtttatggtagacaatgcttttccctttacaatgaagtaccccaaaaatatcatatcagtaaaaaaattactactggttctatatagggtactgctcgttcttcttcttgcacatattacacaggcatcttctcttagtaaaaaaattactactggttctataaatggtactgctcattcttcttacacagattgtagaggcatcttctcttagtaaatagattacttctgtataatcaggtagagttgcaaatgtagtaatagatttactcttcgactaaactcaaatggcacaaaatttacattttaaccatactgccacataacgtagtaatacttttactcaagtgtatttttcacgtgaagtaatacttttacttttagtcaggtatatttttcactggatcactcaggagaaaccaaattaggagtaaacgatcaacattttcaccaaattaggagtaaatgatcaacatgtcactgtatgggtaaaaaaaattacacatccacaggcaaaaaaaaaaaagagaaggaaacatgaagctaaatccacaa

SEQ ID NO: 26334 - DNA, 1501 bp, Oryza sativa
aaaataaattccaacgatagttatgctcgatttttagaatcccaatgacaataaagagtaggcggcatatgggccgtagaggagtatagtggcatcgtttaacgggacttctaaaaattaaaaaaaaaatgaaacccaacgagacaataaactctaaaaactacgaggtccaatttttaaaggtttggaacttctaaaaagtaaaaaaaaaaccaataataactatgttcgattttaaaatctcaatgataataaagaatggaggcagcgggcgagccataaaggagtacaatggcaaagccgctaacggtttggcggaacccgaacgataattatgttcgatttttaaaatcccaatgacaataaagagaaaagacagtgccgggttgtagaggagtataatgacagtgtttgactggacttctagaaattataaaaacgaaacccaacgagacaataaactttaaaaattataagatccaatttttaaaggtttcaaagagaatgaataaaaatagtgataaatcgagtaagcaaataaagaaggatatgacagaagtaaggggtagcagctggtgtgacttttaaaagctatataattagaaatacgtggatgataaggttttgtctttcaaagtcttaagacaacgagatagctatttaataaattttaagtaaaatcagactggaaaatatatgattttgtttgggtgctagccgcgcaattgcgcgggccacccagctagttagtgtttattaggacaattaatctgttttattactaattattatgaaatccaataagattaatgataattactatattttgtaattagagtttcaacagagcaaattataagagtttctaaaaaaaacaatgcatgtactatttggagtttggaatgtaaggaatcaccaccaatatctattggcaacatgtaaatatacttctgcacgattttgtacactcttctctgttgtacttttatgaaagtgtagtgatatctccatgacaaacaatgtcattttgttttgtcatgacaaatcctaatacatttaatacattattttgttttgtcatatatattctctcgacgtttttttaacaactggaacaatacagtttcgctagcttcaaagatatcacttctcgccggcaggagaactgataatgcatcgacgtgatctaggcgactaacaagcgaatgcgcacggatcataagttaatccaaatatttttcaccaatcactagcaaaccagcttccctgtccctccgactttagcccacaaacaaaaaacacacaaaattattccttgttagttagcattatctgaagttcctatatagggaggcaaaagatcagaatccatgatttgaaacaaacacatttattttcactctgaaattataatgacatgacatgaaactcttccccacgatcttgccaactccttcacgaccatttttttttctcttatttcttttcttccaactacagt

SEQ ID NO: 26335 - DNA, 1332 bp, Oryza sativa
ggaggctttcacatgaattttaattattctttgcacaattttcaggatgaattttagggtcgttgtgggacgtgacactctttctgattcaactatctgattgcttgatggaccaaacctgcataactgaacaggttagatttgacctttctgttactttgatccaaacgactgaactgactggtatcatcggattagatccctggagttctggtacccaacacgaccgattagctgatcaaacctatacgagcgatctggctggattcaacactgttgtcccgttgcttcccaaacctgaattgattggttctgcttgaactgacgcagactaggactgcagatactcataaaacttacttatcctgggctgaactgtcaatactagcaatttaataacctgacaattcaccaagctggtagaagagggtgaaacttgcatcgaccatttgtaactcattgatcctacgtccgcttgaacgggtcctgactcgaatgacacgtaattccaggaaacctgcttgaactgtctttcgtctgaactgcaaccgtccctgatgctgcttctcaaagctgagctgttgaccaggcctcaccagtgtacctcagaattcaatcagataacttgtaatcgatgtaactctgctgacactttgcaactgacttcttcaagtactacccggattgttgcagtgggttgaaccttcaactgaaacagcgatgaggtgagccaaaactcatctccgagacctaccccccttacagggagtagtcttactttcgcctgactggaaacaactggactattgtccttggaaaataaccaacacttctcggacttacaaagaccctcactttgaaaactgaaacttcaccgattcatcaaaatagagcaatgacgacgcactatcatcccaacaagatttggaacttaaccctcagttgctgataggaaattccacatacataaattctcatttagctcctgatcatactaactcttgactacttccccaaccagttctaactgctggtacaactgtcttggttctgacttgatttttgttgtcatatacctaaacagattgcatagttgaccttccttgaaacaagcactgatcacttaacagatcgaactcaagaggtccttcccatggcatgacatttcacttcttcgaccatcctttgctgactcttcctgggttgacggaccatagatcctgcaacagttttccggaaaatattgcaatctgaacaactatcggaaactggctttgatgctgccaagagtttctgctctttgatcataacaacttcgctttcatatttttg

SEQ ID NO: 26336 - DNA, 465 bp, Oryza sativa
acgtatatacaaacttttgatacacaaatacaaattttttatacacatatacaaatttttgggcgtatattttcagtattttccctggtttttccctgtttttttcggttttttaaatacgtacgtacacaatatactatatacaaacattctatacacaaatacaaacttttgttgctcgcaggggtcggctcggatgcgatttgggggatttcggggactaaggaatgaacgagagagagagagagcagttagcgagtgtaaagaatgattataccctgcacagatattttttccacaattctactaccattaagtgaggtggtaatagaaataaatctcaaccttttaatgaattgagatcaacggtctagattattttctactaccagtagagagctggatcggtggcgacgggtgtgggagagagggaggtgcgggagggaggatgcggcgggtgcggga

SEQ ID NO: 26337 - DNA, 440 bp, Oryza sativa
ttctttgaacatattggatcccactttgtgaaattactttgatttaaattattgcattatcgctttatttaaattcccgcgttatcactgttttatttagccatgcctatttacctttgttatgaccttattattgttgttattgttattattaccttgttcaccctagaataaacaaaaccccaactagtgggcactctattcatggttccactagtatgaatttaggtagatgcttcgctgattaattaggcaacattaggtggtttcgtaactctagactttgggaatattcatatcacttggacactatggaatggttggattattgtggaattggacgcacacctccccctctattcaaaactctcaaaatggttttaggctgggcttggggtgcatggttttgatagtagcacctcggccacataaggaccggt

SEQ ID NO: 26338 - DNA, 214 bp, Oryza sativa
gccgccatcaatggcgccggcgagatttgcgggggcaaatccgcccgtttgaacgcggtagagagagggagaaatggggggaaagagagagggaatcacggggaatatttccccccactttattgcgcgcgtgtacgacgggaggcggcgggattcgcggcggcgacggcgctagggcacgggcgaggcggcgggagcggcgggaggacaggga

SEQ ID NO: 26339 - DNA, 355 bp, Oryza sativa
ctgcagcccagccttcctgtcttttccaggctagcgcttacacatgttgtatggttgcaaaacctaattataataatccgcaaatctccatataacagcattaaacttcggatgatcatctcttggtcatacgaaccccgaatcgacccgttcaagtctcctaatatttgttataacctaaagaagcatgtgctttcttttttatgtattgttatcgcttctttacaggcttatagctttgcatgtgtgcttcgcgtagtttctgtcgttccgaaagttcccgaagcgtggtttgctgtcacgaccggaaataacccaatgggcattccttacgtgcgtgtattattccttgtcc

SEQ ID NO: 26340 - DNA, 1501 bp, Oryza sativa
tgggcgggagagcctgaactctctctcgctctccggctctctggattccttcacgcacagatccaccagaacacaggagtagggtgttacgcttctcagcggcccgaacctgtctacgtcgctcgtgtcttgtgcatttcctctctcgctgacgttcttcagatcaagggcgaagaacctcacgtagcgcccccggccgaaccggcaaaggggggcctgcgcggtctcccggtgaggagccccacgctccgtcagccctaatccagttggtatgggattatatgatggacaccacagattacaaagggaataacagaactcgatgataccgacgagaccatagtcgagttggtccgactagatctcccggcgacttgactcctgtaggctccggctccgtaggctgtgatgggtgtgttggcggtgagattcgatgccttaggtcccgcccagggggtcccttatataccgcaggtcagttgatctccaagtaggactcggagatatcggagtcctcacgatatggtaaaaacccagcctcatccaagtaggactccttccaaacgtagattctgcttctatcgcgggatagatttccttaatgtattcggaaactattcgtacacgcgcgggtataccgtatcggtacccatcgtatatccgaggatagacggtataccttatccataaccctgacaaactctgtatatatctatgattatacatggtagcaaactaaaataataaaataataaagctgcactaaaataataagtgttcttttaaaataataaagatgcacattgaaacattagaaactcatataaaaagcgttcgaattgcagaagtggtgtgtgaatataaattttcccttccgctcacagaagaatagaaaaaaaagaaaaagttattaattgaaatctctattttattataaaaattaaagatgtttttacctgtactttagtaaatcatccgtctatgagtcgatttttaagttggttcgcttttgaaaatacaaatccgtattttagttagttttcaagctcgttcgtttttggaaatacaaatgaagtcgtataagaaatcttttaaaaaaaaacttacatgctaacttgacacgatcaaactcctaattacagcttataattttctaaaaagatatatatatatatatatatcctatttctataataaattttactttacctaagctaataataaaattaaaatagctttcacccacgggcgggacattttttctaaggaaaagagaggaaaaggcaacccctttcctcgcgcgcgaccgctggctggcggcggagccgacctcacctcgccggagtttaatcccccctccattcttcctcgtcctgattgccaacgacggcggagagctcgccggtgcccgacgtaccgacggctcgatcagtccttcccatcctctgttagcctcgcgtgacgcccgcctgcggtggggggaagaacctcgccgtcgcac

SEQ ID NO: 26341 - DNA, 1501 bp, Oryza sativa; identical to SEQ ID NO: 22786

SEQ ID NO: 26342 - DNA, 1501 bp, Oryza sativa
gacagggattgaggtgagagaggaaaacaagccaggaaagaatagaccagcactagagacaggaccttaaaggaactaactcttcttgttgatgtgttgtctgtttcacttattctgcaagttgattaagcaaacaacctaacatggttacatcacaccccactgatgcaaaccacgcgctacacacacaagcaaggaaacacacgactaacgactctaccctagagggtggcttgggttctgcgacgggttctctaagatcttcactgcttcttcacagctagcttcactgcttcctccacttcgctagcggatcctgcagtcttccggagcttcggcagacaattgacgacatcttcttctccgcaaagctgaccatctagtactagttgaaatttgaagaaggaagaaagagtaaacattttgcaaatagcacaggggaaaggaggaaaaaggaactttcgcaaatagtttcatttataaaatatgtccttaggttttatccacttggcttatcctacagtcgagatggctctgataccagcttgtcgcgaccgagaaaattgccttttcccgaacgctagtgtattaatccccgtcccaggaaaagccggggtacaccaaacaaacatgatacaaaaggcacatctttattatatcgataatatttacattattacaaaggcacttcaggcctgacaaacaaaaataaacagcagcggactagcgggcctacggctccatcttcacaggcgctcaactggggtataagccaggactccacctaagacttcttctccaaagcttctcttactgaaggggggaaagattgagcaaaaatgagtacaaccacagtactcagcaagccacaccggagatgcataattaatgcaagggagtgcaaggggataataatataggggttaagttttacagtaaacagcatttaaaagtcacttagttgcccaaagccattttataaagacgatcctattgctacatagtattattaatcagggccgtgaacccacacgaacctgccttaacccaaggcctacgatgattcagaccgaactggcaacccgaccctgggtcccagctcgtcccaagccaacccaggccaaccattccacattttagttattaagtaggttttaagaatttaaaacacaaacttgggtacattgctaggcttgcccataaccgagggcgcggctattcgaataggttttactctgatcagaggtgtacatctttacccacaagacacgtcttcctcacgtgcaaccacgtgccacataccaccacggcatatggacggaagacatgacatagtttccaacccatcctagccatagacaagagtaccgacccaacccacctacggccggaacccccggacaggcaggcagaattgagcccctagcagcaggacaccagccctgtgccatgacatctcgactaccgggctgcagctcgtgtagccttcatttgtcctaga

SEQ ID NO: 26343 - DNA, 1474 bp, Oryza sativa
tgctgcaaaaattaggattcaaatatggcattaaaattaacaaagtagcacccgacagacaaaggccagcattaaaaaaaaatactctttaccttctgaaaatgtgatatgtcattgtcagtcagctttgcacattgtgcacgcagatggtcgattttttgtttggtaattgcctctttcctctgttcattttcaaaatattttgaacccttgctcatttcgtagattaccttctgcaccttctctttgtcaactccctccattcctaaggcagaataacaagagaataaagaccaaagccatgctttgcacactggggttccatgttgtttccacagatatcacatattcacctaaacatgtaatataacttcctaagtaaagctccatctaattcgtgttctctctaccttaatcttttggatttatttgtaccagtgatttgcgcgatgcagaccccctaatgcccaaaaccctaccccctactggcaacaatcttacgcgacgggaagaggggaaatgcacactcaccagctttggcgttggtgtaggcggtgtggtacgactcccacggcctatctcctccgccatcgggtggcgtccccgccatcgcgtgcgacggcgaggttcttccccccaccgcaggcgggcgtcacgcgaggctaacagaggatgggaaggactgatcgagccgtcggtacgtcgggcaccggcgagctctccgccgtcgttggcaatcaggacgaggaagaatggaggggggattaaactccggcgaggtgaggtcggctccgccgccagccagcggtcgcgcgcgaggaaaggggttgccttttcctctcttttccttagaaaaaatgtcccgcccgtgggtgaaagctattttaattttattattagcttaggtaaagtaaaatttattatagaaataggatatatatatatatatatatctttttagaaaattataagctgtaattaggagtttgatcgtgtcaagttagcatgtaagtttttttttaaaagatttcttatacgacttcatttgtatttccaaaaacgaacgagcttgaaaactaactaaaatacggatttgtattttcaaaagcgaaccaacttaaaaatcgactcatagacggatgatttactaaagtacaggtaaaaacatctttaatttttataataaaatagagatttcaattaataactttttcttttttttctattcttctgtgagcggaagggaaaatttatattcacacaccacttctgcaattcgaacgctttttatatgagtttctaatgtttcaatgtgcatctttattattttaaaagaacacttattattttagtgcagctttattattttattattttagtttgctaccatgtataatcatagatatatacagagtttgtcagggttatggataaggtataccgtctatcctcggatatacgatgggtaccgata

SEQ ID NO: 26344 - DNA, 209 bp, Oryza sativa
cccccttacaggaatctcgtccccgagattcgaggaggctagcatgaagataggttgggtggtcttctcttcttgtctgacttcttccgctccatcttctataacaaacttgcctaacaaaacttctccactctggactgcttggctcgatctcctgttgcaaatggaatcttctcttcacctgacttttccctggttgcacctctagc

SEQ ID NO: 26345 - DNA, 680 bp, Oryza sativa
cggacgtggccgggagaggcgggatttcgccggccaacgtgggggaagtgggggaggagagagaggcgggattctaaaatcgaatcccggccatctcgggcgcgggcgcgagcgggagagagaggggagtgggcgcgggaaacgcggcgcacgcgtgggcgtggtcgacgtggcccggaggaggcggaggcgtggacgcggcggcggttgcgggcgcggcgtcggctggaggatggagacgggcccgacaggtgggccccacctgtcggcgaccccgagagaggagggaggcgggacggcctggatgggcctcggcctgcggccggccctacagggaggagggggaagaaaggagagaatgggccggcggcccattcgaaaaaaaggaggaaaaagagaggaaaaagaaaaagaaaaaggaaaaaggattttccctggaattaaaatattgcttgctcaattttaattggttaaaattatttctagagctctgaaaattccactaaaaatcctgttagtgaatttcgacatgtagaactcaagaaaaattccacatgccaattccgattattatttgcattgatttaaaagggtttactcttgctttgcaccggcatctttatagggtcatttataaattaaaattttggcttggggggaaaacttcggggtgtgacagt

SEQ ID NO: 26346 - DNA, 168 bp, Oryza sativa
aatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcaca

SEQ ID NO: 26347 - DNA, 295 bp, Oryza sativa
tacacatcgaatgaaaaataaaaatcatcatttttacagggtgcgagaatctgttttacagtgtacccaatagcaaagaatccattctttgttagcggaaaattatttcaacagggcgattgatcccagctttgcgttgcttcaccattgtgcttttctcatcattattcccgagacatagattttcacatcattgtgcttcaaatacaagtttatagacaaatatagtaatatttataatattaaattagttttattaaattaatatttttttaattacatggtacaacgcaga

SEQ ID NO: 26348 - DNA, 1501 bp, Oryza sativa
tctcttttaggcttttaagatcatttctaataattccttttaaccaacaatttataatttaaggatttttaaacaagaaaagctcttaacaattataattagatcattaatgatcaaataattactgaactgttctttgtatcatttaggaattgagctctgaaaaatccgagaatatttcagagagttgacttaatcatggagaatttaataaaaattaaatccatccatgctttatatttgggaaattttatttcccacatttaacttcacttgtaaattaaagaacatttaatataaattctaataataatttattaaatgatttataaatcctgaaacaaaaatcaggatgtgacatgcaagaaaaaaaatatcccgaggagagacccgggtcgtgtcctctggcccagagtaatcaaaggccggatgggcgcgggcctacagcggttgaatccgcctacctacgaagtcgacagcgacttcataccccgacaacccccgatttcggagatcatcgacgatctcgataaaagattggagggagggagtcagggcgggtttggcagtccactctgggatttggtctggctgttcttcagggacaacaaggacgggatccgagttttcgatctgaagatagaaccatctcgcccgccacttgctgcgagaagaggggcattggaaggggatgtaacgcgacttcaggcgatcctgaagtcggaatccaacgcatccagataccctgttgggttccatccatcgcagctcatagtaaaagcggaatagatcaaggaagggctctaccccaatgtaggcatcgcaaagatgagaaaagatgctaaggaatgcgatggagttagggttcaagtgaagcaaagaaaggccatagaaattcaagacgagaagaagaaattccgaaggcggaggaagaaaatcgcaagaaatgtaatcttcgaccacaaccatgtggcacatgatgggttcaggttctatacctcctgtctccctgtggttgaggtagacttctcaaggtccatcgtcgccggaggatcgccgagaaacaagagggaagaagcaagctagggttttctttgcggggaacagagaagacgaagggcgctagaaggcagaagagttttatggcaaacggacttcaaatggattcccaaaattcctttcaataagcgctctgccgacagtgcgtattccaaggaaaggagagagattgccgtcggaaatttttgggttcgttgcgctcggtagttttcagacttcaatttaaattcactcatgaccgttggacttcatgcgatgttgtcgatggctctttgtctctatggttttttacaccgagatcaaccagatgagaacgacaacaattccgacattgggagtcatgatcgactacatgagttcatttaagcagaagtcgggggctactgtcagggttatggataaggtataccctctatcctcagatatacaatgggtaccgata

SEQ ID NO: 26349 - DNA, 315 bp, Oryza sativa
cccataacaccgcagctaaacataataggaataagttcacttgaggattcttatcttgttatcgagttttaaaatcgtccctgaaccagaataccagatataacacatccataatcttataaaatcaggttatattgggtcccaagacaatattaaggtgactttggatgacgtggcgctataagaaaaataaaaacccatgtgagatttgtatgtcagtgaaacaatatagtattcttcttatttctctccccatccttcgggtctcgagtctcggcggcgacagatgtggcggcggcgtgcggggtgaggaga

SEQ ID NO: 26350 - DNA, 1501 bp, Oryza sativa; identical to SEQ ID NO: 21032

SEQ ID NO: 26351 - DNA, 458 bp, Oryza sativa
aaaagcgtgctaacgaaaattgaggtaaatctatttcttaatcaaaaacagatgaaaacatttagtagtttcattaaattcatgtcgatatgtttttatagtatatttacaagtttatcccagtttaaaaatgttgcttttttaaacttaagaaggattgattaggtactcccttcattccattttaagcgtacccataagtttctgggttcaactttgatcgtccattttatttaaattttttaaattaatatttttattgttattagatgctaaaatatgaatagtactttatacgtgacttatgttttttattttttttaaaaaattaaataatacagcggattaaagttgcacaaagaaacttatggttgcgtttaaaatgggacggagagaatatacccataaaataatttatgatatgaaatggagggaatagcataatttaggcacacaaa

SEQ ID NO: 26352 - DNA, 269 bp, Oryza sativa
atccatatttttctcatttcgaaaaagatgtcttgagttcgaaacatgctccaaaggaagagtttgtaggctaaacaagtgggagcagataagaataatattgttcacctttcctcactagcttaattatatatttatatgggtgaatctgttttaataaagtcagcatgccacatactcgtccaatatagatataatagaaggattcgaagcctaatagcatcctgggtggcatatcaacagttgtaacgttcgagcctggtgtaaga

SEQ ID NO: 26353 - DNA, 1501 bp, Oryza sativa
aaaaaaaatagaaattagagggagattagggaagttagaaaatttaaaataattagaatttaattatagatcaaatatagtcgtagaattgcaaaaatttaatataattatagattattttggtaatctctataggtgatcaattcacggtaggtactcggatttaattaataggaattttagacgtatattatatttaatcgtttagtcatagactaaattaaatcgtataatattataagataatttttggattccgtccgatatttagctcgcgatagaaatttctaacctattatatggatataatactcgggtagattaaattaaaaacttaattggtatggatataaagatttgggtggtgtccggaaaaggctagtgccgtccttggtcagttaaggaccgagccatgaagttaagcatgaaacgacccccgtacaaccgcacttctcgtatgggtatagacctagcggagtagatagctgagcggaggtagtatctatgcatagtggtttcttgatgtgtgaggcaggggctctacggtggggcaaccattggtagaaccgcgaggcgggtgtctacagtggtgtcgccatcggtaggactgccatgtgagaatctaaacataattataacttaatgcatgtgtgagtcttcccttcccgggtgcgccagaactcctctcactgctagaaaccgtgtacgcctagagtgcatgaggatgtaaagttcatggagcgggtactgccaatgcgaggttatcgaaaagctttgccgtgacgcatctcatgtgttaggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgtgggatgggatattgcatgatgatttctatactgatggagccacttcctgagaggcgggaatgtggacgtcctcagaaaaccatgatgactcaatggcaggaagctatccttgggatcacaatggatggtggacagaaccgtcattgtttaatatgaacaatggtactaaaatttgatcagtctgtgctaggtcttaggtttgtgaaaagaattataaaacttgttttgcgcaaaagaaccatagccatcctttgaatacccctgtcatgtgcattgttgctgtggtggcttgttgagtacggttggtactcacccttgcaatatacaaacttaatcagaggtcggagatgaagctttggaggatccctacgcttactaccaggagggtgatgaagacgatggcgctcgctaggtcttagttacggttgttgcctgtggcaatggcgtgccgctgccttaactccgctgctttatctacttctgtttttggaatgtattccagaccgctcggtccgatgatttaagactatgcctgcgggcttttg

SEQ ID NO: 26354 - DNA, 1501 bp, Oryza sativa
tgaattatgagacttgaacgaatgagttcgtatgaattagctatgaattttacaagatttaatataatttagcaaaaggaattacgatttatttggaacagaaaaatagacgctgacgtcagcgatgacatcatcgccggcaacgcaccggaccgcaaggtcgcaagcgctaggaggctcggcgggctatccgagtgcaccaacgcgaataggacgacgagacgaactcaccgaggggcggcacgaccacagacgatgacgggagatggccggcgacgagattgagacggcgaactccggggaaaaaggatgggtggacgggcttcctgaggaccttgcgatgccgacgcaggcttctgcgatgaccagcggagacggcaacggcgacgcagcttggctgaggatcgaatagatcggcctcacggggacgacggtgtactgatcgacagcaacgtcgaagctccggtggtttgcagcggcagcgcatgggtgaacaggcttcggcttggcgctgcgataccaacggaggagacggcggggttcggcgaccacggagtcgacggcgatgtgcggctggagaagcggcaaaggccgaaaccctcgggttcgcgtcggcaagcggcttccggcgggatttggcgaaaaggaaccggtggacggggtagagctcttcactgcgaagccgaggaaggcgacggcgcagttctgggatgaccgaggaggcggcgcgacgtggctggagcggcggccggcaaaggagagagaagccgagcgtggcggcggctctagggctagggaaaaattcaaaaaaaaaggaggaaacggatgaggaggccgaggggctgccaaaggagggggggatcggctcggatacgaggggaatcggcggcgaaagagctagggttcgtcggcaaaatagaagataaactacacttcgaatccacgcgatataccacgggagtcttgttcctctagatccggtttctccccttcttcagtggttgttcttccggtggtcactggcggtgcggcgcccgctcccctcttcttaggtgctcctcccttcttaggctagggtgcttccagtcgatgccggggaggtccttgtttcggtagggatggcgtgcggaattggattctggcgtcctgtctggtcatcggccacgccgtaggtttgctgcagctgggttcctgtgggtgaggtggtctttggtcgagctgtagtgtgattgaatgttgaggcggagtcggagctgtttgtcttgcaagctcggcaacgatgacccccaacagatgtcccggcaatgtgacgagggtttggaggtggagcattttgagagagcctcgggtgaaaaccttgcctagtgtatcctaggttgatgatatcgacgcctatgggcgccgtttcctccttggaggtatcgtcatgttggctctctctcccttcaggtgaaaaccgggttcctttcggaacgggtgttgatagcatccttgatgttgt

SEQ ID NO: 26355 - DNA, 541 bp, Oryza sativa
aggcctagaaggttttactgagatcattgccgaaatccactttcaggggcagctagccagctaaacattgactttctgttactcagattcttcaggtcagttaattcagaagttggcagtttgttaatgaattctcttacggcattctgtaactagctagctattgtataaattaagacctatatttaatttactatttgggtagagatcgatgagttatatttgtgtaaagagtgattggatctactatctctaggatctgttgtagggaattaaacgcaacttcaaggattagtggtgcttacatgcatgcatgcacattggacacattgagattgatcttgtgtctacatcatcagaggaggatgtaaacccagaggacatatactagtactatatggttaaggatggctttcccggaacatatatatcaaattagcaatcatgtagtatttttcttttgcatctccatcacaattatattctctgtgtatcaggcatctgacaaattcattttgtcaatgtatcctctcgtatcagt

SEQ ID NO: 26356 - DNA, 530 bp, Oryza sativa
gcagctcaactgggatctaagccaaaggtcttctccttctggatcctttttcttcaattgagatttgatgatgattgcaaggtgagtacatggaatactccgcaagccacacagcaagtatgcaagtgcacaaggatactaaaggatggcataatatagtgttcatttgcgaaaacaacatttagcaaagatctaagagtagtaacacagcagagtaattaatcatcaatattaatcaacactgaacagcgcacccatgctgcttaggcccaaccaaacctgaacaaccaaccccggtcgtacagatcaatcctccaaactaggaatttaccattccaaaccaagagtcaaattaattatcacattattaacattaatgagtagtgtgggactaatcacgaaaacattgttagacctgcccataatcgcgggcacggctattcgaatagttttactctggccagagatataccactgtacccacaagacacgattccacacatgttgccatgccccgaagtacccccacg

SEQ ID NO: 26357 - DNA, 467 bp, Oryza sativa
caactgaggtttgatgattattgcaagaatgagcatatgacatactcaacaagccacacagcaaatatgcaagtgcacaaggattccaaaggatggcataatacaagctcatttgcaaaagcagcatttagcaaaacatttaagagaaataaaacagtgaagtaattaatcagaaattttaatcaacactgaacagcacacccatgctgcacaggcccaaccatcctgaacaaccatacccggctgtacagatctaatctccaaaccaggagctaaacaaattattaccaggtataacatccataattattgtgagaggtgtgagactaatcacgaaaaacattgctcaactcgcccataaccgcgggcacggctattcgaatagttttactctagccagaggtgtaccactgtacccacaagacacgatttcgcacatgttgccatgccccgaaataccaccacgg

SEQ ID NO: 26358 - DNA, 304 bp, Oryza sativa
tcatatgccctcttcttcctcataataccaatggctttgttactgtcatactttaaaaaacacatcggctcggctccgaagggcttggctgtagctccaaaggaagggctcggctccaaaggaagggcttggctatagctgcaaaggaagggcttggcggtagcaggacatcggatcggggacgcaccgcagagaattttatcccaatagaactgcatgtgtaattgttttggttgttgcaaaatctcttaaattttgaacgcacatctaactaacatgaactaactatcctattttttatagc

SEQ ID NO: 26359 - DNA, 173 bp, Oryza sativa
catgtggattttttaacatgtagatctcaattttagaaaaaattagagacttgaaccaactaaaacggagctaagatgaattagttatgaatttttgaagattaaatcggattaaaacacttaaattgattttaattgaattatgacgcaataatgaattatttttgaaaagg

SEQ ID NO: 26360 - DNA, 1501 bp, Oryza sativa
acagccgagtgtacatgaacctatagggtcgcacgcttaatgggccagaataaggggattggatatagatccaatatgagcttaattcggatagggatccgaataggagtcctacgggccttggaggcccgagtgatggatcctatatattcgtgaggggtgtgaccggcggaggtattgcatcacgtgagaaaccctagccgccattttcctccccgagcaaaaccctagtagcgtgcgggtgctagcacatctgcgcgtggcgttccatccctatacgtgtggataccggtagaggcgccgcgccgttggtttgcggtgctgatcggcgtgggagtacggcaaggaggacgaacgaggaggagaagatcgagccggtgcgatcgactacttcctctacatcgacgcgcgctacatcgcgagggttccttcgaccccttagcgctttcttccgctgcgcaacgtgtcgagtggtaacgatctatgatctaaagcttgcatggtttctggtttacgcgatagaaaaattttgatttatgctatcgtagcctacgtgtatcccaacaaagaccacatcattgatcaaataaacttgttcaagtgtcaatgcacctggtaagagctgccagcctactccatacatgcatattttgcttgcttgtagaactgaaaacagaaacgcataacacaagccagaggttgttgctatgaacatatcagattcccggaacaagggaaaatttcatgaggcataatggaagctgtcacctcatgagcgtccagccccaactgagactttcatgaacaaatcaagaaaactctttctaaagaattaagaaatcaagttttacacccattcccattgaaaacaagcatgagaatgaaaagaaaaaaaaagtgttttgttctgtgcaccagcaccgccacctcgcccacatccacattttttaaacgaaaaacccatatccacattcaccagcccgaaaaatagatcgattgaaactttagaaatgtgttaaagttttgtatatgtgagagataagatactacggaagatgatctattttaccaaggatggaggctagacaaccttaatttggttgtgacctgcgactgttattggtcagaaaacactatatatccattgaaccatacatgttacagagtttctaataacatggttaagctgtagtattgctccaataactgaacaatatttaattcattttgttgaaaacctagatgaagaaaagggaaaagaagatggttgttggatttattcagaagctgaaagtgggtatcacagagtcgccccgtagaaaaaaagaagaagaaagtttcacgtcttatgtcaggtaaatgaggcaatcaagtcatgaactccttatcaggtggcagctagaaacacatgaactatcacttgcacaagttttcacagttcacaggtgcaaaatacaaactgtcaaacccaaaagcaaggtgcaccagtgaatcacattgc

SEQ ID NO: 26361 - DNA, 1501 bp, Oryza sativa
atgttgtcgatgttccgttctctgcttctgcgggaggatctttcgacatagagtcgaccggggtcgtaaccacgccgttctcgctcccggtaattgatgggccagtcgagatcggcatcgtggtgtagaccgggaagacaatttcgtcgacttgagtccacaccagcatcgttgaagttgaagctccttggttgatgccggggttgacgctatcgtcgagaaggcttgaagtcatagtagtagaaccttgagcaccaagtttccctacctggcgcgccactgtcgacgggggatacccgtagaccggatatagagggtattggggtccgttggtacgaggatctacgtaatacgacatcaagcaagtagaagacaaggattatactagttcaggccccttagtaggtaatagcccttgtcggtgacatggggctgggggtatcgtgactagaggcttgggtagccgcggtcacccacgtggcctgaccccctcgggggggtcgggcccgaggatgacatggccacccctccctctatctccccgatgggtcggaccgctcctgtttcggccccgagggatgggcgccccgaccccctgtggttttggcgccacgtgtgtgggttaggtgagcgcagcggggctcacctaaccgcatttatagtaggttggacgagtgcaccacgccgcatttaatgcggcgccgcgcacgcttatccggtccgtgaccggtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccgggaaggcaggcgagcggggcaggaggcatgtgctctgcttgtcagacgttacttccggctgtagactagccctcattgtaaaaagcatgtttcccttcttaggcagggaggggcccatgtggtgacccgggaccagagaaaaaggaggcccaggcctaggagaaaaaaggagggaaggagggggaatgggcgggagagcctgaactctctctcgctctccggctctctggattccttcacgcacagatccaccagaacacaggagtagggtgttacgcttctcagcggcccgaacctatctacgtcgcccgtgtcttgtgcatttcctctctcgctgacgttcttcagatcgagggcgaagaacctcacttagtgcccccggccgaaccggcaaaggggggcctgcgcggtctcccggtgaggagccccacgctccatcatctggcgcgccaggtagggggcgcgcgtgtctttctaagccctcgtcctctttcgtatgcgccaagcttctccggctcagcccaa

SEQ ID NO: 26362 - DNA, 732 bp, Oryza sativa
acgcgcgggtggcggcttggggttctctctggcgtggcgtgcgggatttctgacgggacacgggcccaataattggacgacggcacgggtgacgggtgttctcgccggtgagagcatgtatattttaaggtctgtttgggaaacaggacttatcatatcggatgtttatacaccaatttagaggtattaaacatacactaattataaaacatattctataccctttggctaattcgcgagacgaatcttttgagtctaattacaccatgatttgacaatgtgatgcttcagtaaacttttcataattatagattaattaggattaaaaaattcgtctcgcagattagctttcatttataaaattagtttttttattagtctatgtttaatactccaaattagcgtcaaacattcgatgtgacacggactaaaaagttttagccccatctaaacacccccttaatgaaatactaccccgttttgttttttaatagatgataccattgactttttcttatatgtttgaccatcgtcttatttaaaaaatttacgtaattataatttattttgttatgagttgttttatcactcatagtactttaaatgtgatttgtatcttatatatttgcataaaatttttaaataagacgaatggtcaaacatgtgagaaaaagtcagcgacatcatcaattaaaaaacagagggagtaaaagattaaagagaatagcagca

SEQ ID NO: 26363 - DNA, 372 bp, Oryza sativa
cttctccatccaccaccatccaacccccccacgcggccactcctccacgcacacacctgtatctctctctctctctctctctctctctattccaatccagtcctgaatcagtccacccctttccttcgctctctctctctaactgcagatttccctcccctttcaacgcgcgcgcgggtggtggggggaggcacggcacgaggcggaggcggcggaggaggtggtgggaatcgatccctttctgttccggccgcctcgatcgcccgctacccgcacgccgccttttcgtcccggtggatttctgcctcccttttctcgattctttcctttttcttcttcttctgcatgcgcggcgggctgtgacgccgacca

SEQ ID NO: 26364 - DNA, 1501 bp, Oryza sativa
cgcctggtggtccgcgagcggcccgatgacgtcggtcagaggaagagcctgcatacatgaagtcacaatgcgatcccagagaagcagaagtaaaggagtcctcaaatacactcacattgatcgcagcctcacgatcggccttccccttctcgcaaagggggacggggacgttgctcgccgtcgtagggctgctgatcatcacctgaccaacgcggcgctccacagtttcgctgtttaaacctgtaggatcgagaaccagaactcgataagtccggaggaacatgcacatgaagaatgaaatctgaaatacaagaaaaataccccgaggagaaatccgggtcgcgtcctccggcccagaattgtcaaaggctgggtggactcgggcctggagcggttggatccacctaccgatgaagtcggcagcgacttcatatcccgacaaccctcgtactcggaggtcatcgatgatatcgatgaaagactgaagggagggagttagggtgggcttggcggtccattctgggatcttgtctggttgcttctcaggaacaacaaagactggatccgaattttctatctgaagatagaaccacctcgcccgccatttgctacgagaagaggggcactagaaggggatgtatcgcgacttcaggccatctcgaagtcggaaaccgacacatccggacacctttttaggttccatctagcgcaactcatagtagaagcggaagagatcaagaaacggctctaccccaatgtaggcctcacaaagatacgagaaaatactgaggaaggcgatggaattggggttcagatggagcaaggaaaggctgtagaaattcaagacgagaagaagaaactcggagggcgggggaagaaaaccgcaaagaatataatcctcaaccgcaaccatgcggcctaggacaggtttgggttcaatacctcctggttctctctccatggtcccgcaaccagggagagtaccgtcctcctgcagcttctttagggacgcgctggcagaagtggacttgtcgagatccattgccgctggagatcaccggagaagggactgagatgagcaagctagggttttttgcgggagtggagaagacgaggagcgcttggaggttagaaagttttctgcagcaagcagacttcaaaatggatccccaaaactcccttaaataaacgcactaccgacggtgcgaattccaaggaaaggagagagatggccgccggaaatttctgggtccgttaagcgcaacagttttcggactttaatttaaattcactcatgaccgttgaacttcacatggtgttgttgattactccttgtctctacggttctcacaccgagatcgaccagttgacaacgacaacgaccccgacatcagaagtcgcgatcggttacatgagttcatttaagcagaagtcgggggctactgtcagggttacggattggatataccctctacccttggatatacgttgtatactgata

SEQ ID NO: 26365 - DNA, 1036 bp, Oryza sativa
ggccgaattcggcccaagagagaggggcgagggttttagggttgtttttctttttataaacctttttaactttgtttatttcttgataattattatttgtgctctgaaaattccactaaattttatttacacattttaggcttttaggaaatatacaaaaatcctccaagccttatttgacttttagctttgcacattttaatttttggaggctttcactaggattttaattattctaagcataatttaagggatatattttagggtcgttttgggacgtgacaaccgacacacaagtgtacgataaaatcgaggagatttgcagggtcgagggggctcctacactgtcagaggttgtactcccaaccatccatttttaatgagttcacttgtgcttcatagcataaattcctattcacatagttgggtttttccctgcacacattttttttgcaccggctggagcatgtacacttagggtatatttgctagtgcacaatataacagaggtatatatgctagtgtacaatataacaaatagtagagtaataaattatagttaggcagtcatgtcttaactccactgaccaagcaataagtcagcaagtggttcaaacaaataatcttattacatatggatgagtactcaacaagttttcattgtgagttaagttataattcatttagttcatcttttttaggatcaacacaagggtaattttgctagtgtacatttaagcaaaactgtagagtaaataattaactccaacttaaaaaactctgttctagacttatcccaatgacaaaaccgattgttaacttattactgaaataccctttttccacacatgttttcaactatctgtctttttttgtcacatataaaaggagcagtcaacaattatagtgtgatatgcatgtggagtcatacagtgactcacgtaaagatggaagttaacatttcacttagttcgatcgacaactacgttgggttaaccttttttttccaccttaaacactttttttttctgccagc

SEQ ID NO: 26366 - DNA, 245 bp, Oryza sativa
ggaaatgatttatcggatttttctggaatacgagaaatggtttatggggtttgaagaaataatatcccaagaatattattaacagtcactgtcatgcgggaccaaaggaaatggcttattggattttggaataaggaattgatttatgggacaaaggaaaaaggatttattaaatccctggaaaaagaaaaggatggagggatgtatattagacttgttcggtggcattggtgctgcccaaaggc

SEQ ID NO: 26367 - DNA, 1501 bp, Oryza sativa
ggagcgtgtccacgtgtctgagcgacgccgcgcgcgcgcagcgctgccccagcgcggaggttgcggtccggccgccgtgcctttccgctttctccctccgccgcgggcaccctgcaggcacagaacgcacacgacttcaacaacaggagaagaggaagcaaacggagagagggagagagggcggcgaggggaggcggcgccacggccgacacggggtgggaagccggcgtgccctcgcgctccgccatcggtggcgaagggtgaggaggagggtggttcgtttcggtgggtttcccctgaagccgctctcggcgacggcgagcagcgagctcaagaccagtacgatctcatagatttctcaagaccacaagctctcacagggaatcgagtgtgtttcagtcatttgtcgcaccaagcagaagcggagggatgcaaggcacaacgacgaccaaggttgggcgcaatggcgaccacgccgacgccggcgtggaaggccccggcacgacgagagcgacagatgggaggggcggcgccaccgtggcagcccgcaaagtcggggacatgcgccgcatgtcatgcgtggaggccaaggactccctgaccatcgtcgcgctgcagtcgctagtcaccgtcgagcgctccgtccgcggcgacctcgaggagcacatccccaagccatgtaagcacaaatgcaatgccttttaatttgagcatatattcttcatggtttaatacttgaactgcaatacagttgttagctgaagatgcgtctctcgttgcatgaactgacgattggatctggcgaaagcgctggcggcgccgaacatcttcgaccgcgcccagctgctccgcaaccggccgccgcccgcgcctgcttccacctccgcgcccatcgccaccgcgtcgccacgccaccccaccgcctgtttcctgcctcgccccgtcggccagcccgcacgaggggagcggggaggccggcgagctcgcgccaccctgagccaacgcgctgccacccgggagccgccggccgcaccacccttcgaccgcgcgcgccgttgtgggcggcggccctagcgccgtccccatgcgagaacagagcgagagaaagagaagaggggaaaaagagagtaggtgctgacgtggacaccctgacgtgtggggcccatgtgggtctcacggtgagacagctgccaggtcggaaaaaaccggagtctaaactgctgagggagcttgtttgcatgagttttgtaagttgagggatgcgttgtatccggtttgacggttagggtacgagtttgtaattcgatgacaagttgagagaccttcggtgtactttttccactagaaaccggtttattttaagtaggaataagttcatctaacgtcccttgactctacaccgaattcgattttcgtccttgaaccacaaaaccaggtacaacctgtcagggttacggatagggtataccctctacccttggatatacgttgtatactgatg

SEQ ID NO: 26368 - DNA, 611 bp, Oryza sativa
aggcgagcagaaacatcatctgtccaaaaactatttgcccaccttgagattaatctgtatacagagcttaatggtaaaacagttggctgaaagtttgaagtatttagcccttggcatcgatttcctataaatcgatatttaagctaactaacattttaaagtacctctctgcggtattgcagaggatccgaatccatctgcagggaattcggacactgttccctcacatataccttgaaaagcattggcgcacgtgtagttgctctaccgaactgagctatagcccttgtcagagatatcttaatatatagagaatttcttggcaagatgaatattctctaatagtagaggatatcctttgatctgtttatactataataacataccaataacgaagcggtatttgcttataaaaaggattcgatctataatcgatcgaagtaaagggtcttcctttgtggtgataaattgcctacttaactcagtggtcagagtattgctttcatacggcgggagtcattggttcaaatccaatagtaggtaggtaggtagaaaaattactagatagcattggccctactttacttcgctatctaataattttttctacc

SEQ ID NO: 26369 - DNA, 427 bp, Oryza sativa
gccgcactcacctcgccccgctgctgcctccgccgtcgcccgtgatggagaggagagaccccgctgctgcctccgccgtcgcccgtgatggagaggagagagaatgagagattgggagagatagaagagagggagaaactgacaagtggggtccacctacttttttataaaagaattgctgattggactgccacgtaggatcaaaaccaccgcggattgagccggagggttaattatccagtttgcaaagttgggggtgaaagatgtccggttttgtgattcaggagggtaattcggctgaccgcaatagttcgggaagatggtaattcgtactttttccaaaagaaaatgaaaataacagattacacctggtacaatggaaaacaaacatattatctctgtcgcccattatcatggttcttctagg

SEQ ID NO: 26370 - DNA, 1501 bp, Oryza sativa
aactgtgcatttattttcgaatgtcactgggtggtgtgaatctattcctttgttatggcctgtttgcattgattactttattccttgataccttgggttattataacttgactagttgggctatatatattggttcagctagatattaaatatgattgcttaaccatgcttagaaacattagcacactattgggataattaatgtttcattattatttaatgatagcttaatgatagctcgcgatggtcaatcgtgattggttaattaattacttgccaaccaaaacttgataatggtgggttgtgagcacatggttttgagagtcgtgctcatgacaattaaggaccggttcgcgaggtactgttgtgaaacattaaccgtgccaaccacaagccagcatgggcaacgactttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcagaatggttgggcctgagtagcatgggcgtgttgttcagtgttgattaaaattaatgattaaagtactctactgttttattactcttaaatgtttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgatttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacatgtaatcctacctgctgttgtgtcctatactccttcctactaattaagggtgctcggtcaggtcaggtaggaccgaagaccgaaccggtagttcagttaaccgaactctcggtctaagaaattttgttgtgttgatcggtcatcagtttctaaaaaccgaactttaaatagactgaacaaaccggactgaa

SEQ ID NO: 26371 - DNA, 1441 bp, Oryza sativa
tcgttttagcatcccctaggggggtgatctcgtctgtgtttctttgttggtctagcggcggtcggtcacgctttcagtgttggcgctgtcggtgtgcaggtggtggtatattttttcctttttccatgttacgaccctccagggttgtattcttgtaattttttcctactctatcgatagaacttcgcaccgtctcatgcgagtcgttcaaaaaaaaaaactacaaccgcccaaacgattaaacgtcagacacgaaaaaccatatctgcacttataatgacacagagtagtacatctacttttaataactatctaaataccactcttagggcatccacaatgtaccataagaatgagacataaggccatataacaaatcatattcattgtggacattagtcataaggcattaaatgccaaaaatagtaataagcttagggcatcctcaatgtttatggtcattagagcaataaaatgagacccacagctttatattcatttgtatatagcacatgctacaatgtgtatgtttttttttatcttaaggtaggacccacttatgagaaaactctattcaacgtgaatgaaagagcaccatatataaattatttttttatttcttatggtctagccttaagtcttaagcttaagattggccataacaacatttcttgctttctcttatcccaatgcataaagatagaacaaaaatactaatttatttcttaaggttactttgcatgcaacattatggatgcgcttatggctcaacctcgagaaataaaataataagataaaacacacaagcacactagagacgagggtgagaatgactctatgatatgctgggacctatttttacgtaggacttttttacatagttgtgggacgcatcttaccatcacttcttgtcttaaacattgtgaccatagtcataaggtgtggtgggtgttgacggtcattatcgatcagtttgaaccgtcaatattactaaaatagaggagaactagtgatgcttgcaatgcataaatttgttagaataataatattccactagtattaggtctactaactttttgcagacaataacaataaagtggaggagaatcgacatcaactcgaatgataaatcaatcggacgatgtcaagaatcagacttatgcatgaataggccaagaactcagaattgacacgatgaattgggccaaaattcacaagtctacaaagtgaagcaatagaggaggttgccagccgaagatgggctggtttttgccagcccatggttcggccgaaccagggggttcggccgaacccccatctccaccgttgaggccagggttcggcatggacgtccaagattgcaccccaatgacggttggagggtacttcgggcaattccccttccacaaccgtcataaccacctctatataaaggcttcac

SEQ ID NO: 26372 - DNA, 415 bp, Oryza sativa
aagtctaatatacatccctccatccttttctttttccagggatttaataaatcctttttcctttgtcccataaatcaattccttattccaaaattccataaaccatttcctttggtcccgcatgacagtgactgttaataatattcttgggaatattatttcttcaaaccccataaaccatttctcgtattccagaaaaatccgataaatcatttccttgtccggaaaatcccattcgagcttccaaaaattcatatcttctcaaccgctcatccgattgactccgttccacttccagtaattccgtaaaattgagatctatttaatggcactactaattagtctaaataggatctatcttttggtcttttgtttaggttttcgattgtttgcgtatagttgcggttatcggact

SEQ ID NO: 26373 - DNA, 423 bp, Oryza sativa
atcttgtttttagaaaggttcgagtcgtgtccataatggaatagtttgtactcggggtataaatatgaaccccatagcattgtaatacgggagacaatccaatacaacttcgcgcatcgccaccctttttactcttcttcgttttcgacgagttcttcgcaagaggtaacccgtctcaatggcatgcgctatcggggctaacatgtcgctttagacgtgttaggctcgatatcgcgagtcattgctatcatatgtcttagttaatatattcttagcttctcaattttgctctatcggttattgctcgctttagggtttatgctggtttcggctaaattgtcttgctagatttagctaaggcatctaccatccttaaaagtgtttaattgcttgattgtctagactgcatgcttcttttcatac

SEQ ID NO: 26374 - DNA, 226 bp, Oryza sativa
ttccgctacatttatgtaagacttttacaatgtttgtaagacgtggatctgtatgtcaactttgtcgtttgtgtaccctggccggttctggataggggttttaatgcactttctacttggaattctattcgggaatttctatgcgtgacatggtcgcggtagttggcggggtggcggcggctggcaacaacggcggaggacatggcggtaggctgctttggtgtcg

SEQ ID NO: 26375 - DNA, 1501 bp, Oryza sativa
ccgtggcgccgcctcccctcgccgccctctctccctctctccgtttgcttcctcttctcctgttgttgaagtcgtgtgcgttctgtgcctgcagggtgcccgcggcggagggagaaagcggaaaggcacggcggccggaccgcaacctccgcgctggggcagcgctgcgcgcgcgcggcgtcgctcagacacgtggacacgctccgggagctcgggcactgcctgtagaagggctacggcgtgcgctgctccatgctagacggccgccgcctcctcatccagaccaacgcccgcgagatcgcgccgcggtcaccgcgtcggcctcgctcctccgcgccaccagcaagctggctacctcctgcgcggcactcttgcctcttctgtgacttcggctgccatgccgcggccaaggcacccagctgctcccccgtcgccacccgtggagaggagacggggatgagaagaggtggagaggggagaggaatcagaggctgacgtgtggggccgcgtgggtctgacgctgagtcagctgccacgtcgaacaaaaccggagtcaaacctaaaccgctgagggatctagtttacactggttttataagttgggggatgcgttgtatctggttttgtggtttggggacgatgttgtaactcgatgacaagttgagggaccttcggtgtacttttttcttttctagttcctggttctaattcagaggtaggtttagctgccctagtaaggcttagaaacgtatgggctgggacgacccaaataaggcccaactagaatgaaagcaaaagagacgcaaagccacctgaagccggccattccttccgcgtttccgtcgacgttccgccgccgacacaaacgctttgatgccttggcacggtgggccggccctgcactgcacggcacggtcaaagaaaaatagtagagggatgcaaaatagattcaatcagccatataatacatggctaaggtagaagagaaatataaaatagacttatttccagtcatataagctcaaaaagttaatggatgaaaaatagacttattctatggagaagcacaataagctatcatgtcttcgggctgacacgacccaaatcttattgggccgtgtgcgcagcccatgggctagcccggcacagcccgacatgtagatcgggtcgtgccgacccaattgaccttggcccaaggccgagtcgtgtctaggccctgacgtgctggacgggccgtttggctatctatagctgtgccgtccaccacaccgcgttgtcaatttaaagttggattcaaaataaacatatgagatatgttcacattgtagagtaaaagtttcaaatttaactacgactaaaaattttactctcaatgaaaaaagtttattcttaatacagtaaacatatctcaaacatccaattctatattcaacgatagtttcaagactttcaccgtatatttttcaatgttgtacagtgtccactatccagtcaaaagccc

SEQ ID NO: 26376 - DNA, 1501 bp, Oryza sativa
tctatttaggactagccttgcattctggtaggccggtgtgtatgagttagtcgataattctgaggaattagtcgatgattcagaggaacttcctatttgccccgacgtggtagtttaggtgactaagtctgtccaatacaacggtattgtgccacgtgggtggattcccgttgtgtccgccaccacggcgttaagtttaaggcgtgggcccgccacttaacggttctagacatatttccaagtatgcctaggatggaggaacacgtatcgtgctggtgcaaggctagattctaagtagtgtaaaggcttcgttatgacctctagatcacattcaacatgaagagtgtgatggagtcttgcaaactcaaaacaaactagagagttcatatcatgtgggtaaagctgtacaaactctgcagggttctttaaactaatcaattagccgtgctcacggtcatgagcgctttggtgatgtgtcatgagtatagactatgttttaaaaatgtgatcatgtgatattggtttgaaattgataaatgtgttgagttgtgtgtgtgtgaggtgatatattatgacttgttgtcaaaggatgacaacaggagattgattataatggaattatgatgaattaaatattgaaacttaaaatttgttttgttaattgaagcatcaactcttttacaaaagaattgcgaaacaaaactgctttatgctgaaaatgaactacatattgccttcctttgaatatatgccttacatgtagtatggtaggattgacttgtgcttgccagtacattaacttgtttaatgtactgactcttgctgttgatataaccttttgtttgcaggtttagtcttagtctttgagtgatgcgggttccgattgcttcttctaggatgagaacttaatggggtatacccctagtcggtgtgcttgtgtttgggtagtcaagcttccgctgttctctaataagtctatttggccggtcggcctatgtaattattaagttgttgtaagtcttaagtttctttcatcttagttgtgtttgctatgtgtaatcatgcttaagatgaaagtgtgaatctagtgcacatcctgggaactagattcacatgagtatgagttaggaatatttgagaggttgtagatctttagccatttttgtcaagtctcctgaatgtgtaacacatttggtcgccgccttcgagtggtttgacgggcacatctcaggctgaagttgactggcaggctaagggcccagcaatgtctccaatattcctctctcgaggtgtcggatgtttcattatgcttgtttgatgacttgaattattcacttcatctctcaaatataatggaaggtccggagagcctacgacaggaagggaagggaaaaagtggaaaaatggaatcaccgaagcaaggccatgccggtggtgtgaggatttagtgtgaggagagccggtggacgagatcggctagtggcaaggtggtgaccggtca

SEQ ID NO: 26377 - DNA, 200 bp, Oryza sativa
  unsure (1)..(200): unsure at all n locations
agtgactgataacgtaagtcaantngcaaacnacctcggtacccataagaggtctcagtagaaagacaaatgaactccacatcctcaaagtcaaaagcttctagcttaagcatgctaatatatactccctccattccaaattgggctacatatagtttttttgaggttattcctaaatgatctacatatttgtgttcata

SEQ ID NO: 26378 - DNA, 239 bp, Oryza sativa
ctgcttcaaccttgctccttcctctccgagtctgatgcaaaattatgttgttaacacatgccccccaattccgctgtattatataatgaggcagaattttctttcgtcgaacccgtgaaaatctagggtttctgctttgactgttaagcttataagcacatgcccactgtttcaaattttctttctccggctaagtccttcacaacctcccctgctgcacaagctctattatctccagt

SEQ ID NO: 26379 - DNA, 1501 bp, Oryza sativa
ttcaagcacatgttctttactatatactaagttcattagtttttctacttcttaccacattgttgagagaattattatgagatgcagatattgatgattgcaatggcaagtttctgaatgtagcagatttttgtttgttgtagcatgttgacaaactacactttgatgtcatttttgtactatttctgtacaaactaggtcttactttttcaatttttgtagggattctcaggaaatatatcttccaagtttgaaagatttatgaaattctgttcatttttaatgaagtttgaatgggaaaaggatgtaaggatctgcactgaccttgcttgggtttggatttttgatatcttcttcatcttttctcttctttgttttcttcttctgctgctccatggttgcttctcgatctgatttggtttggatctcccttttttttggatgtggacggggttggtgaggggtggagcaggtacaaatagggttggtggtgatggggtggagcaggtacaagtcacgtgatcttgtttttctatttttgtcgagctttcttgactgccaagattcgttatttgtttgggctgagaaagtttcatttgatccatagtatcaataggccttttaagaaaatctttgtttattttaaaatttgtgttggcccaaaatgatgttttttttggcccatacgttatttttagtttgattgtactcccactttgatgtttgcttcattattagattctgccgttggatgctaatccaagggctcagaaatctgacaaatttggggcctgaaaatttatcgaatgatgtgtagagagacccatagtagatgggtttgaagtgtgataaaggataaattatttgatcacgtgggcttgaagagtgattaaggataaagtactgaacgtgctagcgtatggatacccggtgcgaggatggaattgaaggaggacgattgcgcttcgctttaaatcttgtatagaaataaatatttcaaatgtttaatatttgctacatgttggatgttgcttgtgaccccaccctttcttgtaacagtcacgtttcatctttcactaataattagctgtagatatgagcacatataccaagactagaaattaaacttcggtgagaatattctatcattagaaacctcactattctatcattagaaacctaactaattgagctatgcacacttcacttctaaggctgagttcccaactcactctccttgtttttcgtgcgcacgcttttcaaactactaaacggtgtatttttttttcaaatatatatatatatgtcaacatttgatagtcacgactaaggtatttggatggtatggggatcgttggtacagggcatatatgagattgaggtaaaagagatggagacagggatttttatacatgttcgggcccctcatcttacaggtaatagccctacatcctgttggccgaagccggtgttgccctttattcatctggatcacacaaat

SEQ ID NO: 26380 - DNA, 1501 bp, Oryza sativa
agctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcaaattattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagggggcgacgggcagtcccctctcgtgcctaggtgaatccggaagcgacagaggccgtcgcagggcccgccccgctccatcacgcccacccttgcctggatgcgtcgactagaggaaagatacactacaagtccagccgttgcccacgctggcttgtggtaagtacgataagttcttccagggcatcccgcgaaccggtccttaactgccatgggtgcgactagcaaaaccatgcacccacagcccaccattcagttgcattttagttggataattacgaccatgaagcatggccagatgtctcgagcacgcagctcaacaagatactagaaaggtctaaaactgtaattatcccatcaactgagctagtggtaattaagcatggctaagcatatagttctagctaggtcacataagtaacatgagctagtcggttcattacccaaggttgccaaagaatagatatcaagtaaacatggcacaagcgagcagataggtaatacccagatcccatgtaattagcaaaacatgcatatttatttgtaaacggtaaaacatttataaattgggatcaacatgctcaaggggaatgtgtgacttgccttgcttcttcactttgatcttccgaactcttttcctcgcgaccgcggacttccgaaacgacgggaactacgcgctggcacgcaaaacgaggaaaaactctaataaaaaccaaggaaacagtacataaaaactaaacaaacatgtagagctcaattttagatgaattttgcaagttgaacggctcaattcggagttcgaatgaattagatatgaattttagaagttttgagccatttaaatgaatttctagaattattaatgatttattgcgcaattattatttatttttacaaaggaaaaggacctcgctgacgtcagcaagg

SEQ ID NO: 26381 - DNA, 859 bp, Oryza sativa
cccatgccccccgctctcataaatctcagcatgcctatcgccatggacccccacaggggaggctataaaaacacggcacggtccctgtaacaaacagtgagtacccttcctccctgcagccgcatacacgcggtacatgagttgcggtcagtaattcgatcggctgtcgttgggagatcgggaagagtcgtcgccgtagcagggtagtgagggtgtatacgcgcatacacatacacatccaccagcccttccttttgtaggcgctccctgattactttctctctcttccttggactggcctcctccctctccatcccccaccatctttccttctttctttctcctttggaccctttccagttgtccacgctcccatctttttcaccatctcctcccatctcccctcccctcccctcatccggcgttccaccctgcccgcccttggccgcccggagtccccttccctacttgtaccagcccttcttttccaatttcatcctctccctccaattctactactcccatcgccacagtcgccaccctccctccctctctctctctcgccgcccacaccggcacactccactcggtgtgtgggagggagaggggaagaggaggccggctgcttgcttgcttgctagctagctagaattgcctacaattcagtaccgctgcttccccaattgctctactggttgcttgtacagctctacaagtacgcaattcaaggtgggggagggagccaagccggccggccatactagttctcgcctcccgagctctggtggtctctcctcctccagctggtgggcgttcaaggcggaaaagtaaagacggcggtgccgtggggcggcgccca

SEQ ID NO: 26382 - DNA, 1501 bp, Oryza sativa
tggggcgatggagaggcagagaacctcctccctcggcttcttcagctccagagtgatgaatggagaatggcgacgcgtctgggaggagtagagagcgagaaaagggaaaccgagatcgacgacacgttgcggccacgcgtcggctcgctcaatctcttcctctctcggctggaacagtggaggaagtgatggacagagtcaaggcaagcttaagaggctgtcaggtgggtccaggtcgtggcaaactaggctagggtgagagggttgggtaagattctgggtaaacttgatttttagatcatttttttttcggaattattttctcctctaactttgtagcttcataacttaatgtgtagaccagaagaattagtgtagattttactggtggtagatgattacacctagattccattttctttggttgcactcaaaaataatgggtggactgctcacagaaattaaacaaagatgggctattagaaagctagattgaatttttaggaggcttaaacagaggaggaaaaatctagaaaaattacatttattcatgataactaatctagtatttgaataaattatttcccatgttcacttatgtgcagttaaatgtacttttggatgaaatatggttttagccgattaaatttaatttgatttcttttagttgtctgcttcgaccgattaatttgagatttcaacttgagtgttaacatgttaccaaaattacagaggatatgtttgtgctaatcactgtccacataaatttttccatgattttatcttgcacaaaatattttagagaattaggatgacctttgtttgtatatgtgttcccacttcataattgcatctaatattattatagggattacattaaacttcttttagactgagaagatgatatttgagtttaatattaagtccacatgttatcacccaagattaactataggtttgtttagtgaaataattcttttagattatgctcatgggacctattatggaatgcaagaccaaaactccaaatgcacaaagaactcgagcctaggcatgcattatgtacatgtatgcttgatgacatttctagtctaatgttgggaatgaaaagattttattttgttctcaaattataatcatgcaatggtttaaattggtcatcacctaaattaaaacggaaatttttggctctaaaaattggagaagttaacctctaactattttgacaagaaatttttaagtcctaaaatttcgggtatgttacacttccaccccaaataatgaggaaataggtcccgatcttttgataggtattgattaacaatcgatttggtggagtagcgacacaactcgatccggcttctgaacaaacacgctcttaagccccataatcgcagcaccatattttctctggttatcaaccatgccgaaacccggttgaccttgtcgagaaggctaatccctatatgcgaattcaagaacacaagcaagaacaagatag

SEQ ID NO: 26383 - DNA, 1501 bp, Oryza sativa; identical to SEQ ID NO: 19810

SEQ ID NO: 26384 - DNA, 1501 bp, Oryza sativa
tgagttagggttgtgttttgcttagattatttctgccttcgcagtttcgctgctagattggtttgtgaaaccccaacgtcgagttcttaaataatcattcatttgcaattaagttgttgtttttcttgttcttacttgtgttctttgattcacacgcagggattagccttctcggcaaggtcaatcggttttagcatggctgataatcagagaagacgtgctactacgattgtagggtttggatcatgttgatcggaagttggatcgtgtgtgtcaagtttccaccaaatcgatagttatcttcacctgaaggaagatcgggaatcccataatcccgttgccatcaccgcctctctgcctttaccccaaggtccatcctagagtgtgcaccaccgcggcctctgcctcttctccggtctcctcaggattgtcatgtcgttcttcggagtctcaagtcatcgaggcaacaaggattttgcaagtattttttttgtgtttgtgtcatgttttggatcttgcaagttttgatgccaattttctgattgagttgtgttctttttgaagcccactgatttgtgctgctggggtttggagaggcagatggctgattatagaagaagagtcgggtcatttgtttcttgtagaaagagttagtctgaagtaaaatgttttgggttaataaccatagatatattactgttaatacacattttgcttcctgttgcaaccgagcatcattttagtttttatttttttaactgggtttttcacacctgtaattgtgatgggtcacaagttattcttcactcttattcttttatctttttgttgggttacactcatcactgatgggccacaacttatgagacgatcgagattgagtcatctgtgacaagttctatacagtcaccatcgacgggccttcacccgtcagagatgagatcagtcatcactgacccctaatttctacgagagctaaactcgtaagaggtgatggtatgggtgcatcggtgtggagattatgggtatcccatatctacacggcgacggtatttggattgggtaccggatacttaatgtagatagaatatcttatctgtatctcgggtttgtttcttaacttgtgtatcaaggaaacaccctgagacttagtcggttacgactgtattttacctgtatcttcatattccgttaggaatatagattatcttttgtaatccggactccttcccatatataaggggggtccgggcgcctctaggggcagatgttgatttttcccaaatcatacaatcaataatacactcggcggattcatccccggacaggagtagggtattacttctttataagaaggcctgaacctgtataaatcctttgtctccaaacccatacacttttccagcttgatagccacccccttttattattgccgaaatccagtttcgacagttggcgcgccaggtaggggtagcgtcaagcttttcgccgatcagtgcaa

SEQ ID NO: 26385 - DNA, 1230 bp, Oryza sativa
ccttgggcggcctggagcggcggcgcgccgtgcagccggcggcggccgaacagagcggcgatgccgggaggcgacgccggcgacactccggcgtcggattggattgggaaagaaagaggaaagggagtactcagcatggagaatccatttttacattcaatttcataggatttgcgatgtatgcgacgaatttgggagctctatcaatggcccaaatttagggttttggggatttttcctccggtaatggcgatttgattcagcgggggtaggggcgaatttgaggaggtgaaagaggtttaaattgtgcttcttttgcctccggtattgtgccttctagttaaggaacgaaggagatacggaggcgggaagctggaggtgtcgcggcggcattcgttcgtcgttcgtcctcgtgcgagcgtgtgcgtgcgtgtggcgcgcgcggggcggcacgagctcagcgcgagcgtgcacgggattggcgcgaggcagcaggagcttgctcggcttggctcagcctggcttggcctagccgtgtagaggaagaagaaagaaaagaaaaacagagaaagggaaggagagggagaagaacagagaagaaagaaaagaaaaaaaaacagaaaaggaaaacatggggaaaattaaaatagataggattggaattgatgtggaattagatgatccgatattcggaatagatttaaatcggattcaagggaattatttgagggatgatatgcactttgcgacaaaattaaacgagaaaagaacatcgaaaataaacatggaaaataatattttaaatgaactattaactcgacggttatatttttagagaatcaaagcaaactaaatcgattttaaatagttgtcaaattttagggcttttacatgtacccgcaccaaagcatctcccagataagctagccgtatattcagtataacaagaacataatgtaaagtaggtaatcatatacttagaaaatatttcaataccataaatgtatttagaagagtattctaataaaagtacaaagcttacaaaatagaagagaaaagttgctagagccatacccaaactcttccgaaggctttcggactccgatttctactctactcctattccaccagctagatactactaaactaagcttgagagaaatgagagagctattgcttgaggtggtgtgaagtgaagagagtgagctccttatatagaggtagttatga

SEQ ID NO: 26386 - DNA, 1501 bp, Oryza sativa
tcacaaatatctcgatattgatggatatatcgtcacctactacatattgaaagaataattagtcataaatacgagcattcgtgtaaaggcttgaacttaaaccgggcatggacaaggaagaaagcttagcttacctcgcaaacttagaaatcttatctcttcaatgtacattctttgtctacccatgtgtactacttttctattaatgaggtgtgctttgacatttttctttaccactaaattttctctggatatgagggttccaatagtaagctgcaaataataatattattgtagtataaaaacatgaattaattggaagagattaatgaaggttggatagcatatttcatgattgtaatttcatcagtaaaacaaaatacaatctatttgcacttatgctaattaaaactttctatgaactctcacattagctagaaattgatttgatgcatcggattattgtgaatgtagttcatgctgagagtcatgttaaataaacaaatgacacaaatgaaaatagcacagactctaatttagtaataaaattcataattaaaaatatcatatcgtatccatcttatactctgaatttagtatttattaattaaaatctagaattcaaaattcataagtagtaacttgtaactaacgtggaccctaattttagtatgagcagatcaatatcaactcacaaccaacacatgcaatgtaataatataattttaatattaaagagtagcctatgtaatgcatgggttagcgactagtggttataatttctaatttccgtagaaacttttatgagattgtatgtgtacttttcatgacatatgtacaacacaccatatgttttcaaactaagtattcattactttttttataagccaattttgaaaaaaaaaatgacacatggccatgtatttttgagcagagggaacatgttatgaaacacaaatcttgaaactgagtcacattccttaatttgagagttaaggcatgttggatatattttccttaatttacatttttctaataattcatgattgttcattccgacatttcctatatattctcaactaatcaatctgcattggatcgatacgatgaaagagatcatcaactcaaattctgatggcatcacctggacagaggttgcatatcatgatactgaaatgacagaaataattacaaattaaatagatcgatttgtaatgcgtctttgaaacttttggatcttagaaactttgaaacgtctctttaatatccccaatgataacaagccatgcgttgcgcgacttttgattccatataagaactatttgttgtataggatctattagtttatagaagattttagatgagttattttatttacaaagtatctattggtctagctaactatagatttagctaagtcgtgctatatgagaaatcactagaagcttcttggttttttttttcttcattatctttgcccccgctctctttgtaccatgtg

SEQ ID NO: 26387 - DNA, 282 bp, Oryza sativa
agagagagaaagtaatcagggagcgcctacaaaaggaagggctggtggatgtgtatgtgtatgcgcgtatacaccctcactaccctgctacggcgacgactcttcccgatctcccaacgacagccgatcgaattactgaccgcaactcatgtaccgcgtgtatgcggctgcagggaggaagggtactcactgtttgttacagggaccgtgccgtgtttttatagcctcccctgtgggggtccatggcgataggcatgctgagatttatgagagcggggggca

SEQ ID NO: 26388 - DNA, 579 bp, Oryza sativa
ttatgttgtatgttgctatttctaaaggatccctgatcaaatatcatatgtgcaacaaatatgtttaaatgatcagcacatgtattaattgatgatcatgtctcatggatcatggtatagagataccaaattaataatgtggacacatgttgggagaacatgttgttggatagacccaacatgagacactgcaagagccatatgtgttggtattgaattcttagacctgagattatcatggttcccaacatgtgtagtagcttacttagggactactaaacgctactccgtagtgcgatacgaataatcaagatgagatttacccctcttatggagagatatctctgggcccctcgatgttatagattatgaaagtgcatggccatgccaaaggtgattgaggagtcaatcacaagttatataatctatcacaagttcaagtgaatgattgagctattagaggatggcacatatctagccttgagcttaatcgatatcgtgaggcaaagggcactacaagaatctatttaatatgtgacgaaatttgatgaaattttcgtgatgttttcagagatcgtc

SEQ ID NO: 26389 - DNA, 243 bp, Oryza sativa
ctggttgcgcgtctttacaaccaagtcatcgacataagcctcaacattacgtcctaattggctacaatacattacctaacaaacagatggtggaaacaaaaactgcatcatggcttgtgctttcatggaaatagcacatcacctaggttgattgtttcgctatggaattctattagagggaaatgatagaaatgagagctactatttagttgtcattgagccaggattttttattttgctggc

SEQ ID NO: 26390 - DNA, 395 bp, Oryza sativa
ttctcggggcagcgcaaaaacaagggcctgttgagtgttgagacgcaattgcttgtcagcttggaagagcgcaaatgatatagtaatcctttcaactatagtacttcctccgttttattctgaatcgttttgacttttctataaaattttttaaatttaattagatttataaaaatgtcataatattttgttgtagcaaggggttaccaccgctcctctatattcggcccaaaacactgtagagaaagagattgagttagaatagtatccgagtggcaaatggtcattcgaacagggaaacggtaaaacgctgttcgaattggaaaacactattcgagttggaaaataccgttcgagtacattcttgtcactaaatctcattatccgttttaagt

SEQ ID NO: 26391 - DNA, 1501 bp, Oryza sativa
tatacataggaaggaacaaagtatccctccgtttcaaaatgtttgacaccgttaactttttagcacatatgtttgaccgttcttcaaattttctctaaaaatatgggtttgttggaaccatgccaccctaattttgcaaaatttgagatatgccacctgtatctcaatgacatgtaggacccatatgagtcaatgacatgtgggtcagggtggcatattacaaattttgcaaaatttatgtggcatggttcaaattttccctaaaaaaatttatgaaatatgtaaaactatatgtgtacatgaaagtatatttaacaatgaatcaaatgataaaaaagaataaataattacttaaattttatgaataagacgaatggtcaaacacgtactaaaaaatcaatggtgtcaaatattttgaaacggagggagtgcttcctccactttttactccctccgtattttaatgtatgacgctgttgactttttaatcaacgtttgaccattcgtcttattcaattttttttatgcaaatataaaaatacttatgtcatgcttaaagcccacctcatgtaaatcaagtcacaataaaataaatgataattacataatttttttgaataagacgaaaggtcaaacgtttgtcaaaaagtcaacggcgtcatacattaaaatacggagggagtaatatatatgatgtcatcggttttttaaaataagtttaaccatattcatcttatttaaaaaatatgttattattatttattttattatgacttaatttattgtcaaatgtcatttaagcatgactttagtttcttatatttgtataaaatttttgaataagatgaataatcaaacgtttataaagtcaacaacgttatatattaaaaaacagatacgataatatccagatagttgatgtcgtactaacagccagcaatccctaacagctgggttagcatttctgtctaagctagtggccaatataaacaaatgttagttcaaccaccagtcacaaaataatatctcaccgttggcactggtacaaaaacgatttttgcaagaggctgctaacctttttacacgggcatttatcaagtctaacgatcgacgcgccacgctagctggaatattagaaaatattataagtgcggcagatggggagagctctcggcgtgtccacgtaggataggaacagtgcgcggggtggcgattttgtgaaaaagtccttcgattttgtgtaattcgatataggtccctagaaaatagtacctatgagacgatattttgcgtagaggtccttataaagtacgaatatttcatgtgaaggaaagaaaaatcacgaattaggactgtgctctaaaaagtggaaaacgaggggctttttcgcaagaagacgccactaaccctaccacccataaccctagccgccgccgcccgttctccctcgtcctcccctctttctctccctctcccgccgccgccgcctccggcttccccg

SEQ ID NO: 26392 - DNA, 670 bp, Oryza sativa
atagcatcagcaaaaagagctttgttgcctggccctctccgtttcgatcttgcaaggaataggccaaagcagcaaaggacctatttgaaagaatggaaagttttgcaagaggagaagaagatgagctaagagtgcaagcagaagaggctgcattgttgggaaagaagcagacgaagaacaagcaagtttctttaggggaagaacaaaaagcagaaaacactgcaaaaccatggaaaaaaaattcaagaacgattacaagcaagatcagaaaaaacaagtaaacttcattggagatgactcaaataatggagaaggaaaagggaagagacaatgggaaaacactcgtggaggaagaaacaattgggggcagtctgcaagaggtcgaggacaatggtggaattctggcagaggtagaggacaatggtggaataatgacagaagcggaggaaaataatatcagcttgatcatggcaagttttgtaaagcacatggtctaggtggtcattctacggaagaatgctatagcaagttttgcgaaattcatggtctaggaggccattccactgaggaatgtaggcatatggcttaattagtggaaaagcatgtcagtcaatatgagaacaagtatgagggggcccgagatcagcgagggcaaaatgctatagaagca

SEQ ID NO: 26393 - DNA, 1501 bp, Oryza sativa; identical to SEQ ID NO: 19814

SEQ ID NO: 26394 - DNA, 1501 bp, Oryza sativa
catggagccaagatcgggcggaatctgctaaagccaccggtaaatagttcgccatggccttgttgtctcctcctgctgcgcggattgcgagaccgtagacggtaacccacgattcggggttagtggtgccgtcatacttctctattccagtcggtttgaagccggctggccaatccactcgacgcaggtcgtcggtgaaggctgctactccgtcaaggtcgtcgtcgtggcggtccggtgagtgatggtagcctcgagctgctcggcgctgtatgattgtgtcgcgaagatcgatggggcggcgacgaggtggtgagcgaggccgttccactcggcgctccctatgaaggtcgggaggtgagtgaacagaccgctcgtcgtgacccctgctcctgcggttggatcctgcgccggtgtgctgaggcttggatgacggtagtcatgagatcggaagtggggaactcggctgccagtcggcgtgtggacgctttcggagttaactgggaccgaggccgcaatcatggtcttcgtctggttcaagatgttgacgacgtggtcggatcgattgagctcgttttggttgaggagggtgtcgagaagagtgatcgcggcaaccgcattctgttgaggggtgcggaaaaccggtgtcccttcgacgtcttgttggccgatgagatcacgcgctcggcgccctgcttccaaagctcgctgacgtcgatcctcagcctccttcgcggtccgctcacggtcctgctgctcacgccgtagccgttcttgttcttgtgcttgatgctcctcttccagtcggcgacgttcttcggtctcccggacttggcgttgctcctccgtctcattattggccatgaaaacgccaaagtagagaggggtgtagttgtcatctaggcttccgtcgaagtcgtcgtagtcgtcgaagtcgttgtagcgagagctaaattcgtcgtactccacgatgtcagtaggacgtgagtcgacggtgggagagctgttgtagtcatctagctgatccgtcgaaaccgtgccgagtggttggaggatgacgccgacttccctgaagctaggcgaaatcggtgttgaagccgacttctgcctaggcctacgggatgaagacgctgtcgtggtgaagacggccgctaaatcgtcggggagcttcatcaggactggtgggtaagtcccatcatcttgatctggtgtcgtcggagaagatgcgatctcggccgagtggtttgaagccgactcggttgagatggtcttgaagtagctttcagccgcgttcgggaatccaaacgggaccgaaagccggttctctcccgactggtctgattccgagtcaaggagagaaatcttgccgaagttgttggtgacgaagtcgaggctgccgaaccgaaacgtctgcccgggtgggaagacgaggtcgtcgatgccggagaaaggacccattgcactgatcggcgaaaagcttgacgctacccctacctggcgc

SEQ ID NO: 26395 - DNA, 1501 bp, Oryza sativa
aagcctcaaaaattaaaataaatatattctcattgtaaaatcttagggtcatattatttgtcgttattttcaccatacttttaaaaaaatccctgtttgatggtttgatgttgggaaggaacaaaagtccatttacctcattgtttggaggactcacttgacactgattgtgggtggtagctaattcaccactcaccatcaccattgagataatttaaaagaatatacatactaatatatggcacgatcattgctacgaataacaaacgccaaaagacgaagagaaaaacatttactcgatcacgtccatttcagactactgcatacgttcatgtatatatgaaccacgtagcatgctctaaattaaaagcgttcttttgatatatcaaaaatcagatttctcttcctacatcaatttttttacttacagtctgcttactctaataacaaggcattaaagatggaaaatccaaaccatttctatagtttttctaattccagctttcgtttaatttccagcagcatataaactacatatgcaattcaggaatgtgtgtaacatagtagtaaaattatcactatctgttaagtacagaagtgggaacctgttgaaaaaatataggccggctaggcttattcaaaaactcaaaaccccatgattgaccccttaatcgtttgcacattgtttgttcacctaacgatccttcccagctcatccctggttgtgccacggatgcttctctgagatttgcttctcattgacactgcaacctccagcatatgatgcagctatatgccataacctccccctggggagcaggagcacggcatccatatgtgcagcctccagcatatgatgcagctatatgcagtacaaaacatcattcccctacccacagtccaagacatacctgattaacaatatttttcttcaactggaagatcttcattaggcaaaccaagcaagaaccttctctgaagttcaaaggggtctctaaggctgcaaaatataactctacgtgaaagaatatatatttttatatgctacagttcatgataatgcttataatgcagaatgccttactaccaacaagcacatgctctccaaacttgtcccttgatcatgaacccacatcattacatatcagcatatatagctgccttcttctccatcaccctcccctccccctcttgcagtttcatgccattcttggcgctgtttgctttcttggatgtatttcaccgagtttccgttattctgcattccagtctcttggtacatttccctcagtttgcttctttggtgtcacataaataatgttactgcacccaatatttttaggtactccctccgaaaacatatgcatgtgtatgtgtttttttccttgcagattaatctttgtggttacttcaatactgtatcaagtcttagtgaaggataattatcttgaagtatatcatacttcccaaatgtagatacaaacacgagttgtcactacca

SEQ ID NO: 26396 - DNA, 1441 bp, Oryza sativa
aataaaagctcaaagttagtgaatgacctgcccctttaagctcaccgtgttcattccagtcgtcttttttatacaagtccggtggttcaaagagagtactttaattccttctagacgatgattagagataacggattccagctctccaaggtcgcaactgagggagctatatatcaaaataggatattattctttgtttgtagttgagatttcttagatttgagtaaatatttaatgagtaagaagtcgttcccaagcggagttcttgaaaagagttgatttccgaaatttatatatttggaaattcgaaacttgtttggtcatttgaatgtcttttaagccaggggaaggtgaggaagtggattaaacaaggaccaaggcggtcttcttagaattcaatggttcgtcagaccaagcacactacctggtcattacatagcttcaaacatggcaatgaccaaatttaaaatgaagaatgagtacgtcgccaaaacattactagggttagccaaagttaattttcagtgcagtatattagctttaattctaaacacaactataaaaatatgaagaggacatataactaatgcatattacaagccaaaacttaatgtctagggccatgtacccctccgtcccaaaaataataataatcctagcaacaaaactggacacatgcgtgtctaggattagtctttttttttggacggagtagtagatctttaccaaattcgatatagatttataaatagacttgaataaatgttgttttctcaagtggtggtgtttatttagtgtttttatcctcacttttttatctttttttttgcggggctcacttttttatcttagctgctactgttgagcaaattgtgtaataagtgattataacttccttcaaacaaaagccaaaattaatattccattattaaaagagctatacttctttttctttcattacagtgaggaaataggggcattttttgagtccctgacccccggacaatctgggccataaaacaaaaatatgagtcaaagtttcaggctccctaaatggaaataagttcacttgatgtccctcgattttacattgagtttgtttgacatcattatttccaataccagaaatcattacccctaaactatacaaaaccgtgcaatttagatcctatagcagaaatgcaatatagatgactggtttagcttatgtggcatcctagtcaggaaaaatttcaaaaaaaaaatgtggacccaacatgtctgtgcccttttctttattctcattccttcccaagcctggagagagagaggtggctggcatgagaaaggagagagaggcggccggcgagcctgcttgggacttgggtcaagctccacgcccggcatcgacccgactaggctcttcaccgcgactggtcttggtgctcttcgaccagcagca

SEQ ID NO: 26397 - DNA, 228 bp, Oryza sativa
  unsure (1)..(228): unsure at all n locations
gtgggcgggtacaacgactaccatagggcgaanncgagctcggtacccggtataggccactggccatgattgtctgtcttgctgacgagagaaacgagcagtacaatgcctagatataaaattgttccatgatcgatcgatgagagattgagagtgctagcttgctttcaattcatccccatgcatgccaggagaggtgaatgagcatcgggttcagaattcagatca

SEQ ID NO: 26398 - DNA, 1501 bp, Oryza sativa
tgtgtgacagaggagcttgaaactttaaagccgaggtcttagtattagccgttagctctctcacagccaattaacgagccatgggtgagagaaaagctggaatttgcttggttttggtacttcttctgtcaacacttgcgcaacatgcttatgctggttagttcttcatgctccttgacctcccttctctatccctctccaatgtattgtgttcgagtatcatttcatatgtattatctattattcaattgtatgtagaaactgaaatcttaatttaatttttatttcttatgtgatgactaagcaacggcaaatctaatgccccgagaccccggcccggggcggccgcctgatgtcatcggtagttggtacattaaaattctatataattggaaggcccgaagatagaagttttatagaatatactagctatggtataattaactatgttatgcctatgctagctgtaaaactgttatggattcaccactatgagtaaggattcaccactataagtaaggataaaagagattattataggttctattttccaatgttttgtgtgattaagatcatcaaccaagtgagattattgtaagttcactggctaaattaattttgtagaacaatggtgctggtatgaagtttccgtgtcgccgatctgtgccggtttcacttgcaagttcgactgctggtttttcgccaaagtcaacaaagccaaagtccagtctcacaagtgcttgggaaaaggttacaagatcaaatgtttgtgccaactttgtaagaatgtttagtaccactgaagacaagatattatgttatgttctattgtaattgtaggagttttattaataatttgcagaagtgatcttttagttggttgttgtcacatcctgattttcgtttcaggatttataaattatttaataaattaataatagaatttatattaaatgttcattaatttacaagtgaagttaaatgtggaaaataaaatttcctaaatttaaagcatggatggatttaatttttattaaattctccatggttaattatactctctggaatattctcggatttttcggagctcaattcctaatttttaatcttacaaagagcatttcagtaattacccacatattaaattaatcattaaatggtctaattataattttgttaagtactttgcgtgtccaagtattttcaagatttttcttggaattatttgagcataggaagtatttttaacaattcaaagatcatttcagtgattaatttaattggaaaagtatttaaaatccccttctccttttcgggccgaaataggaaaagttcagcttctgtcctcggcccattctcccttcctttcggctggccttatccctcctccaaagtctgctttgtgtccctttttcaatcgggccaagaagtagaagcccagcaaaaagtctagtttgcctccctgctacagtgtcatcttcaatctccagccggctggaga

SEQ ID NO: 26399 - DNA, 264 bp, Oryza sativa
  unsure (1)..(264): unsure at all n locations
cccgccgtgcttgcatggtcaaagaagaaccgttcccttgcttcgggcttctcccgccatggcaagaagccaggtttttgacggcatggacgcatcntcttgcgcaagagaaagagctaagcacgcgttttggacataatggaaaagttcgatcctcttctccaagaatggatgctgcaagtctcgccggagggcatcagcatcaggagtccatgagaccaccgtgctgatgatgaactacatcgcgcttttctggcgcaaaga

SEQ ID NO: 26400 - DNA, 1501 bp, Oryza sativa
ctgcagctggctacaaatatgtagcccactgcccttctctcttctcttttatctcttcgaaatgtgtttatagctggtttatagcctgctattattgtacatgctctaatctgaaatagagggagtatgtatcgacgggatcaatcctataagagtaggtacaatagctaaggctataagccaactataaccacatatcaagaagaaaaaagaagagagagaaagcggattacagatttgtcgccagttgtaacatgaactccaagatattatatgtgtatgagaggtgggactgagtattaatgggtagtatatttttatagtcaactattgtatgaatggactattagattagctataaatattttggagctagtagttggctataccattaaacttgctctaatgtaggaatttctttcgtcgtcatcattatcgaaatccaactgcccaacacacttagtaaggactaaggaggcgatcccccgattccgcttcggcaattccttcggcggtgtggaggcggcccccgacaaggtaattagtatagatacttagctaatactccctccatctactttttaatagtcatatttctaaatttgaaaattttatttttgataggcatatttcaatccaacaacttataatcttaatggctttcttggatttaatgcgtgactctccattcttacacacaagattggctacatgggcatcgggaaatgtaaatattaatgaatcgcttgtttacgaggaatgactagtagcatgtttaaatggatgacaagtacaatcacttatcattggtctgtgtgccaagatgaaatattactatcaaaagtagatggagggagtatcgttttccgatttgtagtatttactctattttgtattataagtcatttgattttttttcatagttaaagtttgttatatctgatcaagtttataaaaaaattagcaatatccataacacaaaattaatttccatacattttacattaaatatattttgataatatgtttgttttgtatggaaaatattttatatttttttataatgttgattaaatttaaagatatttaacttaaaaaaagtcaaacgacttataatatgaaatgaaaagagggagtatcattgtctcaactggatgaatcctataagagcaggtataatagcaggctataagccagctgcaaccataatttaagaagaggaaaaagtacgttttaccccctgaactatcgcggtcgaccgaattacacccttaaactcaaaaaccagacattctataccctcaactattgaaaccggacaaataaggccccttaacactgttttgagtggttttgacttaaccttgcacacgtggcgccaacgtggcaatctaaccagcaaaaaaaataaaaaaaaacatggcccacctgtcatacctatcctcaaaccaatctggcaatctctcaaccattccatctctctcacgcacgcgctcgggca

SEQ ID NO: 26401 - DNA, 162 bp, Oryza sativa
gggcatcctacttgtgttatgaaagatgcctttgatatttaccttcccgtctttagggtattcatttatttattatgtgaaccgtatagaggcagttagacaaaatattaggatatgcatggttttgttcttttgatcagaaatgaacctctattttcgcgt

SEQ ID NO: 26402 - DNA, 425 bp, Oryza sativa
aggccaaggtggtgtgagtaacctaacgtcccgtgttgggtcggcaaaccgcgtcaggtgggtgtgtgttctgtggcattgtgaccattaaagggaaaatccctggtctgtaaccggatcggaaaaattaaagaaatcaaatgccattaactaacctttccctcctcaattcatccctttccacaatctctaatccaaatctctagcgaaatcctgattcaattaggcgaaacgctggaagagtcatggaattcgtgacaatctagtattagagcacttcggttctcgtgcgcactggcgaggaagaaggcaaatccaaccctaaccgagaggatgggggcagcggaagaagaagcataggtgttgggcgagaaggtggtggagctcacaacaagtatcaacaacatcctcggatcgcttcaagg

SEQ ID NO: 26403 - DNA, 646 bp, Oryza sativa
cagccgaggcaggcgctagaaaacgcgggttgtggggcccacgaacggaaaaactgatcatgtgcgcgcaccgctcctaggccgccgatccactgatccgatcccctttcccctttctctttgccatgagatcgatccccctctccctcttggcgcgagcgcgagaaaggaggctggcgcatcgatctctccttcctggcgcatcgatcccctcccgccaaatcgatggacagatctcccacccaccgcatcgatcgatctccttcccgcgcagtattccctctcactcactcctttttcttctctcccggtcctataacttctcccgcgcgcgcgaaattcattttgctggcaggtagaacgatgccaaagccccaaaatcgcccctgaaatccatccccccggtgaatttcagggagggccactgccccccgtcctcttccatagttctaccgcaccaaaaccctagttccttttcaccatgtctcgtcggacgaagagagaggttgcaccaccgcaaactcatttgcaagctcgtctggtcctcccggtgttcatatcccgccggcaacaccgtatccatatggaggtcctttgttccccaccccactgccatcatggtttccttttccaccgtcacaagcca

SEQ ID NO: 26404 - DNA, 976 bp, Oryza sativa
tctctagggttttgccggtatcgactaaattatttatgttggttagattaataatggtatctaccaccctgaaaatcagtcaagagcttgattgtcaatatatattgtttcttttcatacttaatgttgcatcagttatgtctgatctattaagtcgtgatttgaatctctagctctagcttgttttttgattgccaataatggtagaatcggggtttcaggcgatcttacctgatatagatgttttattatgtttagttaatctaatcaagcttttcatgctatatctgccctttatgtatataagataaatatatttgatttatattgagtatatttatctagattacatatataaagttttattagagtattagctaatacattatcttttgacctaggcattgtccatttagctatgatataaacacatctaatccctgagtttgtcaatctgatttatatacaatccatactgtcgcagttaggtccaatctataccatttgtctataatttagagaagattgacttagagattatatgattgtttgcctctacaactattagagattatatgactgttggtatttcttaacggcattactagaaatattcattcctagcaatggcgcaaaaatagtcatggtatatttatggttacaaaagtaatccgcaagcgcatggatataccattgtagcatttcacccggaagtattccaaggtatcgtatttaatcctaagggaagatgtgaaagagagaaccatgctaataattatatacatatataatactttctttcatcaaagtctaagcaggggttaattcagtataagggtagaatgacaaagcaaagcttttagatttatcctaataaataattctaaactaagtggaagaagagatagaaagtaatcaattcctatacttctaatatacactcaacctttagtttacatttgctagtatacaatca

SEQ ID NO: 26405 - DNA, 1501 bp, Oryza sativa
gctccaaaatatttatagctaatctaatagtccattcatacaatagttgactataaaaatatactacccattaatactcagtcccacctctcatacacatataatatcttggagttcatgttacaactggcgacaaatctgtaatccgctttctctctcttcttttttcttcttgatatgtggttatagttggcttatagccttagctattgtacctactcttataggattgatcccgtcgatacatactccctctatttcagattagagcatgtacaataatagcaggctataaaccagctataaacacatttcgaagagataaaagagaagagagaagggcagtgggctacatatttgtagccagctgcagcacggactctaaggtacatgtgtgtataacaggtgggaccagatattaattatgtagtatatgtttatatgtaactattgtatgaattggtcattaagttaactacggatgatttgaaggcagcagatggctatactattaaacttgctcctaaggtccattcgaccgtgcatctgcgatcctcacgcgtgcaaacgtaattagcggtagcgtccaggattaattaggcaatgtatttagaaaacatccaactatctaattaattaaacttttgattttaatcccaaatatatagggcgattcgttataattcttttatcttaaaaaaatcggaaattttaatcctaaaattttgtcacctaaatacgttgccaaaatatgccacttattattttaggtatacttttttcattctagtaaaaagttggatagtaatttttttactattattgtaaaagtttctcaatataattttttatttatgtataaagtttatcaatcatttttttacatataaagtttataaatgaaaatattttatctacatagaaaatttatgaatctattttttttgtttatttataaagtatatcaacataaatgttttcttttatgtataaagtttattaatgaaaatattttatatatgtagaaattttatgaatataaatttttatttacatgcaaagtttatgatgattcatatataatttcaagtagatggagtttacaatttaagcttatttctatttgaaaatagaagtttcggaatctaacatatcaaaaatgttgataagaaggttttcgtatcaggatgcgtcttccctgtcccgataccctgttcctggcgacgtgtcatcttcttattcgctgggtcttttctggtgggccagtacgcatgcgctcctctttcacttaaacggcgtcaacgtcccgtgttatactatcacaattaatttggaaacaacgcaatttaagcgctaacaaaaatatggcgccaagcaaataaaattagtggcgggaaaaaggattagagcggtacataagtacaaatacacagttattttattttcatctacacagattgcgtctccacactaacaagaactctcccaaatcttggcacca

SEQ ID NO: 26406 - DNA, 1501 bp, Oryza sativa
actgcttcgaacttggtcaaagtgcccctagcgaatttggcgttgtagttgtacgggatgttgacgatgtcgaagagtatctcctcttctcttctattctctttcgtgccgaaggcgactttgatgagggcctgttctagaacttgcactgcttcgcctctgaaccctctaagcgaagttggtacttgggataatgccgatggggttgtacttgaaatgtagtggggttggttgagttgctgaaggaaagcttggagttgcgcctgcagagccgaagccccttccgccattgtttgtggcgcttggccaggtggttgatgttgtacttgggcagcgactggttgggcttgcagttgcacgtgaggggccggatgcgctgctgcagtcgatggctgcccggcgaagtacattggtgcttgtgcggcttgtggcggaaagggctgggtcgtcacttgcggatggacttggggtgggacataacctgccgaatactgaaggatcggggccgacgtgaccttggtccgtctcgctgcctcgtatgcttgttgttgttcttgcatttggcgaagcatgtcttggagtcatgtcatgttctgtcgcatggcttccatgtcggcttcggcttgtgtttcggggtcagggctgacttgggcctgcacagcggcgagcacggttggggccgctgccggctgcgatggaacggcttggggcaccaccagttggcttgtcgaaaggatctctgccctggtctggagtgcccttgccgccgcagccgccttcgccacgttggccgcattcggcacttgctcagaggtggcaggggccgaaggcagtagtgatggcgcagatgcggaagcagatggtcctcctccatcttcggccacgggcgctgaaggctctgctccctcctcggcggccatgtccgctccggtgtcgctttcctttcgccttgtaaccttctccttcacgaccttcttcggtggcattcgctctcggtggtatcgctcggaggtccccacggacggcgccagctgttgtcgaaacgacaaccgcatacgtcgaaagacgtggttactcaacagtggttggaaagaaacgaagtgtattaattttagaattttttacttcgggatccccttattacatggccctaggggactatttatagccccattacaggttcttactactagggtttaggttatacaggggaatttacatggttaccctaacgaaagggacatttacaggggtacataatgttatggaggctcatgggcccctgatgggccgtcgggcgaccgccggccctatagcccctaggcttgatgggccggaaaggcttcttcggccctcgcgggggcgaacttgccatggcgaagtcgtcttccttcggcaaatactcttcgccttgcacccttcgcctgggacgcctctggctcgacaaggtactcgcacgacccctcgcctcgcgctgttcttgctccatagtcttcgccac

SEQ ID NO: 26407 - DNA, 342 bp, Oryza sativa
  unsure (1)..(342): unsure at all n locations
gtggtcaaattcatggttatctaagctagagtcaatgaagtgttgttaagattcatatgccatacatggaggtttgtgtggtatggatacgagtgaatttgaaagagtcaaatttggatgattggtatgtaagttgtttctatcganaagtttcctaggggattagacttctagtatagtttgttcatgcctttagctgctacctcatgtataatagagaggagcgttgaggcttccggttatcgcttttaagagcaattgagttgatagtttactaagggtttcgagttaagtcaagatttttgtaaggagtgctgttgttgcactttgtaaacacagaga

SEQ ID NO: 26408 - DNA, 1501 bp, Oryza sativa
ttgatcagagaacaccaaatatggaggtaaaattctaatagctggaaggtacattttgtagaaacacagtatttccttcagtatgctagttcaggaaaattcttagcatgcccagcaacagtaagtgccggttatgtcagtcatactgtgaggggctggatggaactagtgggctacacgaacgaaattcgggaatgaagaggagcacggtcgctcagctaactgcttacctcgtcgaagtggccgtcgcggaaggcgcgagcaccgcgctgcgcgaggtcgaacacctcgcggtacttgtccgggtccatccccatctcctcctccctcttcaccttgcgcagccaaacacgagcaggttgaaaacccatcagcacaccgcgtacagtacatataggtgaaaggagcgaagttgacatacccacgggaagtcctcgacgacgagcgcggcggcgaaagaggaggcgcccggcgaggtcattggagggcagcagggcggaggacgggggagtagggtgggaatgggggtgcaggggattgtggagtttggaggaagggggaggagagggagaggtggtggtgggggaacctgcggcgttcgtgcggcgatgcccagaaatttttgcgcggctgaggccgcgaagacgtgtcgcagtacggactcgatcacgccacccgatccctcaacaacgacggtctatggctgagcacagggtgtccttttcccgttcgaccccggtttttcattttaggattctaataatttagggccgtttgttgggattcttaggagcaattctagcattaatcggttggagttgagccaaacgggtaattttccctcagcttccaaagcgaatcaactgggatcgattcccttttttacgaaggaagggagaatcggcggaaagcgagcttctgctaagaatcaaatcaaccaaatatgaaagttcccatatttttcccaaaaaattacccgcctgccactgggtatacccctctttccagccttccccatccacccgagcagatcgatcgacatcacgcgctagggttgcgggagctagacgatggcgctccgcatccagcaccgccatcgctgctggcgctccgcatcgccgccgacctctcccgtcgacgacatcgccgaccatagtcgccgtgcccgagccttttcccaccatccagccaccttcgacgccacttccggtctccatcctgccactcccctattctccctcagccctgcagatccaggccaacaacgccaccagttgccatgttgccattctccgtcgagctccctaagcaggacgaccagcactgactgggcaaggtaccatgtcctaaacttctccatttgattaactttgtatgttgtactattgtgcaaaatagtagaactgaatagctcgctgcgatgtggatttgtgtgtaaataatattgatgtggatttgcactctgatctgtgtatgtctaaatagttttgatgtgcatctg

SEQ ID NO: 26409 - DNA, 368 bp, Oryza sativa
cagtatagatcaggaatttggcatgacctcataggtgtatgatcatggcatcaatgccatgtcaaagttgctaacaactaaaaatagcctgcaccgaaaggaaaacagaacacctataagatccatctggctggtacatgtgcatcatttggtgaccaaaagcagccgttcagaaaaaatgagtacattcgagcttcatcttcacagataactaagaaagtagtcacaaaaggctagcacctaaacagcttgggtctaaagaaaaaagtcctcaaaagtttgtcgtactgaaagtttgaagcaattttttagcaaataaaattctgataatatttaaataattatatgggggatttcctatcatatga

SEQ ID NO: 26410 - DNA, 1501 bp, Oryza sativa
gctcgcttagatcttcaccgagcgatatgattttcgtggggtctaaatcatctatctgcagttggacaaccttgccgtgggggcgggtttcggtattggctttgctttttcttgcccttcgacttctaaggtatggacttccctgtcgaaaggggaccactgtggcagccgaaggctgggaacccttgacgactatcacaccagctgggccaggcatcttgagcttgaggtagttgtgatgagatactgcttcgaacttggtcaaagtgcccctagcgaatttggcgttgtagttgtacgggatgttgacgatgtcgaagagtatctcctcttctcttctattctctttcgtgccgaaggcgactttgatgagggcctgttctagaacttgcactgcttcgcctctgaaccctctaagcgaagttggtacttgggataatgccgatggggttgtacttgaaatgtagtggggttggttgagttgctgaaggaaagcttggagttgcgcctgcagagccgaagccccttccgccattgtttgtggcgcttggccaggtggttgatgttgtacttgggcagcgactggttgggcttgcagttgcacgtgaggggccggatgcgctgctgcagtcgatggctgcccggcgaagtacattggtgcttgtgcggcttgtggcggaaagggctgggtcgtcacttgcggatggacttggggtgggacataacctgccgaatactgaaggatcggggccgacgtgaccttggtccgtctcgctgcctcgtatgcttgttgttgttcttgcatttggcgaagcatgtcttggagtcatgtcatgttctgtcgcatggcttccatgtcggcttcggcttgtgtttcggggtcagggctgacttgggcctgcacagcggcgagcacggttggggccgctgccggctgcgatggaacggcttggggcaccaccagttggcttgtcgaaaggatctctgccctggtctggagtgcccttgccgccgcagccgccttcgccacgttggccgcattcggcacttgctcagaggtggcaggggccgaaggcagtagtgatggcgcagatgcggaagcagatggtcctcctccatcttcggccacgggcgctgaaggctctgctccctcctcggcggccatgtccgctccggtgtcgctttcctttcgccttgtaaccttctccttcacgaccttcttcggtggcattcgctctcggtggtatcgctcggaggtccccacggacggcgccagctgttgtcgaaacgacaaccgcatacgtcgaaagacgtggttactcaacagtggttggaaagaaacgaagtgtattaattttagaattttttacttcgggatccccttattacatggccctaggggactatttatagccccattacaggttcttactactagggtttaggttatacaggggaatttacatggttaccctaacgaaagggacatttacaggggtac

SEQ ID NO: 26411 - DNA, 1501 bp, Oryza sativa
tggtattcacttcttgctcgcttagatcttcaccgagcgatatgattttcgtggggtctaaatcatctatctgcagttggacaaccttgccgtgggggcgggtttcggtattggctttgctttttcttgcccttcgacttctaaggtatggacttccctgtcgaaaggggaccactgtggcagccgaaggctgggaacccttgacgactatcacaccagctgggccaggcatcttgagcttgaggtagttgtgatgagatactgcttcgaacttggtcaaagtgcccctagcgaatttggcgttgtagttgtacgggatgttgacgatgtcgaagagtatctcctcttctcttctattctctttcgtgccgaaggcgactttgatgagggcctgttctagaacttgcactgcttcgcctctgaaccctctaagcgaagttggtacttgggataatgccgatggggttgtacttgaaatgtagtggggttggttgagttgctgaaggaaagcttggagttgcgcctgcagagccgaagccccttccgccattgtttgtggcgcttggccaggtggttgatgttgtacttgggcagcgactggttgggcttgcagttgcacgtgaggggccggatgcgctgctgcagtcgatggctgcccggcgaagtacattggtgcttgtgcggcttgtggcggaaagggctgggtcgtcacttgcggatggacttggggtgggacataacctgccgaatactgaaggatcggggccgacgtgaccttggtccgtctcgctgcctcgtatgcttgttgttgttcttgcatttggcgaagcatgtcttggagtcatgtcatgttctgtcgcatggcttccatgtcggcttcggcttgtgtttcggggtcagggctgacttgggcctgcacagcggcgagcacggttggggccgctgccggctgcgatggaacggcttggggcaccaccagttggcttgtcgaaaggatctctgccctggtctggagtgcccttgccgccgcagccgccttcgccacgttggccgcattcggcacttgctcagaggtggcaggggccgaaggcagtagtgatggcgcagatgcggaagcagatggtcctcctccatcttcggccacgggcgctgaaggctctgctccctcctcggcggccatgtccgctccggtgtcgctttcctttcgccttgtaaccttctccttcacgaccttcttcggtggcattcgctctcggtggtatcgctcggaggtccccacggacggcgccagctgttgtcgaaacgacaaccgcatacgtcgaaagacgtggttactcaacagtggttggaaagaaacgaagtgtattaattttagaattttttacttcgggatccccttattacatggccctaggggactatttatagccccattacaggttcttactactagggtttaggttatacaggggaatttacatggttaccctaacgaaaggga

SEQ ID NO: 26412 - DNA, 298 bp, Oryza sativa
gcagttactagcttgttatggtctggagccggggacaggttacggggtagtaactggccagaatgatatggatttaaataaaaaatatattaatttttacatatgtaaatttagaattattctgtccggttaccggttgctggccaaactaagttctgttcagaatggcttgtttgtggtgactgtcagctcataatagaacataaggatttctatgtatagttcaatggagtgtgtgcttgcctactgggtcacctttatttaagagttcgtaattttgaccttgttgctaattgca

SEQ ID NO: 26413 - DNA, 1170 bp, Oryza sativa
caatccccattgtaaatggggtgaggaagcggtctgttttgtttttattatcatttttgttataactctatggaagacactgtatatgatgccttcaaatggtaaatggtcaattccttcgttattgttgaacaacattgttgttaggtttattcttatatcggtaattgatgatgggagagtacgacttaaaaggtggagatatttctcatctatcaaacttgtcttttaggttatgtagacacaggatctaaagatgtagctccaattgggcctgtggtggagtagactcaatgtgatcttggtggcccacgattagtggatttgggctgcacactaggattcctttgattcatgggataggaaaaaccacaaattgaaatagtatgtttctcaaatacaacaagaataaaaaccagaagaaatacaataagagtcctttgatagtgccatgagaaagacaaaaaaaataacaaaaaggtcacacaacatcttgttatttttcatatgaaatgtgaagcataggaatataatcctatggatagtttcctttcttccctatgaattaaatggacatgtagaaaaaaaaccatatgaatttgaattttatgaatcaaaaaatgatgtaaagtgcatgttcctagtgagatttattaaaatgtgagaatccatgccactatgtttatactgattcaacaatttgcaattgatcttatcctttctataatattgttgatgtgaaaacatggtggcctgggagatctgcttaactccagtgcaggtccaaggctagacttgagtgtgtcaagggcgtgccagctgatttgatcctgcaattagcaagaaagaataaaagcaaaattagtcgacccatagccgatcggacgatagaccgatagcgtatcgttgatggtctcagccgatggagttagaccaatataggatcgagatgtcgactagatggggggtgaatagtctatttaaaactaaatggcacttaatcaaaactaacctaagttgctaggcagggagatgtacaaggttaactaagcaactaagttaagttttgcaaacctagggtgatatgggctcaaatgtatctctaggaaagtaaatcacacacataagttaagttttgcaatcctagggtgatatggggtcaaatatgtc

SEQ ID NO: 26414 - DNA, 185 bp, Oryza sativa
tttccacatcaacctttgaaggctatggcagagctacatttgcagcgcagcctctctgcatgatttcttactagataggattaagtttcaagagttaatttcttgtactcttgggcgatccatgctgtcaaatcagcaactaacgaggcataatctcgatcactagctctgatctgatcttcagc

SEQ ID NO: 26415 - DNA, 174 bp, Oryza sativa
caatccccattgtaaatggggtgaggaagcggtctgttttgtttttattatcatttttgttataactctatggaagacactgtatatgatgccttcaaatggtaaatggtcaattccttcgttattgttgaacaacattgttgttaggtttattcttatatcggtaattgatga

SEQ ID NO: 26416 - DNA, 279 bp, Oryza sativa
  unsure (1)..(279): unsure at all n locations
aggatgatatttcatgccnatncancannccactggaccagtaacaaaagccctttaactgaggttgcacgctatatattcaaactgacaaaaattttgttgctatctttttcgcctttatcgggggcacgcactgacgaagctgaggggccccttctctccacttaccactcccaagcgcatagtaccgtcctacggaggggaccggatccgtcacgcctagccgccttcgctcactaagccaccaccaccgcgncgggaagaaagggagaaagaaga

SEQ ID NO: 26417 - DNA, 731 bp, Oryza sativa
cctgcaagtccttctttgctgcttactggtgtcatttttcttgagccataattgttaccactactgtctaggacacgagtagaccagcaactaagggcaagtgacttgggatttttattcagcattactatatgtcattggattgtgtaccactcatatacatatatttggccttcctagctccacatattacttctggacagtacgtacaggttcttgatccctacaatcgctgactacgccttctaggtatcctttgctttgctggtaagaaccttataagagcttggttaggaactccatattgctgagaatcgttgagaggcaccactacacctgcgtagtagattattagggataaccttcaccgttttgtttctgttttggtgtttcaatgtcaggtaacaaaggtgagaagagtccccaggattttgctgattgtgtcagccaagagcaactacgaacactccaacaaaatactcaaaaggacatcacggaggccgttgcaaagtctgtccaagataccttcactaaaatcggcttcctgaaccacatggagaggttggacaagcggatatccacgctaactgatcgggtcgccgcgttggagacaccttccaatgaggaagtggtgagtggtgacaacgatgctcatcctgaagacacggtgtatgattccaatggctatattgacgcaccggctacaaggcaagcacggctatgacgtcgcc

SEQ ID NO: 26418 - DNA, 222 bp, Oryza sativa
agatcaaaagggccggctaatttcctttctcttctcctttggaacggtttgggtcaaatggaacatgttgcatgttctttaaggttatgaaccacagaaatagtttaagatggggaggttctggttctgttccttcctctgtgagtggctatcttcatcttagtcgcacttcttttgaactttcgtggggctatcatgaagcacaccatctgtttgttgaaa

SEQ ID NO: 26419 - DNA, 277 bp, Oryza sativa
atgtccgatatatagaagagaaattttcacgagaaaagttaacgtacactataattggatattacccatatgtattgttcacttcaaaaaaccaaacaaacatacgtatctacagctataaagccagaaaaaaaacatactatgctgtatgctaatagaacagcggttttaaagtagaattttctatattataaaataaaatttattactccgcatatatccatgtatatgcacagtttaaacaagattaatataaagtatcaaatcaactgtcttt

SEQ ID NO: 26420 - DNA, 268 bp, Oryza sativa
  unsure (1)..(268): unsure at all n locations
attaaaaatcatcttattcttctcaggcgggggcgcccccgtcccttgcttccgacttatgccgaagccgaaggaatacgcggttgttgccgcagcnaccgcncggtntgagtgattactggggtaaccgatggcttctcgcctccggctctttcttgcttgcttgcttgcagatgaagtcgcttctctctctctttcgagtctcaccgtcttgtgatgtgctcagctcatgttgggtagggtgtgtgtgtgtgtatgcgtgtacaga

SEQ ID NO: 26421 - DNA, 1501 bp, Oryza sativa
tggaataacattgtttgttacattatgggttatgtaagctgttgacccacaggattatatcggaactaatctcatatataatacaatcatgtcacatgtgttagagagtactctctccgtcccataaaaactaacctattggatgtgacacattctagtactacgaatctggacatatctttatccatatttattatattagaatatgtcacattcagtcctagctagattcatttcgtttgggacggagggagtaaggacgactattatgttgtagacccatcatataattgtaattgtgattgatgacatgattcaggattctgacaatatattggaaacaacgaagtggatggagtctgttcctacccatggaacaaaaagtaaaggaacaaagggtagggtgtggttaatgggtgatcgatcccatccccctatacgctctctcccccatttctcctccttttcttctttttctactacaccataatttttttaaaaaataaaaaaacaaagttggaaaaacgattatgtatagaaatactatataattttttttgaatttaaatttaaattttaaaccggtatgtaaacttttgacttataaactttgagtctataaactaatatttgaattcaaattcaaatttgaatcgggtatgtaaacttttgacttataaacttttggtatataaactttagttgtatagaaatactatataaaaaaatatttgaattcaaattcaaatttgaatcggatataattcaaattcaaatttgaatcgggtatgtaaacttttgacttataaactttggctctataaactttagatgtatagaaatactatatattaaaaaataattgaattcaaattcaaatttgaatcggatatataaacttttgattgtaaactttagatctctaaactttgtgtataaactttagatgtgtaaacttgaggtgtataaacttttaagtgcataaatttactaaaataggaaagtaatacggtgaaaaaaaaaaaacaggtgtcgggagggagggggatccgtcctagcgatcgattcgcgtgcaacgtgagcgtgacctagcgcacggggcacatgcacggtagcaattccttttggcatggcccatcataggcgaggggtagatttcaagcccattgtctcattatccctatccgttgctgcatatccaggaggtttgggccattcaccgtgaataaagtgcaataagttcactttaggtcctttaatatattgctaagtatgaaattcatccctaacctaaaatactattaatttacaaaaccggatcactcaaggtcctacacaatattatgcccagttttagctgatgtgacatgctgagtaagtgatgtgaaatctggcgccgcgacacacgaaggcatgggaggtctacttaatttcagtgcaggttctaaatcttgatgaggttcggatgtgctagttaatttaatcttgcaactaataagga

SEQ ID NO: 26422 - DNA, 1501 bp, Oryza sativa
agtcctacgtgcatcaatgaaggggttgtttagtatcccatgatgtagcggtttgggctgtgttgcaaagcccaactattttgttgcagcagggaacagcccatcctcctgtagccgctgtagttagtagcggatccagaaaatcgattcattggtgtcataacgtgtctatcggtgtcatagtatactaattatatttagatcacagtgttataacatatgaataagcagttttgctataggttttgccgaaaatcgtcggtgtcgcctgacaccggtcctagtactatagatccgcccctggctgtagttgtaggtgcagcgctgcagcatgttgattctccgaacaactctgaagggtgctatgattttttcgccttcactccttaatccctccaaaattatctagaaatatctatatttcggagaaaggggagtactgctcactagaactgagcttaaatccaacaaacaaagttttagaattcatcaccaatacacacttcttttagaatttgccacccaatttacttttcttttagaatacaacactaggctgcgaattttcttcattatgtgccactccatctaccagcataggttgccccatccttgttaatccgcccggtgttgccgtcgttcatccgtcggtgctgccggcgttgtccaaatttgattagcaaggaaaaagttaaagagggaaatataaaggggcgagataagaaagagaagcaatccaagcaaactaagcatgtaagatgacgtcatcagttgatgaatcaaccaatccaggtccggatggatgccaaaatccatcataggcaaacgacggcaaaagcgcacgtaggttttggttcgaggtaggcccgcaatgtagcaggaagaggacgatggtgtcctggcacaactggcgttgcagaggactatagcgacacagtgatggtggcaaacagacgatgacggtgccacagatggatggactatagcgacacagtgatggtggcaaacagacgatgacggtgccacagatggatggcgatgcagatgatggatgtcgacaacgatgacgccagcggacagagggtgactcgactgatacgagtggtgaacagacgaacaatgacttgtggcttacgcgagcgcggttggtggactaggacgacgcaaccgacgctggcggacaaagtggcgtagaacgaaaaaaattcgtatcctaaattcctaatgtcatagtctgaaaacaacggatagactgataaattctgcagggcgcattgaatgccatattttgaaatttctgcagatacggatcatacggtccagatccttctacgattctccggggattgtccccgttctttttcccgggctggtgggccgtccgttgcgctctcccagagtcccatttgccccctttctccctgtcgagcaccgcttggccgccgtgcggcgaaaccctagcgattgtagcggccggaatcagaggcggcggaagccatgg

SEQ ID NO: 26423 - DNA, 559 bp, Oryza sativa
ggccaatagtatcctgtatactcatatgaacgatgtaaggatataaacgaatgaaacgttataaagtatataacagataattgagttttaaaaattgaagcgagattagctttataacaacaaatacgtaaatgagagattagacgcgctttaattatttgaaaataatacacgtttaaccggcaatgctactgaataaatcatagggattatcccgatgtagccgttatagaaagtaagggcattgttccaataagatttaaagaaataaacaaaacaaaatataatgagtaaggcatattataaaaggccggtccaaataaacactttttcttttaaaattaaaaaaatatgaggggtaaaaaatataatttaaaggtttaagcccaataggcttatccgacacatctctgttgaaattacgcgttctctctaaatccacatctatcatgcgcacaccgtacacacacacacacactcacacacacacacacacacacactccagatcgcgccactgcaacaccacgccgcgcctccattccccccgtcgcggtaga

SEQ ID NO: 26424 - DNA, 1501 bp, Oryza sativa
atcacatcgttccaatttcaactaaactttaaattttagcgtgaactaaacacacccgtagttcatcagcaaaacgagaacatctagatagggaacgaagcccttgtttagttcccaattttttcttcaaacttccaacttttccatcacattaagactttcctacacatataaacttttaactttttttttaaacttttaattttagtcaaacttcctattttaacgtgaaactaaacacacccaaaccgagaaaaaatgctacagatctcatagcattgtgaatcactgtagagggtccagctagccaatgccacatctggaataaccagcgtcgtttagttctaaaatatttctttaaacttttaacttttccatcacattaaaatttttctacacacataaactttcaacttttccatcacattgttctaatttcaaccgaactttcaattttaacgtgaacttaacacaacccggatctaatcgacgacagggtgacaaagcagccgtacgactcagatttggccgcatcttctcctctgttacatgccgcgcctacgcatataattaacaacgtcataattaaacgatcacctcaggcatgaacgcttgaacgcgcttgcattctctgcaaccaacctctcgtaatgcgtccccaggtagataatgatacagccaaggtagccaatcaacacatacgcgtagcatctttgcactgcacggtcacatgcgaacgagtaccttcagacgcgagggcacgcgacgagatcgagcataaatgcatgtgtaatgcggcaacgtacgaacgattcgagtggcagctagtgcgcggtccaagccaccgctctggccgctcgcgcctagcttgtccggtactccggtatagctaagcgatcgaccacgcggagcggacacgccacacatgcaatacatgcaaacacatcgccgttttcccccatgcacggcgcagtcgccatcgggacgggagcagcaaggctctcgctccgtgcaacttagtactactgaattctcacttcctggctcgtacaactgcacgagacgccttccagctgaagcaacccgggcggctgggccgtggacaagcggaggtggggaagtggacctcgtcgtcgtcgtcgcaacgggaggatttggtgcatcgatcggcaggagcggggcgtgtctgtccgcgcgcggcgtcgtgcgtgccgggaccggagcctcaccgcgcgcgctgcgtacgatatagcgtggagttgggccggttttttatggtaactttcatggcgacatatgagaggaaacagagatcggatcggtgttgcgcggaaatccattaacgggacaggggacgggccaacggcgcacgtacgggcgttcacgatagtggctctagttggaagtgagtgacgagggcgtcaattattgtcggagatggagacttagagcttatgatctatctgtcccggatcgtctggttgcatatatggagaaggca

SEQ ID NO: 26425 - DNA, 491 bp, Oryza sativa
aatcgcaaatccggaaactggagtagcagcatcagcagtagcagtactaaacttgtactgcaacacatggcaagcagccagggagagagaagaagaagatagagatagggacagagagagcctgtactgcactgcactgctgcctagcctatctatccatccccatcgccacatgcctctcctgcagctgcggcctgcggccaactcgtagtactcctataaggcaaggcctcgctaccccaaccgtcccctttcgcctccgcgtttcatctcctcgcctcgtctcgcctcgcctattggccgcccgctccccgcatcctcccatctcgccgcgttatcgccttccgcctcctcctccgccgccgcctacgcttctcgccgccgccgccgccgcctacgcttatcttgttgtgctggttgcatgcgccgcggcgcaggggctgacggagaggggtgcgcgtggaattgagaggagtggcggatggaggcgg

SEQ ID NO: 26426 - DNA, 1501 bp, Oryza sativa
ctctcctctcctccctgctatgtgcttggtctccgacggaggctgcagcacagtgccatcagccactgacgttaggaacgtgggagtaaatgggagtcacgaaagatgcggcaactctacgagtaaaaaaaagcaaacaagagagagcaagcgagtcatggcctctgctatcttgatctgacgcgaatccgggcggcgccggccgcattcacgcctcgccactatccaactgcttccggtctacactagtcttgacttttaccagcctagtgatatttttatactcttttgtttgcgtttttgatctctctcttgtatccgttagcttctggtgtgtttgttcatggagtggtagtgcaggagtacaagactacaagcagtagaaactagtactagtaccttttatttttggagcggcgtgtgtcggggaccagctagctactttcagctgggtcaagtgcgacatctgcggcttcattgactttggaggataaagaagtaacgtagtggtaccctgctttttagacggtgagcactgagcaatgtgagcaggcaggaagttggggaggagtagggagtatgacttaacgactaactacaatttagaactataaatcgtgtgcgccatgtgagcatctcgtgaaagtgtaacatagtttttttctgtagggtagataaagaaccttttttctttgtcttacaggggaatctgggaatctcagtggtggttagcagtaaaagggaccacttagaatgttttgaagctatcggctttcaatgggagtgtctgtttgtgggttctgtggtgtcacaagaacctagcctggtttaatgtgtgcctacctgtgcttatccgagctaggtttttagtggtagcaagcttgaactagcgtagtttgtatggaagcggaatgaattatcagcttgtacattgcggtggagtgaggcattaagcgttacagatggcacactgtactatctgtagacagaagcacatggagttggcaaaacatcagaacatttgcaatggcatactcgtactgtcatgctaaaggcattttttttctcaatatcttgagtgtattacggtgtacagtgcataattgctagacttttcttgagttatttgtgaagtgctcttcaaaagaatcattgggtcgttgggaaatatttgtgttaaaatgtatttctgaatcagcacattagagtatactgaaccaaaccctgatctccatgtctgtgcattttaaatgtaatatggcggtataactaattttattcaccgttttcattatcgcaagatcaggctccctggaaattcttaaatttatgtcgcatggtcatctgaatgatttaaaatcttgccaaaataagttgaaaataccaaatgatgtaggggtgatgacgtacaatggccttgagagctgtattatcaacagttcctcttatgacgatgatagtggccttagtgcaacaacgggagcagatgggtgtgtaacca

SEQ ID NO: 26427 - DNA, 1501 bp, Oryza sativa
tcaagggggactcacagggaaccgatgaaccctgggaagaggaggagagcggctccgccatggctgccgtatggcagcggcggcggcggtggcgtgctccggattggatcggaggattcccgggggtgccgcagcgaagagaggggggaagagggatcgccgaatctaatcggagagttggtttgggtagctaaagaactgtgttccactagtgactgacagggaggcaactgaaccctggagagggagagccaggttctacaattctgacaggcccttccgtttcggacactagcggaattcgaaatttcgtgaaatcaagtgaaaaaccggtaaattccgaacaaatttcataaaccaaaatttgaatacaaattccctaagtttaccgacaagttcttgaaaaccggttggttttggcaaaattccgatcgaaatcatcgaaatttcgatccgtaatttgtaatagaggtagtttgctgaaattttttttcttgatgtaagttttagtaaatacacgcaatacatcatttttttcgaaaatttatatcccaataggttctatgaatatcatagtatttataagattttattttatttttttcttttttatcaatttaaatttaaatttggatgaaactcctcgaaatctcagacggtttctactttcgagcctcgtcgaaatttcgtgaaatccgaccggatttcgtcggaattgtaaaccctggggagagccgttggcttgggctgttggaaggttccctggcccgttgaaccttggggcgtacggagcatagttttgtagtatagtactatatgagcttctacaaaaatggtagaaaattgatgtcaaacgtatctgaaagctaagtttgtctttgtgccgtgtgtgctactccctttgtattataagtcatttaacttctttttttagtgattttttttatgttcgactaaatttatagaaaaaaaatagtactctctccaggctgataatacttatcgttttagacaagggtaatgtcaaactttagaatttttaattataaatcttttttgaaatatttgtcttttaaatatggtgactacgtatatagattagtcttaaaaagtactttaataaaatcatatatttgttaacacttttatatatattataatgaaaaataatggttaaattgtttttttaaagacagtgcccttatccaaaatgacaagtattatcaactcggagggagtaacatttacaacataaaattagttttattaaatttaacattgaatatatgtttgtacgatatttaacattgaaaaacatggcaaaaagattcgaaaaaaaatataaaatggataacataaatataaaaaaattattagttttatattattagtttctgttgtttctttgaattttagatgttacttgtctttcagatctaccctttttcccctgaaggcatcaatgcatgatttataagcctttcactatataattttcaga

SEQ ID NO: 26428 - DNA, 1501 bp, Oryza sativa
aatttgaactagtttcctctaaaaatttgaactagccaacgtcatataaaaaaaactggagggagtaatatagaacagtgacaaggggtattcttgtgagcatgtcccaaaattgccatacagaggacaccacactgcaagcaccaaacaagcagaaagtatatcaaacaagactaccttctgcacattgtgatccgatggatccaatacaaccctcaggctctttcaatgaataatatgaattaatttggggaagttggcaccggaaaactctaacactgcaacagctcaccagaagaggttaacagaatatacccaaaaagaattgggtgagaacactgtgtagaagaacaacaaaaatattatgccagcttcaccttcttctaggattacctgccctatccttcccctgctcatgctgatctagtagtaagcatgccatggatgggcacatgaacacaaataatgtgcggtgataggctgtctccttgcactgaattggtgcataaacctgcatataaatgattgttaacaaattgatggcttatatgcataaacctgcatataaacctgcagtttgtcatataaatgaaagacaacctggagaacaaaacgtagtggttcgccacagaagtcacagcacctggacttgccagatggcaaataacaggatcaagccaggcctgaagaaagcaatagatttttcacttaagaaagttcaaaatggcgttctaagaacacatataacgcagactgtaccgttgtacgtaccggaacaccgccagctttattggggaagtgttgagggagaagaagatgccagtcctctggtccctctggctcctctatgaaccctaaggttacttgaggatccatgtcctcatcatcctcgtcatctacgtagtcattcttgaatacagcgacaaggtttgtttccttattggggttgatctgaaggctctgaagcttgtcagtgtcaggttccatatttcacagcaattgcctgcaaggaaatggatgcaggaggggatgagtgtcaccaatccagctgaatagaaaaggcaaaacatttcgctccaacaggtgcaaaagggtgcgaacacagagcatgagggtttagttcagcaaccaaaaaaaagaagggaaattaggatatgagcatttcatgttggagtgaggtataattcttcctaactatctttactatttcctccttttcacaatgtaagtcattctatctatctagattcattaacatcaatatgaatgtgggaaatgctaaaatgacttacattgtgaaacggagggagtaattattaaagtgaagtcggaagttcagatttcagcattttacatacagcatgcatccgtatcaatcaatcaaacaatatatctaatgctggccgtgatgggcagtattgattagaccacgtgtcacactgtcacctctcacttttccgcgttcaactttgaccgtccatcttatttaaacattttttga

SEQ ID NO: 26429 - DNA, 1501 bp, Oryza sativa
ccacgggttattttcaaatttgaacggtcaaatagccgttagtgccacgtgtcgccttcccgttggaccgccgcccgccctgtcacgcgccgccggcgctttcggcctgacgggccgcccgggccgtgccgtgccgcgggccgtgccgtgccggcctgctacaggagccatgccgtgccgtgccggcccgcgggctcggccagcggcccaagcacggcacggctacacgggccgtgccggcacggcccgttactgtagcaggccgtgccgggccgtgcctgctacaggaacggccgtgccgcgggccgcccgtttggcccggcccatttggccacctctaagatgaacaggcgcgggtgaagcaaactagacctttttttctgggccaaaaagggcccaagctgaggagaggatttttattacttttccaattaaccaatgaaatgaactacttccaatgctcacataatttcatgaaaaaaatcctgaaaatacttggacacttaaagtatttaacaaattaaaatcagatcatttaatgattaatttattatttaaatattattgaaatgttcttttattattaaaattagtaattgagctctgaaaaatctgaaaaaaattccacagagtataattaatcatggagagtttaataaaaattaaatccaaccatactttatatttagaaaattttatttcccacatttaacttcacttgtaaattaataaatatttaatataaattctaagaataatttattaaataatttataaatcctgaaacgaaaatcatgatgtgacaatggtttctgccagtgctcctagctcccgcaatacccccgtgcccctggccattgcacatcactcggtggctcggtgccattgacgacatcggcaagatggagacaaatcggtttaagagtagtaaaaaaaaatactccctccgtccaataatatagtaacctagtaccggacgagacacttcatagtacaacgaatctggacagtaagcctgtccagattcgttgtactatgaagtgtcatatccggtcctaagttgctatattatgggatggagggagtactcgctaacatataggtcccatggatgtttctttagctctttctatataacagccacatatatgctatgttagtacaggtggaccaaatcagcgtgccaagccatcgaaaactgcccttaaaaccacagagggagtcattttgtgttgttttaatagttagaggggtcgatataccctagttttagggtcgagggagatgaataagattgggccactagctgagggactcagattggactttctttcccctattttcacagttggttttgtgctgggcccaaaataaggagggcctctcagtcgcccacaacctcagaccaaaaggcttgtgcactcgtctctcatctcgtcctcctcgtgctcctccgccaaaaccccaatccaatcgggctccgactccgactccgaccacc

SEQ ID NO: 26430 - DNA, 1501 bp, Oryza sativa
ttgagtgcctagacacagaggtgcttgaaacgctgccctaagaatgttactgagaatggcaccaacactaacattagttaggccattaagattatcccatgaacaagaccttccttgctcattgtaaaacttcaggttatttgaatgcttatgcagttatgtggttatgtctgattgcaattcttttctaggtgcgtaaaatcgtgaatgtagcacacgatattgtggttaacttctgcaatgccattagagcgcccgaagcgttcaaattagtggctgctgctgaggtatctttttttaaaatggtcgctcttttttgagcatttgtttctatttatttgcttattttctttgtcctgtctgttataatctgttgacagaatgtgaaaccacatctgttgaagatagatcatgatgacaaccttctgtttctacaatttaaggctgcactggaggtacacgctgttgatgcaatatacaagtaaagaagtaaatgtcaccttttttccctgtagaatctaatctgtataatatgcagagggaacagcaggttcacaatgttaaccatgagattgctatatctcttgacaagtacaccaattgcccactgtccgggacggagattgcagagttaactcagccattgagaaggtacatcgtcagcaaaatatacttcagttattagctcctctatcacaaaatagtgctgttttagacagaaaaaagtccagaatccagatatcggattggttgctaaaaattccaatgtgcaatattgagcatataatttctggtgtgaaatatttgtaacacctaataaaaatattatattttcaatgcaatatttgatcggacaaaatttataaaattggaccatgaataaataacatttatttgtgattagatatttggagggagcactccctagcctaataactgcagcctacttcactgattattttttttctttgattcattatgacttgtggccacatattcgagcggcagcacatcatgaactacatgggttcctctctcaaggggtgcccggtcattggttagtataagtgttcatttgtgaggataatttttcaaatgtgccatcacaagtatacaactggatttgcacaatgttacttgaaatgccattgacttcatcagggaatactattctgaaatggttaataggaaccttgcatgtaaaaacttctccatccatttgttagcacttagcataagtctacattattaggaagtatgatttcacaatgtaagtcaacaaaagaattcaagaacatcatcgatttatcattgcaatatttctatattctatctctgatttaataatgtaaaagaggtttgatatttctattatactataatgggggtatatggcccaatgctattagctttgtattggacttttaggtctttcaatgttggggggatgggagctactgtaatatttatcgtgaacaaggagggagggggtagtataatg

SEQ ID NO: 26431 - DNA, 1501 bp, Oryza sativa
ggcgaagactttgatccaaggacgacggctctcgatccaaatccaacagcgcctgcgtgcagggaaggggagctggcgacggacgccgctgcgggatacgggtggtggaaggcgacaacggcgggggaagggcgagggcatgaggggctgaggggatgatatacttgccttggcagttattgcgacgatgcggggattgcgccatcaaggaggcgagattgacgatggcgatggggatgagaatggggatggggctttgggtggatgatgcagcgatggatttctggccgatgatttcaccgagccgattgacggatggagaagtggtggatcgaggcggagcgagtagaagcggcgcgtgttggcggcggcggcggcgacgccggaaggggacgaccctccgaaggcggcgaacggggaatgcgaggaggaagagggcggaggaggaggagcgccggcgggagcagcggtggggcgaggagaatcggcgcgtgatggcagcggcagcaaaagcgctggggaggagcgcgagtcccgcgtgttcagcgcacgctcatcgcgcgaggaggaggaagcggacggataggagagatggcggacggacgatctggatcaggagagacgcagatgaacggtagtgattgattcggatgatttcaccagtaggattggagggggcaactcctcttttttatattagtatagatatagaagtatagatgtgcaatactgtgatcacttagctaccgtggagagaaatggatattttgttaaaaagtaagagaagttctacacatgattaagcattaatcattataaacttgaaaaaagagattaatttgatttgttcaaacatcttctatataaaactttttttactagaaaaaacacaccatttagtagtttaaaagtgtgctaatgaaaaacaagtaagttaaagtttggattcgaaggaaaaaattcgaaattaatcttttttttaagtttataacgattaatgattaattaataatatgttaatgagttttatccttttatgcgtacgatgaatctttcttcaaactcgctagaagaaagcagtcttactacaacatactctatatatcgaacatattattttcaaaattttctaaagcacacaaaatataatctgaaaggggttgtaaaaccagctctctcattgtgagatatttgtacgcaaaaggccagatattttagcggcgaaggagatctttcccgctacagggcaaaagctaaagcgcctaacaatgtacttgagcctcgcgttctcttgtcccatagcgaagaaaacagaggcggctggcaagaaaaatgaaaaaataacaaaaaaaaagagggaaaaaaatcaaggcagaagaatactcatccaatccaaccacacgccccggccagctcgtcgtcgccacctcaccaccacacacgcgcagccaagcccctcacctcacctcacctctccatccacgataatatcatgatccat

SEQ ID NO: 26432 - DNA, 1501 bp, Oryza sativa
actaattcaaatagacaagtcagggtgcttgtcaacatttgtcctatctgtttttatattgtggaaacaaatcacagaatcacaaggctaccaaataatagtatctagagccttgatgaaagaaatatgtgtacaaatacaaccttgtgcatactagtataattgcagacgaaaacttattgtcagtcacatatttagatttcaagctgactcggcgtggcagccctccatgacgaaaaaaagacattctattgattgaattgctggcctatgtctatacacaattacatacagctatcaaacatgtgtactttgttgaattatatattcaaacgttaattttattaattagttggcagtcaggtgttgtatgcctaaacaagaaaattccattgttcattttcattcttcatgatggaaacagatgtttattgtaaaaggttatttaagttgtacaatataagcttggtatatggaactggcaaaaatcaaaataatgaatatgtagaggttatcgcttgtttgaacaaatacctattgcatgtatagtttggaaaaatagaatttacctcaagaggatcagtttctccctcaagctcaaccataactggagcattcatgctataaaacaacagcaagggttattaatactgtatggtaaactattagccatcaaattggcaatactgtgcaatatgatatatagaaacataccttatctgtaatgcacgtgtacccaggatgcgggcacgctcatactttgtcatatactttgacgttttgcgtgggcgctgagttttttcttgttccttatcttcagcctctgcccctacaacctcatcagggccatcctcgttattctcaggttcctcttcagccccttcctattattgaacagaactccatcagttcttttccattaacagataacatcactgcatgaggatagcaatgtgtgtacctcaatctcaggttctggtggctcatcctcatacctgcagaggaaaatacaatgccattccaaaatcaatatccaacaaaacaatcctttaaaatgacatataacaatcagtgcttcagcaatcatatagttgtgcaaggataatggtagatatctcactaggatgaaatgtaaaagaaattcaaaattttcacttctaccaacactaatgaacataactttggtctgtgtaatttagtaattacactaaaattgaatattcctgagaaaatggacatataactaactaattcatatgttttaaccgccaagccaccacagtaaattaagcagaaaagaatgaaaccacacattcttgttccaattagaagcaagatgttagagatcctctaagtttttagctagcgtgacaaagttaggattccatattagtacaatgaccatctatcttaatatgtaatagattttttccatttttatctttcatttttctccttgttttccttatatgcatatatatttttcccctttctttatact

SEQ ID NO: 26433 - DNA, 1501 bp, Oryza sativa
ggttaaacttttgaggtagtacatgctctcacacagatgcagctgtacctcaagagtcaaggagtcaagacaggattaccattctccatttttacattttcagaaagttacaccaaatgattcgttcgaaaaataaaaaagaaagttacaccaaatgatgaggatggcaatggtttggttcgactccacttgtccattaaactgatatataaatttactctaatgaaattttaggttcactctaaaatttatgtctaaaatgttcaatctaaaacagcttcacatgtataaatggtctaaatttgtgcaaatttgcttctctatataataaatcatttctataaaaatgaactgaatttaataggtttttatattatgaacactgatttaaaatttttggtccaagttttatgcacgtgtagtaaattttctctcggtctattactctgtataataatcatttctatgaaaattaactgaacttgaaaaatttttatagcctgaaaatgagtttaagaatttttgtcccagttttatattgaaaattacttgatctattagtaatatatagttgattcatttggatgtctatgataacctatcaatataatgcatgatctcgtggtggattgatcattatagatcatgaatctagaaaaaatagtttaggctcgatcctactcctccatcctataaaagacgaatctagagctggatataacacctaccctcgtctcaagaaaaaaagtccaattctagctacgaatctggacacatgcgtatccagatttgtagctagaatttatttttttaagatagagtagtatgttcaaatttattatattatgttgtgttacatctcatgttagattgggtttcatgggatgacggagtattaaccattccaatcctgacggaatgaactctgctccattatcctcgcagaaacctttcccgtatttgctctggaggctggacttccactttctgcagagtgcagatgtgcctaacactggcactgtattcaatccccgtgttcactgttcaattcaccaccactgcacgtcttaacgtgcggcatcaatggcaggcgttgcgttgatgacgagatcctggcgtacgcacgcactagatgatacccaaggggaaaaagagaggacacacgagctcacacaagagacgcggcccggcgtggaaaccgaacgggggccgcccactctgcgttttgcatcggcagaggcgcggtggagaaaaaaaaaggccgagcttggatggaaagctccaagcttttgcgctgttcgcttgcctgagccccccgtcccgtcccgtcccctcgcctcggcaagaacaaagagcatgcgagattagatcgagacggcgtatccggtaagcgctgttccatctccggcacaaaagggtgagttcttgggtggttggtttggttatgtgtgttcttctgcagctcgtgtggttttatctgtatctcgttttcgcgctctcg

SEQ ID NO: 26434 - DNA, 551 bp, Oryza sativa
tttttaaagtgatttcttatacgatttcttatgtatttccaaaagcgaaccgaacttaaaaaccgaaaccggatttgtattttcaaaagcgacggacttaaaaccgatttttttaaaccccccaaccccggggggggaaaaattttggggaaaaccccccgggttaacttaaaataccagtaaaatcatcttcaatttttatatcgactcttataaataagaaatgccgatgaaaataagaacagaacttgaagactgagcttcgaatctatgcttcctgatgagtctcgccacatcaaaaacctgcattcagtcagtcttaatacgcagcccaaacttctgcagtccttatttgtgtgcattcgagttttcgatgatattcgaagaggagaaccattagccctgcagctctagtctcatcgcccctacgactcccctgaaccctcgactccttcccactagctcgccgctgcctgagcacaccgctggagttccacgtgggtgcaaggatggcggcggcggggttcctttcagctctcggcaggcctcta

SEQ ID NO: 26435 - DNA, 292 bp, Oryza sativa
ttaaattattttagctttatcttaagttaaacttatctaacgtttaccgggtttatggaaaatatacccaacacctataacaatatatatcattaacaaaatatctttgatgggtaatttaataataaaattattctgatcttgtagatgttggtgcatgctgtcataaactcgatcggtcaatgtttaacaaaattgacttagaaaaaatgatttcttttctaaaaataattaagaacacggccctctcctattcaaaccagatgtacacagccatttggacaaaaacaaa

SEQ ID NO: 26436 - DNA, 180 bp, Oryza sativa
taaggaatttctttcttttttagtgttgcggcaaagcggatcgagccaaaccgaaaagactcggaggaggagagattagaacgtggtttagttgggctcggactcggactgcgcagtgatttacttgggcttttctctttggaataagttcactttaggtccctctatttgtcggtcagt

SEQ ID NO: 26437 - DNA, 210 bp, Oryza sativa
ttcgccgcatccccggcgacctcgtccacccctccgtttcgctcgccgaccgccggagcaccgtcgaccccgtccacccgagccgcgccgccgccttcctccgctccggtcgccgtttccgtcgtcgccatcgacccggggtgagccgtggaccgccgcttcttttcccccttcccttcccctccctcggccgccgctccgccgtgccta

SEQ ID NO: 26438 - DNA, 236 bp, Oryza sativa
  unsure (1)..(236): unsure at all n locations
tctagcgccantatncgagctcggtaccctgatgtttatcacagctgcaccaagtttgggtagtgtacggcgtacctatatcgatattaatcaacagtggtgtggttctataaaagcttgaataattatgttcggctatttgaacttttcacgtccctttctcgctttagattaatcatgcttcttaagtactctttacaatgtgaaataatgaatccccttttcatccaatacag

SEQ ID NO: 26439 - DNA, 391 bp, Oryza sativa
cacaggtgctgattcacatgattttccatataggatcgagcatatttctgagcaatcaaagatataaagatcaaaaaaataccctgttccccaaacccaacaactacgtaaatgcatgtccctctcaaaacctcaaattaaaattgactcacccctaaaagttttccagccccctcagtgggccccactacacacgatcagcatgaagtgaacacatgctttcacacaccatagtctctctatatacatctctctctatatatatacgcactaacaccaatagctaatgatgcatgtaaaatacataaccctcacttgatcatcatcaccaataattccccatttgcaacacacaccatggatttggagagctgcagctacgtgctgccat

SEQ ID NO: 26440 - DNA, 1501 bp, Oryza sativa
cacaattatctcaagctcaagatgcccggcccggcaggagtgatcgtggttaaggggcttcagccttcggctgcttcaaaaggtgatttggccataatcaacagagcagtgcacaatgtagaggccgaaccgcatgaccgggcgaagcacgcgccaaagcccgcccctcacgacaagatagtcaagatgcagattgatgatgccgaccccacaaagctcgtatcactggggggcgacatgggcgaagaagaagctaagaacatcctagaggtactcaaaaagaacattgatatcttcgcctggggccctgatgaagtgggaggtgtttcggcagatctcatcatgcatcacctggcagtcaagccggatgccaagccaaggaaacagaagctacgcaagatgtccgttgatcgccaggaggcagcaaaagccgaagtccaaaaattgctcaaggcaagggtcattcaagagatcgatcatcttgaatggctggcgaatctagtgctggtgcggaagtcaaatggcaaatggcgcatttttgtcgatttcacatacttaaacaaagcatgtccgaaggatgatttccccttgccacggattaaccagctcgtggattcgacagccggctgcgaactcatgagcttcctagatgcatattccggctatcatcggattcgcatgaacccggccgacatccccaagacagccttcatcacaccgttcggcaccttttgtcacctcaggatgcctttcggtctgaggaatgccggagcaacctttgccaggctgatgtacaaggtcctttacaagcaattggggcgaaatgtggaagcttatgtcgacgacatcgtcgtaaaaagccgcaaggctttcgaccacacgtccgacctacaggagaccttcgacaacttgcgcgcaaagcaagcttggccccgcgagggccgaagaagccttttccggcccaacaagcctaggggccattggaccgacgattgcctaacggcccattaggagtccatgaacctctattacactatgtacccatgtaaatgtccctttcataagggtaaccatgtaaattctcctgtataaccaaaaccctagtagtaagaacctgtaaaaggagctataaatagtctcatagggccatgtaatagggggatccaagaaaaattctctaatcaatacactttactttcaaccactattgagtaaccacgtctttcgacatatgcagttgtcgtttcgacaacaggggtcatgccctagcctacacggcgaggaaagaaagattggatttgacatggttgaagaagacctactcagatttaatcagactcagactgagaatgccaaaaatagctttacgagttcccttggaatatgagatgactagggatatactcctccgtccaaaaatataatgaatttcggacgattgagacactttctaatactatgagtctaagtctgagtctaaaagacttagactgagaatgtc

SEQ ID NO: 26441 - DNA, 426 bp, Oryza sativa
aggcagaaattcagtattctacaagatgacatcaagttcgtgcccgccgcagagaaggacattgcttggctaacgttcaaggagagttttgattatcctgcggagcatgaggaccgtctcaggcgggctgctttcaaggttatgggcaatgcttagaagaacttcaagactaagctagtaggcgagttcatctacaacccggcgaatccagatccaagagagaaattccatgtgaagaagtcgaccctagagtcaagagctagaagcaaggcatatcgcttgctctagaccaggaaccaacatccgcactagcttggcaccgccggataagccggtaaggaagaggaatggcagcgtgaggatgaagaagcggaagaatcgtgcacaccgctcgtgtttggcgatatcccacaccctcgggctagg

SEQ ID NO: 26442 - DNA, 1501 bp, Oryza sativa
aggccctatatgaagtgggatctaacttgggaacagttatggaagttgacatggccacctttagggctagcaatgtgataagatttaaagttgggatgatggagcttgagtcgctgcccttgaagttaatccttactacacctaaaggtctgctgtatcaagcccactttgagctggaagaagttgttgagcaaggatggttcaatgagagtatctttgaggaagttcaggtagggtctgaaagtttcctgaaaagtggtcagaaatctggtcaaagggatggcaagcagattatggagatgggtgataagatcagtcctggtattttgctaagaggcaatggctcaaaggatgatcctacagatatgttgtgtcctactacaatgattgaggaaagtcaaatcaagtgtgctcagatactgagagacagagcgctggcttttcagcttcaggaagcagaggctaagtcgaccacagattgtggcatagaagtaggtatgaccagtggtgagacaatcctgacggaggaaacacaagttcttctgacacaagacaaaaaatgggagcaggctggaaatagagggatggcagtgaacacaatcgactctgaggcaactgaggtgggtgatgaagggatagacagggaagatgaaagagtgcacttgggtgacagtgaggattatatggattcacaagaatctgaaggaagttttgccaaaagactggggatcaacttagtggaggacaatacaggtagtcaagaagaggagatgagaaggagtaaaagactgaaggaaaaggaagacttgaagccacaagatatggccatgcaaagaaaggaagctcagaatgcttttgtcaacaaaggtcagaatacagtaccctctattattaatgaatcaaatgtctctcttatcaacatggcgaatattctgggtgttagtttaggatgtgctattgaagatgtggaaagtaacttgaatttgattaaaaatctggaatctgctagaattaacctctttatgaaagagggtgaagcagataaaaatgctgaattaaagaaaaaagaaatggaaggcatgtctactgatcaagagtggtcagatgattcttctgacaattctactcttgatgagattgaacagatgctgaaacaagtctagtcttcaatgaaaaaaagcaatcagaggaggggaaaccttgagatttcaaggtcactcccaagagttcaaagaaaagaggtaaagtaaaaaagaaaaagaaatgaaaggcttattttggaatatcaggggaatgggtaacattgaaaaaacaggtcatttacaagacctaattagggatcacaaactggactttgtggctattctagaaacagttaaacatgatttttcaactgaattgttaaacaaactaagctcagggagaaatatgcattggtgttggatggctgctcgtggtagatctgggggaatattggtgggaatggataaggacaaagtca

SEQ ID NO: 26443 - DNA, 1501 bp, Oryza sativa
aagctgagctcatatctatttcaacaaaggaatcaaaccaaggttcgttcaggttcaccgatgagcgcgtgccaacccacagattcaccttcatcccgtctcattaattaactaattaaataaactaaatgttacttctcaacaaactctcatggatcagcttgatcacactcacctcgatctagtcatgattgatggatccatattgatttcgcggccgggccatacagtccatgtgaaatcatggaaatatcgttattggtaatctgtgatgatccagacaaacacatttgccaccaccacaaattgcctggaaagagcaaggccacatgtatgtacatgatattgtccatctttttcttcctttgagccaagagaataacacatacatagctgtttttgaagtctttttcaaaggaagaaaatggtttgcatgtatatattgatgtgccatattgcatatccccaagcacaatgcaacattgcacgattgcgatgagcactacctcccagccgtggctcctccaaaaaaaataataattgtttctaattggggaaagagagaatttttttttgacaagacatggttctactgatcaaagggtgataggtgtggttttaaacattaattgtggttatctcctcaagtctaggtagggaattaattaaggatgcgctcacataaatattaattcatgtagatacatggaaaagtgcgacatatatatttacgactgatcataataatgaaaatgatcttgaatatagtcatgggttcgtacacatacttgtttgttctgtgtgttaggaattaatatgttgaacaatcacacaaatctcccacatacgtcttacacatatgtagtcactttaatttgtatctcccaaaacatggtccctaagtagctaattaatttacttgtgtactcttagtcgtagatgatattgtttttcaaccaaatgatatcgatcgatggcacacaaactaagattacatttgagaggtttggcacaccgacaatgacacgggagaatataacatatgtggtgcatgcctttttgtttcctggctcgacgcatctcgatcggccgggcacgtcgatatcgacccactctctaggtctcgaaatcattgatatgatgaacggcttctccggtacacataggtctgcatcgacgtagagcactctcatggtcgttactccttcagaaaacatgatttgtttttctctttagtgggtagggcagattgtgttatatatgttcggagttgagggggtaattcgtactttagcgatagtttgatggaggtaaatcagacaaaccttttattaaatattaattaagtttagtgtttatatatagtttatatcttctccaatcaattcagatgttctcgaaattgcatgcgtgggtctcaagaggaagtcaactcctcatgcgtatatatatatatatgtcgtccagtattataataatgttgttattattacatgaatat

SEQ ID NO: 26444 - DNA, 1501 bp, Oryza sativa
ggcataatagggttgcatttgcaaaagcagcatttaacaaacatttgagaatttaataaaatagttaagtaattaaacaatattaatccaacgctatacaacataccctgttgtataggcccaaccattctgaacaaccaccccggctgcacagttctatctccaaaccaggaatgtaccattccaaaccaggagctaatcaaattattatcagtttaagcatcttttattataatgagaggtgtgagactaatcacgaaagacattgttcgacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgcccacaacccaccattatcaggttttagttggcacattaattaattaactaatcacgattgaccatcgtgaactatcaataagccatcatgaaataatagtgagtcattagttatcccataaatgtactaatatttctaagcagggctaagcaattatatctaatatctagttgaaccaatataaataaagctcaactagtcaaattgtaataacccaaggtatcaaggaataaggtaatcaagtacaaaagggctataacaatcaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcggctagggtttgggtggaccgggcgcacgggcggcggttcacgcgaacggacggccgagattcgatccaatccaaacggacggccgagatcgatcgggtccacggcggttcacggcaaacggccccga

SEQ ID NO: 26445 - DNA, 578 bp, Oryza sativa
aaactataacacatatatgtaaaatttatgaataatattactaacatttcgtcagatgaagaaataacaaaaataaaagttttagatcttgatgagttattcaactttgttgttgatgactttttcaattgaaatcatttagtatttgaaaatgttgtttgaagttgtcatatttttaaattcaaattcaaactgttcaaaaaaaatgttatattgaaaaatgaccaaactaaaagttctaaatattgataagttatacaactttgttgttgacattttttccatttgaaatcatttactacccgtaaaattattttgctatagtcaacttacaaatataaacatttcatatgaaaaatggaaaaatagtcatcggtgacgggctttagttaatgcccgatagagattaagtatatagcccgtcactgatgagtcatctgtgacgggcctagttgttatctcaaacaggcctcaagttggtgcacgtcacagatgatggtcatttgtgacgggccacaacttgaggcccatttaagatatggaatgttatctcaatcgggcctaaagttgtggcccgt

SEQ ID NO: 26446 - DNA, 1501 bp, Oryza sativa
ccctaggttatgccaaatggttatccatagaagccctctaaaaatattggaaaagtagaactgttcttctccctttctcttttaattaaaccaaactaatggcacatgcacttcataatctcttttaatggttctcattcaaaatttattccagtgttattagtactgtacatctattactgtactaatggctcattataccagcaaaagttttacaatactgttttatttaatcttgctgcaataaaataaatttagcatgttgattttataattttcttttatttcttttgaaacctattgttcaaaagtactaaaattgtaaccttgtttccaactatttcaacttattttgcaagcttggtttaccttatttacttccctttttactttgattttctaactttattcaaattaatccaaaaacttgtgctattaattggataaaggacttaactccctcctttcacttgtctttagatgccgcgttacaagcctgagtacctgtttggtgttgagggttttgtccaggagttgcgtacaatgtcctttgtcattggatttgggactgcccctttttatgcccagattcctcatgatcgtcatgaagagaagtgccgagtcaaagtcactttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgttcccatcctcgtcaaccccagggaagtgaccgtggtagttaccttgagactgaaggaattgagaatgatgctaccacgaagcatttggttgagatgttgtgggctatggatgaaagtcgtgcggagattgtgttagcagctcaagatcgtgaagaccggaatcgtggtaagatttgcaagttagaagacaaggtggatcgtttggaaaaggaattagccgcattgaagggagaagcaccgccgcagaaggccaggattcgtctcaccgcaaggaagagagctctatttgtccctcgctatcaactggcgccaaaggttcgtgtggtggagaaagaagttgccccagctcaagcggatcctccggtcatcatcataagtagtgatgaagaagaagaatccaagcgcaaccattccaagattgagtgggtagcaacccaagatgatgaagacgagccgaacgagccttcaatcgacctccgatgcttggaagaactagagtgacttgttaagtcgttgtcttagatcgttgtgttagtttgcttgcttaaagtttgcttgtgtgtggctcgcatgtgatttacatcagtggtgggatgtaagtgcatgcgtttgtttgcttttgagtgttaggaagttggtgagtttagtggtgtgagagtctttagtttgtaataataaaactcagtcaagatcaataaaagttaaagtaattctctgttct

SEQ ID NO: 26447 - DNA, 1501 bp, Oryza sativa
cagcgagtcaaggcggaacatcagaaacccgccggtttgctgcaacctttgaagattcctggatggaaatgggaagaaatcggtatggattttatcactggtttgcctagaacgtcatcaggccatgactctatttgggtaatagtcgacagacttaccaaagtggctcattttattccggtaaagacaacctattccggaagtcgcttggcggaattgtatatggcaaggattgtgtgtttgcatggcgtccctaagaagatagtgtctgatcgaggcagtcagtttacttcaaatttttggaagaaacttcaggaagagatgggttctaagctgaactttagcactgcttatcatccgcagacagacggacaaaccgaaagggtgaatcaaattttggaagacatgttgagagcttgtgctttagatttcggtggaagttgggataagaatctaccttatgcagaattttcgtacaacaacagttatcaagctagtcttcagatggctccttacgaagcactgtatggtcggaagtgtcgcactccgcttttgtgggatcaaacgggagaacgtcaggttttcgggacggatatcctaagagaagcagaagaaaaggtaaagatcattcaagaaagattgcgtgtggctcagtctcgacataagagttatgccgacaatcgccgcagagatttgagttttgaagaaggagactatgtgtatcttcgtgtcacgcctcttcgaggagttcatcgttttcacaccaagggaaaattggcaccgcgttttgtgggaccttataagattgtcagtagaagaggagaggtcgcttatcagttggagttacctcaatctttggcaggagtccataatgtgttccatgtgtcgcaattgaagaagtgtttaagagtacctaccgaagaagctaatcttgaccagataagtgagagaagaaccaggaatcgagttatccgtttttgcaaagtccagtggagtaatcactcggaagaagagtcaacttgggaacgagaagatgaattgaagtcagctcatccgcatctgttcgccagttcttccgaatctcgaggacgagattctgtttaaggggggtaggtttgtcacaccctgaaaattcaaaatatataaattgttgtttaattggaatttttagaaataattttaaaagtcttgaaaagaaaatctaattttaattaataaattccaatataaaatggggccagataaaatttcattaaatactttgcttaattctataattcctagatttttctgggatttatttgagctaaggaagtatttttaataaatggaattgcatttaaggaataattttaattgaaaaaggttttaaaaagtctcttttggctttgggccgaaagtcggcccaaaacctctcttctctctcctcggcccaagccggcccagtccgccgcgcgcgcgccctcgctgtcgctgacaggtgggtcctgcctgtcagagt

SEQ ID NO: 26448 - DNA, 1501 bp, Oryza sativa
gtcgtttccggagagtccgttttcgcagaagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgattgttatagcccttttgtacttgattaccttattccttgataccttgggttattacaatttgactagttgagctttatttatattggttcaactagatattagatataattgcttagccctgcttagaaatattagtacatttatgggataactaatgactcactattatttcatgatggcttattgatagttcacgatggtcaatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtcgaacaatgtctttcgtgattagtctcacacctctcattataataaaagatgcttaaactgataataatttgattagctcctggtttggaatggtacattcctggtttggagatagaactgtgcagccggggtggttgttcagaatggttgggcctatacaacagggtatgttgtatagcgttggattaatattgtttaattacttaactattttattaaattctcaaatgtttgttaaatgctgcttttgcaaatgcaaccctattatgccatcctttgttatcctgtgcacttgcatatttgctgcgtggcttgctgagtatgtcatatactcaccttgcaatcattcatcagaggaagaattctacaatgaggctgatggtgtggaggattaggtgtagccttggtcaagctgcctgtggagtggagccgtctgcgccgtttattttatttttccgctgcttagatctttattggttgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacagcgcctgcacgt

SEQ ID NO: 26449 - DNA, 456 bp, Oryza sativa
gggggaaggtttttgacctcaaatctttgattgggttccatataaaagtgtagagctcgttctcctccttcatttgcttccatttttttcagttttcatcggtggaatacgaagaaacttgcacttttataaatggaatagtgtaggcacctttttgtttttttattttttaagcaaatacatattgcaatcttttacatgtttataaaagtaattagcacctaaattgaaacgttgggtttgcctcttaagtttattttcatttggatgaaaaaggacgaatatttttattttttagaaatggttagacaatattctattaatgcttaaaattgatgtgcggctgtttaaatagtccgttcaactttaaattactacgtgattagttccctccaatttaaatacattcgtgtttgaatcaggcatggatgtattaatggcaagctttattgtaga

SEQ ID NO: 26450 - DNA, 1501 bp, Oryza sativa
ctctgcgtaccttgtcgtgttgctgggcttcttaaccggagaagcaccaggaaccagatctagagagagatgtcaggagtggaaagagaagggaaagaaggaagaagacatgggcattttggtccactagaaatttttagtgcagcgaaggggtgttcagtggcacatatcaaatacccgttaaattgtaatgatatggttccaaatagttaaatagtagtggcatttttcaaaaccatgaaagtaacaactgcatggattctctcccctcctgtgtgtcacccattcaccaatcccatatgagccccttgctccatggtgcagcagtgaagcgactctcctctgcacataaaggccaacactgttcctggccttctcagcacaccctgtgagttaaactgaacacgactgtagctgcatctagttacaccatctgttttgacttgccacttgccaggtacctgacacatacggcaggcaacaaaaatggtagtaaacaaagtgcaaaagactacttgagctgctgccttagatcatgtctctgtctgaggatagtaaccaactgaagcatattaccctacattgtttgcatttaacacatttgccgaaatatatacatgtgcactacagatgattttaccctttgtaacaccccatcttccagaatccaccaatgcatagtcaccccagtgttttggttggtttcaaccacgcatacgcatagcagtctgctcacacttttgcccttgcctgatgatcctttgggtgtgtttgattataggaaaatgagatcaatggttatcttaacattccctgatgtcctaactgtgggaatttgatcacagggaatgtgacattcccagcatgcacgcgtgagaaaagattctgcatgctaggaatcaagctaacaatttttacaaccagacacccttacatcataatgtgtggataaacatctgttgaaatgaagttggatggtgaggacttgaagtagaaacagtagtaggtgaaggatagatctaaaatagccggccatgtggaaggcaaaatctagagtttagggagtggataacttgaccctcaagaagcttatctttattccttatagttaggagttgatggtggttctgttttgtcctcattcttcggtggatgatagttatgtgctatttttagtgccatttgtaaatggctgcattgtttatttgtgtatattttcaggtggctgtatttcttgcgtgaattatgcacacaataccttaaatttgattatcacaagtatttttatatttaaagtttgagatttgtggaatttccgatgacaaatgactggttattctatcatatatcatactgcagctttgttgagtgaatggaacattaaaatctgttttcagaaagttgctcatgtggatttctttattaaatagttctttgtttcatcctgttttattgtggtactgaactacggggttacataatatatacttggtttgacaga

SEQ ID NO: 26451 - DNA, 1501 bp, Oryza sativa
taaatcctagatttaacatattaaggcgggtgcttggttggtggaatgatgttgaaactgtatgtgatgctggttcgcctgaataggttgctgctggatgacattgaccaacttcattgtttagttgggtatatggtggcatagatttctgcttggtttttaggttgggtatatatcagttgttctcaaggttctgaatatcggttttgccagaaatctcagcacccacaccctggattagcagtcttctagaacaaggttactgccaagattttggacgtaagttgttgcacgaatttcctgatatatgatattggcactaccgcactaatggacaaaattacatactttcaaggaagattgtgtctgctctttaagcctcatcagctccatttgtaaggcatcgtttgaccgtttctgatcatcaattgatgattgatattctcttgtcctgccaataagtaatcattacgatacattgcactcgtcagaaacttgtgcaggcaagtttagcataatgagaatagcttttaaaacatcaagttagcattccacttacaattgctgaaatgtttaaaagacacaacaatgcaaaaataaaatacatgaaataatccaacaataaactttagggattaacaaaagcagagggaaaaagcacaaagtgataaaccatatgcttaaaaaaaaggccatagcaaaaataggggaagatttaagcagcagccctataaaactccattttccctgccaaaaatctgtaggtcttgtactctcgttcttcttaatgaaataactaagatacagaacccatactttaacaagactagccatatacttcttcacacgcttgaaatacatttcagtcctttagattgctgcagtcatagctagtaatattttattaccaaaaactaatatatgcatgacaactaatatactgaaaaagaaaagaaaccaaaaaaatagtagtagttactggcgagaggtcatgatcttagagcaaaattgctacctattaatttctgcacattcttgctatcaagttactggcaggaaaacatagcaaaacttcgccatcctatcaattccatcatccagtatgaaaaccaaacctctctagatcattccaatggagaaatacaaataaatctagggtacctatcaaacaaattgaataggaaattatggtacctttcctcgaatttggcaaacttttgtaaaattgcttcttctcgctcctttgctttctcacactatcaatttcaacagaaaaaatatgcactttgtaacaaagagcaaaagtcacgtatgcagttatcaactctcctgctgcacaattagatttggcaggtaaactcaataaaaaaaaccttcattaacgaattgtctcgttcagcaaatgcttgagcaacgctgctttggaaaaaccttacttgcttctctagttccttgttctgcattattgtttccaaaaagaatgtcacctcaaagataagca

SEQ ID NO: 26452 - DNA, 351 bp, Oryza sativa
agaagcggcagtaaggtttttgggaagcgcttcacgcgactgctccctgtttgtccgcgacggctcgccttcctcttcgttcgcgtgctgcgcgccttcgtcgacgctcgcaaccgcgagtagttcctgccgagcaaccggtctttccgccaccttggtacgtgttcgacatgttgcgcatatttgatctgtttatgttttactgcttagtttacatgtgtagatctaatgatgcgttaatgctagtatacatctgtaatgtcatgatttatttatggaatatattaaatcattatatgcctatattctcaacaatccaaaaaccttattataggcgctatgattttacta

SEQ ID NO: 26453 - DNA, 1501 bp, Oryza sativa
tatctgtgtcgaaacaagatttcggcaatactaaaagggggtggctatcaagctggaaaagtgaatgggttgagagacaaggaattttatacaggttcaggccttcttaatcaagaagtaataccctactcctgtccggagattgattcgctgagtgtattattgatcatatgatctgggagaaaatcgtgcccccaaaggcacccggacccctccttatataggggaaggagtccgtattacaaattatagtccatatccctaacggaataggtagttacagataatatacaatcataaccgactaggatcccgggtatttcctttacatataagtttggaatttaacccaagtccctttaaagatatcttatctatacatggcaccccatacctagtcggactatacataccatgtaggtatggggtattcataatctccatagtagcccctgagacctttacagtcgacaaaatagttttctctcgtaacccaaaacgataatccgagtgctccaacttcttctgccttggcctcctgagtagtaagatcaaagactgtgaagggctcaaaatagaaaaaaaatcaggtgcatcgattagatgcacctaattaggtgtagcccccgactatgtgattagttaaaaactaaacatatagtcaaggcgcaaaaatccaaccgagtggttttacaaccggatcatccatggtatcacacagctaagcatatgctacgtttaataaaacatccagccgactgctttagctttgagataccagaaaagaagatataaaaaactccgagggagaaacacactgaaggtctataaaccaacacatatgataagaatccgagtaaaaactctcaaaaaagatccatcaaatgtggtataaatcatgacaataagtgagtctaaattgcctaagctatgactcacaccatatcaaaataagcatataacatgccgagagaatgactattcaaaaaccagtcatctcaacaaaacccgaacagctagcctaaaaaggcctacaaaattagtataacacttttctattgggcaccattttatttgcgtcgtagtaattccaaagaattatctaactgcgtcaaaaaggattttaacagcattggactatactgttgtgagcaagtgtcaccgaagcaaaatgcctaagtccctaagaatcacaacttagccacgctgatagcaaaattgggctgaagtactgtttaggcccaggcccattagtactcccgataccctaataaaataacactagaagcaaagcgtcggttcgtcttccccgccgaaactctcgccactttccccattctctgctatagtgcaaaaccacaccggcgaagctagggttcacagattcacacaaatccagcctccaaagccccacgaaaatctcccacgcaaccaccacatcaatctcccatccattcccagccacacttcgaaccaaatcacatcatccagttcgcatcca

SEQ ID NO: 26454 - DNA, 423 bp, Oryza sativa
tgcattacaagtgaatagtgataacttctttcaatttgccagatttcaagggagggagaaagcatgctttgagtcctgtatgaatatgtttttgttcgtttctttgttaacctagatcactaattgactgtaatttcaaacagattgaggttgtatgttaatttgtaaattagcatgaggccttgagactgctcccttacttttgtgcattcatatgaatgagcatgcctccaagttttccgtggggtttacttcatgcaatgttttctctagtatctgaataatgtagtttctggtaaactcatcttctgtcatttatagctgcactaggaacttcaattctcaggctagtgacgttgctatctaacagttaaacaagtactgttgcgctactaaccctttcttcttttttttgcagtctgg

SEQ ID NO: 26455 - DNA, 173 bp, Oryza sativa
ttcaacgcactttcctagcaatcgatccatcgagaaagaacacatcaaggctgaaggtgtaaaggaatacgttgaatgctaaatgataacaacataaagagaatagtgggaagtaaactaaatgtaaggaaagtgaatccgagctgcttgttcgtgagagccattcccagtta

SEQ ID NO: 26456 - DNA, 1501 bp, Oryza sativa
actaataaaaaggtaagataaaaataaatcaaaatgagaaataaggtgatgggacaaatccccaactcccctttattattgactagcgttaaaccacataaaattttttagctagcaattcttatggaactacgccacccatagtggaataagagacgcttggctaccgatttcaagagtgtagcaccattacgcatagtatcctgctcctcctgtggtagcattgtagaccaaaagtggagccagtaggaagacataaagataacctgcatagggttagataattgtttaccattaaaaactttatcattgcgacaacaccaaattgaccaacatacaacactagctccaattagaatcatcttattgatggacctagatacccctctaagccatttaccgaaaatgtttttggcgttacagggtgggagatattaaaagcaaaaaacacacatctccaaacaaactgagcgacaggacactcaaagaaaagatgttggattgtctcttgtgtatagcagaaagaacaatgtttgtctccccccccattttcatttagccaggttatctttcattagaattactttcttgtgaagaaaccaaataaagaccttgatctttagtggaattttcaagtcccacagaattctctttttatccgaacattacagttcatgatcgtggcatacatagatttgacggaaaattgaccattcttatggagcgaccatacaaagaagtccttttcatttaacagagctatattagttagcctgaggatcaaatcgttccacttgattagcttttggccaacaatagctcttctaaaagagatatttagcggcgttgtgctcatgacctttgccacagtggactgcttctttcgagccagattatataatgtagggtattgatctttgaaagcacgcgatcccaaccacgtgtcttcccaaaatcttatgtttggatgagtatggatgcttacactggaaatttgaaggactgcatgcttgtcgtggtattatctgactggatgtagatgttgccaatatgacccgaggtccacacttgattgcccatgatgtaggcctaagagagcacggcggactgatgaaatgatcattacctgaaatgaaagaaactatctgcacttaagaggaggcacaattcacactgactgagtaaagttgttaatcagatgagttttgttccaaattagaatgattctggtactcacagacattacaaaattttgcaactatctctgatatcatgttaggactctgtctcaggtcaaaaaacaattatactacttacagattttgtacaaaatttagccctgacttagagttaatactccaattgtgccaaattaaactctaaatcaaatgatcattacctaaaaaaaagaaattatttgcataaagaggagacataattcaaacctgactgatcaaagtttccaaccagaggagtgtgcttgaatttaaaacaatatcta

SEQ ID NO: 26457 - DNA, 1501 bp, Oryza sativa
ctctgtaccgtttcgtccaactcaagagaaaatgaccttcttgagaaaagtattgaattgtccctatacacgcgcacacaggaattgctacccagcaccctatattgcagttgagcaagcgattttttcgatcacttcttgtgtgtaagcatgcatgcatgcttccaataaactaattctaatctgcagcgtgatccataaaaatatcggttggactttgggataggatactacccgagtcaaactgatggaatgatgcatattgtggatgatgagttcttttaaaactaaactaaaactatctgttgcctctctagcactggaagggctagctctttgtaccacgtctgtgatccatctccaatcttaaggttctagaagctaactttggatgccaatggcatgttcttgattctttttataaaaaaaatgaatatggaattaggagatgattgaaatcaaattgttactcttggtctaaatgttggctccaaaacaacccaaatgcactatgatggtttaacccttcaaaatatttcattttgttaaaaacaaccataatggccaacaactactaagattgtagcgggtaatgttgctcccattgggcacggtggcattggtcaagcgtcgatgaattaggccaaggtcgcgtggaacaacaccctagggaattgaaacaacaaatataatgttggcatcacatagaattcaaataaaatgtggttaatggagttatgaaattcttccatcgtgtattcgtgttgctatacaatcatatacgcatgggagattggatgagaacaggataagtatttttcacctcggacgaacacatgcaatttggttcccttgatagaagttccagttgatttatagaggtatcaaaaatggtttacacttaaactcacctacttatccgtttaccatgttagctgccaaggggtgaaatcaagtttggtacgtcagctcatcgtatttccgtatcttagcccatattttctttcggagttagaaagtatggatagagtcaataatctatcactcagtaactcgtatcctatttcatatttgttgtttagataatagtaccacatatctatttttctctctaatatcatccccacgtttcaggtcgggtgagtggatgggtatgtggaaaatacttatcctgttttcatccaatctcccatgcttatatgaactaacttaatcaagttgaaactgagcttttctagtgaaacaacgatgaagtttggatgataccataattctatccctatcgattggattagactcccctaactttgtgcagtttacagttgtgacactgatatgacaatgtgagaggatctgtttccctatcgattcgcccaccgaatctcaaattaaacatggtgttgacaattttcttgggatgaactttggaagcgccgtagtacgtacagcggtacagggttggtgaccgagtcgagtgattgacttttggagatggaaacaa

SEQ ID NO: 26458 - DNA, 1501 bp, Oryza sativa
cgcctgctaggctataagttatctattcacctcttgagggggcgtatagcggaccttttcctctcgtgtcgtctcctctcgggcggcacgggaggcgcccaggccgccgtcgcccgccctccctccctcctcctccgcctcgccgccgcccgagtggccgccggcaaagccgcgtggcggcaaggacggcggcggctgggcttcgcttcgtctcgccgcacaagggcagggggaggtctgccggcgtcgggaggcagaaaccgcccagatccacgccggccagccagagttctcgttgagttaagccggcggcggggcagtgtgctcgggagcggcctttggcggggatggcggcggaggtttggaggcgctggcggcggtggaagaggccgccagatctgacgcgaatctggcggggaggtttccgacggtgcccggtgggggtctggcgccggcggaggaggtcggcgtcctcagggcgacggcgacggcggtgccgatgccacagcggccggaactggcggcggtggagccagacgacgactgctgaggaggcggccggatccggcgtcgacgggcgtgacggcgcggagacgctggagacggaggtgcggtggctacgacggcggtcgaggggtggccgggtttggtggtcggctggcgacaacagcagcggcggcatcggctggtgacgacggcggagggcatggcggcggcgtcggggcgttgctggctccttggtggcggagagcgacggtgcagcagcggtctgcggaggtggtgactggcgctggtggcagcggcgacggcggccgtgactgtggaggcggtggtgacgtcggcggcggggaaggagtcgggtgtgagtggctgggcgttcgacagcagcggctgtggtggtggtgaccgcgactgcggtcaccggaggcatgacggcctcggacggctagccgagggcgtgggagacggctgcttctagccggcgcggcatcgttcggtggaggggtcggagaccggcttggcgcagagaggcgcagccgatggcagcggaggccggttcggcgtgagaggcgcgggcggcggagatggaggccggcttggcacgagaggcgcggccgatggagggaggccggattggcgcgagaggcgcgtccggtggaggaagccggcttgacgcgagaggcgcggccggcagtggaggaggcgacctaggtgtgaggaggagttgccggtggatgtggcgtggtcttcggcgcacgaaggctggccggcgggggacgccggtgcaggggtcccacatgttggcagagtttgtgtggtggtggagcatcggtgcgtcagccgtggattcgcagccggtgagcggcgggtgaaaacccagtccggccttggccggaccgacaacgatcctcctatgggcgttgtcgtgctgtctcacccctcaagggtgattgctgggtgaaagcccagtcttggctgagtcccgacggacggcggcggc

SEQ ID NO: 26459 - DNA, 262 bp, Oryza sativa
aaaagaaagccaattaaactgtgttgggttaaaaagccaatgagacagtagttggggataggagtttggatacgccttttacagatcaagataaggattgttggatgaaacccataagggtacccgccatgcctctacattgataagttcggatatacctgcaaacagttaagaagatccaggagacatcaatatttgagaacatagtagtcgatggttggtaattagtctatcaggtatcagaaaagggtcaaaggtgata

SEQ ID NO: 26460 - DNA, 1451 bp, Oryza sativa
agagtagcattgtgagagaggagagctagagaaaagatcttggtgagcttccagcagcaattgaagaaatagaggtaaattagtaatgtaaatattataaagtagaagtttagtgatggcttatgtattagatataattattagtgtattggataagtaataatttagataatgtttatatattacatataaattgttcggttatatggcattttagaaattgtaggtaccacttacgttagaagttgataaatatatagtatgaatgtagtttaaatatagaatgggtttagtattatatttgttgtatataagacgtgcataaatttttattagtgtgtgaggccgtgggagaaatgtatatattttgaaatttctttagttgtgtgtacgatatctgaacaagatagacaaatgggtaaaaaatatattaatttactatgtacgtagaatggttgtagtattatgttttcgggtacataataaggggaaagttttaactagtatttagagccgtgctgcacgaataattgaatgtggtaagaagttttttagttgagtgtaccatttgagagtgaataagacaaatggaagaacaaaatttagaggtaacttgcatgacggttgggattgatataaatagtatggattttgcaagatttattattgacatatattcattattttgaaggttataagtgtgaacgtggtgcatttaatttagaaattataagttcggagaaggacaagaaataaataggagacatacaggtaagcatatatacattttatatgtgtttaggtattcattaaatgtgcaaatcatgtaaactaatgaaatgaagaagggaataaaattttcttaagaaatcatggtgcgagttaattttctggaaatctcgatgaactaaaatactatatggaattatcgtgaaattttcgaagctatattggtaattttaaaagtgtcataataatttcagcaaaataaaaaagtttaataacggccatcaaaacgcttcacatacaaaatgaaaatgacataatccatatcttcatttgtgacataatccatatttcacagatgttcattttttgtaatgcttatatgtactgattaatttggaaaatttcaggtatggcggacgattggccctacccgttactcagtagagacatcgatgcacggcaccgtgcacgacagatgtcttccagctgtccaaggggtctgtcggtcttcataacgcggacttgcccaatgtggggggtcgacgaacgttgggtaccaaggtaactaatttttatacaggcttacatgtaatattggtaatattttttttacttcaattagtgttagttttgtctgacccaacgattgtcgttttgcaaggttgtccaccgcaggccttcttccttttgttagttgcaggctcgagggcattaggattaca

SEQ ID NO: 26461 - DNA, 1501 bp, Oryza sativa
ggattctgcatgtgctgtcattcatacgggcttgcatctggtcgtgtgttctttgttttcttgcacacaaaaattcgtggaaaatgtatactattcggtagctctattatagcatgtacaatagcatactataagccagttataaacacatatcaagaagataaaagaagagagagaaaagcagcgggctacagatttatgtgtatgataggggggaggtagtatatttattagctattaaattaactataaatgatttggagttagtagtattaaacttgctcttaccgcaccaactgttgactggtttcacagagagatacattcagttatgttgatattgattaatatcattatgagctgggataagttcatatcatccccctcaactaccacatttatctaaaagaatccattttactctaaaaccgacataattccttcccgaactcataaaactgtttaatttacacccctcatacaaactagactggttttttctatgcggcgtttacgtgaacagcatgtggtgtcgatgtcagcataaaaataaactagtagcttcacatgtgacttcttccccctccccactctccactatgtctcacgcccttactccaacgtatagatcaatgaccaaatgggccgtctggcctaggcacaaccgggcccgggccgagattagtcgagccggcagactcgacctacacatcgggctgccccgggtctatccacttgctgcaccatctgcctatgcacgacccaataagacttggatggtgtcgagctagcccaaagccacgaaagtccattgcactcttccttggataaaagactattttgcttccctcatatctttgggccgtctcttatatggttggaataaatctatttttcatccctcatctgtttgggtcatttcttgtatggctgaataaatctattttgtctctctcatctatttaactccctgatcgttggactgggccaatgccgtatcggcccatcgtgtcgagacagaggcccaggcatggcgcaaaggttgggtcatgccgacacgggatgggcctaataagtcaagcaatcatcgtgccacgtaggcgtcacattaactagaaatcgctttcaatattgtcgaggaatttaatttgtacccgttttaaaagttgagggacactccggttttatggttgagtggtgtgaataaaactcgacctatagttgagggacctaaagtgaattttatttcaaagcgtacaagaacctgaaccttgcacgttagctcaaaacctggatgtgcataaatcctggccccatcctaagggggtggctacctggcgactggtcgcgcctgccccatcgcgcgcgaccaccccccactcctcttagtatctatactatacaactagtagttactagtattactattactattacactactactattagtactagtattatttctataaaaaatatatttttatatgtatatattgttg

SEQ ID NO: 26462 - DNA, 419 bp, Oryza sativa
tgcagcccatattgaagcaaataccttattgtcaatgaatccatttagttaaaagaaaatatttggtattgaaacaaaacgaaattgtgcttatggtacacactctcatccatgtttccttgtaagttatttacttatatcttattttcaccccctatggccctgtcctcaaaagttgaagcacatatactttttaaccaacagtaaattctgaacaaggaatacatcattatacgcttctttccacacccaaagccctgatgaggatgtcaatgtaatgctctcactcctcaggattcttgtctggaacacaagaaaccccttctgccgtccacagcagctaagccgccgccccccaccctctcctccacccacctccctcgtgcgctccgcctgcgcctcctccctctccccccaga

SEQ ID NO: 26463 - DNA, 584 bp, Oryza sativa
catataatggtaacgagttagagttgctaccaatgagccctgctgatatttgaaagatgattatgagagagtaaagattaaaaacaatgagccctaccacctgcaagtctaaaattatatgtataaaacctatgctggaaaacatctcattgcaagtattctctgatttagcaaaagcattggtttcccctcatccctcacttccaattggacctcacaggccccatggctcatttggcatccacccagcaccccctagacccatatggcagtcacaccaccgccctcgacacgtgctggcgttagaacgcgctagcacaccctgggcttggccacctccaccttgacccgatgacttcgagaacatcctcagaccatcactccacaccgtgtctccatcatccctggttgcgttctagccattcccgctgggagataaagctcttagcaatcatttccacctcgagatcttcttcgggcataaaaaagatgacgtcctcccttacaaatgagtcaagattttccctatctctttgttccctcttctcctcaccacacctaacaacttttgtttttgccttagt

SEQ ID NO: 26464 - DNA, 308 bp, Oryza sativa
ctgtgtaaagtaccaacactgcaatttactgtaactgccacacaatctaggctcggtcaaaataatgcatggccacttggcctatgtattccagcagaagcatttgatctaacagattttaggtgcatgtactctcccaaaaagacatagaaagtgtgccaggtatataattcatgaggtgatatactgcccatgagataaatgacgtgccacgcgacttatgtaagttccatgcaccacagatgaaaactcagccacaggaagtcactaaaattgaatattttctgatgggatagaatgaaaaaaca

SEQ ID NO: 26465 - DNA, 187 bp, Oryza sativa
acattttgaaacggagggagtatatttatttcacactgtcttgaaatagaattttttttttctgatgaattatttagatcacgagtacgtatctttttaagcttatccatcaaaatatttattcgtccctataattaaatagacaatccagtgaataataatccattttaatttgcacccgttcaga

SEQ ID NO: 26466 - DNA, 849 bp, Oryza sativa
ctactgtctgttagcaataaggtaatgcatgttgttttttcatcaggccagtgccacaccacgtgcgaggcacgccagggcaccacttgccatcaatggagaaaaccagctgcctctagcaccacaactccacaaggagaccctactaatcaaagaagaaaccctaagtacttcacgtggtacatgggcctcatgtggtggctattgcgttttgttcatccaacgcctaaaatgtaatctaatctagtgatccaacggctgagaattgatgatgacgtggaacattgaggtttgagatttagggtcttaattgcatttagtgtgtcataactttataaagaagggatttagtcattggaatattatatgcacacaattgaatgtaataatgataaatgtctgttattttattaaactctgaaatggcacatcgatatcggtttgtctcagaaagttccatccctagaaataaatcagaatagcctccgaaatgggaatgataaatgttgacagtcaaaaaatggaagttcttgctagaacctttggctgcacaagtggggagatgcccttcacttatctaggtttactaatggggaccacaaaaccaaagattattgactttgcccctctggttgacagagtggagagatggctcccatctatagctgcttttctcaatcatggtcagagactaacaatggtaaattttgttctatatgctccccctaatttctacatgtgcactcttaagcttcaaaaaaagtgattcaacacatagacagagcaagaagacactgtctttggaggaagtcaaatgatccaaacactaagatccactccttggctaca

SEQ ID NO: 26467 - DNA, 1501 bp, Oryza sativa
ggatggatagaaaatatatatatatcgatcagtgaatcagtgattcagtagtgatagctatagtacccaaattaatggacgtgttattttataatctaaatgggaatgcaaccatttcattcagcagcatgcttccaggcatttaaatgacgtgattgttttttttaaaaaaaactttttatacgtgaatttctcagaaaacggtgcgattcagctattaaaataaaacgaaaaacatccctcaactgaacgaacaaaaagaacaaggcatatataataagaaactcagtatagtgcattttttctctcttcacttttctaacaatcaaatattcagtagttgagtgtgttaacatgcatggagaaatgcaaaggtgaagtcctgctgcttcctgcagaagcagcagcagcatgtagtcctgtagctcatcacatacatttacacagcaaagctaagggcaacaatgaaaaggctttccatccggtgcatggcatggcaatggcaatggcattgccaaccacaaaagcgacatacgcatcaatgtcctcctgccgagctctctttcgagtctgatcaatatcagctcatccctacctaaaggcaagcatgcagcttgctaggtcaagctgcttaatagctacccactggggtatataatttatatgaacactattcaagtttaagctttgatgatcacttaactttttaaggaaagtttataaaatacctattcgatcaaaatatgtacctagacgactttcaattataacataattatctaataataatttaaggtcaaaatgagatatatggccatggtcaaaacaatacgctactcgttcagatagctactcccttcgtcccaaaatattcttcagcaaaacctagtattagtagtgccaagtcgatattttgggacatagggagtagacacttagcaaatcagttaattaagcagacaaattaaagctaaccatagcagctaatggtgacactgatagtgaaccaagtactagtagccatctgtcccaaatggcaatggaaataatgggacaggcgagtccttttccaagtagcagtactactagcactgtagactgtagtaggagaggagaggaggtttgtagtgttgtgcgtaatctcaaggaccaggaatctcctatcctaaccctcatccccatgtgcactgcactctgcactgcattctctactctactcgatgatcatcatcgatcaccttgtgttggacggacgaagaagaacaaatccatgctgctcttgcctgcatgcctacctgacaccaccatgcctcaaagttcagctgttgtactctagtactacacacacccatgctatgattagatagagaagatactacactccccatgaacaatacaaaaagaaacaaagccctagtactgatcatatgctgcagcataaaacctgaatcagttaaaataagtgaaatgtgctttggcacgttcagaagcataagtataa

SEQ ID NO: 26468 - DNA, 224 bp, Oryza sativa
ggagtatcacccaggatttggtttgttcattttaaggaatgaacttcaattatgatacaattacatacactcgccttttatggaatattttcaaactttataagtaatattgaatgatgtggaactaagatggtaacccaaaagcccatctggatcttctctgattagaagtgtaaacactgtatatgacttatctagtgaagttccattttgccatcttcagg

SEQ ID NO: 26469 - DNA, 191 bp, Oryza sativa
aaaacgaggaaaggaagggagggggccaaaaggaaaagccaccgtcctctacgatatcgcccaaaaacctgccagatcgtgccgtcgtggggagggcgggctgccggccgccgctgctgctcacggaacggaacctccacggcgcatcttaggaagacgggaaccccctactcgtcctccccctcgatagt

SEQ ID NO: 26470 - DNA, 170 bp, Oryza sativa
cccccctcccccccactccgttcgggagcgtgtagctcggggagccacatgaatggtgcggaaagtagtggggaggccgagcggcgaacgggaaacggtgccggcggcgactgcatctccagtgggagggagcactgctcgccggcgggcgtcccaccgtagtccatcca

SEQ ID NO: 26471 - DNA, 1246 bp, Oryza sativa
cgtgcgtgcgtgcgtgcgcgcgccccgcgtcaattcgcgttgccctactcctgcctcctcggcgtaacgaaacctgcggctgctagctagcgcgccgctggggcggtgcaagtggatcaagtggggagtttatttggtttcgggatttgcctgcagggtttctttcattctttggctgtgcctgtgcttagcttgcttttgctattccctcccggagaatattaatcatcgttttggtggtactcgtatttttttttcttcttacccacttgtttgacttgtgagcacctgagttattcgcgcgtaaaattttataggccggggaagcaagctattcagtccagccataattctggaaagattatcgtgtttccaaataaaatagtcattattcatagtctcaatttatctaagacttaaacgaatagataacttagatgattgtctgaaacacaaacgatcattttaatattcattagttacacttacatgcacatatatacagtggcgaagccaccgtaggggccagggagggccaacacccccctaacccctatgtgacctcccctcccatctcttctcccaaggataattagcccttataatctagccattaattacatcattagttgcagatgagactaactatataggataactgcctagctatatatgacttatgaaatgacttagttaactgatttatcattttaaaaatgattacaagactccaattaaaatcatggaacaaactgtttaaattggcaaattatgatctatgggttctcattctctcttctagctaatcgctataacatgtatgatgtcgagttagtgatcatacatttcaaaaaaaaacacggtacaatatcactgttcaccgaaccttaagtaagttaccacgtctcgtaaatggcaccccccatctctaaattctgggttcgccactgcatatatatatatatatatatatatatatatatatatatatatatatatatatatatatatatatatatatatatatatatatatatatctcttttggtattcgttacatacagaatgagttatttttttctgatactgatgataaaagtaataagtttaacacttttttgatagagagtatagtataggtacgccaccaaacaagttgcaatatggtgtggaaatcggaaacgaatggataggatagaccgtaggagcatttgttgttttccttcgtttccctttcggagtgttg

SEQ ID NO: 26472 - DNA, 941 bp, Oryza sativa
tgaagatgtaagcactaatccctaagaacataattcgtcataacgagctttacctcttgttgaagatcgaaaccgatgcagctcaacccggaagcaagaactcgtcgaaataaaacaaaaacgaaaggtggcgatgcgccggaattgtattgaatgtgtgtatttcgttacatagggttcggggtctacttatacccgaggattacaagatatgcccgtaccggccacgaccattatctctaacaaactctaaaatatcacgagtctttgcggcagactcttgcccacacttatctataaggaatttacataaataatctaattaatagatacaattgccttctcaggactctatccagacatggcaatcatcttgaagcacatcaaactgagcccgacgtcgcgcacaagtcgtattatcagaatcggctataccagcctacttagcctagctcaaccttagccgatcctagccgtagctgatccagactctagccgatccttgctctgttccagaactcgatcttcgtctccaactcttctccgattaagtcccttttcctgatacaaatacttaccaaatttggttgttaacacaccagtgcgacttcgtgcttgctctttcgacttccttggttcacttcgccttttccactttgcttttggcatagacccgatggcccatcgtaagcccaccaaggccggatcgaccggcgaagaccccggtaaccttggcgtagggtggtcgtgctttcttggcaagtcccttgtcaaggaggccgacttggccgatttcatctcctctggcattctagccgagggccaggcggattgtgggggtgaagccgttgtcccctcgcctggcaacaggtgaacggtcgttttcgtcgccttccttgccgctggacttcacgttccttgcgacgatttcttggcatcga

SEQ ID NO: 26473 - DNA, 342 bp, Oryza sativa
catatatattgtaacactgttatcaataaaggatccactcattcattccctacattcttgtgtttaaattctctctctcaatctctctcgctcaatcaattctatccacattcaacacgttatcagcactttcgctctcgcgaaggagatcgcgaagtgaaagaaggaaacatcgcttttgatttcaagaaaagcgaaagaaacagaagaaactaaggaaatcgcctaagtacgtctaccttgatttcatcctcgatgccgttctcggcctccatcgctgagaccgctttcatcaccttcttcacctcctccctcgattcgatggagtcaccaccatcgcca

SEQ ID NO: 26474 - DNA, 1501 bp, Oryza sativa
tggctccccgagctacacgcttccgaacggtgtgggggaggggggggacggcgtccgaacccgatcggcctcttactccgatgaggagagggagccgtcggcttagtctcgccggcggacgatggggacttcggctgctatggcggtggggacggcagaaatggaggcgctggcggtggtgtaatagggggagatggtggcggcgaaaatggaattggcggtggattagggaggcggcggcaaaagtggtgaaggaggaggcgccgaaatagacggcggcggcagacgaggtggaggaggcagcgctgtcttggtggcgtcatgtgcggcggcggcggctcaaactgctgggcggttagggtaaccctaaccccccccccacgcccccctttgcccttttccccatgggcttgatgggccggctgcactgtagtggtggtgggccaaatcctattgatttcggcaccacccatttacccctttattttagtttttaattttattttagcagcaattttatattagtccctgtatttttatgtaatttagtgaaaacagttcattagttctacaaattttgtaatggtcctataggttagtcctcttgctaatattgtaaatttcagagaaggggattttcccacttcgattcgctgattcagctgcgaagctgcatttggtggtcgtggcttatatctctataatctttccccaccattgaagtttcccatgtaaaaaaaccggttccctaggaaacccactccacccaaaaggaaaatcagtgttttcacacaaaaaatcaagacaacaaaccggatagaaaagattaaaccgtataattctaattctgttgcaacgtacggacatgacattagttttctgagagcgagaatatacagtatagttggtagcgactaggtcgagcacaatagagtcgagggaggtaatggggagaggctttattcctgtgtattcctcttatgggtaccatgtggcatgtgggtatattaattgatccacaatatggaagttcagaaaaggcagaccaaagtaaaatcaaagggatacgatgagataagtggcaaattaaatgtacatactgctcaattatctgctaaatttataattgcagttaactttgtggtaaaacagagttgagcccttgcaattatatagccaaggagtaattttccgaaataatcaacagaacaaaagtcaaatcacgcattagaatttcaactgagggagtaggagtataatacagagcagaacaggtaacaacacgatctacgcgtttaattagttcccgatgacagtgcctgcctcaccgtgatagataaaacgggtatgatggatctgcggtggaccatgcggattatctgcaacgatggtgtcaaaaagaaaatattagcagcaatccaagggcggggaaacaaaaacactgcgggcagtagctctagactctattggctggcaaagctaaatctgttgaaaatcgttt

SEQ ID NO: 26475 - DNA, 1501 bp, Oryza sativa
acattctctccttcataattttgaattcaagagattatggatcttcacggttagggtcatgcttgccatcaaattcaaaggccgtacgagatctttccttgattggggccagccggctcttgataaaatgccgggtgatctgttccccttgcagaccctgttcctttagcttcaacatacggtcaaccagggcgagtgcttgagcagcctcatctcccattggaagcgagttccaagtatcttgatacactggaggaaggcaggagtactcgggaagagctgattcaggattttgcacataaaaccaattcgcatgccaacccttgtttgaggttttgaagggcatggaaaagtacttttggctcaaggttccccttagttggaaaccggctcccccaacaacacatggtttgctcttgtttggctggggcttgaggaagaagatgcgacagaacagggcaaaatgcggtcttacacccaggaaagcctcgcaagcgtggataaaattggtgatgtggactatggaattggggtttaggtgatgcaaactgatcccatagaaatccaaaatcccccggaagaaacttgaggttggaagagaaaatccgccataaaagaaatgggaaaacaccaccacctcgtgtgtgtcgggggtcggaaatgtttcaccgcacgctagacgccacccgatgatctcctttgccagaagaacgccgtgcgccaccatctccttcaggttttcctccgttacatcggagggcgcccactgaccctcaaagctttctctctcttccgccatggatgcgaactggatgatgtgatttggttcgaagtgtggctgggaatggatgggagattgatgtggtggttgcgtgggagattttcgtggggctttggaggctggatttgtgtgaatctgtgaaccctagcttcgccggtgtggttttgcactatagcagagaatggggaaagtggcgagagtttcggcggggaagacgaaccgacgctttgcttctagtgttattttattagggtatcgggagtactaatgggcctgggcctaaacagtacttcagcccaattttgctatcagcgtggctaagttgtgattcttagggacttaggcattttgcttcggtgacacttgctcacaacagtatagtccaatgctgttaaaatcctttttgacgcagttagataattctttggaattactacgacgcaaataaaatggtgcccaatagaaaagtgttatactaattttgtaggcctttttaggctagctgttcgggttttgttgagatgactggtttttgaatagtcattctctcggcatgttatatgcttattttgatatggtgtgagtcatagcttaggcaatttagactcacttattgtcatgatttataccacatttgatggatcttttttgagagtttttactcggattcttatcatatgtgttggtttatagaccttcagtgtgtttctccctcggagt

SEQ ID NO: 26476 - DNA, 1501 bp, Oryza sativa
atcccggccgccgttcccgcgcccaggccgcggtccgacgcgccgccggcgacgaagttcccggcggccgtggacgcggtgtgtgtcccgtggccgacgtcgtcgtcgccgccgccgccgccgtcaacgaaggacttgacgccgacgagcttgttgttgcaccgccgcgtggcggcgacggcgcaggagcccctccacctcgccggcggcggcgggacgccgcggtcgtcgaaggaagggtgcgcggcgtggacgccggtgtcgagcagcccgacgacgacgcccttcccgtagccggcgacgtccctccagaacccggcgcctctcgtcagcccgaggaactccggcgtgtgcgtcgtcatgaggcgcagcgtccggcgccccgggaacgcgcgcacgaacccgggcttcttggacaccacgccggcgagctcggcggcggtgagcctcgcggcgaagccctcgaacacctcggtgtaggagcggatgatccgtgcctgatcggcgccgtcgtccatgcgccggcctcccggcaagaaagactcgtgccaccggcggtgcccgtcgtcgtccgtggccgcgccgtgcggcggcgggtcgacgagcacgatgtaagtccggtaggcgtcggctggcggcggcggcgtgccattcggagtacggacgacgctgcctgcttcacctgcatggatatagcagagtgcaggtgcaggagagagcaaggaggctagagccagtaacacaagaagattgatcatgagatttgtaaaggatgacattgatgggaatgcaattaagctagcaagccaagcttcatctttatatatacatatagatatcaatcatgaaggcaaaatgaagcacactacatatctcagcaggattaattgcattctcgtttctctgaatcgttgtagatggggcttgcatttattttcgtgtgatcaaataatcaattgagcataggatggtttatgtattaaaggcttggattaattttctccctccacctttccaagacaaaaaaatatttaatatgcagggagggatgcatatctatatcagtatacaatttggtataaatgtagatttgaaaatcaaaccaaaacaaagggtatgtattgttaaagatatgaaagttatatgtcagaaaatctttgccattaagacataagtctctgtattaaatgcccaacttgatgcatatactccctccatactcataaagaaagttatttaggacagcgacacggtctccaaaacacaactttgatttcttgtttttataaaaatatttattgaaaagtgatatatgtatacttttgtgaaagtatttttcaagacaaatcgattcatataatttttacattttcaaactcaacaacttgagagttatttatgatttatattcctaagatttgacttaaacattgtcctagaccacttcctttatgagtatggagggagtaccttatgacctggctatacttatgacgtcata

SEQ ID NO: 26477 - DNA, 453 bp, Oryza sativa
  unsure (1)..(453): unsure at all n locations
cgagagaaagacagatagttttcaacctcaaaaaggagaagtgataggtgttaacagtgtgtgaggttttttgttagaaggatagggatcctgtggactagagatagacgggagtagaaaaaatctcgtgggaggggngtatccccccccccccccccgaaattttttatttttgttttatttgtttgatatttttttcacgcttagggacacacacaagaaccaaccatagaaaaattgaactcaaatggacgtaatatgtgacatgtagaatttttcctctcctctcctctctccgaactagtgcagaggagagagatgtgcaacttttttatttttattttattttttttgatatttttttcacacttaggaactcacaggaaccaaccacgtaaaaaataaaatcaaacggatgaaatatgtggcatgtgaaattttccaaagctcaac

SEQ ID NO: 26478 - DNA, 1501 bp, Oryza sativa
tattcatgtatctataaatgctcatccatctaccagagtttgaatcacgatattcctacatttaaacacaagttgtgtcttagtagtaggaactgttagattaattgggctaggcccgatttattctattaaatgtcaaaggctcataataaatgttaaggataataataccacctcatgaattaaacgagaagtatctcaacttaaatagagagttattggaggctccctgttgaccggttgaggtgggaatcggaaagccacacgcgcgtgccgagccggcgaggcgtgtgtcgcgtctaccctttttgcaaccacgatcccatgatcccacgattgcctccgtaacagcgcgtgcggcaactcacgattgcctccgtaacggcgcgtgcggcaactggcggatatcactcctgctatataaggaggccgctaatccgattagaactctcgcttgctttctctcgctggtgttcttcctcctccgcgcaactggcggatatcactcctgctatataaggaggccgctaatccgattagaactctcgcttgctttctctcgctggtgttcttcctcctccgcgcgcctgtgctgcctccccgcttaaccacgatcccacgattgcctccgtaatggcgcgtgcacgatcccacgattgcctccgtaacggcacttaaccacgatcccacgattgcctctgtaatggcgcgtgcacgatcccacgattgcctccgtaacggcgcgtgcggcaactggcggatatcactcctgctatataaggaggccgctaatccgatcagaactctctcgcttgctttctctcgctggtgttcttcctcctccgcgcgcctgtgctgcctctgttctgcctccccgcttctgatcgcttgcgcgcaccggaaccacacctttgcctgagatctgcaccgggtaggcgggtgatcaggtttttggggagtgcttctgtatgactgctttcgacttctgctctgttcattgtcgtctccaccatgtctgcacttgtagccgctgccgcctcacctagagccggcgccgctgccaccgtccctggagatggcatgccgggagccggagccgctgtgaacgacaacgtcaacggaggcagttctgcctcacaatccagtggagggacattctcggggtatatctttctcctactgttaactcattctttaatacctctgtttgtcctgttagtcacaattctattgcgttcttggtatgttcatgatgcttattatactttaagcatgctcctggttatgttacattttatcattagatcaccccacattgttcatgtcatgattattgtcttaatattttggattaaaatatgccgatatatgaccatatttccaacaatccaaaaacctgataggtcattttcggtagttggctttgctctgaaaccacatgcatttgatggttctaactataagaggtggaaagcacgtgcactattgtggttgacagcga

SEQ ID NO: 26479 - DNA, 1126 bp, Oryza sativa
  unsure (1)..(1126): unsure at all n locations
cgagagaaagacagatagttttcaacctcaaaaaggagaagtgataggtgttaacagtgtgtgaggttttttgttagaaggatagggatcctgtggactagagatagacgggagtagaaaaaatctcgtgggaggggngtatccccccccccccccccgaaattttttatttttgttttatttgtttgatatttttttcacgcttagggacacacacaagaaccaaccatagaaaaattgaactcaaatggacgtaatatgtgacatgtagaatttttcctctcctctcctctctccgaactagtgcagaggagagagatgtgcaacttttttatttttattttattttttttgatatttttttcacacttaggaactcacaggaaccaaccacgtaaaaaataaaatcaaacggatgaaatatgtggcatgtgaaattttccaaagctcaaccgaaaaacttctctcctcgaaaacacaatcttgcaagcggaatttggaggttttaatatttccgaacccggcaaagcgggggagaatcggatgtaactttttctgtagatgtccgtgcatatattatttgcctgattccgagtccgtatgagaaagttacgcctattttaatagatggcatattttgtccgtttcggtagagttttggaaaattctacatgtcacatattttgtccgtttgagtttattttttatacggttggttcctatgttctcctaagtgtgaaaaaaatatcaaaaaaatgaaataaaaataaaaaaaattgcatctctatgtactgtttaacttatatatgtcattttatgtggttatattttgaattagattaagtaatttcatatagtggtagagtgcattatgtttaacatgctgatcaaagggttttactaaaggagttatggtctaattttagtgaaggtgcaaagtagactaagtggtatgctagatattttcagacttagttaagtggtagttcgagtttaaattttttttgtggttggttgtatcgtgatcctgagtgtgaaaaaacatccaaaaaaataaaataaaaatgacaccgttgcaactccatacagagaaacaggaatggaggcggcggcgccagccatgctg

SEQ ID NO: 26480 - DNA, 1501 bp, Oryza sativa
taacacggtgaataggggtaggcagaataggaccaaaccgaaaacaccgataccgagaaattctgttagtagttcggtctcaactgtcgaaagaccgattttttttcaggcaattcggtcattggcttcagttaaccgagaaaaccgatttgtggctcaataggcctaggaggcccaataagcctagtgaaacacaaaaccctagagggcagcaccagcagggagtaagtcagccactcccactcagcctcaccagcgctgcctccaatccatctctaccctatccgtcgagcgccatcgcgcggtcacgcctccgcctccgcctccatcgaccatcccgccacctccgcccttcacctccatcgcgccgcgggcatccatcgcgccgcctcctcgtctccactccactccactctcaagctaccccgcctccagctcggtgcctccatcctgccggccgcatccgtctgcatcggggaggcagcaagccaacggctgtgaatccgttacgatggctacatctgttgattcttgcgatgtaagtattatgattattttttgatctactcctttgatttgaatccagtgcataataatgacttttatttgcaagtaatgtactcatcaaccttgaacttttatttgtgacttgtgagttgtactgtgactgtgaagtttagacttgagacctatgctatttaatcttcctatcttgtgatatattatttggtgtatgatgttgcctattatcttgtatttttgtgatatataactatgaaaaaatgcctgaaaagaggggaagtgctgtcaaattttttcattccaaacttatctcctgaaactgtccaaattcagtcagaccaagaccgagaccgaatttgctggccccgagtttttttggggtgaaattcggtcctgagttttcaaagaccaaaatgaccgaaagactgaagaccgagaccgaatttttcggtcagaccgaatgcccacccctactagtgagtgctggtttctattttttttggtttgacatggttcggttttttgtaccatggtgagaagagaaactggtcctcaccagaaaatcgccccaaaatctcattcaaagaccttgcccacctgcggcgcttgcagtttgtgtcgtgcgcatgtcgcttggaggccccattgcgcaagccatgctcgatgtactttgcttcacctatatgtggatgatatgttgattaggggggatggcgttggccacatttccatgtggaaaagcaccttgagcaatttcagaagactgattttaggccttagttctttcttaggaattgaggttttgcattctctacaaccacccctatggatcttcacttgtagctacgacccttatggatcttcacttctagctagggatgaaaacaacttgggaatggacggaaactagctataccttttccactttcatatttttttcagtattggaattgaaatcgaaaccccaaatacaaaatcg

SEQ ID NO: 26481 - DNA, 1158 bp, Oryza sativa
cgtggggtggagatacgattgactatacggcgaattcgagctcggtaccccgtagctaccgagatcaatgcagttaattatgttggaagaaattcgactttcatatatatatatatatatatatatatatatatatatatatatatatatatataaacacgctggtttaacagatgacgtggcgtcctcttatagtacgaagctagctaggatttttatccatgcatcatgggcacatctcttaattgacgtatcacgccttcgattcggtgtaaaacgtcaggtgttatgatagaggaaagtgttgcgcattttttttcacttgggtaaattgtttcactagggatcacaggacgaaaaaagcattaattttcacttggttaaattgttgggggggccctaaattgtttcaaacagatgtggcatctttaatttttttttttaaaaaaataacggatggtgatgatgagcaaaggtaggagctacagcacatgcatgctcacactcgaagatgaataaaaacagggggagggaggagatgaatggcggagaaaagaaactgaaacggtgggttctaaactaggcgatgagagcgtgcaacgatttaatagttcaaactttttatatgaatgtttatattttgaaatggaaggagtacatatttaggtgatttctctaattaggtcaatagggaaatttcgcatgagtgcacatgatgcttagtaagtactccctctgtttcaaaaacaaaaggcaaactataggttgccatgccaacgtttaactgttcatcttatatgaaatttttttataattagtatttccattgttgttagatgataaaacatgattaatactttatgcgtggcttatctttttaatttttttcataatttttttaaataagatggacggtcaaacgttagacacggaaatcagggtttgttttttttttaatggagggagtacgtagtagtcctgagcacacgcgagtgatgtaacgggtgacgaactgacgatgcatatatatgcgtgtactacgtacaaagtaaaaagatcgtggcgacgaacgcgtgtgtgggcgcgggaactcaaacgccgtccggacggtacatccatccatgggcgttttgcatgacttttgtcttcgcgatcact

SEQ ID NO: 26482 - DNA, 1501 bp, Oryza sativa
tatgtttaaaagtgcaggtttattttaatacattttagtcatagtctctttttgcataaatcaaaaggtcagcgctatcatatatttaggagaaaatctatacaccggtatcccatggagacaggatactaatccggatcccctcctcctacctcactcctcccccaaatcagatggcacctgaggtacagccctccccggcccgtcaccgtcgccgcaccgctcgctgtagccggcggccgctgccgcgggggaggcagcgatggcgaggagctcagcggcgggcgtggtgagcaagagggagagcgggagcggggcgggccgcggaggtcgaacacgtgagggaagaggtggatgtcacaccccaatccagcaccgccgtacaacggcacctgacaggagcgtgtcataggaataacggcgcgaaccgcttcttacgaaaccgcgatctcagtaccagtcccaggacatagcgctggtacccacggtgacaaatatgaatcattgcaatccttaaaataaatagaggacttatttaccttaacttaggttgcagctcagaacagccgagaatgcaaccgacgacgcggacgagaaaacaccaacaacagcagcagcagcggaaccaacgggctaacacccaacaccacagacgacggctgggaaccaggacgaaaccctaatcttcacttcacttcatcttcacttcaaggcagaggaactatatactcaatttcaacaatggtgcccgggcaccatggagcaccaaacaaatgtactatatatatatatatatatatatatagagcaagggtgagtaatttcgtactcagcaagtcacgggaatttaggtgtttaatgcaagcttggaagagaggcaaggttgttttgcaaatcctttgtttgaaatcatttttgaagtcactaagtgatttatttctttttgagtttggatcgaaaagagacttacgtctcgatttgacttaagagatgcttttcaacaactcaaatggtaatgtaccgacctcccgggtcagatcattacttatcggctcccagagccatttcacttgattaatcggctcccagagcctttttcattttctcggactcccagagtccagctgcccagcagcacaacaatccgcttccactcaggaagcctagtctatgatgcccgcagacatcccgaatcacacagattcgtttccgaccactcaggtcatccatttgccacataggctgattctggtaacgattcccacaccacaacaacttttcacaaagcacaggcaataaaatctacgcaacgggaaccacctcacatctgcccatgaccgtgggcacggctgttcgaatagttagttaacctctgcagaggggtacactttacccacaagacacgaacttagtccagacactggccggtatcagaggttcgcgacaaagcctttctcaagccgacccagggttacctcatgccacatagaaggatcaaatc

SEQ ID NO: 26483 - DNA, 577 bp, Oryza sativa
cctgcagcccctgtgttaaaacagtacttttccagtcaaatttatttgatgtaactgagtctcagttctcccaatgtacctcaattcataaacaagcatcagcaactgccaacagtgagctaaatgaataatgttttttcttcttttattttctcatacacaatcaaccttttctgattctgtaattggtttccttattgcctgtatggcagatgttatactcttttgtgagggtaagcataagctaatactcttctggagttgtattgtacaaactgagcactgaagagtctgaagaccgctcagcatttaggattaagttgcacgccctcgcaaatcatgcatggcagatggtttccatttttatattgaaattattagttaataacaggcggtgctatagtgactactacattcaagtgactgcattctggctttttaataatcttccttatgaacaatgcgaaccattatccatttggcaattctcgcagtgaatatcttgtgattaagatatcaattgtttctgtatcactcaaaacttgtattaacccacctcagaacactcatatcttat

SEQ ID NO: 26484 - DNA, 1501 bp, Oryza sativa
ccccctctgcagaggttaactaactgttcgaacagctgtgcccacggtcatgggcggatgtgaggtgtttcctgtagcgtagatttgtttgcctgtgctttgtgaaaagttgttgtggtgtgggaatcgttaccagaatcagcctatgaggcagatggatgacctgagtggtcaagaaatgaatctgtgtgattcgggatgtctacgggcatcatagactaggcttcccgagtggaagcggattgttgtgctgctgggcagctggactctgggagtccgagaaaatgaaaaaggctctgggagacgattaatcaagtggaatggctctgggagccgagaagtaatgatctgacccgggaggtcggtacattatcaaatgagctgttgaaaaacatctcttaaagtcgaatcgagaagcaagtctcttttcggcccaaacttagaaagaaataaatcacttagtgatttcaaaatgtcttcaaataaaagatttgcaaaacaaccttgcctctcttccaagcttgcatcaaacacctaaattcccgtggcttgctgagtacaaaagtactcacccttactctatataaatatatatatagttcctccgcccggaagttgaagatgaagtaaagtgaagattagggtttcgtcccggttcccagccatcgcctgtggtgttgggtattagtccgttggttctgctgctgctgctgttgttggtgtttcctcgtccgcgtcgtcggttgcactctcgggctgttctgagctgcaacctaagttaaggtaaataagtcctctatttattttaaggattgcaatgattcatatttgtcaccgtgggtaccagcgctatgtcctgggactggtactgagatcgcggtttcgtaggaagcggttcgcgccgttttccccacgacacgctcctgtcaggtgccgttgtacggcggtgccagattggagtgtgacagttgactacttaagaaattttatatatattaatgtgtagaaaatacaaatgaatttacatcataatataaaattatattgatgctagccgcacaattacatcataaatttatatagatgctagccacttgattgcgcaaaagcatattctggcacacaaacttcccgtgtactgtccgtgcacaccaactaacaattatcatggaaagttcttgaaaaaaattggatttgtgctcctaataatattacacatctttgcaacgtctgatattcaaatttattatattttaaccataaaaaagaaaaatctaatatttttaagaataaaaatctatcagaattttctcttttgttatggctaaaatataatttatttaaagataaggtttcacatataagtgtaatacaatttaaagtatgtgtccattttcttctagaattttttatgatatttgctagttggtgtgaatggaaagcttgtatgcataggatatggtccatgattgacctaacctactactttactttaataaca

SEQ ID NO: 26485 - DNA, 1501 bp, Oryza sativa
ggaaagcatatgataattggattgaattgtattgtattgagctggtgtacatgttcagttgaaaaaaaaactgcatcagggaattgaagattgtgtagtgcgtcagtaaaatggatttggaggattgaaaccggccgggtcaatgcctgccgcaatccacagaaaactaaagcagaggcaacaggagttggatagaaatgttactaccatcgatcaagacagattcactgcctctgcttttgttcagtaagtacattagctagtagtacaggtaaaaggtgattattcctgaaaaccgtacgagttgatccagctggaactactatataactatctgttcaaaaatggcatatagtacatggaagacagatgagagtcggtggtgaatatatggattcatgtgatgtatgtttatacacgctattagcataatttcaggaacgacgtaaatttactagaatcctggaatcccagcagttgctgatgagcagatcaactgaacaatgctgacacacgattacagagacctaagctagctcgcttggcttacatacatggagagtgagttttgcagacaatgcagtcaaatttctgtgctccataagatctcttctctttttttttaagggatgacacaggatgagtattgtatactgaattttgtttatagtaacaagggaaactattttaatccctcgagagaataacccctcgttctttgcatgtcacttaaatggttatgaaaaaaattgagaaggtgtattaacatgtgatataatactctacaaacatgtaagttcaaattcaacttgtacatctcgtaacgaacagtaacaaacagctacactgtatactgaattactatgaggttttgcaccgtccggccggcgtcggcgagctaagtactccagcaaagaaagcaggcacgtgtggcagcgcagagcagagtgccagtgacagtagcacaggatccgaacgcgcccccacgactccccacgcaatctcactgccactgcatcttcttcttcagttcttcttcttctaatcatgcatgttcccgatcctctcctctcctcccctacctacatatatagctggccggtcgatcccaacctccatatcttccatcctgtgtgctgcttcgattcgagacatcaagcagcagggaagctagctagcctgtacatttatattcgcttctgctgcagcaaagtcaccatctgcctagctagcagctagctcctcctgcagctgcagctgctgcgcgtatagcttagcttagtcagctgcaggaaggtagagtagagtagtagccactagcacagccattgctagtgcggcaacgcaagctcgccggcgacaagatcatattaaccggaagagaaagctagctgagcttgcttgcttgcgcgtgtatctatcaatcaagggttggtagctagctacaaatcgatagcgtacagcggattacacaagagaatgcagcagcggcggggcggcg

SEQ ID NO: 26486 - DNA, 1501 bp, Oryza sativa
  unsure (1)..(1501): unsure at all n locations
ttgatcgatggtagtaacatttctatccaactcctgttgcctctgctttagttttctgtggattgcggcaggcattgacccggccggtttcaatcctccaaatccattttactgacgcactacacaatcttcaattccctgatgcagtttttttttcaactgaacatgtacaccagctcaatacaatacaattcaatccaattatcatatgctttcctgctttacatatataaacctgattgatcacctcctaattatcacttgaccaatgtactcataagatccgcaaatgaaggaacaacgcggtcgatgataattctgcatgtgtgtgctctacctgcataattcaggccagctaggcaggcagatgagcaaattaaatcgtcatatcgatttcctaatatgttctgaacctagaatcatcatatcggtttcaagaacaatataaattgaagcacttctcaatattaacaatgtaattagctgctgcgcatgcatgcattccaggtgattttaaaaatgatgggagtcaacaatgaaatggttgcaccgaggagagggtagtaccgaagtaagcaaaacaagaagcttgagatgagcgtgcatgtgatcaactggtggctcagttggctggggcatgtgctctgattcgtaaacacaaacctcattactagtagtacattatgcctcccaaagagaagaggtcgccacctagctagtagcttaattatctgtaattaacttatgatgatatactaattgtatttctactactgcccagtttacagttgcagttagttgtccgaggtagatcaagctgcttgttattgcattcctagcattcattcattaatgcaccaagtagcttacttggtctgacagggagatggaaacaccggccttgcatttcttctttcaagtttcagctgacttctcacattttcagaaagcttagaccttccggccaatataatttcagctcgaacattaagggcttttgctgctttgttcaaggtcctgatctgatttcttttctgcaaccaactttcttatatagtgaagtatgtatataacttgtatacttcactcctattcacaagtcttctgtcatagactttgctagagatccacgcaaaaaacacttctctgatgatctattgtcgtagtaggcagtagccattagtatagtgttgtgagtcgaagctaccttaattattctcttcttctgttcatgcatgtgcattgcgcttagctagctagcaagatagttatagagtgatttggctagcgatataagctagggatatatctatattgtctctnnnntgatcagttaaaantgaancaaccaaacattcattcattcagtcgttggctcgcatatatacaacacaaacaggccgggcagatcagatcgatctgccacctaactatgaagaacatatgtactccggatcctacctgtatagatgctcatgcagtgatcctaccatgtgctcat

SEQ ID NO: 26487 - DNA, 1106 bp, Oryza sativa
ggattctttataatgctcaggcagctgaaaagcctcaaatgaaatgctactggtgcactacagtagcagtcggcacggcagcaaccagccagccactgcatatgtagaaagaaagaaaaaaaatgagctcgtgcatccacaaagctggaacatgggtgggtgtggtccgggacaggtcgacccatacttagaccatgttacccaaatggtttataacaataccgagtgggtcgacccattgtccattggatccattgggtagaatgggtcggcccatcagtatgtgctatcattgatttttgtaattaacacgtgatgaacaacaaagcatcatcagattctaccaagtgccgaatattcaatttcaaacatggaatacacacaactctgtcaatccatacaaatcacagatgtaatacacaaaactttagaatctcataccaagataacacttgtattcaacatgaggactccaggccgaatatagaaaacacagaaggagcataaaaaaggaacagaagggtgggaggaagaaattgtgcagagctctggtctgcacatttgtcaagaaatcagccaactgaaataaaatctctgctgaaactgaacttaaaatttcttctgaaactgaagtgaaactctctgatgaaactgaactaagtgttctgctaaaactgaactgtaaaaatttctgctgaaactgaaaattcaatttgtatgaacttattcccacgttacaaaagaattacagaattattagctagcaatccgccaatacttggcaaggaaacagtagatcgaaattaagaagaaaaacatgctttcttggattgaaatcaataaaagaggagttgttggctagttggaacataccatctccagacacaggaggaactgttgacatggagaccgccatcgaggctagatgaggtcgtgtcgccatcgccatgaaggagatggcggagataggcgcagggagaggtggcaaaggagggtagcaagtagggagtcaaggaggttggtggacgacaggatggtagtgaagaggcgcggctcggccagcggtgacgctggtgctagtggggaagggggaccgacaggcacga

SEQ ID NO: 26488 - DNA, 786 bp, Oryza sativa
gcacttggcagctgccaatacttttttttcacaagttggcgcctccaagtcctgcacagctgcactaatatcaagctatatgcgcggaaagcaaatcaaatgatacatgcttttaaccattttgccatgaagtacgccaagctcactttttttttctttgttgttgtttcttggaatacctctgtaatagtctctaactgggcattaggcgttcttcactagaggagttagcaactggttagtagctactgggactgaaaatcagtccttcgagctgtatatagaaggagatagattcatacagttaacagtataatgcaggatgtaaaagggataagggacatttctttctttcttttattttcattaaaattggtttagttacgttgggaataaagaaacaatgtgtatcctgcttggttgaaataaaatgtgatatgacgggggctatccagctatgttgttcgttcttttgtttcggtattttaattatattttatttgcacaaatgttgtagccttgttttgtgagatcaattgacttatagagcgatatcttgaggttaaaattaacacttgcaagacgattttgagacctaggaaacaatggaagataatttagggacttgtttatccctgttttgctaatatgtatgagtagaaacgagtcaacacacaagactactgaatcaaacgggaaaaaacaataaatgcaacaggggatgattgcacagcaaaatttgaaatcaatttattgccgtcaccacatgctgtttgcatttgcagc

SEQ ID NO: 26489 - DNA, 1501 bp, Oryza sativa
ggaatacctccaaagaatctgttgttcccaatatctagggtgatcagcgccttacacatctctaacgatgatggaaaaacaccggtgaagccgttgtcggcaagatgaaccgattcaagagaacagttgtagttcgtctggactgtagggatttcacctgagaatgcattgttggacaagtcgatgaactgcagattttgcaggttccaccagcagtcgggcagcttaccagtgagcttgttgtttgacaggtacaggatctttagggagagcagttgacagaaatccgaaccagatctgctgttagaggaattccctgacgaatgatcaactccctgcatcttgaaattgtttcccatatttcccggaatcggtcctgaaatggagttatggctcagcttcaggaatgtcaaatggctgagatgacccaactcaggtggaatacctcctgtcagatcattatctgacaaatcaagatcctccaagcttgtcaaactccctaatgctgcgggtatgctgcctgataatctatttccaaacatgaacaacactatcagtttccctgcctttcccagctccggcggaatcttgccggtgaacaagttgttctgcacttggaaggatatgagctcgggccagctcgtgaacaacgccggtgggatctcaccggtgaggttgttcgttgaaatgctgaacacccgcattgcttgcatcccggcgaactccggcggcaatccaccggagagctggttcatggacagctccatgacagtgagattcttaagatttcccagctcaggcggcagagttgaaacgagctcggcgttcatgatgctgagctgctgcagcatctggagctggccaagaacaggtgggatagtaccgcccagcgggttgaatccgagatcaagaaccttcaactgcgacatcgaccccaggaacaccgggacgccaccggtgaggttgttgctgtcaatccgaaggtccaggagcttcgtcaacctcccgatcgacgccggaatttgaccggagaacgcgttgaaggacaagttgaggtacatcagattcgggagcttttccggcagcatgtctggtatggacccagagaaattgttgtgcgacaggtcgaggaaagtgaggttgccgctgcggatgacgaactccgggaagctgccgttgagggagttgaggaaaagagacaggaacgtcatggtgggcatcggcgagaacttgcggaagtcgagcccggtcaggtagtttgctcccaggtcgacatgggcgatcttggggagccggctgagctggtgcgggatggcgccgacgaggttgttgttgtagaggcggaggtcgacgaggccggagaggtcgccgaactgcggcgggatggagccgtcgaaccagttgctgccgaggtcgagcgaggcgagtgagcgcagccgcgagattctggccgggatcgcgccgacgaggtagttgtcgttgaggtcgagctcagtgagcg

SEQ ID NO: 26490 - DNA, 204 bp, Oryza sativa
ctgctaaaccaaaggaaggggcttctttggcatatacccatggacaattcagggcatagtgtcctcgttctctacaatcgtgacaaaaggggacatcctcttctggcattggaagctcattgacctgggtggcaaatgctcgatcaaacacatactgattttggtcttgacttccaaccaatggtagctgtgaactaagcagca

SEQ ID NO: 26491 - DNA, 1501 bp, Oryza sativa
tgaaatcactaagtgatttatttctttctaagtttgggccgaaaagagacttgcttctcgattcgactttaagagatgtttttcaacagctcatttgataatgtaccgacctcccgggtcagatcattacttctcggctcccagagccattccacttgattaatcgtctcccagagcctttttcattttctcggactcccagagtccagctgcccagcagcacaacaatccgcttccactcgggaagcctagtctatgatgcccgtagacatcccgaatcacacagattcatttcttgaccactcaggtcatccatctgcctcataggctgattctggtaacgattcccacaccacaacaacttttcacaaagcacaggcaaacaaatctacgctacaggaaacacctcacatccgcccatgaccgtgggcacagctgttcgaacagttagttaacctctgcagagggggtacactttacccacacgacattactaacccggatcacccagcccgtgagatcagccacgtcgagagaccctaaggctttcatgacaaggcatttcgaaagccgacacaggtttaccatatgccaacaagaggggtcccagaccaacaccaggttaggtcccagaccatactgtgccaggaagcccgagggttctccctgacaccaccccgttgaatccacatgtctcttggcatcatggctcccccgattagctaattactcagccaggggcgtcccattgcacccgtgtggtcgcacttattatatgctcggataaatttcccacaggaatcggtccttatatgcgaatacaggacagtaccacataggcacaacccccgcatcgcgagttttcacaatctattttgttttcaaacacaccgacgccacatgtcgggttttcaaggcttctcaaacccatttctcaaattatcgacaaacaacggtgtatgtggaatagttgatatacgcactcagagaacacggataccgaagtaccacaaaggtggaacgataaggaatcagggtagtacaacctacaggaattagtgcgactactaggtaggtccgtcggtttggcacgcaaaccgaggccaagcaagttgagtgtgtgattctactaatgcaagttgcaaacaaaataataatgattttccaattataggagcaattggtcaaagggtgacttgccttgctcaaggtattcactgagcttcacgaatcttcaagaaatcccgcgattgacgaaaatccggtaaccgcaactatacgcaaacaatcgaaaacctaaacaaaagaccaaaagaaagatcctatttagactaattagtagtgccattatatagatctcaattttacggaattattggaagttgaatggaggcaatcggacaaacggatcgagagatatgaattttctaaggattatttgattttctgtctaaaggaaaaggaattattaattctcttggaaaagaaaaggaaggaggga

SEQ ID NO: 26492 - DNA, 1501 bp, Oryza sativa
cagccatgtatcagcaaagaactcctaatatctactgctagggaggctagaccttcgacatcagcagaacaaaaaatgcagtatgacatggacttcggtcaatttgtatcgtctaggaagtctgtttcaacgaaggtgcggttcatgctccattttttggcatataaacaatgcgtttttcaactgaaaattccaataccgcatcttattgatgctcccttctgtcggtgtttgatgtttcttgcaataagattcttggacagctactgaaatatttctttgcaggcaagggaatctaaaggaaaaaaggtcacgctggcttgagtctctctgcattggacaagtaaggccacctcttcgatctgttgtcttcatggttcttaggaatccatgagatatgaatttgttgagcatttcaatgaaccttgatgtttccccctctttgaatccaggtacaattacgttatgttcattggcgcagaacaagaatggcgagcgccttttttctgctcggcaaatctcagttttgacttaccaactccacccctcttctttgagaaagggaaagaaactcattttgtagattgtagtgcaggcagcgaggggctgtgatgatgtatagcattgtgccaaattttgatacgaatggcttcttcttgtgcagtacgaaatagaaatgctgacagaacgcgtgtagcgtttgaatgaacattgggggaacgtactgacgtatctaatgctaattgtgtcgatatactttatctgtttcacattataagaaggttttggttttgaatagattcatgcatgaatccatatatgtgcttcatatatatgttgaaattcatataaatgttaataaatcttgacgagggacagagaaacaaaaacgtcttataagataaaattcatataaatgttaatgaatcttgacgagggacagagaaacaaaaacgtcttataagataaaatggaaggagtaaatctttatgtttttttatgcaaagatctggtcttgatatgatcaaccttgtgcctgacattgcaatgtgtttattgtgccaagaatcaataatatagtacatgcttaaacgcaaatttcttacacaatttgtaatctgaatttgaatcgagagggacatacattgcccttttcttttcccccaccaaaaaaccaggatagcgctaccaatggcagcgatcagaattcccgtctgttctgaccgcccgatctagcacgtgcggttgagatcgaggctaagtacggtttaacgggtacatttccacccagcccctccatttacctcatattatcgaaatcccacaagcactcagaggtggggtggggccacatcgtcagtgaaacggacgggtatagggttagggagttgggggatcgggaggaagagagtagggagacgagaggaggaagaagaggcgggcagcgaggagggaggagatcggcggcgagcggcgagaggggaggagaaggtaggttgcg

SEQ ID NO: 26493 - DNA, 1501 bp, Oryza sativa
gtttaatgcaggcttcaaggaaaggctgttgtttttgcaattgattttatttgaactcttttctgaaagcaactaagtgagtgcttctcaaacgacatggatgagacagtgcgtctcgtccggtcggagtatgtgcaaatgtatcagtctttagaattgatcaagattggcacccggccaacaactttcaaatggccacccgggccaacaactttcaaatggccacccgggcctagctgatcccatcagctgcagattttccaaacaatgatccccttttcacaacagcaatttcacaaggcagtagtcgaacaacactacgctaggaatcacctcacatccgcccatgaccgtgggcacgactgttcgaacagtttgttaacctctgcagagggggtacactttacccacacgacattactaacccggatcacccagcccatggggatcagccacgtcgggagacctccaagctttcatgacaaggcatttcgtaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaagtgcaagagcgggaaaccgtacacccggtacgttccctggtccgcggttttggaaattcatttagttcgcaagcaccgacccaggtgtcgggttttccaagccttttgtaaaacccaagttttacccaagaagtttttcagattttaagtttgaaggcgaccgtcgatactagcatagggtgcacgaatatcgaggcgcaactagatggttacaaggggacatgatataacaattaacaaaggaaggatcaaatgcaacaaattaggtaggtccgccaatctgccttgcagacgggacaaacagattaagtgcgatcctatcaatgcataatatttttcaagcaacataattaaattcaaatataggctcaagatgttcaaaggtggcttgccttgctcgagatctggagcttgatcctcgaaatcctcgcactgcgggtcttcgggctccgaaactacacgtgaaacgggacaactcaacaaacggtgaaaataaagccctattaaagacctctaagcgtgccattagatagatctcgagatttgaggaattttggaagttgaacggagtcaaacggatttacggttgggaagatattgaatttctaagattattggatttttgggtctaagggaaaaggatttaattaaatcctttttgaaaaagaaaagaaaagaaaagaaaagagggagggaaaatagacttttcctcgggcggctagggcgcggcccgagacaaatggagcggtccggccgagctaaa

SEQ ID NO: 26494 - DNA, 1501 bp, Oryza sativa
atatccaaccgtaagaacgcagacagacaacaaattcacgtggcaaacaaagcccacatcgccacatgtgacgggactacaagtggcacaccatgacaccaaattcatcgtcgaggcccaaccacgtcgcgaaccacggcccctgcatgccagttcagttgttcgcagccgcggcggctgcccgctccgcctgcctcttcttggcgtactcggctaatgtgccggcgtccggcaagaccgccatggccgcatccagtgcggcgaagcggtccacccacgcgtccaggagcgggctcctggtggcatcgaagagcctcatcccgtacagggcctcgccggcgtgcacccagctgaccagggcgccgagcgtgacgtccaggtacccgacggcgtcgccgccgaagaagggcttccccttggagcactcctcgaaggccgcctccaggttcgccaccgctgtgaacgtctccttcaacgcctccgccttctcctcctccgtcttgcccatcgacgcctgcagccacgacttcaacagctgcgacgacgcaccaagcgcagcagttgacagttaatcaatcaccagaaacatcgtcatttggtattgattcgatgcaaattcaagacagggcgttgcgattgatttgaggcaatttgtgaatcaccttgtcgtcgatgtaggcggcccagaagcgagcgacggcgcgctcgtaggggtcggaggggaggaggggcacgccggcgccggggaacgcctcgtcgatgtactgcacgatgacctgcgactcgcagatgggcttgccgttgtggatgagcacgggcaccttcttgtgcaccgggttggagctgagcagcagctcgctcttgttgctgaggtcctcctcggcgtactcgtagctcaggcccttgaagctgagcgcaagcttcactcgcagagcgaacgggctcgtccacatgcccagcagcttcagctcatctcctgctccggccattagcttcttctagctgtagcttggtggtgaactgtgaatcgtgtgagtgaggttttgagatttgagatggttaaataaatggttttggttcgtgttctgtggacggggtagctagtatactgattgcgtggctcgttgaatgcgcgctcccatattcagatgtattgaaacatgtgatccgctaacctggtctaaaaaattaaacgaaggcatattgaaaagaagtaaatcactacatgaaggcattgaaaatgacacctggatcgatgacctggagctaaataggaacactacttttacagtggacctgatcagccaacttgtgtccctatggagcgcaacccaggacatcatactaaaccaaaatgagtcagaccacatcgtctggaagctctcgaatcatggagaatgctcggcctcttcggcatacaaggctcagtgtctaggaatagtcggcacaaactttaatcccctaatttggaaatcttgggctcctgcaaaatgcaaattct

SEQ ID NO: 26495 - DNA, 1501 bp, Oryza sativa
aagtcgatctcggccgtccgttcgcgtgaaccgtcgcccatgcgcccggtccaccgaaaccctagccgctgacgcaataaatcctcttttccttttgaaaaataattcattattgcgtcataattcaattaaaatcaatataagtgttttaatccgattaaatcttcaaaaattcataactaattcatcttagtcggatttagttggttcaagtctctaaatttttctaaaattgagatctacatgttaaaaatatccacatgtactgttcatgcttgtttatgtgctgttttggtgattttgctcttttcttcttagattccgtcgttaccggagagtccgtttttgcagaagaagaatttgaagagttccaaggccagcaaggcaagtcacacagatcccaaacaaccctttgagcatgttgatcctatttaaagctattgtttctattcaattattgcatttattttcgaatgtcattgggtggaattaacctattctttgttatagcccttttgttcttgattactttattccttgataccttggggtaatataacttgactagttgaactttatatatattggttcagctagatattagatatgattgcttagccatgcttagaaatattagcacactattgggataacttatgactcactattacttaatgatggcttaatgatagttcacgatgttctatcatgattggttaattaattaatgtgccaactaaaacctgataatggtgggttgtgagcacatggttttgatggtcgtgctcatgacaattaaggactggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtctatgccttgtttataagggggtgattatgatccaggaaaggtgcgctgcagtggattgtgttgtacgagaggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatatctttcgtgattagtctcacccttctcaccataataaaaggtgctttaattggtaataatttgattagctcctggtttggagatagaactgtgcagccgggatggttgttcagaatggttgggcctatacaacagggtatgttgtatagcgttggattaatattgtttaatacttaactgttttattaaattctgaaatgtttgctaaatgctgcttttgcaaatgaaaccctactatgccatcctttggtatccttgtgcacttgcatatttgctgcgtgacttgctgagtatgtcatatactcaccttgcaatcattcatca

SEQ ID NO: 26496 - DNA, 1123 bp, Oryza sativa
agggagaggcgctcggtgcggctcacgcgcacgcgcgtgcggcgcacgggcagagcgagggaggggagagagagaaagagagagagagagagaaaatgggccgagagggaatcggtccacagaacctgagggaggcaaaatagacttttcgggaaggattgagattagggatttgaatttgacgatggattggggatttgagatttggaattggcacggaaactgacaacaagcaaagaaacaatcttcgcaaatagggtttttagaattaaaattttcccactaggcgccacgacggaacgggcgctacagaccaacccccctaacaagaatcttgaccccgagattcagcacgtaagggagcagctccggaaactcggcgcgaagatgatcttctcgttcccaggttgcttcatcttcggaatggttgctccattggaccttgtagaacttgatggtctttcgtcgagtctgacgttctgccttttcaagaactctgatcggcctttctttgtaggtcagattcttttccagctcgatattgcctaggggaacttgttcttctggaacacgaagacatttcttcaactgagacacgtgaaacacgttgtgcacatctgcgagaccttcaggtaacacaagctgataagccacttcgccacgtgtagcgcccgttccgtcgtggcgcctagagggaaaatgtaattcctaaaaacccaaatttcgaaatatgtttccttgcttattgtctagtatccgtgccaattccggatctcaaatccccgatcgatcgtcaagttcaatcccgaatccaaatccttcccaaatcaaatccctccgcaaaagtctatttcgcctccctcaggttcgttgggccgaatccctctcggcccatctccccctccctccccatccctctctctctctctccctctctctctctctctctttctccctctcccccgctctgcccgtgcgctgcgcacgcgtgcgcgtgagccgcgccgagccgagcgccctctgccctcgttgccgtttcccgccgacgccgcccaaatcgccgcgccgcccattgcttcccacgcgcgcgcgcatcatggtggccgaccggccagtcgccgcc

SEQ ID NO: 26497 - DNA, 529 bp, Oryza sativa
ctgcagctagctggtgactgatcacgacagccaaatgcaaattgagaataaagcgaaaattaacgcattatcactttaatgatttcagggtggcacgcattagagggtactcaataaaaacatatttttctaaaacaaatgaataacatatgtgcgatattttatcacatatagcaagaaaaaaaaattatggcattataaccatgaaaagctatggaaaaagaaaacaccaccactacaatccgactagctgtcactaagcattatcgaccaccgctagactaacaaaagagctatagctataccgctcaacaacttcctacaaaccgtttaacgcctagctagcacctataaaatgtgaactcaaactgtgtagcaaaactagaaagttcgcgtctataggtcattaattattctgcatctcaaacttgcacaatcaaacctttcatatattcacattccgtttcctctaaagcatgattctaccaaattaactttttgcctctccggtcatatatatcccaacagc

SEQ ID NO: 26498 - DNA, 1501 bp, Oryza sativa
aataacaaatacatatttacatacataatatttttaccaaaattacagtacacttgcatatcatatcagctgaatttattaacgattttagttatataggactgtaattttttgcactaatcttgacgtatgatcctacagctaagaaaacatcaaatataatagaaaaaaatcactctacatacatggcgcgcaaaatcaaaaatttcgcacagagatcgagtcacgttgactaccacgaggcatgtccaaacacgggcctcatcctcatcccgcactgttccagcacgaatcatagtgcaatccaacgaacagaaaaacgtcaaataccaaacaaaaaatcacccgacaaagatattacagaatcgttccggaacaattcatctatgtgtcggaccgttcggtggatggacccgagatcgctaattagcaatcaatcgagccagacgatagttcttttttcaccacttaccttttctttttggcaccatatagtttttctttttagttaagtttatatacctaaagttatacatctgaagtttatacacctaaaatttattggtcaaagtttatatacgcgactcaaattcgaatttgggttcaaatatttttatatagagtatttctatacataatttgtttacatacgaagtttactgtgtatatatttataagtataaagtcacatgaatatatttttaaggattctagatttttatattatattttattcttttctaacttgttcttttttaatggtttgaaattcatggtgcagtaggaagggagcaacggggaggcacgtgcgtgttaggggagggaggggggggggtgcccgattgccatgggcgagcgatcacccggccattagccctccccttatggaccctatccaatccgatgtttgtgggtctggatcgttttgtaatattgtatgcacagatgtgacatcttaggatctctttaaatcgcagggttcaaaaaacggaggaatagaaaaaacacagtgtggagattatggttatcccatatctacacggcaatggtatttgggctgagtacaggataccaaatatagatagaatatcttatttgtgtctcgggtttgtttctcaacttgtacatcaaggaaataccttgagacttagtcggttacgactgtattttatctgtatctgcatattccgttagggatatggattatcttttgtaacacggactccttcccatatataaggggggtccgggtgcctctaggggcatatgttgattttctccaaatcatacaatcaataatacactcggcggattcatccccggacaggagtagggtattacttcttgaataagaaggcctgaacctgtataaatcttttgtctccaaacccatacacttttccagcttgatagccacccccttttattattgccgaaatctagtttcgacagttggcgcgccaggtagggggtgcgtcaagcttttcgccgatcagtgcaa

SEQ ID NO: 26499 - DNA, 1501 bp, Oryza sativa
tggccacggccatttttaatgatggtttttatttcggggttgcatatgaaatgaaaaaggttatgacctgtgaaaaaaattaagcagtggttttgtcactgcagacatcatcacatttgcattaatccggaaagaattccatgccgggtgtccgatttgggggaaaatattgggtgccatctacaccgtccgatttaggtggctctgctgcttgcggctacgttgggtatacctttcactttgtccaatgtgacgcccaagacttgttattcacaaatgattttaaacctcaaaacattttttttataaaatatttatttgattgcaccattaaattcattacagttaaatctttttaaaaaaccaattgaatagtttgcatgtaaattgcgagataaatcttttgagcctaattatgccatgatttgagaatgtgatgctatggtaaatatttgctattgacagattaattaggctaaataaattcgtctagtaatttacaggcggaattctgtaatttgttttgttattagtctacgtttaatacttcaaatgtgtatccgtatacttcaaaaactttgcacccaaagaactaaacacacccttcgacaatttggtcactttcatccacacagtgtcctcgctctctcgaatactggtcaagtaccatgtattttctttccaagtgatatttgtatccgtttggtgtacgctagggtatggctgtaatgaaaagatgatacttttgtatgtttgcaacattattctgttccgacctcttgtttttgactcaatgacaaatcccacggatgttgtatgtgtgatgtgatattcttattcgtcaatatttgtatcagttgtttggaaacttggacgttctttggttgtagttctacacacgtgtttagattactatatacggtaagatatattaggacatggcgttggtgccttcgagcatcataatcgcagtagcaaagttttgcttccgttgagctgttaatttgtctgcattcgagataggtttggacctgtacgcttacaagggatgactgatcatataccctactgaagaagacttcttggctatatacacttgccagttgatccacaagaccaagtctaggccttttgttttctcgttcgttcatggccggccgttggtacgatatttgccgatcattaattgttacaacatagtaaccgcggagaaccaatgtaaattcacgtttcaaatttttagatcacgtcgagctatacaactttgaaatagaacatatttctatccgagatcatttgaaaacttaaaaactttgttttttttttcaaaacagatctgggagcttgtaacaaatatttgactcctaaacgatctcaaaggaaaaaatatttcaactacaatgttgaatgtctcgtcaagaactataatctattgtcttcatcaagtaattgaaaagaagccaccaagttcgtatttgtgttagctgttgagaaatgtgtt

SEQ ID NO: 26500 - DNA, 1501 bp, Oryza sativa
gaggccgccaccggtttccctgaggcgcggcaggtgcccagcgcgcggtcttcgtaggggtagtctgactcggcggcgatgccgccgttgctggtgatgtagcggaacgcttcgtccatgtcgccgcggttgcagccatggttgttcctcccggtggagcagtccaacagttgctgcgtcgagagggcaaccagattgtgactcctgatctggtggatgccttccaccgctgccaccgctgagaacgcccaacagctcgctgtttatacatacgacgacacaaaaagaaaaaaaaaagtagttaatcaatatatggaaaatcatatttgctagtagatatctaacatagaaatagtactactggtgatccgtaagcaatttttccgatcattaattttattatgattagttttacgagttacttgagtttaattaagagatgacacaggaggaaaaagaagatatacatatatatataaaaaaagaaaggaatgaatgaactgaataattaaagctcaccacaatccttttggttcttgacttgggtgacagcgcctctatccctccagtttatgttggctggcacgtctgaggtcctcacgttcccgtacatgaagccactacctccaattacaggcgtgctaaacggcctaccgtagtactccgcgaactcttcgtttgtcaggtcggcgaacttgttggtcgtcagccgggggctcttcttgcctcctgcagcattaaacgaatcgatgaacagggcgttggtcctgaatacctcgaatcgccgcgccttctccagggagtccttgtacgtgcgcccatggtccgccgcccacttctcgtacctctccctcatcgcgctgtcgtcgccgccgccggcagcagccggccccttgcgagctgcctccaccaaacccgtggggcagcagtacatgatgatgatgaggaggatagcagcaagtgaaaacgacgacgacgcgatagccatgtcttaagtacagtaatatatttaattagtacactggtgcagttgattgtttcagagttgagtagagcaccagactcctctatgcgcttacaatgtttgagttgttactagctaaccaggtaacctagccagttgctcacttgctcattgtcctcttcttctctaggctgctggtcggttttatagaacctcaacctgcagtgtcaccgtctcgatagactgcgtcctcattttgcctggtcgctactgaggattgaggatactaatctagtcccaaattaacgttattgcatgaacgcggtctaattaaatagaaataaaagtttttaaaggttacaatttaatttcccatcaaatgttcaatttgacacataaattattgcaaaatatatattttacttcatgttagattgaatttgatcttgcatttaagcagtatgtaacacaaaaaaacccatctaagtaaatatgttctttgacaataaatagttcttgtctttagaaacctatacc

SEQ ID NO: 26501 - DNA, 1501 bp, Oryza sativa
tgttttttcctatattttgtaatcctctgttttatacttgcattcttatcaaaatcctgtgtgtcgaaactagatttcggcaataataaaagggggtggctatcaagctggaaaagtgtatgggtttggagacaaaagatttatacaggttcaggccttcttattcaagaagtaataccctactcctgtccggggatgaatccgccgagtgtattattgattgtatgatttggagaaaatcaacatatgcccctagaggcacccggaccccccttatatatgggaaggagtccgtgttacaaaagataatccatatccctaacggaatatgcagatacagataaaatacagtcgtaaccgactaagtctcaaggtatttccttgatgtacaagttgagaaacaaacccgagacacaaataagatattctatctatatttggtatcctgtactcagcccaaataccattgccgtgtagatatgggataaccataatctccacagtagcccccgagacctttgcagtcaaccatcgtagccttctcaaagataataatccgagtgctttcaaacctttcatgccaagactgtaaagggcgaaaagataaagaatacggtgcatcgaatagatgcacctaattaggtgtagcccccaactatgtgattagttaacaaactaaacatatagttgagaacaaaataatagcacaatcgtgcatcgcatgacaaaagcatacgcggcgcctaaagaggcattctagccgactgctttttagccataataaaaggaatccgagtggttagcactctaaaaggttcacgaatgaactcacttgacaggcatccgaataaaaaactctaaagattacccaccaaatattataaaaattatggtaatgaataagtctaatagcctaggctatgactatttaccataatgaaaacaggcatataacataccaaggaaatgactatgataaaaacaagtcattctaagttaaccctgacagctttcgtagcctaaaaaagcttacaaaaacggcataacacctttctgtcgggcaccttttaatttgcattgcaataattccaaagaattatatgaccgcgtaaaaaggattttatcagcattgggcaacactattgtgcgcataaattgccaaagcaaaaaaaatgcctaagtccctaaggagcacaatgggccacgctgtttaaagtactgggctgaggtactgttcaggcttaggcccatttgcacctccgatacccttaacaataaatcccaagatccaatcgacgcttcgtcttccccgccggaactctcgccattttccccactccctgctacagtacagagctgcgccggcaaactagggttcaccattccactcaaatccaccttcgaaaagttcatcaaaatccttcctgtgatccaccgcctcaatccctcacttctcccaagccatccctcgaatcaaatcagcgcattcggataaaatcaa

SEQ ID NO: 26502 - DNA, 1501 bp, Oryza sativa
tatgaagtcaaaactttaaaaattatagaaaaatcattttaagtccaattgtggtaaaacaaagttctttgactaacatcaactttcgtaacatatcactcttataaagacttcatgacataagtaaacaatcatactaattaaagaaacagtttaagaaatatagactcgatcatatttaagaaaatactgtaaggattatagggaactttgtttcaactcaatcagacttaaaattgaattttctataacgtttgaaaattagacattttcaaaataataagagaaaaatgttttttttccgtatggacttctttaagggatctccctttaaataatttttataggcggctctcataaggaaaggcctgtaaaaatatgttttataggtggttctatcataaaactgcccttaaaaggggaggagagcactactaaaatatgacttttcataacatatgaagtatgatggtgacaatctttctatgagaatctaattgtactgactgcggactgtggagttgtggactccctccaacaaatagttgtttataatctgaatctcaaatatttctaaatatatctaaatatttcagatattatttctctacattgtgtattatttcaatactatttatttctttattttcaaaccgaattttacattgtattttttttgcatgtagtattatttaaaaaatatttatttattataaatccaatatttttcaaatatctaaatcgtatttcaacatggactcttctctaaaaactatttattttttaatctgaaatttacatatttctgaattttatttttctacatggactattcttttcatattatttttaatttcgatttcaaataattctaattcatctttctacttggactcttttattataatattttttattcagaattttagactttaagttatatttctacatgagcttttttttctgtttaatttgagaatttctatgccatgatagagaatgtggtggcttatttttctattaatttattaagataatagactataatcctcaacgagatctttaactttctagttgaaagttttgtttttcatttgagatcgtttagggtcccaatattcgttacaagctatcatatctatttataataacatttttttagttttactaatgacctttggatggagacatcttctatatgaaagttaaagagctgggagcaatctaaaagtttgtcttcaaaatttgtaacatgaattttgtcacttttttttgcagttactctgcgtggtaaccatgctaccgttagggttggtaaatcctctcgaattcctaatacttaacatgcaaagataccacatcatcatccactaacacttatcatatttaagcatcatgtaagcatgctatattatctataatttaatagtttattaaattttagagaactaaaatgtaagcatgccaaatcatccaacataattcacgtaatatttcaata

SEQ ID NO: 26503 - DNA, 1501 bp, Oryza sativa
cctaatcggtttaaaatcccggatttctctaagttttcgggacaagagggcgtatcaacctacgagcatatcagccgatatctggctcagtgtggagaagcgtcagctgtggacgccttgagagttaggatgttccgattgtctttgtctggatcagcttttacatggttctcatctttgccatatgggtcagtcaatagttgggctgatttagagaaacaatttcatagctacttctacagcggggttcacgagatgaagctgtctgacttaacagcgatcaagcagcggtatgatgagcctgtacatgagtatattcagaggttcagagagatgaggaataagtgcttcagcttaagtttgaccgatgcccagttagccgatttggctttccagggtatgatccctccgatcagggagaaattttcatccgaagatttcgatagcttgtcgcatttaatacaaaaggtaaccttgcatgagcataggtcggctgacgtcaggagaagctctaaaaaggttaaccaggtctgccagtatatgtatgaatcagatgatgaagatgatgatcctgagatcgctgcagccgagtgggtgaggagcaagaaggttataccgtgtcaatgggtaaaaaaccctggaaaggagcaaaaatatgattttgatataactaaggctgacaagatctttgatttgctaatccgagaaaagcagattcagcttcctgccggtcatacgatcccgtcggctgaggaattaggcaagaagaggtattgcaagtggcataattctggatcccattctaccaatgattgtaaggtcttcaggcagcaaatccaggtggccatcgaagggggaaagattaaatttgatgactccaagaagccgatgaaggtcgatgggaatccttttcctgtcaatatggtgtatacggcaagtcaagcagccgatggacctcgtttgaagagcttccaagtacattcggccagaatcattgataaatatcaaaggaggtataacaagcagcaggagagatgctacgaggagaatgacaacggttttgatcctcattgggattgtgaattcttcagattctgctggaatgaagggatgaggttgccatctatcgaaaattgtcctggatgtagcgacgtcattaagagcttaagccgaccacatgataggggtgatcggctgagacagacaagactccctgttcatcaaagattgggtccaatgagtcacgatcgtaatcaagaggacgagttgaccaggaagaatcaatggtgtccttctggtatttttacgaagaaccagaaaaggagggtccagagattgaggagtagggagcgtttccaggaggttgaagaggaaatcaaccattgactgaggaaaccaagaccaaggcaggtgtggcgcgttaagacccaagttcctgcagccgatgatactacagccgatgaggcaaagagattggcaaaaggaaagagtgtcgttacag

SEQ ID NO: 26504 - DNA, 1501 bp, Oryza sativa
atctatatatgttgttctagttcctttaaactaaatatttttaaagttattgatggtcaaagttataaaagtttgacatcaatcttgttcaaaacgtcaattaatatagaaccggagggagtagacaaggttgttaatagtattattggtctctccttgtctcttaggatagcccaatttcccatttccaagtgatctctgaatatttcggagtgtctgttgttgcttggataactagttcagaaaatccctggttggttccagaatgtgactagaatagaattattcattagcataaaggcacacaagtcgtaatactatttaacaagttcttattacttcttggcatgcatgatatcatcatattctgaattgtttcttgtgttttaaagggatatatgcttgccctgattccttacagcaaaataaaatttatggattcatgctagtgcatagcttccagtcagtgggagaaatgaatcaggatgcaacagtactctgaattatattgttctagatttccatttcattctattagcgattctaacaaccaagatgacctgatgcggaaatgtatgattctctccaatgcagttccagcgcaggaacagaatctacaaggaggagcaacgtaagttaagagctgctattcgtcgtagggaggaggcggcaaaggagaaggctgagggagctcctgctgtttcagctcagcattagccactccgataaaattcatgtgtgctttttgtttgctgtcaaaactttgttctactgtgatgctaagagcaaggcaataattccccaccttcatgttggactacacaaactcttttcccctctcactccatgactttgatctgtatcaaggcgttgcataaaccatcatggtgatgaagttttcgtgcctgttttggataattttgcgataatgatggttggttcgatcatcatattttgcacgtttattgctatcgctcttgatgttcttataggattgacagcgcaacattggttttgtcgattgtacttggaatggtcttctgactgttgctttgcatgctcgttctattataattcttgatggccacttttccattccatgcttgggttctgaacttgaactcgcgatcacataaccatggggatgatcttgtttttcagcatatttcgctgcaaatgcaaacagcatgtggtgacggcaataaattgatttcaaattttgctgtgcaatcatcccctgttgcatttattgttttttcccgtttgattcagtagtcttgtgtgttgactcgtttctactcatacatattagcaaaacagggataaacaagtccctaaattatcttccattgtttcctaggtctcaaaatcgtcttgcaagtgttaattttaacctcaagatatcgctctataagtcaattgatctcacaaaacaaggctacaacatttgtgcaaataaaatataattaaaataccgaaacaaaagaacgaacaacatagc

SEQ ID NO: 26505 - DNA, 1501 bp, Oryza sativa
tgccacaatgccacaatgcaatccagcttctctcgaaagctaataataaaaataaaatcaacgaagaaactaggaaatgatgatgatggaccatctcatcatccatccatggaggagaaaacaaaggccacattggatttggatctggaaagcacctacagggagaagagaggacaattctaaggcaattagcaaacaattgggagtagttgggactcaacagtgcattattgattgcatttacatttgccctctccaatcattttcaccagcattcattcatgcatccatctgtactgtaccctaaactaaactgcactctgctaagtacttgccgcactacattctccgattaaattcttattgattcctgctaaggaaaggagatgatgagggccatttcttaatcctaaagaatgtctactaactcattggatacgggattttttcattctattttatttgccaaatagttattggctagagctggcttggactctggagagcatgattcctgcatgctttctggtcaagcaacactattatcatagcattatcaatcagatgatttgattagattaggttaggtttgttattcacctaaatcaaggcatgagcacttgggcatacaatcaggagagtaggagtagtaggtaaagggagtaatgtacagcgtacactgctggggtctacaccctaatattagtatacatacggctacctgcctatctgtatcacaccacaaatgtatacaacagcaaagcgtaccagctgattgatggtgtcactcaccaaatgttctttgtttttcagttacaagaaaaaaatcgatggaataacaaatacggagcactgaagttgcatactttggccaaacatagatggaaattttataattcgtaatcgtcacttgtcctttaacctatgtaataatgaaatgaattctattattgagaaaactattcctgaacttgtaccggtatacggcccttcaagtacacggttaagtaattttcagcagatgcatttattccgaaagcgaaaattctgaaaaaggccaaaagaagagagagagagagagagagagagagagagagagagagagagagagagagtggcaggcagctagtccacattcaattcagtattttcagcgcagtgtgagtataaaaagtggcagagtctgaatctgtcaactcgatcttcccttctttctctgcagccctgcactgcatttccaaggctggagattgatcccacccaacgaaccagcgacaaaagggcgacggtagaaaattattttcaccaggaaatgaggaagagagcaaggggtttttataaaatctccagcttttttctgttcctctggtcttgattcttgaactgccctcaagaaagcaggggaaaggaaaggactcccctttccactgggagagagaaaaggagagagagacctggagaaggggggaaagggaggaggaagaagaggggagagaggcca

SEQ ID NO: 26506 - DNA, 1501 bp, Oryza sativa
gccagaaaacaactgtgacggcgacgaccccaacatacacaaggagccaggacaatctttacattatttttatctcttagaaaaaaatatgtcccataacaatttttttttcaaaaggctcaccagaccactaacaaataggcgaaaatatctttaataatatccaatcgtttcctaccctcttccaacggccaggatcatcttgtttgccatatcaacggtcatggctgatatcctcatccaccaacccacctcaccacacccatccccacataaacccagtccatacacgcaaatctaatcaaaaccacatgtatagctgcagaatatatataacaattctatcatatatacatactacaaacttgcactttattattccaagaattgataccatttccagcatcttttttaaacctaactgtagaattttgtgaaagctacaaaatcagtcaggtcaatgttcatgtaaaacgaactaattctcatcagattagtgtgctataaacataagcaaaatatataaagaaattagtaagatcactcctctatgtgaatattttcacacctttgccaaatatgcataaattttttatccaagatgttgcatatacttcctccgtttcacaatgtaagtcactctagcattttccacatttatattgatgttaacgaatctagacagtctagattcgtgtctagcttcattaacatcaatatgaatgtgggaaatgctagaatgacttacattgtgaaacggagggagtacttacctaggttaacatttgttaagttttttttattgtgtcatattttcatcatttgttgataatgctatactttcttttcagtatagactatgtaagtaagtagctatagcttctgttaaaacaaatgtcaggttttatctattatctaaaaacatccaagttaccccctctgcttcatattataagtcgtttatttttttcctaatcaaatattgttaatttcgacaaaatttatagaaaaaattaacaacatctaagatattaaattagttttattaaatctaagttgtatatattttgataatatgattgttgtgttgaaaatactaatatatttttctacatatttagttaaacttaaaaaaagtttgataaaatttttttaaaggatttataatataaaaggagggagtaacatttgttaactacaatataaaaactaatttaaagatcaaataagtacaataactactttataaagattataggttcaataattgcggcgaagaaagtgctcctaatctcaccagccatggcggcttaggatgctggtccatgcaccatgtccacgtccacaccatagccccctcctttttattggctacgagtccccccaaaacgcacccccaagtctatacataacccatcccatctcccaccccacaacctcgccatctccgcctctcctcgccaccacaccactcctctcgccatggccgcgcactccgtcg

SEQ ID NO: 26507 - DNA, 1501 bp, Oryza sativa
ccgcatgacctcgtcgtagaggatgtgccccatgggcgcgcaccccatgggcaggccggggtgccccgagttggccttctcgacggcgtcgatggcgaggaaccggatcgtgttcaccgacttctcgagcagcgcccccgtcgccgcctgcccctcgagcgtctcgaccgccgccgcgcgcacgcggttgttgtggcggcggcgcgacgcggacgccgatggcgcgccgcggcgaggcgggagcggggagcggaggccgcggccggcgagcgcgctgaggcggaacccgaggcgctccggcggcgcgggcgctggcgcggcggcacccgcgcgcgcggcgatggtggcgtgcgcggcggcgacggagtgcgcggccatggcgagaggagtggtgtggtggcgaggagaggcggagatggcgaggttgtggggtgggagatgggatgggttatgtatagacttgggggtgcgttttggggggactcgtagccaataaaaaggagggggctatggtgtggacgtggacatggtgcatggaccagcatcctaagccgccatggctggtgagattaggagcactttcttcgccgcaattattgaacctataatctttataaagtagttattgtacttatttgatctttaaattagtttttatattgtagttaacaaatgttactccctccttttatattataaatcctttaaaaaaattttatcaaactttttttaagtttaactaaatatgtagaaaaatatattagtattttcaacacaacaatcatattatcaaaatatatacaacttagatttaataaaactaatttaatatcttagatgttgttaattttttctataaattttgtcgaaattaacaatatttgattaggaaaaaaataaacgacttataatatgaagcagagggggtaacttggatgtttttagataatagataaaacctgacatttgttttaacagaagctatagctacttacttacatagtctatactgaaaagaaagtatagcattatcaacaaatgatgaaaatatgacacaataaaaaaaacttaacaaatgttaacctaggtaagtactccctccgtttcacaatgtaagtcattctagcatttcccacattcatattgatgttaatgaagctagacacgaatctagactgtctagattcgttaacatcaatataaatgtggaaaatgctagagtgacttacattgtgaaacggaggaagtatatgcaacatcttggataaaaaatttatgcatatttggcaaaggtgtgaaaatattcacatagaggagtgatcttactaatttctttatatattttgcttatgtttatagcacactaatctgatgagaattagttcgttttacatgaacattgacctgactgattttgtagctttcacaaaattctacagttaggtttaaaaaagatgctggaaatggtatcaattcttggaataataaagtgcaagtttgt

SEQ ID NO: 26508 - DNA, 400 bp, Oryza sativa
gtatcaagatcgctgcacagcttgaacttgcaggcacagtatgcacaaacagtaagcttgctgcctgtgtgagtagtgagtacaaacagtagcaaaaggatgcaaatagtccggtttccagttctttccagttcgtgggctgcatttcaccgcagaaatgacatgcaaatctatagtatatttaaagccagtactgagtagtagtactatgtcaatatcaaatgttgctaataatgctaccactataaatcagaatcaaactccagctgcactgacactgtgtatgccatgccagggttgtaccgggcatggaggagtggttcatactggacagcattgtgcagatagatttgaggagtagtaggagtatgcaagaggaatcttgagacctactcctaca

SEQ ID NO: 26509 - DNA, 284 bp, Oryza sativa
catctttgtcgatttgcgccgtaaatcgtccaccgcccctacaagagtgcgacatctctttgtaggtttgtcctgaaaaccttccgttttgcccacgagacgggtagttatctagaatcggctccgttagccagtttagttatcaaaacctatcttggtttagcttttgctagattgagatggttggtgactctagtatcaacgcaaggcgtttacgtgctgcgatcgtgcttgtcaacttgtcacaaaaagttgccaagatgatttttggcgactccactagg

SEQ ID NO: 26510 - DNA, 1501 bp, Oryza sativa
tttgaaccatagatctatcatctaatggctagaaataattgaggtgatgtggcttattaagagaagagggaaataacaataactacacttagtgaggattaactatataagtatataggatttattaaacaacaaaaatattagtaatttcataaaccatggtaattaaggttgcaggggatgaaatttacacttatgtattttttgttgggtcggaatgggattgttggaccggaatgtggccaggccgcaacggggttacgaagattatgcctgccgttcaattcaattagttagctcgaccccgattcactgattagataataaccattgtaatttgaaaattcagtgataatttcctggacgtgaagattgaaatgcgatacatttacagcaagtcaactgatcgagcactcacttaactaattaagtctactcctgccaagaattagtgcatgcttggacttgacctggtcgatcttgtactcctggtaatttctaggaatttaatatgctaatagctatactagctaggttagttgagatcgattggctagggaaaaccagcgatatcggtttggacgacactgtcaagtgaagccacacctatggactatagtctcttacttagaagatatatttgtgaaacccaacaaattcaaaccgtataaccttcaaaaacaatacatgtagctatatatgacttacatatgtgttcttcaacattatttaatctgacctgcagtcaaccatgaaggtaggaaagggatagatcgaattaatttcaagaacgcgttatgaccaacagacatgataattcaaactaaatcaacttgcaggtcaaccacgaccctgtttgtacttataaacatatatgcatggatgatgtcatggaaacatggattgtagtcaaatacctataggaaaaataaataaataaatttggtaacattgattaattaggatagcataagcctatacacaagcatacaggttaaatctacaaatagaggggaaaaagaaaaaatcaagcagcgaatagtatgtgtgcaacatggtgaaaagcatttcttttttttctacagtttaaatttagatttgcatgtttgtttattggtttataccatcataatctatcttgtaaaatttcattaaattttttttgcaactattcaagttaaacacatttattttcgtgcaattgaacataagcataaacttactttctgataggtacatactaaaatacatatgttctgtttggaaaagttttaaattatgataggcatttagttaatagctggagaagctaaaaaaaccaaaccagtttatgattttaaatttattttctgtatgtaactaccggttttcttagaatttgatgaagattgatattgtttgaaaagtttttgattatggagaagctgcagcggcttaaaacctccctaattaagaggccaacataagtgcatatgtactgcaggcataagtgcatatgtac

SEQ ID NO: 26511 - DNA, 1501 bp, Oryza sativa
catacagacgacgtactacagagctagagctagctagcgcctagtgaatagtgatagagtcctatatataatggcggaggtgcaggtagatgaggtagaaggaggcgaacggcggcggcggcggccgctggcggagtacgcggcggagctggaggcggtgagcttgagcgtgcgggcggcgccgccgctgcggctgaaggcgctggtgcgggcgtgccaccacgcgctggccttgttcgacctcctcggcgtggaggccgggttctggaagacggaatacgcggagcggctggtggcgctggagcgcgcggcggaggccatggacagcgcggaggagctcgtcgaccgcgacgtcgccgccggccgcgtcagggccaccggcacccactccaacaacctcgtccgcgtcaagcgcggcatcgagctcaagcgggcgctcttccagctcatgctcgcgcagctgcagcagcagcgaccaggaggaggaggagtctccttcgacggggtggtgtccatggcgtacgccgccgtgttcgcccggtaccacgacaagaacgtgcagagcaccgtcgccgactccatctgcgccatccccgtcaagtccatttccgacttcttcgccaccatcaatgagaccggtactgttccatccatcatccatctatagatcaggtttgctaattagcgcagacacgctagctagctaactcgcgcgcatttcggcccacggcaactgtttcgggccttccagcccacttttgttttctttccgtaggaaacgacacagacatacgcgtgcaccacacggtaacgtaattagtttctaataatcatcgttctaattatcgtgctaattatttttatttttcttttttataggttgtttcttgtactaagattttaaaaatccttacgtgaaatttgaacatttttcagttcaaattttgaaaactttcatcccgaattttaaaaactttcaactcgaatttgaaaactttcaacttgaatttgaaaacattcgacccgaatcttgaaaactttcaacttgaatttgaaaactttcgattcgaatcttgaaaactttcaaatcaaaatttaaaaactttcaacttagatttaaaactttcaatccaaatttaaaaactttcaacccagatttgaaaactttcaagtcaaatttgaaagctttcaactcaaaatttgaaaactttcaactcaaattttaaaaatttcaagtcaaaataaaaaaaactttcaattctacatttgtaaatagatatgcaaaatattgaaaaaaattggaaagaaacagaaaaaaaaagtgttggaggagtcaaaatcaggaagaaagtgcgaaaaaagaaaaaacaaaaaaggaatcggaaaaaagtgcgaaaaaaagaaaaaatcaaaaagggcgcgtggagacggcccagctgacgtgcgcgctagcaattttgctggcacgtaagcgcgcactaggatccccctctatagatgg

SEQ ID NO: 26512 - DNA, 225 bp, Oryza sativa
atttaggtagatgcttcgctgattaataggacaacattaggtggtttttataactttagactttgggaatattcatatctcttggatactatggaatggttggcttatggtggaattggacatacccctttcttcctctttcaaaacccctaaaacctgttgtccggtggggtttgggtgcatgccagttgtgggaagtagcaccccggccaatataaggattaa

SEQ ID NO: 26513 - DNA, 1501 bp, Oryza sativa
tgagagattgactgattggctgaatttccccttttaactagttgattcccctgcattttgttgcggaatatatgaatgaatgcataaatatattataaaaatgatatatgtatgtgtttaaatagtgtgaaaatgaagtggagataatgatttgacattggttgcatattgagttctaaaaatacaacaaaattgtaattgatatatcatgtttgcatgatatttaaaatactctagataataattgctagtggcacatttgcatgttgtttaaaatattgtggataataattgctattaggtgatggtgtgacatactagcatgttaagctttacaagttactatatatgcatcaactttatagtgagataggatatgtacatgctcgtttagtgaaataatgaaaaattggaccaccatatatatatatatatatatatatatatatatatatatatatatatatatatatatatatatatatatatatatatatatatgtatatatatataaaatatgtacatgcacggtggattaggaataaggagtaagtttcaatcattagaaacaacattagattggcaataatttgtgttgaatgctaatctgtctaaaatttgctaggaatgcattttctttgaggcagtagtaatacttacctttggtcactattgtcagtccatgcaaaaaaatgtttaatatctaaagtttccttttcgaattcagtgcaattattatttttagtatgtatcagccactcaaacattttatttagtgaggacgcttaccactttatgatgtactacttccatcctaaaataaaccaatttagaattagatggaacatcacatagtataacgaatttggacataacacatgtccagatttattgtactatgtgatatccaatccaatcctagattggtttatttttggatggagagagtgcactagaggtaatatggttattttagaaaaacaatataatggccacttaacagccaactaattaacggaatagaagtatagaggataatataaaaaatcaggggcataaaaaggattagcaaaatttagcgacatagaagggattaggtaaaagtttaggggtatacaaaaatttctgtgttacaaatagcaaatgcatgcatgcagcattaagatacttcttgtcttgattgcttaatgcaggagagctcggaacagaaccaggtggaggtagaggtcaaagccgaatgcatgtggcactaagagtgctacaagaaattggtattgctgcagaagatcctggccttgagggcatgcgctataaaatctataactggaagatgattaacaaggaggatgttaaattcaaggaaattgccgaagagatcgggataaaagctagggtcatggctgcaggattcaagatatctagcaacttcaggaccaccaagccaggcgagatttactcctacgagcctaacaagagggagaaaaacgaggatggagtcac

SEQ ID NO: 26514 - DNA, 405 bp, Oryza sativa
ttgctcctaagcattatcaacaaggcatgtcaaatgggactgatatgcaaacctatcaatgagcctgatggaggcggattaccaattagtcaatatactcgtgatactataatcctgatgagggcttcacataatgaactttttttttgccttaaagctttgttgaatattttgctcagcccactggcctcaaactgaattttcataagtcaaagtgtaatacctcgtaatgtactagaagtaaaaggtggaacaactagctggtacttttgggcgtgtagtaggaactattccatttacatatctatacccttaccttgtactacaaggtcaaggggattaaaatcatctaacctatttctctctaacctgtgttactgacatatgggccctctacccagtaga

SEQ ID NO: 26515 - DNA, 705 bp, Oryza sativa
gatacattagcaaaatcattgaaattcaaaaaattgtaaaactttacatcaaatttgaaaagtaattcttgaataaatatacggttttaaaagtatggattttgccataaccatgtactacctcctccaaaaagaatgtatttctaccatttcaaatttgttaaataagttgtgtttctagcaaggtgagaccctactaactaattagttgatgaatatatcctacctccggccctcctatatctttccatccctcatctcgccatcctgttaatgcatgtaatttgagagattgactgattggctgaatttccccttttaactagttgattcccctgcattttgttgcggaatatatgaatgaatgcataaatatattataaaaatgatatatgtatgtgtttaaatagtgtgaaaatgaagtggagataatgatttgacattggttgcatattgagttctaaaaatacaacaaaattgtaattgatatatcatgtttgcatgatatttaaaatactctagataataattgctagtggcacatttgcatgttgtttaaaatattgtggataataattgctattaggtgatggtgtgacatactagcatgttaagctttacaagttactatatatgcatcaactttatagtgagataggatatgtacatgctcgtttagtgaaataatgaaaaattggaccacca

SEQ ID NO: 26516 - DNA, 1501 bp, Oryza sativa
gcatgctaaattgagcagatccaaaggaggggacaaggctaaagtgattggacacactcctagacaatggggcagagctaaattggttgaagcaacggtaaaaacaatggctctagggactccaaccatggaggcatgccagtattggcacaaagtttacacaaaaaaggatgaaagggaagagtgaagcggactttctaggggccaatggcacgagaaatgcattgaccatagttccacgaccgtaatagaaaaaacgaagaggaaaggagttggcaaatgaagaaggtatgtggagatgtcatcggggaggcaaacggatctagggttaaaagaggataagagaggaggcacataggaaaggtagccgctggcaacggcagccataggtggacattgttggttgggggtggaaaacatcctgaagaagaagaagccacgtccaccaacctttcacatgagggagtcaaaccgaccgaaacgggtgccaggccaactagatgcaccactagccatgtggttgtcattgttcaccaagccctcatacacaccactgcccatcgtgtcttggagatgcagcctacacaatttggcgcacatctagccccatagttcatcgggtctctccagtgtctgtcgtagccatccccaatgccatcacattcatcatcacaacccgataattaatgtcaacttgttcactatatgtaaacctctagatttggtaggaggggagggggcgttatgagtgttagggaaaagaataagggtgacgagattgtaaacgagaaggggcccgatggttagccactaaagaggggcacggaagtttcatcctcagaccttcaagtgagtactctaccgaggatagtatggtttcagagtggcagcactcaaagctgaccattagggatccaactcttgtgactttagggctaaagacataggagaacaataaagcatgtcttgtgctacagtacgaaacagtaatctgcagtggtttaccgtagcaacagtgataagcaggaaaatatgatgtacaaaggtactgtttgcgtgttactatattgtactgtagcgatcgatctcatccattcgctgcaaatcggacggctgagaataccctaaagaggatctcaatccgaccatcagaggctgaagaccctctgccacatttattttaataaggaaatcagaaatactagtctctcaacacataataattgttgacaacaccaaagaacttcacacagggtgcacatacatgcgctactaacaaaaaacaaaacactctgaagcctgaaccaaacaagtgacattatattggccactccattatgattgtactaaacaatgtgacagaaatatagaatgtccatttctttttcatctgtcgtctgcttacgttaagcccaagtgccaatcactgtcaagcctcatacagagagagaaagagaccttgtacagtgcctgtctgtctgtacttatctcccggaccggt

SEQ ID NO: 26517 - DNA, 777 bp, Oryza sativa
aatgtcgcatagcagattcgcaacttcaaggtagcctgaaccccagaacatcccacaaaagcatagagaatgataagctgtgattagactcagtctgcaatgcagaattttcaacaacgcatactttgaccttatgtttgatgagcccatccaccaaagtaacccttgagaattagtgcctgatgctgccaattcggtgagaagcttctgagcataaggatcaacaaccctgctactgctccttcctgaccccccccccccccctctccctttttttctcttttcccttaatcctctgcctcttccctgttcgcttgttcattgttctcacgtcgaatgtcttcaagctggccaaactttactagggaagttggtgcaggtgttcgtatggcgttctttacacgtgatgccaaatgagactagatgagaaaccaagtgatcacattcttgtttctgcatctgcaaaatgagcgatagaaaaacacctatcatttcaatacaccatccatgatgcatgcatgcctgtcgaatgatgagagaaaacggagatcttacttgatctcccacttgcacatatcgaacaaaaaaatcttgtgctgaagggggttctacaagcccatctcctaagagactacatgctctctttgaacacatatttgccgatggcacagaaatacgcttgtgtccacgtccatgtaatgctggctcctgaggtaatcttatgtttgcatcacccacgccggggtcaactggagaccatttcatctctctcgcagg

SEQ ID NO: 26518 - DNA, 1501 bp, Oryza sativa
agtgggtgcaggaagaaacaaattccccaggccatcagacccatgaacaaagtcagcaacacgtggctctcctccctaaagtacaagagcacatcattaacaagctcatccagataagcatggggcgttgactggaattgaataggaaatgtagtatgatcggaagtctgcggtcttaattgaatcggtggcatataaaatgttgatgcttatgcaaataaaagtaaactgttcaatctatattataaatagaaaaatgaatattatattaagccttaactcccacgggcaaaaaaaaaagaaggttgtgccctgtacatccaataaactaggaagactgtttcgtcttatttttaagatgtcacattagctacacatttatgattgacgctaatcaagtcagcactcaagagccatttaaaattgatatttgacaatgtaagcaagcataaacgaaggaaaagccatcaaatttgaaagcagccatgaagatcggtttgtgcgggagaacatgtatcaagattcatgttgctcgtcgtacacgctaagtcttacattgttacatataactgtataagcatatcgtgaaccagcgtaccttgagaggctctgcgctgccctctgctactggaacctcaggatgtcctgctctctcacactgtcattttcaatacatgccgctgttaacaagaggccaagagcaagaaacataacaaaggatattcaaccatctcaaatctcaccagcaagagcgcattctgagtcgcattctttgtggtggtgttgccaaatatggttgtgagccctatgatctccacagttggagctctgaacgccataaggattgtcatgctatcatctggaaccagtttgtaaggaaaagaattagcaagaagtagtttcctagaaggttgaaattcagatgtattttctgaagacatagaaatcagaaagcacatagtttgaggcaatagattcacaacaaaatcttcttcaaattatctgtctagtatttgtgccgtatcggtctctctctctctcaagaagtggatgtagttttgcaacaggagtgaaactatctctcttttaaccttgaattgttttgcgtccaatttaaatagaacatttagaatttgaacataagaaggtcaattggaattggctagcacaagcatcagatgtcatgcatttctattgcacgatcaggaaaaggtgaatgtatgtgaaaggggaatctgtaacttctcaatttacactaaaatgttgaaagtgtgacacacacacactcgtaaagctgctcttttttaaccatcaactaggcaaaaatcaggaaacaaaacggttcttcactgtagttaaagtatgaagaggtggcccccacgaacgacacctaggtgagacttgagaggaatcatggcgtagtgttgacacttgtcggccgcattagcacacagtcctggcactaactaggtgctttaccattagactgaagatgctaata

SEQ ID NO: 26519 - DNA, 387 bp, Oryza sativa
atacaaactgcaggtttcctaaagattcattgattcaccatgtttttcatgtctcgcagctcaagcagtttgtgctagatcatgtgttttttttttgctgggacagcttgtccatgaagtgtggcccgttttttttttgtccatggatgtcaatgccatgtgggccacatgccacgtaggcaccacgttaaccaaaactagcctccctagtgtattaggatctcttttgcactgtttttgcaagttggaggttaagatttgttgtattgcggttgagggatgcaaattaaatttgacggaatgataagggacataaagtgaacttattactccctcttgcctccactctcgccactgcctcctctcctctctccctgccgccgcagg

SEQ ID NO: 26520 - DNA, 1501 bp, Oryza sativa
cggccgtaggtgggattgggtcggtactcttgtctatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttataattcttaaaatttgctcaacaactaaactgtggaatggttggcctgggttggcttgggacgagctgggacccagggtcgggttgccagttcggtctgaatcatcgtaggccttgggttaaggcaggttcgtgagggttcacggccttggttaataatattgtatagctaggatcgtctttacaaaatagctttgggcaactaagtgacttttaaatgccgtttactgcaaaacttaacccctatattattatctccttgtaccccccttgcattaattatgcatcttcggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacaagctggtatcagagccatcttgactgtaggataagccaagtggataaaacctaaggacatattttataaataaaattatttgcgaaagttcctctttttctccttcccctaatgctatttgcaaaaggtttactcttttctttcttcggatttcaactaagtactagatggtcagctttgcgaagaagaagatgtcgtcagttgtttgccgaagctccggaagactgcaggatccgctagcgaagtggaggaagcagtgaagccagctgagaagaagcaggagtgaagatcttggagaacccgtcgcagaacctaagccaccctctagggtagtgttgttagtcgtgtgttccttgcttgtgtgtgtagcgcgtggtttgcatcggtgggttgtgatgtaaccatgctaggttgtttgcttaatcaacttgcagaataagtgaaacaaacagcacatcagcaagaagaattagttcctttaaggtcttgtccctagttctggtctattctttccttgtatgcttcccctctcaacctctaccttgtgacagatggataatactggtaacaaaggctatgggaatgatggatccgatgactcaagaacccaagccaatgggaatgatttttgagatttgaataaagcaacaccgaagga

SEQ ID NO: 26521 - DNA, 1501 bp, Oryza sativa
actcagctatcgagccatcggctattgccttcatcatgtttgatagcgtgtcgactaacaccccggactggttaatcaaagcatgatgtaccgcgtagtcaacccgatcttgaaagttgtggaaagacacttgaagatcttgactgaaatctcctcctggtagttcttggggaatacggcttggagttccatgcacctctggaaggttatcgccttgattccctgcaaaaccaccggtagctcctttggcgctcggctgagccgagccatctggatctcgcttaatttccccatctttagatgaaccggttccagggatgtcggcgactagcttcaacttgtacttctgaacgagtgatcccttgcgggtttgcatgtatgagctcagatactgatcccgtgcttgttgcatcattgcttcgaagtcctgcttctgctctgcttgaacttctcggggtcaaccggcaggacattgtcgtcaacgatgtcggtcagccctggctttggcggtttgcctttgccggagcctgggcttggcggtgctgttttcttggccatgagggggatatgacgtctgacttctaatcaggtcccaccgggcgtgccaaaagcgtgttgatagaaaacacgaggcctgggagatctgcttaactccagtgcaggtccaaaactcgccttcggatacgtgagcgtgccagttgatttgatcctacaatcaacaagaaacagagacaaaagaaccgtggttaaatctataaatgatagccgatcggccaggtgccgatgacatatcatttacgtttgagccgatgtcatatatagatcgatcggcaatggaaaatagataataaagaactaaatctattcgatcggctgtagatattaacaatacataattcttatatcgacatatacttaagttaagtgattgggatagatcggccatcatgccgagacagtacaaatcacttggactaaaagatatgtttataacagaactatatacgtctacagcatagccgatcaaataaatctagcatgcatcggctaatactccgatgcaattctatgttaagatattataacaagcagaatatgccaaacaaaagcttaatgtatgtaaatgcaataatatcttgacatgaaaggcagatttaacatatcagtgcgacatataaagcgaatatagttaaatcaaataagatcggctgaaaccccgatactatcctaattaacaaccagaaagcaggctagagattgctattctaagcatgacttaatggatcaaactcaactgatgcagcattaagtatgaaaagaagaacaatatctagacaatcaagccactggaagattcatagaatggtagatatcttatataatccaaatcaacatcgagatctaacctaatcggctgtcttttgcatgcaaatgttagccgataatagattagatagagatattgttgaagattatgtaagatatgtgataactcggcgaa

SEQ ID NO: 26522 - DNA, 1501 bp, Oryza sativa
tgtggctccccgagctacacgctcccgaacggagtgggggggagggggggacagcgtccgaacccgatcggcctcttactccgatgaggagagggagccgtcggcttagtctcgccggcggacgacggggacttcggctgctgtggcggtgggggcggcagaaatggaggcgccggcggtggtgtaatagggggagatggtggcggcgaaaatggaattggcggtggattagggaggcggcggcaaaagtggtgaaggaggaggcgccgaaatagacggcggcggcagacgaggtggaggaggcagcgctgtcttggtggcgtcatgtgcggcggcggcggctcaaactgctgggcggttagggtaaccctaccccccccacgccccccttcgcccttttccccatgggcttgatgggccggctgcactgtagtggtggtgggccaaatcctattgatttcggcaccacccatttacccctttattttagtttttaattttattttagcagcaattttatattagtccctgaatttttatgtaatttagtgaaaacagttcattagttctacaaattatgtaatggtcctatagattagtgctcttgctaatattgtaaatttcagagaaggagattttcccacttcaattcgctgattcagctgcgaagctgcatttggtggtcgtggcttatatctctataatccttccgcaccattgaagtttcccatgtaaaaaaaccggttccctataaaacccaccccacccaaaaagaaaatcagtgttttcacacaaaaaatcaagacaacaaaccggatagaaaagattaaaccgtataattctaattctgttgcaacgtacggacatgacattagttttctgagagcgagaatatacagtatagttggtagcgactaggtcgagcacaatagagtcgagggaggtaatggggagaggctttattcctgtgtattcctcttatgggtaccatgtggcatgtgggtatattaattgatccacaatatggaagttcagaaaaggcagaccaaagtaaaatcaaagggatacgatgagataagtggcaaattaaatgtacatactgctcaattatctgctaaatttataattgcagttaactttgtggtaaaacagagttgagcccttgcaattatatagccaaggagtaattttccgaaataatcaacagaacaaaagtcaaatcacgcattagaatttcaactgagggagtaggagtataatacagagcagaacaggtaacaacacgatctacgcgtttaattagttcccgatgacagtgcctgcctcaccgtgatagataaaacgggtatgatggatctgcggtggaccatgcggattatctgcaacgatggtgtcaaaaagaaaatattagcagcaatccaagggcggggaaacaaaaacactgcgggcagtagctctagactctattggctggcaaagctaaatctgttgaaaatcgttt

SEQ ID NO: 26523 - DNA, 1037 bp, Oryza sativa
aaccccccccccacgcccccctttgcccttttccccatgggcttgatgggccggctgcactgtagtggtggtgggccaaatcaaattgatttcggcaccacccttttacccctttattttagtttttaattttattttagcagcaatttcatattagtccctgtatttttatttaatttagtggaaacagttcatcagttctacaaattatgtaatggtcctatagactactgatgttatgtgttaattaacataggtgttttttcaaataccatgtttcactaaatttattagttgtcttaataaaatgccttttgcatattatttcaagacatgctctactttcttgctttattaatttacaaaattttataaattttatactttaatttagcaaattctcttaattatgtactacataattaatggatgatttaatgcatgttccacttcacactttgacttggaaattaatcacatgtcgatggagtcctatactttggtcatcgtgaccataacttaggcagcgagtatctcgcccatcaacaagtgatctacattttgagatgattacccgatggagccctacaaattggccgcactggtcgtaacctaggcagcgagtatctcgccgatctcacagaggtctacatctcacgatgattaccgacatgtgtttttttccgagaatatgttttgaaaatgagattattggaattttggttgagcacaaggtagtggagtcctaaacattggctgcggtatattcaccagaatatatttgcctagagaccgtgttttaggcagcaagtataacttgcccactattaagagatctactacactgtttaattacttggagattatccacattgtgccacctaattttgaattctaactcaaattgtcaggtctattacctgcattttttcgaaacattacaaaatatgaagtcttacatttcgcattgagattacaaccacaatatcatctttttattaatttacctctgtaaattaataatgtttatcatgatt

SEQ ID NO: 26524 - DNA, 1501 bp, Oryza sativa
cagagatggcgagatgggaggcagcggacggctggcggcctctcctccgctggaaatggcgggaggggaggcagggcggcggaggcgtccgggaggcggcgcacggccgggcggacggcagcggcgtgttttgtgaattttttttatttttggaatgatttgtaaattttgttgtagattattttagatttggggataattttgtgaattacttgtggattgcggatgattttttggatgggcaattgtggatgatttgtggggatttgagggtgacgataatctttagtcccggattgggtgtcccggtttgcacccggggctaaaaggttgcaaatcgggagtaaaagagccattccacgtttgataagtactgctattccataggagagcaaagcgctgaagagttcaaccagttgaaaaatcctcgcacatcttgactcttcttgtctggcgttatttgacatcagtggcttcccggcacgcacggtaaaacagacaggttgtatcgtttgttcgtgagctcgatcacaaagcaggccagctgcctgctgaacaagcatgtcgcccactctgagcagcttccgtcttcttctgattcgacttgttttggtggctcttctgataggcagcggcctccccatgctctcggctcagcaaggcagcccaggagtccgtgagtatcatctttatatattagcaaaacgattttcaacagatttagctttgccagccaatagagtctagagctactgcccgcagtgtttttgtttccccgcccttggattgctgctaatattttctttttgacaccatcgttgcagataatccgcatggtccaccgcagatccatcatacccgttttatctatcacggtgaggcaggcactgtcatcgggaactaattaaacgcgtagatcgtgttgttacctgttctgctctgtattatactcctactccctcagttgaaattctaatgcgtgatttgacttttgttctgttgattatttcggaaaattactccttggctatataattgcaagggctcaactctgttttaccacaaagttaactgcaattataaatttagcagataattgagcagtatgtacatttaatttgccacttatctcatcgtatccctttgattttactttggtctgccttttctgaacttccatattgtggatcaattaatatacccacatgccacatggtacccataagaggaatacacaggaataaagcctctccccattacctccctcgactctattgtgctcgacctagtcgctaccaactatactgtatattctcgctctcagaaaactaatgtcatgtccgtacgttgcaacagaattagaattatacggtttaatcttttctatccggtttgttgtcttgattttttgtgtgaaaacactgattttctttttgggtggggtgggttttatagggaaccggtttttttacatgggaaacttcaatggtgcggaaggatt

SEQ ID NO: 26525 - DNA, 1501 bp, Oryza sativa
gaggatggcaggctcgcggctggctcgcgctggggatgggaggaggagcgagcgcggcggccggagggagggcccgcactgccacgggcgatggaggagagggcccacgtcttggcgcgcgcgggggtggtaggtggaagcagcgcgcgatgtgggagaggaagcaagcgcacccggcggcggcggcatattcgatcggtggcggagggaggcaaaaggacgtgcatgtgtgtgtgatggagtacgattggaccattcacgaggtttgatcgaatgactgaaaataaaagaagtgacgtggcttaaccacagctcaggaaaattcctaataactacactaagtggggatcaattatatagtattataggatataggattggataggatatgagttttgatatttttgtttttttattattgatctaattcatctatgcatgttcgtgggggtaatatatgatggaacaatatatgttatcaagtttattttatttgtgccgattgttaagactatttattaacaagggttaattggatccatgccattacaaatttgcctattcagaaaaatgtcattacaattcgtctatttgtagccatgccactaaaattttataaaattagaaccgggccgttgccgtcacgtttccatccttctttttccatcttcttccttctctcttccatcttctctctgcatcttatatcttctctctccatctctctgtcgtcatgcctccagcgcacctcgccgtggaggacgagaaccacgtagccatcggtggaacggtggcagcagcaagaggtacggcgacgacggaggcgtcaagcgggccatctcccgtagtgaggcaagctcggaggaggagagagagcttactagcgacccaaccatgctggcggcgtcgcaatgcagcttcgcactctcctctccctcctcttcccgatccccaaatcccctgtctcctcctcctccccctcctccaccgccgcatggatccaaccgctggcctcaggggcgacctcctccacagcggcgaccatcctcctccgccaccgcgctcctccctttggcctgcctcccgcaccctcggcctccccggcggtgatggctttgtcctcttctccatggacggcgccatcgccgccaccgtcctccgccaccttgacaccgctaccaagctctgggctgcctcctgcgtcggtgaggatcgaaggcgacggcaccatgtgcggcggtgaggagggaatgaaggaagaagacggaaaatgcaggggatggatggaaaacgtgatggcagtggcacggttttaattttggaaaatttcaatggcacgattaagaatagacgaattgtaatgacatttttcggaataggcaaatttgcaatggtatggatccaattaacccttgaaatattttggattttattgatcttaagttatcagtttaattctaaattaaattaccatttaactcgccatgcttagttaaatttc

SEQ ID NO: 26526 - DNA, 1501 bp, Oryza sativa
aaaaaaatgatagtcaaaaatgaattcacaccaattaacagtgtcaagcagtaaggtatgcagtagtaataatgaggtgatggcccatgcggcaggtttgctgttgcagctgttgcctcatctcttcgatcccacgatttttttttcctctcgatcgaaacattgtttagtccttaatttttttttcaaaaacatcacgtcaaatcattggacacatacatatgtagagtattaaatatagataaaaaaattatttacacagtttacatgaaatcgtgagacgaatcttttgagcctaattagactatgattaactataattgctgcagtaacctatatgtactaatgacggattaattatgtttaataaatttgtctcacggtttccaggtgagttataaaattagtttttttatttatgtcagaaaacctcttccgatatccagtcaaacgttcaatatcacacctaaaaattttcttttcgtgaactaaaaattaatccacgcccaagactgtgatatgtaatctacctatagctgcacatagtacatgcatatgcatatgctgttctgatcgatatatatccatgcatggttggttattgcttgttgcctgcagtcgaattcattccttgcttaaataatttcactgcagcatgtgcgtactatcctgctgcaacctgcaccgtgcataataatgcacattactagtatactgtatttttcatgtgtatggtccaatatatccagctatccatccattacacagcaacactttactcaaatactcaatgcagagctagctgtactctgcatatgcagacatataaggccccacttgcggtgtgcattcaccttgtaatgcacatgcccgaagctgctcattatcttaaaaaaaatacggctctatcgttttacttattcgggaaaaagccaaacagcatatttataaaaaaaataatttatgaataatattttttttatatgttcttattggtctaaaagtaaaggctgaaaaataaactttaataaaaaatacaaaataaacttaaaaattaaaaatttaaattttaactaataaatataactataagcgaaaagacgagtccgatatctgtcgccggaaattagtactccactactgccagtaacatttactgacaaggcccggtacattatagtaaaaagaaatgaaaaatatcgtgtgtttgttgccatgagtacaggcatgaggcctgcatgcatgttgacactgacaacatgtttaacaggaggaggcatgcacagatgcactgtgtattagctctacgatactatacttacgtcctagaaagaatagttaattagtactaccataactgcacacttgtactactggttacagctagtagctgcgaaactacatgccgcagattaacttatagacgcactaggaaattaattaaaatgatgcgattaataaattaattaatgtgaaaaaggaaaacatatgcgtgctgtgc

SEQ ID NO: 26527 - DNA, 1501 bp, Oryza sativa
taaccttcagatcagtgcttattatatattgtttctagccgattggtttctatcggattatattattgttattttattacatcctcatcagccgattgctttcatatcattatctacgttggacatatagccgattgcttaaaccctatcgctatcggctggtatcggcatcggctattatcggctatcggctagaactactccatcggcttgtcaaccgatcggctgttttgatctactatttgcatatcttgtcagttgcaggatcaaactgactggcacgctcgcatctaatcaagatttggacctgcacaggagataagcagatctcccaggctggtgtgttcgattttctcgtcaacaccatcacatcaaaactttcctacatacacaaacttccaacttttccgtcacatcgttccaatttcaatcaaattttcaattttaacgtgaactaaacacacccaaagatacctccgtccaaaaataaagtcgtttctagctataaatctagagatactcatttttatttataaatatagacaggaacttatccaagtttataacgccgtgattagtttcaaaataattcttcaaactttcaacttttccatcacatcaaaattttcgtacacacagatttccaacttttccgtcacattattccaattttaaccaaactttcaattttagtgtgaactaaacacagcctaactagaaaaagtttcattttaggacaacggtagtatttatcaaactcataccggtgaattttggtatatatgatggatactgaagtaattaagtaaccattttttttctcaaattaaaaattgatattagttatctatgtgatgtaatttagcagtggagcgaaagtacttgtaatctagcggttaaaatgcttaaatatcatccctagatcctcgatgcactcctcgcgggagcaaatttcagacctaagttaaaaaataaagttacttgttgactcccgtaaaaatatatgttaagaatcgatctatgggtaggttcttatctatgggtaggttcttgttctatggggcaggggtcttaaagaacgggttaaaaaccgatccatagaagctactccgcatgtgaaagaccaaccattttattgaggcttttttctttttaatgaaaaaaagagagtcgtatttcaggagtgtgtactgatgaaccatttaactctcccttcggctgcagctgtgcatatggacagcgctatctccctcctgctgcattaactcttcagtaattccgggcacacatgcacagatgatccagtaatactctgacacgcctagcaggatgttaggtgatcgtctgatcaagcactagtgatcgataatcctgctccttttttattacttattttttgaccgaattggtccagcttatattggaagcaacaagagatcgatttgcctatctaattgcctatatatatctgcacatgagcctccctcttgcgtgcctcact

SEQ ID NO: 26528 - DNA, 1501 bp, Oryza sativa
attagctggccaacatcaacatgttactccctgcaatgtacaacagattcaggtttagctgcacacaacactgaatttattttaaggcaattgctgcactgctgaggcattgagaacagcaataaatcaaggtcacatgcattgtgccacttgaacagttggaactggcccttgttgatggctatacctaagcttaggtggactcgttcatcatacatgtactataatactactagacttaggaaaagtggtcctaaatactcgtacattgttcctacttaggagaataaatgtataatagcgttgggctagctactgtcatggaataaatcatttcatttattattattatacgtctaaatttggaggcgattacaacaaattgtttcccttcttggacctcagattttttttttgtctttacatttaccgtcggaatttgcacgtgattccttcaaaattcttgtgttccaaacagggtcccggtaagtggaattatgttatttttctcctccctttgacctgaaaagatttatattttcagtcatcctaagaaaatttactagtaagggggaaataccatagtctctctggtaagtaagaggtattgaagggataaaacttcgattaaggatagatataagatgataggaatcgattgtcttttggataaattttgaacctgaaatcaagtgttttttttaatggaggggagtaggtaggaagaaaagcagagagaggtgaaaactgacagccaatggcaccccttgaatcgcaatgctatatacatgtctcgagaaagaaaaaaagatggtactgtaatgttgaagctaaaggagcgcaagttggatgcacattgttggcaggcggttgttatttttcaggaaatctgtttcccctgccggcctaataatgccaataaatgcaaggcacgccgagtaggtctagcagcatttgcatctcatgccgtcttacttgctgctgctgctgcttcactggcaccacacactggggcttgctacaacagtatcttcagaattgcactggtagtatcaatctaacatactcattcaatctttttgatgatgtgatccatgcagacatccaacatgcatgaaatgcagttggtggctaaagtttcttgagtggtactgatggaactatcagtctccagtgctgaaatcaagaaaaagggtctgctgttgtaaccaatctgcctcttgttgttagctaatccagctgctgctcgcaagtgtcgacatgcttggtttcgtgcaatcactcattgacaacaacaccctttgtcatacattctctgtcttcttcttttgcagccttgttgagtagcagtacaacttaaactctactactcaccaaatgcaaatagaattatgccaagcagccaacagatagatagaacggtggtgatcgtgctggtaagatgatgaacaagattattacaggaccgatggataaagcagtgtaaagatcaattatcagt

SEQ ID NO: 26529 - DNA, 638 bp, Oryza sativa
  unsure (1)..(638): unsure at all n locations
gcccacaacatgggtaaggttgtttgtttggggggtgggtgtgtttttgtgtgtgtgtgtgtgtgtgtgtgttttcgtgtttgggggggngggggggggttctggctctgcatagcacattttagaaccattgtcaagtatgtagcctactgcaacttgcataggaccaaagggtgatgtttctgtgtagagaagttagatggcgatgagtcaatgacttgaattagaaatgctctaggtgaaagggaaaggaacagatctagaactacaattggaattaggccaatcaagtacagaccactgaaactgaagacttgaggggctaatctttgctaattaattattcagtcttagaatcatggctaggatcatatataacctaactaattaatctgaactagaaaacaagctgaactaactattcttaggtagctagtttgcttttgccaactctggacgcttgtgcggtttctcctgttgtcctgcatgatgctagactattgatcattgctgattgctcatacagtcgcactggtatattgctgtagtagaccacatatatattataatgtttcatgttcagttacctttcatgttatctccatgtgtgctcataactagttaactcctgtcacagc

SEQ ID NO: 26530 - DNA, 1501 bp, Oryza sativa
ttctctctctctctctctctctctctctctctctctctctttttcatgtggactgtatgaagaacggttccatttctttatcaccagtttcatgttgactgtatggagaacggttccatttcttgtatcaccagtgctctcatgtggtcatttcgtgtgccttctgcaggtttgacattgtacgcatgaggttcttccaccctttgcaagcctgtgaaagacaaatgttctgaactttatgtgctgctgtggtgcatcgagttggtccttcaaacctcaacccagaggcagcaccatattattagaaagcactgcctttgatgaggtatgtgttccgagttttaactagctttcccatccataacccaagggcaatgggactgtaacatttttgctgtacacgggattggtattgcaatttaacaatggaaaaaatgtaacgagccagttagatgaggatacatggacgatttttccatgcatgggtgtaagggcgtaagttttattttgactagccactgaatgctgataccaattagactgagctgagtaaccgtcatttagctgccgtgtagaacgatggcttttcgcgggcgtcatgttttggcgccggctaactttttttcggtagtcttgattaaccgatgagtcggtcgacgttgtgatgttgacatggtgatgatgcccgtgtaaacagacaaggaagggggaatcccaatcccgtgtttgtttggccggccggtgcgtgctggaattgggttaaagaattgttgctgcagtggtggggcatgtgcatcgtgaacctggacacggagaggaggttaggcatcctgagcatctactaggtgttcccatctgacgctgtctgtccactgaggttaagatcgtactacaattattgtaatagtgttgcacaaggaggttagtgttggctgtgacgttgcgttagaaaatgaaaggagtagagtagcgttggttgtccccgtggtgttgaaagcgaaaggaggactagtaattagcaagcataaatgttaacctttgataacttttgggatagtttgtaatatttactccttccgttctaaaatgaaacaacctaagactaaatacaccactacttaagatcacgaatctgaatgtacttatgttcacattcatagtttcagattgtgttttatcttactatagtattttgcaatgaaggagtattaataattgatcaatcgtgctctaattaacgggcgtcagcaatggcgtgtgcgcattcgttgttgcccttttttcccgggtgggggtgagaacggtcaactgggtcgtagatccggtatgtactatgcgactaggccggcgagactagccgccctcgcccctctcgctgtttgacgaacaagagcgcgccgcgtgggcgccaaaattagttggtttggtgggggaaacgaacggagagagaggaaacgagacggaagcagcaaacctttccttcctccgatcgatcgagcta

SEQ ID NO: 26531 - DNA, 1501 bp, Oryza sativa
acatttacatcttcatgaatcatcttttgctcatgggtcagtagccatttatcaattttattagtggttttcttcattttaaaaaaacaatgtttgccacttctttattttattgatgcatttatgtctttattgttgatgtcaaaaatttatcgatcagcggttgcattgaaaatttagcttgaagttatatatatattgatatacttgtggtacaattatgaaccccctccatttcgctatagcttcgcccctggctcgtggtagccgtcggaggtgttgggggacagcagcgtgtaggggagcctcgccgggcccgtgcaattcctgaggcgcgggtcccggttcatctccgcgatgcgcgccttgatcccgacaaggcggtcgccgaattgccggaatgcctccttcgctgtgtccaaagtccactccggcgtgtcgcgctggccgaggtacacctcgtcgtcggagtgcttggacagtatctcgatcagcgagatgccgcggagcgtgcgccgctggccggcgatggtgcggagctccacgtactcctccgtgtcatcatggtgctgcacgacttgagcagcgccgccacggtggtcatctccggccaccatgcccggtccttggtgtggaccactcgtcctccccagccgtcctcttcaccatgcattgacatgcggccggcacgggatggagcacgagggcacggccgcacgggatggctgtgcgcatgcattgcagagtgagatgcagagagggagacgggagaaaggaagaagatggaaagggaagttatggatggaaaaagtgacgatagtggcacaattctaattttataaaattctagtggcatcgttacgaataaatgaattgtaatggtatttttttaataggtaaatttgcaatggcatggatttaattaacccataatcaaaaggacgtgagtccagcaacactatattccgtacttgggatttgattgatgatcttatgattccacagctaattagggtttaatcgatggcggtttgatgaccttctgattcaatgtttatttgtttcgaaatagagatacaaactgaaggattattttctttttcacaaacatgcaaaagctttgcgtgtttaaggattattttgcttctggtagaaacattgttcagtttgttcattcaatgattcaatcatagatcgaactgatactctgacagaagtaatgtacgctttgactgaagaagtgttatcatcatctacgccttgctctgaccaccaactggcacagccatactactagtcgctttgattttttcttgtaaggtttgttcattcatcttatttaaaaagttaatgtagatataaaaacaaagaagtcatacttacaatattttttgataataaagcaaatcaaaaaaaataataattccataattttttgaataagacgaaagctcaaaagttgaaaaaaaaactcaaaacgataagtattctagaacggagg

SEQ ID NO: 26532 - DNA, 1501 bp, Oryza sativa
acagatgttgcctgtatacacaatttacatcaacacaggcaacaaacaccacacgtttcaggctgtaatacacataggtaagataaggcagtggggtgaatttatcctttttctgaaaaacagggggagacgcaccaatgcacgtgaaaacatgcaaacgtacacagacaaataaacatgtcaaagaaggtagcgcacaatcttatacgctgataaagcaaacactacattgcttgtacatggaaagatgtcgaaattcacatgtactaagcacctgacacaaaattatacagctcgtcctgataaaccaagcaactagaaatttgaagctgtgaagtctgagctatatatcactacacggaacagattgtcgtaatcaaatgatcagaataatgcaacaactgaaagcagatagtccctaaaccaaattgcaacttatacagtgcacacataacccttgagagaatgcattttggtattccaactgaccaaaatctccgaattgagctgaacaaaaactgtgagaacccatcctggtgcttactaatactagcacatgcgagcatatccgtaaaacttgataaccatatcacgtacagccagaaaaactcccacacttcccaatgtgcataatactatcacggacaaactccaatggagaaatcaggcaaacgcgatggggaaattggagagataaaatgccgtccccgaattagtgcacgcacggtgcggacacactagggctgatagtcgcagaagcacccaaaatcagcgggacgaagcaatcacaggcaacttcaatccacatggacaattatcaaatcgagtggcgctatcaagcggttccccaatcagttcatggcccatcgctgagacgataagaagctagggttggtgtgatttaccgagacagacgaagaggacggagaagggcttcgcctgcgccccctctgccgccgcggcgctcgcctccgcagccatctccccctccgccgccgccgccgcagccgcaaatcgaaggcgagggtttagaaacggatcgcgaggacgagcctggccgagacccgagctggagatggagattgtagtgggaaaaggtgaagcggtgcagtgacgactggctgccacaagtggaggccgcggcacgcgcctcctaaccgggtatcgcgttgtcgggttcggagccggagatgagcaggcggcggagctcgccgcggctgctccggccatggccgccggcgccacgagctcctccctctcgcgtgcgcgggggaagctgtgtggatgggggcaattcgagcgacgagtggctcgcgccgcggaagcggagatggttcggtgtactggagcttttgaatccgaaaactccctaataatcctcggaaaaaaaaaggagagaaaaatatcgataaggttgaggaattcgtctaactgggttgggcctactggaccgttttaatatgggccgtgggttacggcctgtgggctggctgttgtaaac

SEQ ID NO: 26533 - DNA, 1501 bp, Oryza sativa
gcggcggcggcttgcgggttccacaggaaggtggcgagggttgccgggtcccaggtcagcacccagctgccatgcgaggtcgcccagctccgcttggtgcggagaagctcgtcgtcgacgtcgcaggggcggtgcacgccgttggcgacgttgtacagcgtcgtcgtgggtcgccctccatcggcgtcgtcgtacgagacgaggaacagagacggcgccgccggccgccggcttgtcgacggcgacatatatggtaggccgagatcactaaacacaattgtcaattgtggcggcggctgatcgacacgatccgattaagaggatcggaggttgatcgtgtcgatcttaagtaggatttcacaccatagtcgatgtcggacaacaaattaaatttgttatcgattcagattcgtgtacttagcagattcagagaggtgacagaacccatgctactctgaatatgtcacgagctggctgattcatctgaggctagtaataaccaccttttgataatttgaaaaaaaactggatttttcaattttctagcatttagtttagtttttttattctagattcttaaaagagagaatcgcttatatgccactgaaaatttgtctgataccttatatgccactgaaaattggctcttctcttatatgtcattagtctaaatttgcgcaccctctcatgccactcccgttagttgactgtgggttgaccattaactcagaaggacaaatacgtcttttttactttagagttaacggtcaacacacagtcaactaatggtagtggcatgaaagagtgcacaaatttggaccaatgaaatatagggaaagagccaaattttagtggcatataaggaatcagaccaattttcaatggcatataagggattctcttattcttaaaatctagataaaaggcttggggttcttccggcggcttacacgcacataaatgatccaaaatgatcctcgtggcagttttcacgaggactttgaaagactcccgcaatttcctcgtgttggtgccttggcggcgatatcacacacgtgcaagcactattgtcatacgggctcaattcgcctccccttcaaacgtaggcacatgtacgtggtactaggactacaaagcccgagtctgatttcctcgtcgccataaaatatataatttgattcatgacgagattattggaatccattaatccatgatcataaatagaaaactttgggcaaaattaaacaatgcgaatggagtggagaaatttttacccccaatggagagtgaggggatgcatctgagttgggtattaggagtggggtgctttcctgtacttggcttagtctttatcgaggtgggcccccctacacggcatgaccgagctgcagggggccctatatggcacgaccccgttgcgttcgaggtggtccagggattatacccgcccgtacagtatacaacggtagcataccatctatacaagaaatacaaatcccaa

SEQ ID NO: 26534 - DNA, 1501 bp, Oryza sativa
cagccatgtcaacatccacactgcccgtatggtttgcctcgtcgtccacgcggctccgccgccgccacctgacggagtgagaaaggggataaaaaaaaaagatcgttgtttcacttacatgtggggtttcgtgttatcttttattttcttcttgtgccacatcagcgccatgtcactcaaaaccgctttcaatattatcttaggactatattttgtattggttttgaaaaatgatggatgtgttgtacctagttttacggtttagggatgtgattcaacctcgacatcaacatgagggactaatggtgaacttattccttcctcctacattcctatttccattttcacagcgtcggcccatcataatacggtccacatatttgttagttttattttgggaaaagtctgttttgagtcctctccgggagagctgccagagagagatggagtcatgtagtgaagagaggggagagggagaggatgtatacatgtggccctatgaagatgggaagtactccctccgtcccaaaaaaaagataaactctgggtttccgtgttcaactttgactgtccgtcttatatgaaatttttttataattcgtattttcattgttgttagataataaaacatgattaatattttatgcgtgacttgtttttttaatttttttcataatttttttaaataagacggacggtcaaatgttaggcacggaaaccagggtttgtctttttttgggacggatagaatagtcacttacacgaggagggctcacgtctactccctccgtcctaaaatataagtatttttacctatgaatctagacaactatgtgtccagattcatagccaatagttgttatattctagaacggaggtagtactttttattttttttgattgggcatcacatcaaccaaaaccaatctcaaaatagccgagtgagtcattctaaactgattttagtatcagaggagacggtgatatacctagttttacgacggttcagacttgagagatacaaatcagattcaaccaatagcaagggaggcaaaattgacttattttttctttcgtttttatcgtgcgagggttattaatattctttttcatcattgatgccataacccttatttaaaaagaaaaacagcaaaatttcattaaaccggattttgtgaagaaccaaacataaccaacttcctgggggtcttcatcagcataaaaaagtgttagaacaagactaggaaagattattgcacggatgcagaatcatgatgtgccgaagcgatggtaggcaggaacacgctgtcagcatagttgggttacagggattattgcaagaaatcatcatgcatgcttactctgtccatcaccacttgattaggagggatctaaatggtgatcccgctgtagcaatcttcaaacagtgcaatatatctcaatggaatatactaattaaattgcatggttaggggttagggtgtcaagagcatcaggtcgg

SEQ ID NO: 26535 - DNA, 1501 bp, Oryza sativa
gtgaagatctcaccgattataaaccaaaatgagcggcactttaggctcgcttctgcaccgtagagaacaatggtgccttggcagttgttaaggtatttaatccttcatattcctcctattcaagaaaggacacgcataactaaaaggcagaaagtttatactagatcaaaaatccgaccatagggaactagatgcaccaaaagaaactcaccgattatagatcaaaggcggctcctttcgtaggaatccaggcccgctgaccgcgtcatgcagtcagatccgcggctactctcctcggcgtccggccaactcgcgactcgagtggatatgacacgacaaattcagacccatcctggccttgccatggcatggcatcgcggcttggcatgcagatttgccaggcgaaacggcggcgagaggagaaaataggaggagagattgaggagggggattggcgattgattggggaaaggaaactttgctaggtcaatgcggggggacgggagtagtttttatcaactccgtttaatttgcggggacacgtccgccaccaggatgggctgtgttgggccaagcccagtgtgagccctgtctggtctggacgcttcctcgcatcgcgtcgtgggccttcgaccaccagaatgttcgggaaatcccggcgagtcgaggcgagacgagaggcctcgtttgtcttcgtcttcctccctcctcgtcacgtcaggctgccaacgccacggataaaggccgctccccaccaccaccaaaccaggacaaatcctcctcctccccgtcctcggcggctgatccccacccgtctccctccaccagcgcgcgcgcaattccccccccccccacccatcctgcgtgcgctccggcctcgaggagattcaggtaaggttggttgattgatgcctgcgcggttaggaaatactaggaaatcatgcatgttaatcagcttgttcggtgtatttcttttttttgctgttgttcctaggatcgttgattcgtgacgtgaggagagagtgctagagcttgtagcctagaagtagttggagcctgtaggtgattttcggtggtagcatctgtatttcgtggggggaatcggtgagatgagcattctgcaagtgcgaattgggggaaattcatgtgttgtttttctcctatggcctaaattgaagtcttggttctacaacggttgcggtgctatcatatggtggaattcggtgggattaatttgtgaaatgaattggagatacagtgagctctgtaagaaatatgaaattgcatatgaccatgtgcacacgatcgttttcctgtacctttgaacggattaatttgtgaaatgaatggtgtcttaatttttgaacgatttctgtatcatatgttaccggctactcgaggtagcgtaattgctgaaccctgcagagcttacgtaatcacttagtaatggatagagggcgaaatggaagagatgacttctatggtgggagggacccgtatg

SEQ ID NO: 26536 - DNA, 1501 bp, Oryza sativa
tctctccacacgagagccccttggagccgccctgtttacgttcagaagccttccgttgatatcctgtaaaacataaatttatcagccagcagctgagaacactgtgcaacttatacaatttcttctgtactatcattttatcactatgacagaaatatcttcgagctcagttttactgaacgcagttcatcgggtatgggaacatttcacaatggttaacctaaatgagatgtaccaacagtataattttaccctttgatcagataatataaattgtttcagttatcaaggtacttccaattttatgtgtaacggcagcatgtgcgaatggtgaaaattgtgaaaataaaatacttcaatggattaagaaacgacaattcagaaatgcactcacatagcggttaagcatctcaatggccttgtcggcttcctcaatcgtactcatggtaacgaacccaaatccacggctctgccctgtctctctgttgtaaatgacctaaataaaaacaataattgggtaattggaaatactgagccttgagaatttatgcaattggcaatagtatcttgcaattcttctgttaaaaagaagaagggggaaattgattgtgggctggcgcgcgagtaggctcacctcggcgacctcgacgacgccggcctgctcgaagagctgggcgaggccctcgctgtcgacgtcgtacggcaggttaccgacgtacaccttggcctcctcggggggctccgccgcgaactcctcctccaccgcttcctcctcctcctcctccacggaggccaccacctcctcctccgcctccgcctgctcctcgaccacctcctcctcctcctcctcctgggaaccctcatcggcctcctccgtctcgctccattcgacgccggcctcggcggcggcggcggcgtcggaggaggcgacgaggggcgcgagggggaggcggcgggaggcgcggaggaggggcggcgcgcgggagaagaggaggtggtggaaggggagggcggagagcttgtgcggggcctgggtggcgtcggcggaggcggccgcggccatggccatcgcgagcgaggtgacggaggtggtggccatggccatgggcgagcgaggaggaggaggatgaggggggggagtaggaggggataagctagcgctactgttggagcttgaggcgctcgtcgccctccccctctttatccgccgcgcaacgtagggtgggctccttactgggcccaattgattttgggccttccacgtccaactgtccgttccggcccatttcttggaaaggaaatgagccaaccgccgtatgatgtgtggatgggatcaccaatacatttgttcacaaattttcgaaagttttaaaaatttaaaaaagatactctgtcctattcaaaaaaaattagaattattatttattttctttgtgacatactctctccatttcacaatgtaagtcattctagtatttcctacatttatattgatgttaat

SEQ ID NO: 26537 - DNA, 1501 bp, Oryza sativa
ctatttgctcaggtgatcaacagcatactaattagctagaaacaacaatagagtaacttatatgtctggcatagcattgggtgttaatggtcagatgttcatgatggtgttatatgatctttgactgacaaaactcctgcggaaaaagaatttaccttagcaaacggtcgataggaagtttactgggtattggatgaacagatgtttctgtcagtgttagcaggtcttcagctgactacaaactcttgtggaaaaaagtattagcgttagtagctggctgttaagtactaagtagtcagtacaaatacaacaatagagtatgtagagtacgttaccatatttggctgttagattgtgttagctatcaggtgttccaattggtgctagcagattagcgactgtttcctctagtgtctttttaacaggggaactgtgcttgtttgggtattttttagcttgaggtttggctttcttcgcttcactgttggctttcttcgcggccttgctagcctccattgcctttttcgcttgtagttgttgtgctcgaaggcgaagcagattcatcctctctaaattctgtttgcggtgttgtttagcatgtgccttttcttgtacagatggtacccaatcgtcgatcccgcactccttgcagtacacgtactttaatccgtctctgttgtcagccatcctgcagttctgcaatatgtcaaattattgttgcatatctgctggcttctcgtctcacaagtctttaatactcattaatattaagaagttgattacaggttgcaaagatattaggtgccagaatgcttaaggctgtgtttagttcacgccaaaattggaagtttggttgaaattggaatgatgtgatggaaaagttggaagtttatgtgtgtagaaaagttttaatgtgatggaaaagttaaaagtttgaagaaaaactttaaaactaaacacggcctaagtaagcagtccagcaatgcggtatgcgaaattattcacccaagtcataatatagaaagtgacagaatgataagcagttcagcaatgcagtatgtcaaattattatgtcatccaagtcattacaaagaggttacagaatgcagagaaagatagtactaggtgacagattgataagatgttggtggcatatgcgcttataagctagggaattcaggaagcgcataatcgataccacacgttgataggtctgtatcaaatcagatacaggcatcgctgcagcctagtttaatggcatgtaggtagattgtttttttttttttttgacagagaggccacggtggaaaacacatgcgacccttaacaaaagaacatctgggatgcgacaattaagctagggtttgacaattttctaacgaagttgtaataatcccaaagcacgggcaaaatcagatctccacgcgacgccgacgcgaccagaccacgctagagaggcggtggcagcagccgtcgtaatcgaagacgagaggaggttgaa

SEQ ID NO: 26538 - DNA, 184 bp, Oryza sativa
atcaatttcaggggaatctacgaactataccagctggacgccctcgacgtttctattatgagttgctggattttgtaagtatatcgttcagttagatttcttactatacgtctcctttaattaattaggtccttgtatataagtagactatagaaaataatatactcccttttatcgttgtaga

SEQ ID NO: 26539 - DNA, 251 bp, Oryza sativa
ctgtggcctgtgtgggtgcgggtgggaccgtgggtggtggccacctgaacctgaaggaagaaatcttggcctttcctttctcatccgacggacaccattgcttggagctcaccatcttcttcctcctcgcgtatatatcgtcgtcgtcttcctctcgcttgttgctttaccacctgagactcaaagagagagagagagagagaaagagagagagagagagaccacctctctctgtgctgcgtccacccagc

SEQ ID NO: 26540 - DNA, 384 bp, Oryza sativa
tgggctatccccacaaccaaggttcgtttacatcgtattttttaaaaataaaagactgaaaagcctcactgcaattcatagcggatggcccaacagaagtatatgaaaatagccaatctgagctatactattttactactaaaacccttacgttttcataattatgctcaagttcttacacttgtattccatatagcaccttaacatttttcaaatttattaactatagttagatactttatttgataccccatagattgataggtaattacgtttgaatctctcaaaggtaattgtgtaaatcatcatgtggttactctcgtaggatcacaactactattcatcctccttggaacattgaaaaattggattacgccaaatagg

SEQ ID NO: 26541 - DNA, 213 bp, Oryza sativa
ttggcccaatgtgacataggtgacccacagttggtgggctaggttgcgcactctaatataaaaaacaaacgaacaactcttgatcaattagtggaattggcatgtaagggatcaaaagtttggtcaattagtggaattggcaggtaagggatcaaaagttactggaggatatataatggatctagcttggaaatcttaataagagcatttaat

SEQ ID NO: 26542 - DNA, 1501 bp, Oryza sativa
tccacaatttcaattggtaagctagtaaaatttagagaagcaaactgcagatcacattttgtatttctagccatggagaaacaggtattcactttataaaaaccatatgacttttacatagcatgtaacaaaaggaaaacagaaactaatctgtctgctaaagatgttagatacagccaactgccacctggccaaccgcatagcacattcttttttttttttttttgtacatgcaaaaacaggagaatgcagcagtaataagatttggacacaggcccacagcccaggacagaacctgcattatgaaacagaagaagctatattattgcccaaacctctgaagccactgccaattatgaaataatttacattgtttagagccactgccaattctccatccatgtgtaccagttcaccactgaaaacctctaccagcagcatcctgctagtgctagcactgacaaagcattctgcataattgcccaaaaatcaagtcattgacaaacatgaaaattgctgaggtgagatcagacagttttgtactgactactgagaaaaacaggagccttttttataccactacaggctaggctgcatttcaaagagacacattacagcaatacagctgccaccccaaccactgcaaactcttctctttctgatttaaaaactttccagcccaggtcatgagcatttgctgggaagttagggatgccaaatgaaattgaacagacgaacttgctagagggcctgtgaaaatagatggttgaatatttcaacattcccacaatactgacaatgctcattgccctgcaaacttctcctaactagattatagtttaagagaatacaaatgtctggttactaaccagagaaacatggtatctgaagtggctatttagttcatacggaaatggtattttctgaactttgggagcttcaaggatgtactgaaataagccctcttggccccaaagtcgcaaattaattaggttcgtaagtttcagaccagcccctttccatcctacccacgtacatctatttgtaaatatgttgtattaccggcctcaatgaaaccttcactttggatcattttgtccctttctttctctcttctctgagagctgtgcgaaacatttctcaacatgaacctctctgttcctgactgatacacacaaaactaaaacatcacaatgtttgtctaaaacatcaatttgtcttaacaaattttgttttacttcattatactttccttcaaaccgattaatataactttttacacaaacacattatttaagccttctcagttgtgcctgccattgatcaaatattactggtccctgagacaggctgacataaactgaaaatcaaataaaaaactttcccaaaacaattgtgttttgggaaagttcatatttaaaatgtggattcaactgcagttgagttatagtgtcaatttagtgaagaagcatgatctaagagggttctttccaaagatcta

SEQ ID NO: 26543 - DNA, 1501 bp, Oryza sativa
aatagataaactgtcatgccgcatcctctttaaactcggtcacttagggataagcttcctttagtagattgattttcttaaccgaatatagcaggaattcgactattggcgacttgataactcccatcggctgattccgagatgctgcagccgataatgattcttagccgatgacgtctttaccgattaccaaatttcactgttaacactcttgtaatagcataaatatgaatccacacacaggagtagggtattacgcttcccagcggcccgaacctaaataatccctggtctatctcttgatcgccatccaccacactagccaaatccacggcgaagatgcgctcttgatcatcgcgccctatcccctggccgaactcacaaaggggggcctcacgtcctcccgctagagaggatcactcctcgacaacatgataaatgactacaaattacaaaattacagcttaattaaaaacaagatgaccactaagaagtccaccctaaagtatttagagaactctatccattgttgatcatagtgtgcgtaacagttgtttctagcaacagcttacaagttgtacgcaatccttatctttcttaaaccataaaaacgtaatttccaaaactagtgatcaattatttgtcgatgaattcagctcccatcactgttggtgaatggcatcaaacataagtggaagaacatcaatgattatccgagttgtaaatcaatcattagtctagagcttaccaccaccaaataacttacaagttgtacgtagtccttatctttcttaaaccagaaaaacaaaatttccaaaactagtggtcaattatttgtcgatgaattcacctccaatcactgctggcgaatgacatcaaatatcaaagattatctaagttgtaaatcaatcattagtctagatcttaccacgaccaaacaacttacaagttgtacatagactttatctttcttaaactagaaaaacaaattttccaaaactagtggtcaattatttgttcattgaattcagctcccatcaatgctggtgaatggcatcaaacatcaaagattatctgagttgtaaatcaatcattagtctagatcttaccaccaccaaatgaacccaatctaatagggaaaccgcagtaccatcaaggaacatctaacataatgtctttaggaagcttgcgacatcttaaataccatcatcgctaggttttcactcaaagagttgcaaacaactttccctccaaaaccgcatagacatcccatccgataggcgggtccacttacacacctttccacttacactttcgtcctcgtttcgtgaacctttatagctacacaagcatacaactatacaagcaaatgtccagtaacatgtcccttcttaggccctgtttctttcagcttgggattattataatccagattattgggagtaagctgaaagaaacagataacttattgaagtagcttattataatctggagcccagct

SEQ ID NO: 26544 - DNA, 1501 bp, Oryza sativa
cataaatagatcggtgttcaatgaaggaaaagaaaaatagtgaagataatgcatactaagttcagtttatctttcactgttttatattgttacgacccattaatagttgctaacattaaactgaccttggtctatacacgatcacctagtgatcgagctgatgtgaactagcatggtggcctacgcatattacgcggctagcatgattatatttttctctcatataatagcatatatattttctcaattttatcattaaaatatattaaaatgataacataattttaattttataccaacttaaccaaactaccaatgtgtaatatttatattgtatggtatatatgtgatagttattaattatttatcaaattttagatatttctaaattgtattattatatggactttagatctgtctttcaatattccttatttttttaggaaaaatttgctacagaaaacgcaaaaatcgtgtaattaattagctaagggacaccgcggaaatgtgatattgccccaggacactgtacaaaaattgtgaaatttgccataggacatcggacccattattttatcatttcccagttgaaaattgtgataattttttcgtaatgcccagattgtccctgtgtcaccatctataccgactaggtgcggtcgaaacggagtcgatcactttcgtcgccacacaccaccgaggagaaaatccctaacccctaaccctaaccttaggttgcggtggcggcggcggagcaggaggatgtttgggtgacagcggtgacaaagacctactcggcttcggtggcgcgggagtgggaggcgtccgctgtgggcttgcggtgcactgtgaggactgaggggttgaacactcgcgcggtaaggggaggggacaaaatgaaaacataacgtaatcctttcatgtaaggggaaggaccagaaattaatagaagattcgtgaaggatcacgaagatattttgcaaatcgacagacccaacggtctgtaatgtccggagtgacaatctaatggtgtatattcagttgatgacgtggcaaagtaattttgcgagaagggttttacctttcagttatttagattgggccgacttacggcctagcagcaaaggaacagtttgggccaaacccaaactaattattcggagtacataatatatatgcaataagtttgattttagatcgctcatcaaaacgtcgagattaaaagacgttctcaaatcgcagtacagaatatagtgtattcctcaacattttaaaccagtgtaagtgagatcactaggtggtttggactatggttttagctgacgtgacgctacgtggctggtttgatttagtcatcgttccacgtgatgttaacgtggcactaaaagcaaagattaaaaataaaaaagttgaaacaaaatatgtaggaccttattgtcagggttacggataaggtacaccctctatccttggatatacgatgagtactgatatggtatac

SEQ ID NO: 26545 - DNA, 1501 bp, Oryza sativa
ttcatcttaatctagtcttttttccgcacaaaggggggaaagattaatagcattcgagttttacattaaaaatgattgaattaatttccatcaaacattttttacgcttccatcgtagtgacaatttttaatccgttttattagacagtaacaatataacttcaaaagtgtgagtggccttataaggttgcgttctatgttgttgtttggcttacctactccaagcacgagaaacgttacagattattaattaagtattaaccgttacaaacttaaaaaataaatttatttagtttttctaaataactttaatatagaattttttttttaaaaaaagaaaaacgtaccatttagctgttcgataaatatactcatgataaataaggcagtggccccttttagccacgtaaaagagcgcaacttaagatagatccttcacgcataacctcatctaattaaatggtaattgtggaaagataaaacaatataagcccttaggacaagtagaatagtttagccttctacacagagatagtatcctcttctatagttgagacaataaatgctctttccactaatgctatatccttatctagcaaagttttctcttttcttgctttaagattaacaccgatttctctctcttatccacattagtagatagatataggttgcaatttggcgagccagctgtcaattgttgctatacactcagcaaattagtttagttggcagtttcataagctatctaatagttgttgttgtacaacccataggagatagggtcttattgtttaccatataaagaataagccattgttagaatataaaatttgaaacttaattatctttttttcagattgacttttaagtcacaaaagaaacacctataaaagttttactcccaaattttttccgctaataagcccttacagcttataatcaactcttggtcaaccgatcgatgggaggtaacaaataacaacagaacttctaatgaatttctctcaaatccaaaacgaaaaacaaacaagaaacactaaacctctcttttctcatcctaatttcccctctctgtttttttctcttcttttcattcacaagaggaggaaggggaagggcatcttgagatcgacgtgcctgcttgcatctcccttgtggatgcggtcacgtccatgtcgatcaccccctgtgtgctggggtttgtgtgtgatgtttgtttgtggcgccctcgtctgctgccttttgtgccccctcccccctcccttcccttccactcttttaaatacaccaccacctcctccctcttcctcctcaggcacagagactcctcgcctctgctccgctgctgcttccctgttcacccgccattagcgcgaccgagctcgctcgctcccggtgcaagttgcaccgcctaccggcggcggccatggtgagtgccgagtagtcgtcgtgtggcgcgggttcttctctgtctctgtccctggagcggttcttgtgt

SEQ ID NO: 26546 - DNA, 1501 bp, Oryza sativa
gccaaggagggcgaggaggaaggcggtgcccatgaagttggtcaccgtcgtcgccgactgcgacggcgagtagtgcatgaaattcatcaggtaggtcaccaggttgctcgcgttcgccaggaacgccaggttctcgagcacctccaccactgcacacacaacaaagccaatattctcaatccaaattcgatcttgaaaaaaaaacaaaatctctatcctaatcagtatatattaaattaagttatactgttctccattggtaggattttccattgaaattaagctatgaaattgagctaccgtgtgccactgaaaaacttcagatggagatgtaaagttgtattttaatcggaggcgtttgaaaaattggaagtactagcatgcatgtgcggtggtaactgatataaccgccccagcataatgtgtgcggttcccagtgcatgccggccaattttctttgttctccctgaccgtttcggccttgcgattcgtgcccgaattcaatgctcgcgtagcgacaattttggacagggtcaaattataatggcaaatttttctccccaaaatccatggctggttctctctctcacactcacaaccgtcagggcaaaaaaaaaaaggaaaaaaaaaagtccttcacacatgcaaggaagcaaaaggcagtcattttccaactgaacattcgggatcggatcaacgggagagatatcgaaaccgaagccgccatggtgcccaccagtcaaccaccaccaccatcagcagcagcagcgcaagattgcaagaagaggtcgccgtcgatcgagagcagggacaccgtctttttctcaggtggatgcaatgcatttgatggagggaaggtacagaggacactcaaggaaggacgccaatgtttggatcgtacaaaagcttctccccactgatgataacgacgacgatgcgcaattgcaagaggggggggtcaagttggggaacccaacccaacttgcaagaacaggggggagaggagagatgggagattaacctcgttggaagagaagagcacagtggtgtactggtgtgaaagggaaaggaagaaacaggggagagagagatagagagaaatggagcccaacggcgaccagtggggaggagggcgaaaaaaaggggagaaaaggcaacttgtttcgcgagcgaaagcggccaaatccggcgggaaaagggtgcggtctgatcaggaaaaggaggaggaggcgtaaagggtggtgatgatggccgatcgatctgaccacggtgctgtgcctttcagtctccagaaaagagagagaggagaggtgcagggaacgggaggaggaagaagaagaaggtggaggaggagatggtccatggctgagtatcctattcgagctttctttctttcgtgcttgcatgctgctgctgctggtgatagctagctagctgcaacagtgcaatgatatgatcgatcttaattaattctgggcttatccatcgtccctgtgggttc

SEQ ID NO: 26547 - DNA, 1501 bp, Oryza sativa
cgtgtactcatccagtagtaaaataaggtccttccaatctcaatcggatagctaggatcttggtagggtaattttacaaaaagaaaaaataaaccacccacttcccaccttgtacctttgtaagcgaatcaagtggcgtataagttagcaaagagagcgatgcaggtaaaacaaaactgtactcgggacgatgagccccctagctttattcttgatttgttagcaaacgatgtaactatcctaaatgaataaaatctgccatatttgttaaaaaaaaatccccctggcatgggtttcctgttctttggctgtagctacccccaaatcactttgtctctcccacgaatgacggggacgtgaagctgctcgatgagggcgatggcagcacccacccacaagaaggctgatacgaagcgatgacttaggccatagatataaggaatcaagtgctagatatccactcttagattcctaaaattcttctttctcctattcgttctatccaaaacctaaatctttaattcctctctgcaaaagggcatgtagttcagtggttgcagtaaccagagtagcactccatggatatgagttcaaatcttcataggagcaaataacttaaagagactcggtaacagctcgggcgtgcccacggaaaaaagaaaaggtgcccacgcgccatgccgtgcccatcgggccgggtatccgtggatacccgaatccacgggtatccggttggattgtagagacagagaaaaagttatccttctctaaaaaaataaaaagaaatctttaattcctctctgctatatggaaatatggaatggtggtttagaaggaatctttggatttgtcgcagcgttgtgctctgacagagtaatgggaggatgaactggttaggggatttatgcaaaggtagaagataggaggcgggtgggtttttataaaattacccaccctaccagatcctagccatcggattgagatgcgaaggacctgattgctggagtgtatgagtgcacaggatgagggtcaaacggttttaaaagagagtcgttcctctttcctcaaaccaaataaaacgttatagaatgttttaacatgaaaggcattaatggctatcaagtagaactggggagcactctcaggaaaatggataaactgagttcaggcacaaaatttgtactcggtacaatgctttgccgtatatagaggactgtccattgtttgaatagtctgcacgacagcaaagatggactacgaaccaactctttctttttcttttgaatctttgactgtagatatgcatctgtgaggttggaacaaattcaacaaatggctagccgctatcctccggcaacctataaatgcacataaccctgctactgaaaaaaaacacaacccaagctacagctagtcttccacaaacataacagcaacaacatccatagtagcggatagatgattcctataggaactctcactccctcacttctcacttttg

SEQ ID NO: 26548 - DNA, 1501 bp, Oryza sativa
ctcgcttcgcataaaatagtcaaaccaaaaataatatggttggagggacaatgcattacaggttggctacactcttgcttaaatagcaagatagtactactactcatgtgcacacaatgcttatagacaacacatgtcaaattctttaaataaaaaaatatagaccacatcctaattgcactaggatgtctaagacaccctctcaaaggatccgacgttcccgtcggtccaacttatctccatagtcacatatgcatatagacaaatatccaaaaacatgtcacctcttaatgcacgtccgtacgtctagtgatcgaaacaagcttccaaaacaatcccaaaaaatattgataaacacagatttagaagagtaaaaaaataatttttttttgaaaaaaaatcttatacataaatattcatcacaaaatttcaaacatcattaaataaggtgcccgcgcatttgcacgggctaccttcctagttgatttaaattccataactgggtaggcgttgtttagcataagtaacactcctcagtcaccaacccgctcctgttcccctcctaatttaagaaaaaaaaaactctcacctttgttctatcgctaggatcttcacctatcacccaccctcccccgcgtcctctctactgtctcactcgcctctcatcccctctactctcccacttccttgttagcctcacccttttctttttttactttgggagagcaagaaactagtgagagaaccaattttcgggtaaataaattgtcgagatatttttttcttgaggttaacttttttatcacgagagagcctaccaagataattgattgatgcttcatacgccaagaggggtgagagttttttttttctttattaggaagatgagagggattagggaagggagttaccaatataaaaaaatttaactagaagggtgtgagcaatttttcttcatcaggaggagaggaagtggggtagagtataaagataaatctcttaagccaaaaagggtgatagttttttttcccattagggtatgggtcgagagcttagaaatagaacatgtacatgtgagaggagaggagcaggataggtgtggctacgaggcgtgtagtttcgaacaaccattcaatttcaataatatttctaaaatccaactctatagttagtactatcttcgtccataaatctaactaattttcagcatttaaatttatctcacgatatacctacttctccacttatcttcttatctgaatcaattacaaccatgtaaatatagctacttccctacctattttctcatctcaactaatcagaactatctctaatttaatttattcatctactttctcatcccaaccaacctcaaccataccatttctcacttaaccttaattccacgaaatactgagggaactatgttattccattttcttatagtttaatagttttagaagtcctaactggcgacgggagttataagttacttttttat

SEQ ID NO: 26549 - DNA, 1501 bp, Oryza sativa
attatttcgttatctcaaactgaactcaatagcagaattttaattgcgccacatgcatgcatctccataattcgtccattttctttagatattggaaagattttcggtctttggctacaaacaagttgcaaccacttattacataattctttttttttcggggaaaaggaaatagattactcaggaattaaatcatctcttacaagatttgaaatcaaaagacatgtagctatttccccaccaaacactagacaagccatcgctacggccacttattatacgtaattcagcgaatggagagtataaaaaaacatcgaagcactagacaagaactaataataccaacacaaaatagataaatatttattgaattctatttataaatcttcatatgaagttggcaagtatctgcacgacacgtagcatatattagttccttgtcgtccatagcagaagacacagagcaatttaatttgatcgatcgatcgctagtaggatatatactattattctcaacgtgtatatagaagccgtaattatatactccctccgttttaaaatgtttgacatcattgactttttaagtacatgtttaaccattcatcttatttaaaaaatttaagtaattatttattctttacatatcatttgattcattgttaaatatactttcatgtacacaaatagttttacatatttcataattttttaataagacgaacggttaaatatgtgctaaaaagtcaacagtgccaaatattttgaaacggagggagtatatgcacgtacgatcctgtgtcgtcgttgccgcgtcgagcatcaggtaatagcaatactactgctgcctgtcgggcgctaaaatagaaatgaaagagagaggccatgcatgcatgcaaatgcgatggatgaacacccaccgaatcttcaattctcaacaaatactgcactgcatgcaccatgttttccttctgaattataggtatcggtcaattttgaatagtcactacttgatctgaacttgcgaagatgctcataggggtagagtttacgtacgtgtgtttataggggtgagtgtgcgtgtgttgtgagtctctgcgttgtaatgtatatatattttttttaaaaaaacagccccatccgaagggcaaaacaaaaacaacaagcggcagagatccaaacacgtgggcgccgactccgcatccgcctcatccacgtgtcgtgccactatcccttcatccgacggctctccttcctccggcacgatatcggacggctgtcccgccaccaagctcagacgatgacaccctttccccctccctaaattaaccaaatcaaaccaaaccaaaccatgtttgtcatcgctaatcaatccacgtgcatcgtgttcgaccgacgtcatcttgcctctcctcctcctcgtcgccatcgtcatcgccatcgtcgcggtctatatatggaggcgaggcgaggcgaggagatcggtgtcgtttgttgctgccag

SEQ ID NO: 26550 - DNA, 1501 bp, Oryza sativa
tctttttatttggagcttcagttcagagttgggccatgcattatgaaaaacagagttcagagttgatcttaactgaacatggccaatcatgcaaaactgcatttccctcttgctatgttcctggtatttcctgtcacaaggcaggcaggaaatcaggaatgtatccctgggatcatgaaatttcagatagtataacggatcttgaggagtgcacatcgaaagctactgctagggttggtaaagtacaagaggaagaaggtgcagctctttgaatgcctcttgttgttgcccttgccattcttccactcctcatcactgaattcacaacttactattgctatgtcctttttatactactgataattgatctttacactgctttatccatcggtcctgtaataatcttgttcatcatcttaccagcacgatcaccaccgttctatctatctgttggctgcttggcataattctatttgcatttggtgagtagtagagtttaagttgtactgctactcaacaaggctgcaaaagaagaagacagagaatgtatgacaaagggtgttgttgtcaatgagtgattgcacgaaaccaagcatgtcgacacttgcgagcagcagctggattagctaacaacaagaggcagattggttacaacagcagaccctttttcttgatttcagcactggagactgatagttccatcagtaccactcaagaaactttagccaccaactgcatttcatgcatgttggatgtctgcatggatcacatcatcaaaaagattgaatgagtatgttagattgatactaccagtgcaattctgaagatactgttgtagcaagccccagtgtgtggtgccagtgaagcagcagcagcagcaagtaagacggcatgagatgcaaatgctgctagacctactcggcgtgccttgcatttattggcattattaggccggcaggggaaacagatttcctgaaaaataacaaccgcctgccaacaatgtgcatccaacttgcgctcctttagcttcaacattacagtaccatctttttttctttctcgagacatgtatatagcattgcgattcaaggggtgccattggctgtcagttttcacctctctctgcttttcttcctacctactcccctccattaaaaaaaacacttgatttcaggttcaaaatttatccaaaagacaatcgattcctatcatcttatatctatccttaatcgaagttttatcccttcaatacctcttacttaccagagagactatggtatttcccccttactagtaaattttcttaggatgactgaaaatataaatcttttcaggtcaaagggaggagaaaaataacataattccacttaccgggaccctgtttggaacacaagaattttgaaggaatcacgtgcaaattccgacggtaaatgtaaagacaaaaaaaaaatctgaggtccaagaagggaaacaatttgttgtaatcgcctccaaatttaga

SEQ ID NO: 26551 - DNA, 209 bp, Oryza sativa
attcctgcagcccagaatgttaatttgaagcacccaaatgatactaaccaatatgctggtggacatgagtatctttgtggaatttatgacaccgaagagatgagcgagtctgaagatgtgtgataagcccatctttccacccctcttttttttttctgtctatagcatgtaggcatatgctatgcttcattgccagtggcatactgaca

SEQ ID NO: 26552 - DNA, 203 bp, Oryza sativa
gctagggtattctcccgactgacgcattgtgtttcagtttgcttttgcacttttacgacccaagcttgttcttgttcttgcaaatttgttctgttcccgatgcaaatgcaactgacccgcgcgttctttgtaccggttttctttcttctttcttctccttgtgtagcagttgatagtatttatctcttgtgtgtcgcctcaga

SEQ ID NO: 26553 - DNA, 1501 bp, Oryza sativa
acatctccttgtcgataaacccactcaattgcacccggaacgaatgggagacgcatcatgaacatcatgtcataattcacaacgtcatatatcttgacagaccaatcgctggagatcgtgcagcaaagtaggccatcaacactcacctgcattactgaatcacgctataatttgaggttgttcatagttccataggcaggagctgtgactaagagtagcaactagcaagataaatagactaatatatattgcgaatgcaaatgttttccctggattagggaagtcaatataagaatctgaacactcacagctaggccttcaatgggactgagatgagatcgaaaatgtttagcaaattcgatcccagctggtttcttcttccaaaatttcaaatgtcctgggtagagaggagaaaaggatggtaattaagctcccattacatgaaaatgaatcagcttattattgaatcataccacaggatttgatcaatccatagatctaaaagtttttcaaccaatactattacgcaagtctatcaagcccgtgattatggttcagtgaaggactatcccttatgtagaagggcttgacatttccacaagataccatccgaaatctaacacatgctgccacaagctaacaaactaccacaaaggcacaaaccactagtatcgcacactgaatacggtacgatgcagagacgtgagcgcgagagattaccatctgcgctcccggtgatgaagtagtcagcaggagagacggcgacgtgggtgacgacatcccgatgcatatagctcttctcgtacctgcaaaaccaagccacggccgtcagcctcccagccgacgcaccccctaccaaatccgaacctgaaacggcgaggagaacactcacatggccgcggagggcagggcgtcgaggaaggcctgctcgaactggagcgggcgcttcttcctcggccgcggcggcacgggagccgggccgatcatctcctcctcctcagccgccgcctccttccccacggcggcgggtgcggctgacacggcgccattgccgttgccctggtcgcgctccacctcggcgtcgtccgtggcggtcgttatcgtggagctcgccggcgcatcgctcgccgtcgccatctcgaggtggagctccgctagggttctggggatttgggggagagaagtctcgactcctcgagaccttctgctccggcgacgaggagcaattatttgtgttacgaaactaataatagggggtttccagaaaaacaagtccctactctccgcctcgattctagccgccaatggccgatctgacggacacagtgacacgggggattcaaatgaaaagtaaattcttctcttggggttttttacgcaaatgtttacaacagccagcccacaggccgtaacccacggcccatattaaaacggtccagtaggcccaacccagttagacgaattcctcaaccttatcgatatttttctctccttttttttt

SEQ ID NO: 26554 - DNA, 1501 bp, Oryza sativa
gtctctagcatagcttgtatttattctaatcttttcatgagatttagattttgcttttaagggagatgaagcatgacacttaaattctacttgaattaagcaaatatgcaatgttgatgctagcatacggtttgatttgtaaatgctctatatatatgctttattgacttgttattcctcaaatagctttaattgctcattgtgaaaaagagaataaaaaatatgaaaaaaatgaataccgaatccttgtaaatagtcttgacgacaaggacgtattcgatgtgagcaaaataatgggtgccgaatctctggaaacagtcttgacgacagggacgtacccggaataaaagagaaaaatatgagcaaaaaggctcaagaaaagaaaaagttaaagacattctcttggttattttgtgctaaaggttatttgagaaagagtgataaatgcaataggtatatgtatttagtgtttattcttcaacctatgtgcttgttaagatgttccattataaatcatatgaaatcatcaattttgattgttgattcaagcttaattgtaaaatctttggttcatgattatactttaatacatgcttgtatattatagataggttcatcttctttttattgcaacacatgacttgatatgctatatgtatgctaagcacttgaacattaatgaacgtaattcatatgcttgatgaaatcattgtcaaaaggggaagaagtaatgtgaaaatttttggatttttggagagttgttgagaagagcatgtttttggttcaattgggaatttctttcttttaaaaaggggaagaaattttcttttggattttagaagttttcttttggatttttgagcacgatgtgtacgtttgtacgaagtgtgctttttactacttttgtttttatttttccaaacaccaaaacaattttgatgggtttgccaatgtgttcatcaagggggagattgtaaaatcaaaggtgtttttgattattattctgtgatgaacaattgggcattggagattattgattttgatatttggaatttattcacgaagcggttttggacaggattggatttcacaggtgatcgcaggatttgttatttcatgtgaccggtcagactgggcgctggtagccggttagacctgcgtgttttgctcggtcagactggctagcccgcggtctgaccggccgacgctgtgtcggtttcggtttcgggttgtttgtttggatatccgtgattatttcatgattaaggcttctagatggatactatacgaatgtaataatattgtttgctactaatgagtcaagttggagatagcttggtctcgaaatatagtttctttgtttatttcatgtgtaggtgactcgatgtctcgggagagtatttgcagtgatggaccgggagtcgacttggggataagacgacgtccgtggtggtcagagatcatgcgggataatcatgcgggatacttaggctagagttga

SEQ ID NO: 26555 - DNA, 1501 bp, Oryza sativa
agaagaagaagaagaagaagagaccaaaaaagaagatggatttgattcgagacgcgttgcgttttgatctgctactctacttgtgatgccaaagtcgatgaatataaatttgttgcgaatttcttccttcttgtttatattggcatggtcgtgtggtgagcttgcagagagaggtggcatccgaggaattgattagtcgattaaagtatgcacgtcaatggccagcggcaaccaatatctgcaggtctggtcgatttaaggatggatctcatcatctcctatagatgtatggttggttggtgatttggacaaactgtacacacccaatgctagctgctttggccatctgattgataatcctcatgccattggtggcactgctacttccagtttttctcttgtatcttaccacacgagatcacatgagatagtgaggtgttaaccttgacatgctgatgcttacatcagttgggaggacatgctttcacggaaatttttaatcaacacgcaatcgctagctgtatatcaaggtccagttcgattatgggcaagtgacaggacgatcgtatcatatattctgagaccgacctgatgctcttgacaccctaacccctaaccatgcaatttaattagtatattccattgagatatattgcactgtttgaagattgctacagcgggatcaccatttagatccctcctaatcaagtggtgatggacagagtaagcatgcatgatgatttcttgcaataatccctgtaacccaactatgctgacagcgtgttcctgcctaccatcgcttcggcacatcatgattctgcatccgtgcaataatctttcctagtcttgttctaacacttttttatgctgatgaagacccccaggaagttggttatgtttggttcttcacaaaatccggtttaatgaaattttgctgtttttctttttaaataagggttatggcatcaatgatgaaaaagaatattaataaccctcgcacgataaaaacgaaagaaaaaataagtcaattttgcctcccttgctattggttgaatctgatttgtatctctcaagtctgaaccgtcgtaaaactaggtatatcaccgtctcctctgatactaaaatcagtttagaatgactcactcggctattttgagattggttttggttgatgtgatgcccaatcaaaaaaaataaaaagtactacctccgttctagaatataacaactattggctatgaatctggacacatagttgtctagattcataggtaaaaatacttatattttaggacggagggagtagacgtgagccctcctcgtgtaagtgactattctatccgtcccaaaaaaagacaaaccctggtttccgtgcctaacatttgaccgtccgtcttatttaaaaaaattatgaaaaaaattaaaaaaacaagtcacgcataaaatattaatcatgttttattatctaacaacaatgaaaatacgaattataaaaaaattt

SEQ ID NO: 26556 - DNA, 1501 bp, Oryza sativa
ttttgctatttctccgttttttctaccctgctattcaaagggccctcagagtggtgtgggtcaagctcaaaaggcaatgaatgtgagtgctttggaatgcagggcaaatgggtcatttcattattttttttcttggtttgttcaatgttcattttgtggtgagggagaagaagccgttccctacttccaagatttttcaattgtgcttagagcaggtacaatagcagactattagccagctacaaacatattttaatgagataaaagatgagagagaagagcagcgggctacagatctgtagccagctgcagcacagactccaagacacagtgtgtgtatgacaggtaagaccatatattaatagtatagtaagcatctattgtatgaattggctattagactggctatagatgaattggagctagtagtgggctatactattaaacttgctcttaagggtatgtttagttcacgctaaaattggaagtttaattgaaattaaaacgatgggtcattttggattgatgctaaaatgtgccctaccaattttttggtagcttaaatagtgaatttaatggtttggtttggaggcaagtaaatggtaatgcccatagttaatttggcataattctaaaactttcttaactataatataaaatttggctttcaattagtataatccaaactcattcactttaaatactaccctaccaaaatattggtagtgccaaaacatgcctaaattttggcgctatcaatactttggtagggcactaaaccaaacaaacccgatgtgacggaaaagttagaagtttatgtgtgtaggaaagttttgatgtgatggaaaagttggaagtttaaagaaaaagttgggaactaaaccaggccttgcctaaggcctgtttacttcgcgaaaagaaaaatttttgggtgtcacatcggatgtttgactggctattggaaagggttttcagacatgaatgaaaaaaatatttttataactcgcctgaaaatcgcgagatgaatcttttaagactaattaatccgtcattagcatatgtggggttactatagcacttatggctaatcatggactaattaggctcaaaagatccctctcgtgatttccccttaactgtacaattagttttttaatctatatttaatgctccatgcatgtgtccaaagattcgatatgatgtttttggaaaaaaattaggaaactaaaccagggataaatgcaagttggttgttttctcttaaagacaggtttaacaacatgaaaatggcataacaagaataagcaagcaaatcaatttacctctctaaacttggaatgaaaatccgtctaacagaagactttgaaacatggtgtacatggtttgcttgatagcttaccagccacaactacaatttaaattgtaaaagttaatttaaagtccaatctaaggtttctcttattatggtttatttttcaatatttacttttaaaaactgcta

SEQ ID NO: 26557 - DNA, 1501 bp, Oryza sativa
tctcgtcgtcgtccatgtcgcgcggttagaaatcaaagtcgttccgaggaggaagacgagaggcagcgtgggcccggttcggcatagagggggatgcggtgttgaccagtccaatttatccacgtgtaattttgctatatatttatcaataatttttctctaaaaaaataataaatattgtaaattgcatgtaactataatgtaacttatatataactttcatataattttgaaccgttatatttgtttcaagatttgtgcaacagtgcaagtgaggaattaaaagtcacggcgtgtatacatgtgagatgattcgtctctacgacctccgtttcaccgaaataatatattacggagagagttctaaaagtccctccgtttcacaatgtaagtcattctagtatttcccacattcatattgatgttaatgaatatatcaatatgaatgtggaaaatactataatgacttacattgtgaaacggaggaagtatattgtagttacatgcaagttacagtgtcattacatcacaattgcactaaaattatactccctccgtcccataatacaagagattttaagtttttacttacaatgtttgaccgctcgtcttattcaaaaaaatttgtgcaaatataaaaaacgaaaatttgtgcttaaagtactttggataataaagtgtgtgtgtatatgtgtgtgtgtgtgtgtgtatatatatatatatatatatatgcgcaagcacaccgtactgcggactctagcgacgactagcatcactagcctctccgaggtgtgcatatgcaccatgcgactgcctgggcaaagaagaagataagattgatatgatatacacgacataagaaataattaagtagtactaaccacatgtattctggtgtctcagattgtacacaggatctgatcgatctcgtatggctatcgccgaatgcattgtcgccatcgaaaaggctttgcgcgagatcgacgagtgattgatgccgcctgggttagttcaactattgctgcatcgcaccgtcgactagtcccgtcccgtcgcgccgttgccttggaggacgatgacctgcatttccgccacacgatgttgccgatcggtctacaccgccgccgcgccgcgcgtgcaggccgccgcgccgggatcacgccgtcacctgcaacgcagccatggatcgacgatgaatctcgctgctgttgcggaatcgacgatgaatcgccgccgccttctccgagttctattatatcgcggtctctcctagtgacctgattttcggatccgatgcactggtggaacgaggaattgtactcaggtcattccggtttccgtggctaaattaaggggtacgtaatttttttcttgtcaaaaagttaaacgggtccgctcgttaatccgatatcaggatccatcgaagctaatcacagatcaacggtggatgatagcaggtgtacatactcccatgtgtgtgtgtgtatatatatacacatta

SEQ ID NO: 26558 - DNA, 428 bp, Oryza sativa
tatgactccccaggtcgctcttggaacctaactcagatcagatcagactatatcattagtacaaggcacaatgaatatagtacaatgtgggggttgcaaaggcattgttagagaatgtgtaccagcaatttagttcaatgtttagagaatgtgtaaatgttatctaatagaaagttcaacatgcatatgatttgaaacaacaaaacactagcataatttcgcagttatcaacatagaagaagcacaaaacttcataatttgaaaggtatacgtaagtgccgtggaatcacacttagcctctggcacatcaaagctagctgggaaacaagctatctattcctagataggaactagaataatgtgatccaactggaaccgccattattcactatggatcatataaaaacaggacctaatataaattcaga

SEQ ID NO: 26559 - DNA, 1501 bp, Oryza sativa
acagcaacatgagagatgaggcatatgagattgaaatcaatccccttcaacgctctaaatggcactcgacaactatggttggcacatacactgaaatttgttgtagattatcttatcttatgtgaatcaagatcatcatcaaatatcccaaaggtacaaaggaactagtaacaattaacagtcggcataaaattctaattcaattcgttgtaagtccataatcaaatgttggaatcaggctgccggtggtgattagaattaacaataactgacaaggttttagcctaaattatggagaactctccccataatttcgctaattactagtaccacaagaactcagactagcgagtaatatagccttattaggactggatcaacaattaagcacagtaaaatcacaattacgtactagcaattaaagaagatactcacggagcccgcagatgctgaggatgatttggaggaggaggaggagaagcaggaaaagatgtagcggagtacctccatggcgaaagtgagagaacactcgatcgggtggtctctcctggtttaatcttaatcttggggccgattgggagcgcgcgggtgggtcgcggtgcagctgcctttgccggtgcagcggcggagacgtgggggatgtcgccgcgggaaccggattcccgccgcggcagtggctggtggctggcggtggtggtgggggattgggagagagagagagagatggattcttctcaaaccacctagcgagagagaggtgtaggtagcttgtgggccgattttatgggcctaatccatgggccggaagagcgttcccatgggctaggcctccatgtggccgctcgtcatgccaaacctgaaaccggcgccgtttcttcccaacacaatagtctttgttccggtaaaaaaacgcaagagttttgtttgagaaaactaaaattgatagatttttttaaaaaaaatcattacagtctaagggtacgaagtacgaacaaatgaatctttagaccagcactctaagaaaattgttatgtatgaaggacaccatttataaatttaagaagcgtgtgcaattttttctaagagaagggtatttttttactcggcctctatatccaactggatatatgcagcattttttttaaaaaaaatactccctccgtttcgaaatgtttgacgccattgattttttggcacatgtttgaccgtttgtcttattcaaaaaatttaagtaattattaatttttttcctatcatttgattcattgttaaatatatttttatagacatataattttacatattttataaaagtttttgaataagacgaacggtcaaatatgtgctaaaaagtcaatgatgtcaaacattttgaaacggagggagtagaaacttagtttgaaattcactcctatggagatttaaacttaggaccttatgtgctacacagaagtgtgtgcaaatgaaaattgaaaattagaaaatatcggacaaaattcat

SEQ ID NO: 26560 - DNA, 167 bp, Oryza sativa
attggggacagaggaagataagcaacctgaggccgcgtctccagatcgcaaacaagattatcttccaactggatgtagcacaaggaaacaggtccctgttgtcgcaagagctgcgattcagggctggactcaaagggcaggctctacctgacgcttgcctccctaga

SEQ ID NO: 26561 - DNA, 1501 bp, Oryza sativa
atttaaagtgaatgagtttggattatactaattgaaagccaaattttatattatagttaagaaagttttagaattatgccaaattaactatgggcattaccatttacttgcctccaaaccaaaccattaaattcactatttaagctaccaaaaaattggtagggcacattttagcatcaatccaaaatgacccatcgttttaatttcaattaaacttccaattttagcgtgaactaaacatacccttaagagcaagtttaatagtatagcccactactagctccaattcatctatagccagtctaatagccaattcatacaatagatgcttactatactattaatatatggtcttacctgtcatacacacactgtgtcttggagtctgtgctgcagctggctacagatctgtagcccgctgctcttctctctcatcttttatctcattaaaatatgtttgtagctggctaatagtctgctattgtacctgctctaagcacaattgaaaaatcttggaagtagggaacggcttcttctccctcaccacaaaatgaacattgaacaaaccaagaaaaaaaataatgaaatgacccatttgccctgcattccaaagcactcacattcattgccttttgagcttgacccacaccactctgagggccctttgaatagcagggtagaaaaaacggagaaatagcaaaaacataggattctgacagggattgaagtgtaaaacagaggattgcaaaacacaggaaaaacataggaattgtcgtttgattggagcgcaggaaaaacgcaggaatcggatgaaagagatagacttaaaggaaattttccaagaggttggagctcttgctaaatttcctccaaaatccacatgtaatgtgccattccataggaatttcataggatttaaaagctttaatcctttgaatcaaagggctaaataggaaaatttcctatagaatttgaatcctataaaatttctgcattaaggccccctttgaatcacaggaatgaaaaaacgggagaatgggaaaaacataggattctgataggaatacaagtgtaaaacagaggattgcaaaacacaggaaaaacataggaatgaccgtttgattgagccgcaggaaaaacacaggaatttgaggagaaacacaggaatttgaggagagagaaagactcgaaggattcttaacatgaggtagaacctcatgttaaatttccttcaaaatttgtatgggaagaggtattccataggaattttataggatttcataggattcattcctttgattcaaagggctatataggaaaaattcctataggaattaaatcctttaaaatttctatgaatttcctttaaatcaaatggggcctaaaagggggccatgaatctttcactccactctgctcaaatatagcactccactccctggtcagtgctacttcactctcccacttcgaggctacaagcttttcttgcttgctgcaatgg

SEQ ID NO: 26562 - DNA, 1501 bp, Oryza sativa
tatacaataattttacagccctgcagtttcaactagacaaaacttaattatttcactatgagtgaattcaattgatttcctagataataatataatttaacctccatatatatacattattattcatctactaattaggagtaatagtgttgtctaccagcggtgcccttgtccgccgtgatcatacgactgaaatgtttgcggcggcaacggcggagtcagcaccggcggtggtacagctgcgacgggaggcgccgccgccgtggccgacgcagcataactggcacagtatgctggaggcggcggcggcggcggcgggagatcaatggtggagtcaacgtagtgacggtcggcgatgttggagtggcggccggtgagctcctgcacgacggcgcggaactcctcggggctcgccgtcagcttcatggggctggctatgtacaccaccctcacggcgccagggcattgcggcggcttgtacttcctcgccgccgccttccccttcttcgccggcggtggcttcgagatgccgtgccgctgccggccatgctgctgcaccccgagcatgttatctagagctttttgtgagcgtggtgtgcagccgtacgtgcaatgtgcgtgcctttatagaaacagtagccctgtttcggaacgatatcctgcagtaacagacgaaacagtggtaattttctgcagtaacagacgaaacagtggaaattttgggagaattggatcagagcattttcattgggcggctggggtgagagacaggagtagatattattgtgccagttaagtttttttttatatgatgaatattctggccttttttttaaaaaaaaaagaactggcattttcttcaattaagatagaaaccacttattacaaaattttgaacgtaatgaccaaagatgatgagagagtaagttcgaacaacaaaaggagaaatcttattcaatcctatgtgtaaactttcatccaaagttaagccaatatctacattaatggacttcaaattccaacatgcagtatgtataaatcttttatccttatcacacatttgtagttaagttcagaatctgagctagtatgctatgctaccttgaaaaaatcctgcctataaaatttagttggagatttgtaccagctagctactgtagttattaattttaaccatagaaaaattcacgcatggaaggaaggaagacaagacaagagacttgttggttcgagttagagggaggtcacccagtcaagtactcttacccaaaggataggttggaattaactgagataacccattcaaagtccagattcataggatgtgtttcatctatctacaaacaagaagttatctaggtaaaaagatgaacggtaaaaccagattgctagctagctagctgtctcacggctattcgctctctccagtcagtctctagccaattggctagcaggtaaacacaagttattctcttcagtcaaaaaatgaagtcgttttcga

SEQ ID NO: 26563 - DNA, 552 bp, Oryza sativa
catttaaaaccccttttttttattttacacttaaattactttcggtgacattttttctaaagaaaataaatctatttctaaagaaaataaatctactttcttttcaaatgacaaagaagattataaataattgcttatagatattacctatatatatatatatatatgatataacataaagctaatgggataaaatattattaaacaattaattaatgctgacaaaggccatttatgaagaaatcatgaacaatattctctggttaatacctcgcttttatcaatacgtacgcatgatggacgagctcctttctagttatattaatgtatccaaaaatgcattatattattatttggattttcttccagagattgatttcaagttttcggtaaataaaataaacaagtttggctactttttttatgtttactcccatgtttaagcacctaagaccgtcagataaccatttgtaataatatatgccgatggtagtaacgtttggtgaaacggcaagaatcgtaatgacaatgtttttacaccactcgagtttc

SEQ ID NO: 26564 - DNA, 1501 bp, Oryza sativa
gactgtagtactagtatctatatgtatcttgactgcaaacagcagctattagtacgtataccggtctagaatgtaccataaaagtactcaagctatatggtcaataatcactcaattggactagtatctgatcctggatatgcgtttgcttaattagtcaattatgaatcgacaatgcatgcatctggattcctgattgcttttgtcctcgatcagcaatcgatcgattgatctagtctaggcatgcattaggcacataagtatgatctgcatctgcatgctagctacctgggaattttatcgatcaccaaaaactatatatcctgatcagtcgcacgcgcgtgcgcacggatgttgaaatgtacgagcgccttgggtccgtgtgaatgagacaatttatcgatcgatctcaaggaatataattaatcgatcggcaggtcaaactcaaaacgaatggatgattttctagctctgaatttctcaagtctttaaaaaatagtagcaggctagcacacccaccttcttcaattcgtcgtcgagcggttgcgatgccatcgtcgatgacggtcatcactgacgatcaatgctgcgctggatgattttgctttcaaagaatccaaatataatatatatactcgaaaacgacttcattttttgactgaagagaataacttgtgtttacctgctagccaattggctagagactgactggagagagcgaatagccgtgagacagctagctagctagcaatctggttttaccgttcatctttttacctagataacttcttgtttgtagatagatgaaacacatcctatgaatctggactttgaatgggttatctcagttaattccaacctatcctttgggtaagagtacttgactgggtgacctccctctaactcgaaccaacaagtctcttgtcttgtcttccttccttccatgcgtgaatttttctatggttaaaattaataactacagtagctagctggtacaaatctccaactaaattttataggcaggattttttcaaggtagcatagcatactagctcagattctgaacttaactacaaatgtgtgataaggataaaagatttatacatactgcatgttggaatttgaagtccattaatgtagatattggcttaactttggatgaaagtttacacataggattgaataagatttctccttttgttgttcgaacttactctctcatcatctttggtcattacgttcaaaattttgtaataagtggtttctatcttaattgaagaaaatgccagttcttttttttttaaaaaaaaggccagaatattcatcatataaaaaaaaacttaactggcacaataatatctactcctgtctctcaccccagccgcccaatgaaaatgctctgatccaattctcccaaaatttccactgtttcgtctgttactgcagaaaattaccactgtttcgtctgttactgcaggatatcgttccgaaacagggctac

SEQ ID NO: 26565 - DNA, 478 bp, Oryza sativa
ccttaatactattaaaacaaatatgaaaaaaaacccttcaaccaagctggttttatgttgaattgtcttaatagtattaaacaaatattgaaaaaaaccatcgaatcaactgtttttctggtgaattgtcttaaaactattaaaacaaatatgaaaaaaaaccatcgaaccagctggttttctggtgaattgtcttaaaactattaaaacaaatatgcaaaaaaaaccttgagcaaatggggagttaaacctcagacttgatgagctgcatgccttgtactttccacctaaccaactgtgtaagaaaaatttgttggcgaggactgaataactattctgtttagcagtttaagcgttaattatgataaaaaataattagccataaatcgtggtccaaccgatgaaccggcggtccaagcagtgaaccggtgaaagctcactgatcagtcccagcctcccaggttcggtttttccacca

SEQ ID NO: 26566 - DNA, 1501 bp, Oryza sativa
gctgctgctgatatatagctggagctagcgcgtcatcgctgctgatacagatatacttgctccgtgtcaaaatgttgctatctaatatatgatcggatattttctagtacaacaaatttaaactgaaacctattttgatttgttatactataaagtatctaatcattagctaggttagtagtaatatttcgggacgaatatagtacaatggatcagtgacgaaagcagcggtttcggatgcagataccttggccatcgcgacgagcaatcaatcgatcgatcgatcaaggcggatttttctgacggattgatggtgttgcggcggttgggtccatcactccgaggcgcgggcgtcgtacgtcagggcggctggcttggctgcggagattgggccgggtagccggccggccgaccaatttactgactctctccgccgtcgtctagccatttactgcagctgctgctgctgctgctgctgcggctgtcacggcgttgtgactgaacgccgaggcaaaaccgtcccggagctgacgaaatttgttcggtgatgagatgccagtggttcttgtctgcaaacgtcgtgacaatttacatcattgccggaggtctgcgagtcatttgatggaagagaagaaaaagatgtctcggctatgtttgaagcaaaggtttgagaaccgtttttcctcgacatgcaaaatggagggttgagttagcacatagttaattaagtattaacttaaaaaacttaaaaaataaattaatacgattctttaaagtaattttcctataatattttttttatttaaaaaaacaacagtttagtagtttgtggagaaagagtagtaaaagttaagggtggatcactgcctggtcttttaactgaccaagtggccatgtttggagagaaacattggagatgtataccttagtgaaattgtgaggttaattctatttggatttgaataattgggaatcatcacagtccgtatgcaaacaattaatccaaagttttctgtagggaaaaaaattcataaactgcaatattcattcagtgaactgaggccaaaatcagttggacatgatgtgtgttgccaaagaacaagattatatttctgatgatgggcccttaaacttcaatttaaagcaaaatgaagcctgcttcacagattgacccaatttgctttgggccttaaaaagaaaggcctaacggtaacttttaggtccaatcagatccagcccatagcctaaccagcccattgaacccgtctcttctacccttcgccgacatcgccggagccgcgcggcgcgcggcggccggcggcgagctcggatccccacctccacccctcccgactcccacgccttcctcctccactgcgacctacggtgtaggcgcattccgcctacgtggcctcgcctccgcctccggttcctccgccacgacgtgtccgcgtcccgtccactcgcccgatgaggaaatttcccttctgtactgtttcgc

SEQ ID NO: 26567 - DNA, 1501 bp, Oryza sativa
ccgagtacaaattttgtgcctgaactcagtttatccattttcctgagagtgctccccagttctacttgatagccattaatgcctttcatgttaaaacattctataacgttttatttggtttgaggaaagaggaacgactctcttttaaaaccgtttgaccctcatcctgtgcactcatacactccagcaatcaggtccttcgcatctcaatccgatggctaggatctggtagggtgggtaattttataaaaacccacccgcctcctatcttctacctttgcataaatcccctaaccagttcatcctcccattactctgtcagagcacaacgctgcgacaaatccaaagattccttctaaaccaccattccatatttccatatagcagagaggaattaaagatttctttttatttttttagagaaggataactttttctctgtctctacaatccaaccggatacccgtggattcgggtatccacggatacccggcccgatgggcacggcatggcgcgtgggcaccttttcttttttccgtgggcacgcccgagctgttaccgagtctctttaagttatttgctcctatgaagatttgaactcatatccatggagtgctactctggttactgcaaccactgaactacatgcccttttgcagagaggaattaaagatttaggttttggatagaacgaataggagaaagaagaattttaggaatctaagagtggatatctagcacttgattccttatatctatggcctaagtcatcgcttcgtatcagccttcttgtgggtgggtgctgccatcgccctcatcgagcagcttcacgtccccgtcattcgtgggagagacaaagtgatttgggggtagctacagccaaagaacaggaaacccatgccagggggatttttttttaacaaatatggcagattttattcatttaggatagttacatcgtttgctaacaaatcaagaataaagctagggggctcatcgtcccgagtacagttttgttttacctgcatcgctctctttgctaacttatacgccacttgattcgcttacaaaggtacaaggtgggaagtgggtggtttattttttctttttgtaaaattaccctaccaagatcctagctatccgattgagattggaaggaccttattttactactggatgagtacacgtgatgtgctgagtgcacctgatacattgccataatggaatagaagcatcagacatctggatctacttatctatcctacaaatagttggccttctatattagtgtacgccagaacttgtattgaagttcttaaaataaattgagtaaattttacaaacctacatatacttccatagatttaaggtgttctacaataaatttagtgatgccgtatctgtaattttgttatacgcatccttaaatttatagtcttgcaataagttggtcaaagtacatgtcgttttgtgaaatttatttaaataaataacatgtgat

SEQ ID NO: 26568 - DNA, 1501 bp, Oryza sativa
ctagctggcctgctgaacaaagcatgtcgcccactctgagcagcttccgtcttcttctgattcgacttgttttgctggctctcctgataggcagcggcgtccccatgccctcggctcagcaaggcagcgcacgagtccgtgagtatcatctgtatatatttgcaacagatttagctttggcaatcactagagtctagagctacggcgcgcagtactgtttttgttcccccgcccttggattgctgctaatattttctttttgacgcatcgttgcagataatccgcatggtccaccgcagacccatggtactggttttagctacgacattattcgtgctaatggtgcaataggctaacccacgaaactcacctataagccaaataagtagcgaacctatttattttgatctatatggattagcggcttactcacttatacccttgattcgtgctggataaatatgtagatcgtgttgttaccgctctatattatactcctactccctccgttgaaattgtaatgcctggtttttattgattatttcggaaaatcgctccttggctatataatagcaatgcctccaactctgttttaccacaaagttaagtgtaattacaaatttagtatataattgagcagtatgtacatttagtttgccacttatctcatcgtatcccttctattttcgtttccactttcttttccttctgaacttacatatctattactccctccgtcccataatataagggattttgagtttttgcttacagtgtttgaccactcgtcttattcaaaaagttttgtaattattatttacttttttttacttactttactatccaaaatactttacacacaactattcgttttttatatttgcataaattttttaaataagatgagtggtcaaacactacaagcaaaaacttaaaatcccttatattatgggacggagggagtatctattatatattaaaaatcaattaaactttctcaaattaaatgctctcagaccatcacgtggtgctctaataagttagagaaaaataatagaaattatgagaacaaaaagtaaaacatccatccattaatttttatttaaattggtaggtccacgaaaaaaagggcgcggcaaaaaaaagtgataaaaaaagctccctgataaaaaagaaggatgaaaaaaaccggtttcgattctaaacatcgcctgcaaaaagaaaatcgaaaaaaaaaaagaaaacgccgtccctgatatagagccataaggcctgaggcccgaaggcccggcccacggcacggctttttggcccggcccaagcacggcacggaccgacttgggtcgggcccgtgccggcccggcctgaccgccgggctgtgcctgggcctctccaccggcacgctgggttggcccggcacgatgggccggtaggccaggcccggcacacaaagtatagagactaaaaatagacatataaatgttactgtccaaataatagg

SEQ ID NO: 26569 - DNA, 1501 bp, Oryza sativa
gcacgatgggccggtaggccaggcccggcacacaaagtatagagactaaaaatagacatataaatgttactgtccaaataatagggaccttaaatagacttatttcagctattcatataccacagcccaaagataagggacgtaaaatagactttttagctatatatatgtcacagcccaataggagggagggaaattagacttattctgaggaaatgcacaatggcccatcgtgccttcggaccggcccggcacggcccgagacgtgttgggccgtgcctgggccgtgagtacgacacggcccggtgcgtcggtcgggccgtgccggcccaacatgcctcggcccaggcacggccgggcctaggccgtaccgtgccgggcagtccacatggccatctatagtccctgagaaaacggccaaaaaaaaacaaaaaagacgccggaaaaaaaaaagaggcaaaactccgttcaaagaaaatggctaaaaaaacgcgtctattaaaaagcccacaaatagggcgaaaaaccaaaaaaaaaaagccaaaacaccgtgagaaagaaaagacagctaaaaacgcaaaaagggaaaaaacgccatcccatgaaagcccccaaaagggaaaaaaactgtccgactactatatgttttatagattactagcaaaagtgcccgtgcgttgcaacgggaattgtaaagactaaaaaattgaggaaaagttgagaaatatttacattatgtaattcattgaaatacaaatttcgatattttttaagtaggtaggtgtataattaaattagtttacaagtaaagtaagtgcgagaaataaaatggtatagttaaaattaattttattaaattctccgtgattaattatgctagttggaattttattggaatttgcgtagcttaattgctaattttcataatactaacatccttgcaatatttatttgaatagaaatcttccactctctcgttggggcattttcagcccatttttatacagcccgcagccaagctggcccgctttcctcccttctcctctcctccgcctcaaccgcacacttgtccggcccaaaaataagtctaatgaactccccctacttcatctctcactgccgcgtgggccctaaccgaaagtctaagttaaatttttttgttcgaccggtcgacctgctgcggcccatgaagcgcacgcgacccaatagtgattcggcctaacgcgggatcgatctgagccattcgtttagagaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagccggccgttcgctctcgggcgacggccgtcaacgaaatttgcaggtggcccccttgccgccctccgctagggcgattttatactgtgcggggggccgcc

SEQ ID NO: 26570 - DNA, 635 bp, Oryza sativa
gaaaataggtacgataaattgtatataaaatattgcgtacctttgtagatacatgccgaatatatctacggaattagtagatcaatttaattaatctactaattaccttaattagccttggtagccgatctgaattgtcttctgtgcatgtacatgtcgtcaaatcaatgcacacctaggcatgtattgagtccatgcatatgtaggtgcacatgtcaggagcaaatagtacgtgatggtcttgaataatgatgtattcggtctcctcgccacgacttgtcgggatggacgttctcactatgtgttaggggtgaggataatccaggtcccaacagaatcaaaattaattgacgatgtcacttcccgggcagtcgactcgaacggaggcttcctggtcaagtcattgatctctgcgggggacatactccggtcgggttagatcttcctatagccgaagtcatcgagtattttgttgtcggagaatccatccctcgaacccatctcgtcaaaaccttgaagcaccaaaatccccctacctagcacgccactgttaacgtttgatattgcgactacgttatttagatggtatggggatcgttggtaccagggtatatgccagattgaggtaaaagaga

SEQ ID NO: 26571 - DNA, 1501 bp, Oryza sativa
atgcactactacaaaaaagctcatagagatcggcactataggtgccggatcagctaaagccggcacctataatgcttttatctcctccgtggactgaaaacacataaaaccgacacctttaaacaactataggtgctgattctaaagaagaaccgacacctataatataatataggtaccagttttctaaagaaaaaccgacaacgatattataggtgtcggttcttctttagaaccggcaccaataataaactataggtatcgtttttttttaaaaaaaccagcacctatccaagccgagccgagccgatccaggctgacgcgtcagcctatatgagtcaatatcgccgagtctttatctctatctctctctcttgcctctcgtcttttctcgcctcctctctcttgcttctcgtctcgtctctctctctctctcgtctcggcggttgggcggcgtcctggcagaggcacagtcagcggtggcaagatgggaggcagcaggcaacgagctgcatcggcggcacctacagcggcggtgaccttcgatatgcttttggataagcatgagaagcaaggtggtgagaaagctcgcaataaaggaaaaagaccaagatcacctcctagggagcgatttggtcattcaccaagacagtcgggatcacctacatatcattgttctcaagacatgtcatgagggtcttatccaatgccaccgccgggttatccctttccttattacatgccatgggggcaacaccactaatgttcaatcatatgcctccaatgcaatacaatcaaggatagggaggaccaaggaggccagctcatgagcatttgtcttcaccaaataatggccggttttgtgctaaaaacctcgttgatgaaggaaagagggaatgaaagcatgttaaggtggagacaaggacttcggaggtgattactatcaaagtagggtctcataatgtgccaatacgttctggagatgaggttgggagtcttcaagtaacaaatccgaagccgggatcagttcatcgcagtcggccggtttgaccacagccctacggccggtctgaccgccggccacatgccggtttgattggcgtctctggctggtctgactgacggcctacgtccggtctgaccgggctccagcgccggtttgatgagaggtttacaaaggatagctcgggggcttcatcgtcttcaggtagaatcaacagggggcattatttctctcctggaacaaagccgaaaccaaggtagatgcctaaggatttaacggctactcaaaaaagaaggttgcaatgtctttgggcccaagaattaaaagagagagagagagaggccgaagagcaaagagatagaagattcaatgagttgcgaccaccgcctacaaaggtgtggaggcgtaaatccatagggggagaagaattggttgttgtgcaaatggggaaggaagaacaaccggttactaaggacgaatcatctccaaaggacgaca

SEQ ID NO: 26572 - DNA, 1501 bp, Oryza sativa
actctactcctttgtaggcctgctacttaatttatctcgtcaaatgttttagatggtcttgtacatgcatagatcatactggcgaagatattgtaccttaaattttatttgccatgtcttataaaatacaaatatgcttaggccagggcgaccgacgggggtggagcaggatcgagcgctccccccctccccgtgcgcacgttcccctggccccaccacgtgtctcaaaaaatatttcacttaatgtactcataatatttcacagatctaatgttgcagtgaattaaaatattattttacaataaatcacctacatattttaaaaaccctctattaaggaaagtcgttttatttttttgttccactaaaaatgtttcacctagtgtactcacaatgtttcactacgtatagatctaatgttgcagtaaacgaaacttcttttgcaacaaatcacccacatattttgaaaattctctattaagggaattcgtttttatgttccacaaaaaatgttccaccaagtgtactcacaatgttttactatgtatagatctaatgttgcagtgaactgaaacattcttccgctatttgctaaagtattatttttatataaggtgaaataacgcccgatttaataataagctaaaaaaatttcgccggaatatatccatgtgtggtcttgttttgaatatttaattgcaacgaatttaatgatgtaatcggatcatgatttggataaataatttaagagaaaaaatagtttaaagtggttttgcacgcatgcatggctctgacgttatgctgacgttagcgtccgattttttcatgcttggatggggcgcccgatcggtagtctcgtcctataaaataatgtatatctatgttgatttcttcgtagcatacttgttttgcttctagatcgattgtgggctatctccgcccaatgtctctgctatcttggcatgtgcatacggcatgacatgcatgcagtgttctccctctttactatcaatggccatgtatgtatggcacgtatattttccagccacatatgaaacgtagatcactatagttcaatttgcactctaattaccatctaaacatagattaatgtaatttgtctgattactgtccataagaccatagcatccatactcagacaacctgtccgactcctaatcaatcaacatgtccgacttctattcattcaacatgtccgactcccatatttcctattagatcaaagttgctttctatttagactcaatattgtcatgaataatctataccactaaaatctagtacaactacgatctaacggtgtaaatatttatccttttatccgattaatgtgggaatttctaatccccacagtaaacgtggtgtcttcttttaaggctgttttaataatataatagataaatagatagatagatgtgcatggtcctttagtgatgttaggggcatattaattacagccgtttacattgtggaaaggagg

SEQ ID NO: 26573 - DNA, 1501 bp, Oryza sativa
tgtaaggatgtacgcatcacttcactaaaaaaagaagattatttagctcctgcttgtttgtgattagttgctttcgtgcataacaatgtgcagttttgatggcttgcctttacataacatgcttgatggtcacctgggatgtaaatatgtgatatgcctgtttgagaaacatcattgaatcttgtacattaatcttatatctttctgactttgttttgagttatatgaatagactgttctatttgctgttcgattcctgttcagcattattatgtataaactcgttacttacacactgcttttttttcacacatgaaaacaagttaaaaaaataatttacatgtaactgcttcttctttttttttttgactgtgtaactactttcggcgctcactttgaacacacaagattagccttggataactaagtttcagcactaaaataattatctgttttgttcatgagttttagagccccctagattttaagctatgtcaattatataatgcagtcgcttggctgtcaaattcctttttatgacagaagacagtttggagatgtgcatatgactgtgtgcttacattttgcttagacgggagcacacctttactgacagacagatggtgatgtattcacacctttactgacagacagatggtggtgtatttctttctttgcgttaagtggattatattttcatggaattcgatgttatgcaattctgtcagtatatgcaggggttcctgagaagttcctggagaaagtctgaacattgaggttatgtgctgaatgcagcctccaaattgtctgaatgttgatttattttatattctttgccagcgtaagaaaattatattctttgccatgaattgcccacatttttttaccaagttttgattataccattctaaacttcctatgcagaactcaattatgtagaaattgcaggttgttttctctctttggtgcctgcagattcttctgattctttatggttagtaggttgcttgctaatatcctgggatcttgttttttttgctggccatattttcgactgaactagtgcaagcaacatgcatcctttgttctttcaaatattcacgaagtagtgcttcctgatgaaaaactcatatataatcatgatttgtcaatatccagaatctgaagatttgcaagcttcaacaccatcaggcattgaagtagagcacagtcttgtgttattgatacaatcgttagtttgatcttcattaggatattcataatgtcctattattccactcatatcaatattgtaaattcagtgagcaatgcaacggttctgtgacttctgtcattctatttgccatcttcaaaatcttggaggaaatatcgttgtttgggattgagtgcttagtctgaattcttctcaaacatttcttgtaattgatgccactgtggtttactactacttacaaacactagcacacaaatagtaagctgattatctgatcatgcatgttct

SEQ ID NO: 26574 - DNA, 1501 bp, Oryza sativa
cccacaaggccataacacgaaagcttggaaagtcgggggactttactgataaaatgcactccgcgtccaaaccgcgtcgagggtacatacgtcattctgctcatttaaaaatgtcaagaaagcatccatcatcggaaaattccaccgttttacaggcccacatgccgtaaagtcacagaggcttgtccttgacggaacattcaagattacacaaatgccctcacacacatgctgtactttgacgtttgggatgagttttacgtaaattctgaaagaataaaactgtttttatgtgaaaatcctgtagaatttgcttttgtgcatacatagagaatcaatggaacatgtacaatagtacttcctctattttaaataaaaagatagttgctctctccgtctcattttaaggctctgttcgtttgggcaggtttccaacttctattcctcgttttccgcgcacacgtttttcaaactgctaaacgatgcgttttttgcaaaaagtttctatacgaaagttgcttaaaaatcaaattaatctatttttgaaaaaaagcaaatacttaattaatcacacactaatggattgctccgttttccgtgcaggggagttgggttccgaactgcctgaaacgaacagagcctaagtgcagacatgatttttcgtgcccaacttgatcatctgtctcatttgaaaaaataaagaatttaaaaacataagtcacgggtaaagtactattcatattttatcatctcataacaacaaaaaatactaattataaaaaattttcaaataagacggacggttaaaattagacgcgaaaactcatggttacacttaaaatgggacagaggaagtatatttttaagcgaaaggactgagggaatagctaggtagaatcccgccaatccagggactgatttttttttatcctaccaattgagggattggctcaaagcaaactcatgccaccacaaatataggatgatttggacattgacaagctaaagaaaatgcaactttaccaaataagtaagtaaattttactttggaccattttatcttcttatatactatatattttagatcatttcaactctcttctgaaacatatgagagcgattttgagtatgtcggttccttaataaactatcatgattatatgttttttgacatatgacaatttaggtgtagatggataaaagagttcggggtggtttaaagtgtaaaaaaatgttaataaaaatatgatcctgtaataaaatgaaactattttcatgtctatgttttgaaaaacattatacccattactaatgaggaggggtagtttgggaaaagcaggtggtcgaaggtaaagcggaggtgacggaagacgcggtataaatcgggggtgggaaacttccaccggacgccacgccacacaagtctctcctcctcccatctccgcttcccttcttcttcttcttcgttgatccactcacccgccgcgcgcagaggaggcca

SEQ ID NO: 26575 - DNA, 1501 bp, Oryza sativa
gccagcctcctcctcgctgctcacctctcgcgccatcatcatcgggcagagcaagtgtgtagtagagctagctatatcgtttgaggaaaatggcgggagagctcgggtcgggctttggccttatatatagaggagaggagaggatgataatggcatgtgtggacttggaagaaaattactaacaatcaagcagcttaattagcttaatcgatgagatagctgctgtgctctgatcgattccaaaagcctaaagcgacggagctggccatggatgccatgcgtgattagtttatcttttggaattacaacaccacattaacgatgctaatccacccacacacgtcaactttgacgcctcctctgacttatctccttacttccttcccaaatctctctctctctctctctctctgttttgtctgtctctgtatccagtttgcctgtctcacatatgccaacttcactgtactttcattagtttcacatcgatattgatttgtactacttcagtgaaaaaaattcagacttttctgaatcatagcacaatataatttagttcttttctttttgcatgatcaggacatagatttctttcttagccttaatttaattaggctttttgatggtgacaaggccggattaattgtggctgtcattttagcttagatttatcagatttatgtgctgttcagagttgaaacttgaaatgaacacacccacaccatctagccaagtttgtcaacatgctactgaaaataactggtactataatacaatatacaactagtacacattttgtcactcaattatgagcaatcagtcaactgcttgagctaatatcagaatcttttgcaacccaatttctgctaactaaattaccaacttgatcattctaaaaccaaaaacaatcacaaatacaaatacagtacagcagggtatggtcaggttccacaccgcgcgttgaaatttgagcatttggattgaattgtttttcagctagggtgcccaattttgtcaaactcgcagactctggtctcctctgatctgtcacagggatctctatcaagtccaagcaaagtgctgtcatttagaattgcagctgcttaatcacacacacactgacctggatgatcagtccctggtattggatacaatcgatcaagtgccgtggtctcgtccatccattgccagattgtccctgacattattgtttttcttttccattgccaaatgccaaagctaggtagccagattaatagacatgttcctgttcatgcatatgcaaatctgtttgcttgctagcaaaggtcaaactattctctgaattcgtgggtttttaaatgggaattattctatggattaccatacgtgtattcgagttgactcatatatgcagaccactgtactgttcaatccatatgtgtccatatatgcagatacgcttgcattttcgaggttggggatgagaatctcagataaaatagtgtttgtggtgtagcat

SEQ ID NO: 26576 - DNA, 1501 bp, Oryza sativa
atatattaagaaaatagagaatgtacagggatggcgaggcttcacagccaccgcctatttacaagatgctacaccacaaacactattttatctgagattctcatccccaacctcgaaaatgcaagcgtatctgcatatatggacacatatggattgaacagtacagtggtctgcatatatgagtcaactcgaatacacgtatggtaatccatagaataattcccatttaaaaacccacgaattcagagaatagtttgacctttgctagcaagcaaacagatttgcatatgcatgaacaggaacatgtctattaatctggctacctagctttggcatttggcaatggaaaagaaaaacaataatgtcagggacaatctggcaatggatggacgagaccacggcacttgatcgattgtatccaataccagggactgatcatccaggtcagtgtgtgtgtgattaagcagctgcaattctaaatgacagcactttgcttggacttgatagagatccctgtgacagatcagaggagaccagagtctgcgagtttgacaaaattgggcaccctagctgaaaaacaattcaatccaaatgctcaaatttcaacgcgcggtgtggaacctgaccataccctgctgtactgtatttgtatttgtgattgtttttggttttagaatgatcaagttggtaatttagttagcagaaattgggttgcaaaagattctgatattagctcaagcagttgactgattgctcataattgagtgacaaaatgtgtactagttgtatattgtattatagtaccagttattttcagtagcatgttgacaaacttggctagatggtgtgggtgtgttcatttcaagtttcaactctgaacagcacataaatctgataaatctaagctaaaatgacagccacaattaatccggccttgtcaccatcaaaaagcctaattaaattaaggctaagaaagaaatctatgtcctgatcatgcaaaaagaaaagaactaaattatattgtgctatgattcagaaaagtctgaatttttttcactgaagtagtacaaatcaatatcgatgtgaaactaatgaaagtacagtgaagttggcatatgtgagacaggcaaactggatacagagacagacaaaacagagagagagagagagagagagatttgggaaggaagtaaggagataagtcagaggaggcgtcaaagttgacgtgtgtgggtggattagcatcgttaatgtggtgttgtaattccaaaagataaactaatcacgcatggcatccatggccagctccgtcgctttaggcttttggaatcgatcagagcacagcagctatctcatcgattaagctaattaagctgcttgattgttagtaattttcttccaagtccacacatgccattatcatcctctcctctcctctatatataaggccaaagcccgacccgagctctcccgccattttcctcaaacgatatagctagct

SEQ ID NO: 26577 - DNA, 1478 bp, Oryza sativa
gcagcttgcacctgttgcttgcgagttgcgatcacgaaagggaaggattaagcaggcaaaggacgcctcgtggattttgaagcttagtaattagtactacggattaacaacctaaatgtctttgcactatgctacgcatgctatcaacctttttgtgatactgatatcgcctagagttaatacaagaattgactggatgatttgatctggcctgctatcaatttggtcagcccaagcccaaattacatccctttccttcagaaaattaatcatatgaaaaaaaaacaaatcccggtttaatctatataggatatgttccgtttgaggcatcctagcaataatatggatattattagcctcatcttttcactcacgcttatcagccaaagtttgaattttcaatcttaaatttagagttgattttggggtttttttcatcgtagtttatttttcaacatttgcttttagatcgttcagaacacgtatataaaagttttattcacaaattatttttcatttacaaatatgtcgtttcactttttcctccgatatgccaaaattgatggggctatatgatatggatatgattcattttagaatggagggtgtacgtcttttaatcacattctttcataatttgcctgtaaagttaaaattgatgatttacctattttgtttctatcgtaataatcatatacccaagaagtggatcacgagtgcatatctttacttcgcacgtttttttttagggaaacttcgcacggtttaaatgttgatctccacgaggcttttgtccgttaatccatttaagcgtttctttgggacttgccggtgtgtgggtacttagtgttagtgttgtcgtgcgttatccatgtaattagaaaaaaaaaacattgctattgtttgcaagaattttgagttttttttcctgatttctcaaaaatcagactcacaaagtcatagtgcccgttgcctggtcatggctagcacgacatgaaattcaactcgaccatactctctaaaaagacgagaatttataattagatgtgatatattatagtacaacgaatcttgacagaaatatgtctaaattcatagtaatataatgtgttatatccagcactaagttatttttttacatgataaagtgagcataatattcacacatctcttaaaaatatatgtttgtgtaagtaagagggtgtttgggagagagaggctaaactctcaaaaacataaactctccaaaacataagtcctctctccaaacaccccctagaagactacaaaaatcgtgttgagttgcactttgcgtcttcgtcacttcgctcatcacatacaggtagagggtcccactgcaggcgggccctacaaatactccctgccctcgttgcccactcttcccctcaaatttcctcctcgcctcgcctcgcctcgtcccccacccaccagatctaagcaggttgaaatggccacga

SEQ ID NO: 26578 - DNA, 1501 bp, Oryza sativa
atcatatacgtttatcatttctataactagatgaatatcccgccgcgttgctgtaaaaaattaagttacataatatgtataaataagatgtaatttgattataaaaacaaaacaatttgatacaattttaagactaaaaataattgagattgcatgtttttaagagagaagaaataagagataatttggaccgtagatctatcatccaaaggttagaaataattggagtgatgtggcttaatgggagaagagagaaatagcattaactacacttagtggggatgaactatataagtatataggatgtataatatgtatttatccacatattccgcggcaaagcacgaggtattaactagtaatttaaaacggtaaagctctgatatttagatttagcataaagtgtgggcccatatgctaacttagccgattgaactacgtcaacgagccacatctgcgaaaaactatcctcaaaactcattttgcactggtttaaaatatctagtattgcggttaactgacacgaattaggccttgtttagctgataaaattttttgcccagcgtgtcatatcggatatacggacacacatttgaagtattaaaacatagtctaataacaaaataaattatagattccgctagaaaactacgagactaatttattaagcctaattaatccgtcattagcaaatgtttaatgtagtaccacattgtcaaatcatggcgtaattaggcttaaaagattcgtttcgcaatttacacgcaatctgtgcaattagttttttcacctatatttaatactccatgcgtgtgtccaatattcgatattcgatgtgatagataaaaaatttttgttttggaaactacattcgatgtgacatggccttagattgaagctacattttgagggagttaaagtgaacatattccgcgtaaaaagccttgggctgggcgctcacagaaccttctggaaggccgggccgaaccaacgcaacgcggtccccacagcccacacgcacacctcacttggtgctggtggtataaacccaaaccaccgcgtctctcccgtagaaaaccccgcgattaaggaacgaaaccttctccgccaccgccgcggacatcaccgccggcgaccacctcacctcgccgccgcccccgcaccctccgatcctcctcccctgatcgcctatggcttcggcgagggccactgacccgctcgcctcgcgcgatcccccaaccttgccctcgtaccttcctccgcctcctcctcctcccttgccctcgccatcgccccaccaccgtctcctccccgctcccatggccccgatcctcctgcacctccaccccgccttcctcgcccaaatggactcccgccggaccacctccctcctccaggttgctacatctatcaccatgctttcttgctcctgcttccgctgtttattttttttcccaccaattttgggtcactaactcgctcttgttgttggattagtttt

SEQ ID NO: 26579 - DNA, 154 bp, Oryza sativa
ccatgctaggttgtttgcttaatcaacttgcttaataagcctaacatacatcataacagcaaaagacttagatctgttaaggtcctatccttagtttctaatctgtctctcccctttgttttccctctctccctctccaaacctttgcaacaga

SEQ ID NO: 26580 - DNA, 269 bp, Oryza sativa
agatttatggtgtgcttccacaatatttgaagtgttgtatttaatgtttagactacttttttgatacattgtgaatacccttatatttgatccagatacaacctccatctgagaatataagggatttcccccatataattctataaaaaaaatccctcatattcttatactgaggtagtattaagttgtgtcaagcattgctgtgtactacagtaatgtgtccgtatcggtcacgggctgatgcttcatgctttgcattctctcttagg

SEQ ID NO: 26581 - DNA, 418 bp, Oryza sativa
ggcctaattcatcgtgtcaattctgagttcttttcccattcatacataagtctggttctcgacattgtccgattgatttatcgtctatgttatgccgattctcctccactttagtgtcattctctacaaagattaatatacctaatactagtggaatattattattctaacaaacatatgcattgcaagcatcactagttctctcttaatttggtaatattgatggtcgaaactgatcgacaacgaccgtcaacagtggttgcggtatgactaccttaattaggagttgaattgttttctttgtagttgttttaattcagattagacaattgcactaaattataatgtaataaagcttaggttttttagcagtctatattctttcctttccccctttttctgtccatccccattcaga

SEQ ID NO: 26582 - DNA, 815 bp, Oryza sativa
agatttatggtgtgcttccacaatatttgaagtgttgtatttaatgtttagactacttttttgatacattgtgaatacccttatatttgatccagatacaacctccatctgagaatataagggatttcccccatataattctataaaaaaaatccctcatattcttatactgaggtagtattaagttgtgtcaagcattgctgtgtactacagtaatgtgtccgtatcggtcacgggctgatgcttcatgctttgcattctctcttaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttatggatcacaaacaagttggttatcttcagacactgattgtgtagaagactactaattcaacatgcctgagagattatgagtaagagttttagtttaacatagcaaaacttaagca

SEQ ID NO: 26583 - DNA, 215 bp, Oryza sativa
ccacgggttgtagaggtagttaacaggtggtgacagtattcgggtacatcatagagccatagccagagtctccttggcagaccaggggtaagccgatgcttgaagcaattgatagagttttatcttaacttgattaagataattaacccataggaatcctctctattcttggcctaccatatagttatttcccttggaagaatctcgttcttaga

SEQ ID NO: 26584 - DNA, 572 bp, Oryza sativa
taatgaatggggtcgacagagggatacgacattattgttgtgatgacttcatcctccacaggccagatctattactaacgtacgcaccgcttaggtggccctgtcaatgtgattcaccggactcaacaaaatatgtcactaatttattggttaaatcagatgcaccctcttgtctaacctaagtaagctatgctaaaccaaatgcaccctatatatatacacataaatattatatatttgatttttaaataattaattaagttgatcaccatgaatcatcacgcaatatatacacatctaaaatcacacataagcgaagtgggcgtaactcaactagttagatttttttgtggtggaaccaatccatccgggttcaagttctagacttgatacgggtactcgcatttatggcaaattattctttcagtagtagacgatgtacccattgacatcgagacacccatggtgactttattaatctcaagatatattggctcagtctcgcgaagatgcttataggggtagaaatcacatgtaagagattagattcgcagatacgagtcttgcgaaga

SEQ ID NO: 26585 - DNA, 1501 bp, Oryza sativa
agggagaacactgcatgcatgtcatgccgtatgcacatgccaagatagcagagacattgggcggagatagcccacaatcgatctagaagcaaaacaagtatgctacgaagaaatcaacatagatatacattattttataggacgagactaccgatcgggcgccccatccaagcatgaaaaaatcggacgctaacgtcagcataacgtcagagccatgcatgcgtgcaaaaccactttaaactattttttctcttaaattatttatccaaatcatgatccgattacatcattaaattcgttgcaattaaatattcaaaacaagaccacacatggatatattccggcgaaatttttttagcttattattaaatcgggcgttatttcaccttatataaaaataatactttagcaaatagcggaagaatgtttcagttcactgcaacattagatctatacatagtaaaacattgtgagtacacttggtggaacattttttgtggaacataaaaacgaattcccttaatagagaattttcaaaatatgtgggtgatttgttgcaaaagaagtttcgtttactgcaacattagatctatacgtagtgaaacattgtgagtacactaggtgaaacatttttagtggaacaaaaaaataaaacgactttccttaatagagggtttttaaaatatgtaggtgatttattgtaaaataatattttaattcactgcaacattagatctgtgaaatattatgagtacattaagtgaaatattttttgagacacgtggtggggccaggggaacgtgcgcacggggagggggggagcgctcgatcctgctccacccccgtcggtcgccctggcctaagcatatttgtattttataagacatggcaaataaaatttaaggtacaatatcttcgccagtatgatctatgcatgtacaagaccatctaaaacatttgacgagataaattaagtagcaggcctacaaaggagtagagtggtggcagttaatacgacatataaaaactgttaataaaacaccaaatcgaatcctaatgacgattaaaaggagggacgacaggcaggccgtgaagcaaataggcaaagcggttgccgggacttatagaaagtaaaaaaataaaccccattgataaccatattcgttttttaaattttcaatgataataaaaagtagaagcagcggacagggtgtatatgagtatagttacagagctgccaacggttggtgggacttctagaaaataaaaagtaaattctaacgatagttttgttcgatttttagaatcccaatgacaataaatagtaggtggcaaataggccttagaggagtatagtggcatcgtttgatgggacttctaaaaactataaaaaatgaaacccaataagacaataagctctaaaaactaccaatttttaaggttcgtaacttctaaaaagtaaaaaaaacaatgataatcatggtcgattttaaaatctcaa

SEQ ID NO: 26586 - DNA, 1501 bp, Oryza sativa
agctatttaataaattttaagcaaaattataccgaaaaatttataattgtgtttaggtgctaagcgcgcaattgcgtggtccacccagctagttatagaaatgctatactgtttatcccgcccgaccacacgcccacgggttgccattttcatcaatgtgcctcaaaggtgatggtttttaatgggaaccagcaccaataataaaagtgccgaatattttaacaaaccaacacctgtgcatgagataaaagtgttggttttataaaaaactgacacctcatcggagctgagccgagccgtgctgagcgcttggaccgccaggttttttaagtccggcactcccttgtttccttcacactatcattcttctctcgtctctctcccgccggcatatctaaggctggcagtggtgcggctgcggcgtgcccgccccgtggccgctatgcccgcaacaagttagtggtgccgagcagcccacatgcaagcccgcaaacttctggcggccttgcccacctgttcactggttctactttgtccagattaaaagaacatgcatgatcagataatcagcttactatttgtgtgctagtgtttgtaagtagtagtaaaccacagtggcatcaattacaagaaatgtttgagaagaattcagactaagcactcaatcccaaacaacgatatttcctccaagattttgaagatggcaaatagaatgacagaagtcacagaaccgttgcattgctcactgaatttacaatattgatatgagtggaataataggacattatgaatatcctaatgaagatcaaactaacgattgtatcaataacacaagactgtgctctacttcaatgcctgatggtgttgaagcttgcaaatcttcagattctggatattgacaaatcatgattatatatgagtttttcatcaggaagcactacttcgtgaatatttgaaagaacaaaggatgcatgttgcttgcactagttcagtcgaaaatatggccagcaaaaaaaacaagatcccaggatattagcaagcaacctactaaccataaagaatcagaagaatctgcaggcaccaaagagagaaaacaacctgcaatttctacataattgagttctgcataggaagtttagaatggtataatcaaaacttggtaaaaaaatgtgggcaattcatggcaaagaatataattttcttacgctggcaaagaatataaaataaatcaacattcagacaatttggaggctgcattcagcacataacctcaatgttcagactttctccaggaacttctcaggaacccctgcatatactgacagaattgcataacatcgaattccatgaaaatataatccacttaacgcaaagaaagaaatacaccaccatctgtctgtcagtaaaggtgtgaatacatcaccatctgtctgtcagtaaaggtgtgctcccgtctaagcaaaatgtaagcacacagtcatatgcacatctccaaactgtc

SEQ ID NO: 26587 - DNA, 1501 bp, Oryza sativa
caatatgtgtggttctatgaaacaacaagccatcgattgtagtaagtaaaggaccgagtcaagaagctacgcaggaaacaatcagagtatgattccattgcttgagtgggtatagacctgatgcattaggtaacctgagtggggcagcacctgtcatggtagttctgcagttgttactgtttgtgatggaagatgtgttcgattgatcaaatgccatgacaaaaatctaaaaggcacctaagtatatatattgtgtaatcctcctagtacctcgaaataccaggagtccttgcagtgggtgtcgcaatgcaagggtgactgaaaaatagggttgtgacaagtctcatgtgttgtgtgcgtcacggagtgcgggattaaaagcgtacatcccttgcaatgtgagtaaacaaatatattcgaatagtcatgctcgcgattaagcgtcgggacttgtattactcttgaatagccttataaattttaatcttgctttgaatagtgttgggagggattgtgtgaccctgcctaatgtgcgggaaggttggaatggtgaagaatacggaaaactggatgcaagggtaaaccggatgaagtgaagcttagggaaggtggatgaaccctcgttgataatcgaggatttcaacttaacattgttttcagttaaaactgctaagtcatagggttgtaaaatgaattatgaaatctagctttatacaaataagtactgatgattcagagaatgatatcgtaaaacacattggatttccggtgtacaaaactgggggccacactgacggcgtaataaaatgttacatgtctatttacattgacgtgtaggagtatgctcttcgatccatcatttgcactgtattgaaccatgttttgttctcactctccagatcttacacatgggacaaatcttcatgcacttcgtgaagaaacagacatatataatacacgcgcgagtatagtctccgccgcaacccaagagaaaagcattcaaccgtgatggggaaaaaaatgtcgccacaattttagcaaaatcataaatttcttgtgatgtaatatctccatcctggaattttctcttacacatatatgcaccatcgtcaaagaggattgccagaaacccaccttgcaagcatagcaaggcattgctttggcatgtattctggagcagtatgtccaccaccctacacaaattaacaccaaaatactctttttagttactgagggcctgttcactttgatgccattttcaaccatattatttttttaaagttataaaaaaaatatctacgtttagtttgttgccaaatttggtcaatacataagaaattctgccaaaattttgacaatattgccatcttaccagaattttagtattgccaaaacttgataatatttattttggctacaatctaaacagaccctagatcatgcgtaccaagatattaatgtgttgcatcccttgaaggaagctaaaacgctggcacatacc

SEQ ID NO: 26588 - DNA, 1501 bp, Oryza sativa
gccgccatgctaggccaggcgagcgagcgcgtgtgtgttccccccgttctctccacctcacatgcctcaagtggctaggcgagtatcctcccttataaggaggtcttcctcttctagaatatgaaaggtggtactaaagtccccgtgcatgccatcccaggtgggcttttgtgattttccaaagaattaatcttcgaatgggttaagacccatctattaattctaataattccccaccaaatctcaaaatcctactgagatttgcctttttccaatgtactgtttatataccaactgttgatggagaccgattaagattgaacatccacctagaacttcaagctacacttactcacaacttgaacaatggactatgccttgaattgcaagtcttgtgcaagcaagtttcacacagagtcttatctggtactagaccgtcagtagactgctcctcgggtagagtgtataagtcatactcattggtctcttagtaagcttcctagaagattcacctaaaatatcaagagtacaaccaatagtcaagctcacaaaggtgtgttcttttaagaatgctctacaggatagcatctttgctaattaaagctaatagaactcattaaggcatatagccaacctgccttgcagctcatgagagtacatgcatcttcacttaaagaggatttagattggtactctcctccagttgactaatggcttgttcttcacaggttctaattcacgggatctccgatcatatagattgggttaccgccatagtataactcacatgggtttcaaactcatctccttcgatgcattgtctatcacatttcgtgatagttacttcgtagatggatttgccaggtttctagctatttcagtgtaattcaatgttataaccccggagtttctcaaattcctgacagactacaattgtcttttcacatgtttagatgatttcatgttatccttataactgttcactttcacaattaccgtttgattgtcacagttcataagaatagctggcacggtttttcaaccacagacagatcaattaatacatcactttttcaaccataggcagatccatcaatagatcacgcagccattctacctcaacagtagcagtatctagtgctgtcagctctgcttccatggttgacctcgtcaaaatagtttgtttgcaagaccactatgaaacaacagcactagcttttttgaagacatatccactagtgattttgatcccatccacattagagatccaattagaatcactgtatctctcaagtatcgcaggatacccagtatattgaaaccccaattgtaaaatccctccctacaagatacacagtatattgaaggcccaattgtaacagcccttcctccagaaccacgtagtcagttcatccgacagatataccactccacttacacttgcgttctcgcttcctgtaaaagggttaacctgagagtgacatggttggagggaagatgc

SEQ ID NO: 26589 - DNA, 1501 bp, Oryza sativa
gtaaaactattcgaatagccgtgcccgcggttatgggcggtcaaccagattcaccgtgattagtctcaccctagtgtaatcttttgaaactggatagtttaggtggatggttgggcctgttgcaacgtgggatagcgttggacagtggatagttaatattaattaattattacaactgtttaatctttcaacttctgtttataaatgctcgctttatgcaaatgaaccactttagctcttctttgatgattccctgcatcatgcctctattccggtatgacttgctgagtacagtgggtagtactcagtcttgctctacttttcccaaccccagagttcgagtatgtgtcagatgaaggtttctccgaggagtaggcttcgtccgtgccgtcgaggatgcctgtggagtggtgatcccgctgcggttctagtcaaggcttagctcctgttgtctctctttctttccgctgcatttatgtaagacttttatgatgtttgtaagacgtggatctgaatgtcaacattgtcgtttgtgtaccccggctggtcctggacggggattttaatgcacattctgcttgaaattctattcgggaatttctgggcgtgacatgtccctagggaataagttcatttgaggtcccttaacttgtcaacgaatccgattttcgtccttcaaccgcaaaaccagatataacgggtccctcaactatcaaaaccagtgcagatgaggtccctcggtggtttggacggcggttttggctgatgtggcgcctatgtgactaatttgactagatcttcgtcccatgtggcattgacgtggcgcttacatgacaattcgatttgaaaaataatagtcatggacccacacgttagttacaaaaagatagtaatttaaaatggtggggccacatgtcattcttactcccctcctcatcttcctcagctcttccaatctcccctctcttcatcttgtcttgttcctgctcttcttgatgatggttgttatgcaggaattcagagacgaagaattagtgccctgcagctgctgattatgatgatgatgatgagcagttgtggatttagggctggatatttgtagcaggagatatgcataggccgagagtgttcttaggataattgtatcatctcgatgtaattgactgagttaaataaaaacttccattatctaaaaaggatactctgctgctgctactaccgttgacggtaaaagagtaggcggctcgcagatgctgccgattggtggttgaatcgggtcgatgtcgtcgtcgcactgccggaggggagcacggtcatagcaatgcacgttcatgtgcctaccaagcgcctgctaaccggaactcccaccggcagaagctgcacatgtaggagcacggcggccacaagcagccgccgaggtgctccgctgcgtcctgcgagaacacctgttcctcccacgacggcttgacccctccgccactggcatgagctaccggccagc

SEQ ID NO: 26590 - DNA, 1501 bp, Oryza sativa
aattgattatgagatttgtgatgaatttgtgattttgtgaatggattagggcgtccaaggattttggatttggggtgggggatttttgggtaggggatttgagatttggggtgggggattttggatttgctggtgtgattttcactggcggttctctttaggtagccgccagtgaaaatatattttcactggcggctaattcccgcttgcgaaaatacgctattttcactgggttttcttactggcgactgcactggccgacagcaaaaatataaaatagccaccagcgaaaagctttttcattgtagtgcatgttggagggtggcgctatcccctccggcgcaaccaaaaaagagcattgttaggttaagttttttgggatctatttgtaaaataagattttgaaaagtacacaaatgtaaaaattcagcatcgaattcagatgcatcgatccgtctccacacctaacagagttaataagctagcaattaattaaggtgagtagcaaaagtatagctagctagctatctgccaaaggaacgtgacgaatgagatgaagtagccgacacagaaataacaagcggctacgagatgactttattagctagacttttgtcatgttgtaggtactcaccgatatgtgtttcttccttgttgaattgtctatgtctagctcgtgggagaatttgaatgtgctcgtgttttacttttacaatcttcattccaaaataaaatatgaaatattttaattaagtataagtacaggtattaagaaaagagataagattaaataagagaggattttcattgctcgagaaaacaaaatagatgaaaaatttaaatagcgatgaaactgttatatatattatgagataaatttttaatattaaatgttgttatattttggaaagagttgagaagcatgctgggcatgtgtcccgatcgagaggagatatagttgtacagtagctaatagcttacagtaggtaggtagattcgtgtacgtgtggtgcagctagctagggtgaagttagatgacggcaatgcgtcgcagcctctcatatgatatcgatcagctggagagctggcctggtactcttgcgcagtagggaaaggaaacggacggagtagctcacgcaatcgctgaccgcatatatgcaccccgggtcactagctacctttacctttttcgatctcttctcttcatctccagtgtaaagcttttttgactgcttttttttttgtgtgtggggggagtgcttgtaaacaagtccatcgatctcgttaataaaattcgtgaagaaatcaattaatttaattattgtcccacagggccgggcggcatgcacagtaaataaattaaattaagaaatggacaagagcatggtagccagacaaagacggacggacggacggacggaggacctttatttaagaaagaaaagggggcccctgctgccctggctcatgcatttgctagctagctcatcgtcgataccaa

SEQ ID NO: 26591 - DNA, 1501 bp, Oryza sativa
cccgtgaattagaacctgtgaagaacaagccattagtcaactggaggagagtaccaatctaaatcctctttaagtgaagatgcatgtactctcatgagctgcaaggcaggttggctatatgccttaatgagttctattagctttaattagcaaagatgctatcctgtagagcattcttaaaagaacacacctttgtgagcttgactattggttgtactcttgatattttaggtgaatcttctaggaagcttactaagagaccaatgagtatgacttatacactctacccgaggagcagtctactgacggtctagtaccagataagactctgtgtgaaacttgcttgcacaagacttgcaattcaaggcatagtccattgttcaagttgtgagtaagtgtagcttgaagttctaggtggatgttcaatcttaatcggtctccatcaacagttggtatataaacagtacattggaaaaaggcaaatctcagtaggattttgagatttggtggggaattattagaattaatagatgggtcttaacccattcgaagattaattctttggaaaatcacaaaagcccacctgggatggcatgcacggggactttagtaccacctttcatattctagaagaggaagacctccttataagggaggatactcgcctagccacttgaggcatgtgaggtggagagaacggggggaacacacacgcgctcgctcgcctggcctagcatggcggcacccgtgcacaacgtacgcgtcgaatggtccccaaaattggttcctcacccttgcacagatacgatctcctttcgcagttttgttttgctgcagaaatttcgaattcgttttttggaaacccttcgaataatccgatgcgtgaaacgacgtggagtccggataagttacacgagacttatccggttcggttacgcggagtgaagattgtgcaggtgccctgatcaagcgtcctaatatttctatataagttgagcggctgcctccacgcaatatacgtgaaatcaatctagggtttgcctcctcctctgtactgcgccgtcgctcatagtctactccatcctgctcgctgacgtgcaccggcaatcgggagagcaggtctccggaaccttcgccttcgatgtcttgcactgggagaaggcggcaataaggtttttggaaaatgctttgcgcgactgctccctgtttgtccacaatggctcatcttcctcttcgctggcgtgttgcgcgccatcgtcaatgcacggtaccctgagtccttcctgctgagcagccagttttccaaaaccctcggtatgcattcgacatattccgcatattcaatctgttcatactttactgtctagtttacatgtgtagatcgtatgatgtgattatgtcatttgcaatgtcatgatttatttatggaataaatgaaataattatgtgctaatattttcaacaatccaaaaaccttattataggcattgtggttttacta

SEQ ID NO: 26592 - DNA, 1501 bp, Oryza sativa
acacaagtgaagaagaagatgggcatgatggtccagccagcctttacatggggcctgaaatcctgaaattaatctcagagttagaggaaccaaccaaaacaatagctgtgcgataaggctaatgagtaaatatgtggtctccatctccatggagacggaggagacctagctacctctccccaacagaatttgcaggcctcttgtaaactgctgctgctactacatgtggtgtgggtggtatggtagggccctgattgtgttggtccttttggccattagcacagagttcgccacgtagcaaatgaaggtaccttgtctaattattgtgcttttaatttccagcaggaactaggaaccacccctaaagccgatgaacagtgtgttcccttttgcaacaaaaaagttcagaactccgcaattgtttttcggagcttttttttaattaaaaaaactgtttttcagagcttgaaccatgttttacaagcatcatgctggtaaatttgcttggtcactgacggagtgtacgcagcagtattgtgtattgcaaggcaaattgtttgtttttgagcgaaagaagccgccttggtttggtagtacaattgttcatcggcgcacgaggagagataccactcaacacgtggtattaaaaaccgtagtactgcattttcctggattgaatttgggcaaaggcgttagtcaagagggcattataaatggtagttgtcgctgttgtttcccagcacctctcgctcggttcgtcgtcgcccgcccctacttgcttctttcctcctttcttcctcctcctcctacagtggactcgtggctggcagcatcgtctcctctcctctcctctcttcttatcctttttaacttctccttattgttgttgtcgtccttcttcttctccagtccacacacacaaaggcactctctcttcttctctttctactagctgagtgccaagcttatggaaagagtggtagagtaatcagaaggagatcagataagggcatagagagagtcagagagaggtatgtgtgtgttccatgctcctaggattcattcaataaagattccattttgagttccctgattttgatgcgtgtctgtatacggcccgattattattttatttttgtcttcttacttgatgatggcctttgatgatcctttgttcatcatttggcacatgggcgcatgttctagcttgttttcacttctgctaaaccatttctctttgttaatgaaatcatcatttgagttaccaaaagcttatgatcattgatcagcaaagtaattactatggggaaaaaaaactaattcgaggtcggcttacgtgcaggtggatctatagatagctactgctctgctgctgctattaagtcagtctgtgctacgatcgaggagatgatgggagcagcggtgaccatggtggatcggcgcatggcgttcgcggcggaggccgacgttgatagcaaggccgcctttggattcttcggag

SEQ ID NO: 26593 - DNA, 1501 bp, Oryza sativa
tcgtctcgtggttttagtttttttattcgtgaccgaaaatcccttttgacatccggtcaaacgtacaacgtgacaaaaaaaaaatatttcaccagctaaaacatgcctaattgatgttcgagatggagaggcaggcgatgcatggagatcacgtcgcagcatcgatcgatcggcatcaggcaggcagcgtgcgagggagaactagaagagcgccacgtagagagggaggcacgtaacgtaacgttggttgatgtccgagtgtctcatcactcgatcgcccacgcctctattttgttggatgaggcaggcccacgtaacacgcgtacatcgatcgatcttgtgctctgagtattttatacgttgttcatacaagagagatgttcctgtcctagtatcattgttattggttttatgtcatcatgtgtatcgttggcgtaatagtatcagagtaagtgttaattcggcgtagttctagcttcaatttcatctcttatatagagctgaacctcaaccaaataattttagcttcacttaaaaaggaagtaaagtggagctgattatagtgctctcacaaaataagctagcacgactaatatatccttctaaagtactccctccttaccaaattgatcattatataatttttcaaattgattagtgtcatataatcgcgtggacacggatttcatcggagtacaattaatgtagcataggagaatgtagtgcatgctaaggatataattatgaattgtgttttaatcgatgcatgcattatgagataatgtgtgtatattgtgcatgacgtcttaaactcttaatcgatgcggtttaaataactttttgtcttagtgcacaaacattatatgtgtgattatcaatttgggatggagggagtagaatttaggagttagagtcctatcaaatgaacccaaaacttgttttggtgcatagggaccaaagtgatgcctgagaatgagtatgtccatgacatttgtgactaattttagtgtagatcggtgggtttttcgtatatgtgcgttcgatctggagctgcatgatcagtcccaaatgacactccaacaccgtattacaatttctggttgaaattcgattcactctgcctaatgattcaaatggttccaactccatttcggataaggatgtttgccctcaacatggattaaccgatcgctttcccgtaacaaattaaaggaagtcaactgcatgaatgcaccctagaattaatgaagtcaaattgaccgctacgtattgcaccctaaattgaaacgcgatggatctaccacaggttcaccccgatgaactagatgaaccttttacagaggaggaagtttgggccgctttaaagcagatgccggcagaaaaggccccaggtccagatggctttaatggtaccttctacaagaaatgctggcagttaattaaacaggatatcatggatgttttccagtgtttgtataacctgtcaggaggaaactttaga

SEQ ID NO: 26594 - DNA, 1501 bp, Oryza sativa
tgacacgatctctatctgttattctacctctctttgaagtcattgtcctgaaaggattgcatattgaatgcaaaaacacatcgaaaagtcagaaggacgaactaagtatgatatctccttactgatgctcgacggcatagctacttgcagaggagcaaatgcccaatttggttgcaccaaaccaaaaagacgatctagatgaagttcatctgtagctaccgattgaaaacgagacccaaatattaaagccattgatgcttctattacaagctgacatttacagcactagagctttcagccatcctattgatcacgatgttggacacgtcttgtgcaactgtgtacaatagcgatagagatagacgaagataaattaattaaacgatcatcttaatttgtactctttccattctaaaatataagagtattttttatccgattctaaatttttatattttaagatggagtgggtattaattaaatagataaattatttagaggacattaagctttgaattgaagctgctgcgcagatatataaatattgcgtcgtctcccatgtcgcctcgcgtctcactgcattgttgtggatcgagtagctatagctagctagtgatggagatcttggtgagtgcactgctcctgctcctcgtgccacccttgtccgccctcctcgccgtcgccgcgccgagcctcgcgtggccgtcggggtcgtcgtcggtgaggaagctgatcgccaagaaggtggcgccggagcaggcggcgcgcgacgagctgctgcgcgtggcgcggtacagtagcgctagcgccgccgctgccgctagtgctgtccaacaaccaggcggcagcgagagtagtcgtccggcggcggcggcggcggatgatggtgggcggccggatcagtgcgcggtgtgcctgagcggcatcgaggagggcgacgaggtgagggagctccggtgccggcacctgttccaccgtggctgcctcgaccggtggtggttgtcggcgcggccgcccgccacgtgcccgctctgccgctgccggctcctgcagagcccgtcggcggcggcggacgacggcgacggcgacggcgaggaggattcggactcggacatggtgatgttcatggcgtacctgcgaagcagtagcacctggctctagccattaagggcgtgtttagttccaaaaacttttctcaaaaacatcgcatcaaatctttagacacatatataggacattaaatatagataaataaaaaactaatggcatagtttgcatataaatcgcgagacgaatcttttgagtctaattaggccatgattaactataagtgctacaataacttacatgtgctaatgacagattgattaggcttaaaagattcgtctcgtggttttagtttttttattcgtgaccgaaaatcccttttgacatccggtcaaacgtacaacgtgacaaaaaaaaaatatttcaccagctaaaacatgcctaattgatgttc

SEQ ID NO: 26595 - DNA, 1501 bp, Oryza sativa
  unsure (1)..(1501): unsure at all n locations
gcagggaagaagccgagaagaagtggatcacactgcctgcgcaggcagcaagcaccgattcatcacgggagagttcgaggagagagaccccggggagagggatgtccgcgacgcagcagtcccgtgcgcagcgggtggtcgacttgcccttctcgcgcgcctccttgctggcctcgatcaacgccttggtcgtcgcagccataaaccctggaaacacgaggggaaacccgaagcggtgagatcgagatgggaatgccctggtccgtcgcgacttctccgtggcttaccgttggggtgggcaaggaagaccgcggcccggcggttggagacggcgagcgggcgcgagggaggcgactggaggtcgaagagcgggagcggcgaggaggtggtagggaggagggggatggggtcgccggcgaggcggaagacgaagtcggtggtgccgtcctcctcgccctcgacctcgtcggagaggtccagctcccgcggcggcgccatggccccccaccggtggtcggaggagcctagggttttgggcgggaagcgggacggagacggcgcggcggcgagggagcaatagcaaatggggtttcgtgaagcgagagcgctagtagcggaggccttggcgtggagtgtaagcagagcccagcagcgtggccggcgggcgggcgcacgcggcggaggggagagggagaggcggaggcggccgcttcgcttgccggcggtgatggtggtggcgctgaatacatgggctcttgtcgttgccccgtgggcttaattgggccttctactgggccgtcacatatattaatttggacttctttttattgggcttgaccttgacggtgagtaagaacagaaggcgcatgannnnnnnnnnnnnnnnnnnnaggcgagaaaattccggcgatgtcgcgacggtgacacggcgaccgaacacaaagatatcgccggcaaactcacgcaagcaccgcgcgaccgacgaacggcaggcggaaccgcgcgaacagtcgctgcttccttttcgtctccacctagcgacgtggagcaacgccatacacacgctcccatccgcacgcgcatttccagccttactactctctcgcaccatcgtcttccatccgcccatctacctccctcctccgtccaccctaactacggcgggtcgccggccatgctcgcgttcgcggtcatcgtctcgccttccgcgtggccgagagccgtctcctcagctttcgcggcggccgtcttcgcgttcctggacgtcgtcgacgtgctcctctgcttcgtgtacggcttcctcgacgccgtcttcgaggacagcccggtcagctgctactgccacgggagccacagcgcggcggcgctggacgacgacgacgaggtctccgacacattgtaccaccggcggagcgctctccgagacgcgctgatggggctcgtcagaggcaggagcggcggctcgccggagacggagacggagcggcgcaaggggcggagc

SEQ ID NO: 26596 - DNA, 1501 bp, Oryza sativa
ctgagattaatttcaggatttcaggccccatgtaaaggctggctggaccatcatgcccatcttcttcttcacttgtgtcattctccctaccatttctccatgtttatctgtaggtgtcggcaggtttggccagcttgctctctctaacttcatctgcaaattaaaacccagcaccttgatagcgatccacgcgtttactaaaggatcgttgaaagacacctctttcatctgcgctgctcttaattcatgctgttgtatattcattctgaaaaatgttgtgttgctgtgctgtagtcagtaacagactaacagtaacacgcctcatgcacattcaattttggagaggtcaagttgtaacataaagaatgaattctcaggatcagatttcagaagacagtgaatgagagagagagattttgcaccatgtttatgcctgatgctttgattgacaacaaaagcaagtcaactgtattagcaacttgcaagcgtggagagtagtactagtatatcgaatgctgctgggtcgaccatgtttccggtagcagtggcaatgattggcccaagtattctagagagttttattcagttatcgacatctcctccccaatcctttgatctgatacaccacgttgtacgcaatgtttgccaacttatttaatccagtttgatagttctatttcaggtcgttatcgctgttagtttattttgcttctttcttcaagtctccaataggagggatcactacatttgcaaatgccgactgaattttttgaaagatcgccgactgaatttattaacttttttttttctgaaggtcagtaaacttggtgtgacaatttcttgccaaatttcggcacaaaaacaagatgattcatactagtactaagaaaacaagatgacttgctttaactttgtgaagcacatgccatctctccaaaacccaaagtgaacaggttctctgaacaacgaacaggtagcagaatagctcgcggtgttgcatgtgtaggatgtcgcacgcagcagcaaagttttacaagagttgcagataattgacgatgacaaggatgtgctccctcctcatcaggcaaggatctccttggatcatctcgaatctagatagatactcaggaagatctcaggagcaaatctcgtcgtcaatggtgttcagttcactgaacagggctgtagaaacctgcaatgatctgaacattggagttccaagtcattgcttggacttgtgtgcaatcatttgtccatgttcagatcactttgggcgatggtctttctgaatgacttcagaaatctaactctatatcacttatatagcatgaaacatatgcgtagtttgcttagaattttttttgtcaaagtttatgaacttttgaatcttgagttcgttgtgtcttatatcactttcataaattctgaaatttaaaatgcctaaaaaatttttgagcacatctctgttactcaaagcacttgaaaatgttatactgccaca

SEQ ID NO: 26597 - DNA, 222 bp, Oryza sativa
tcaaccccaaaaataggagacccacaagctgtgccatgcatggatcatgccggatggttaattaggttaatcctaaccaagagaaatccctgccacacatggcggagatacttaaattaggtaaaagccaatatcggcaccaaccctggtattgtcaattaaggaaaagggaagttcaggacttgagtgttgaataacctatgatcaccaaccatctgcagt

SEQ ID NO: 26598 - DNA, 298 bp, Oryza sativa
atgtggagctttagtagttagtgggcatcaactttatagtaagatatgatttgacacattaaaagaaaactaaattctattttaccacctaagttgtttcttatcagtttaatattccctccattttagaacataaggtgttttggttttatcctgtattaaactttctgtaagtttaacccagcttataggaaaatatagaaacaaattgttaacgccaaaatttggtaagccccgaggtcatcatcggcctaggaaccgtatcggcttcagagttctagaatcggctaatgggaaa

SEQ ID NO: 26599 - DNA, 584 bp, Oryza sativa
catttgaactgagtgacatttgataatttgatttgagctatgtttcaatttgctgaaattatgtggcttgtactgatctgatctgagatggcatgtaaaaatgttgaagttatgtgcattgtgatgatctgagctgatattatgtttgtgaatttgtatgatctgatatgttgacctgatctaagctgaaatttcaaaatgttctatttggtatcttatgtttgtgagctatatcatgtttgtaatatgaaaatattgtgcaatgtgcaatgtgagctatcttcatcgaaattcactggaattactgaaatttcagacagccatagctgcattcactcaaattccagacaaccatattgcatcttagatgtattcattgataattcagaatattacagctcagttgttgtacacatcaagttattaactaacacctaacacaaatggcagcaataggactagaacaaccaccattgtgacctaattggtgctaacatagtgcacctcatgcgaaagggactatagcctagtggttacaagagcctcaatagcaccttaggtcctgggttcgattccccatgaga

SEQ ID NO: 26600 - DNA, 1501 bp, Oryza sativa
ttgagatcttcccaaaatgatcatcctctaacaaacacatctttatttatttgtgcaaaaagagtaaatgagcatcattgaatacgccgcatgcaaccaaccaagattaatttctattggtcaactacatgcaatatttaaaacttgatgtaatccatgggatacgaaacaacgtagtacaacatctccaacagcctctcccattgactctccaagttaaattttggctattctacccaaaaaacatgctccaacagcctctccaactcactggccgccaaaccctcctcctcactggctaaatttggctggccaatggtgggccccacactgacagtctcctccataccccccctctctctctctcgcatccgtctctttcccacccctcgagcacaggcaaccaggcgaggagcacggggaggagcactgctatggcaggtgaagacggtgcccgccccgccgctcgccgcagcctgccatagcatcatcctctggccgccctgccgccgcagccgccggcctccgctcgctacagcccgccgcctccgctcaccgcagccgttaccccgcctccgcccgccccgccactcgctgcaacctgtcacctcgcagcctgacgacggtgtcgaggtgggagaagggagacaaggcggcgtgaagggagtggtggcgctagcgagataggaaatgaggcggcagtggggccggcttcccctttcgccgtcgccgtagtcttcgtcatccctcgccgtcgccgtcgactcgcatgtgcacggatttgccgccgcctgcttctcccctttcatcgtcgtcgtctacttgctgcacgagcccacctcgcgcacacggatttctcccacccccttcccccttgccgcctccgatgcctttgcctcgcgtgcgcacagttccaccttcgccgtcgccgaagaggcgctcggtgatacctgcgggagaaagaggaaggaggggagaggaggaagaagaagcagcgactgacatgtggggacccactgtgatagacttaaaatagagtgggtagatggagaggctgttggagcgagtaagtagtttgactagccaaataagatggagagttggctatatgggtgtttggagagtccgatttggagaggctattggagatgctcttataactgatgagaattaattacagaatgataaaggtttagttgtccatgatctttgtgttctttgcttatgtgatgtttaaaatgggatggatggagtatttatggttaagacttactcactcttgcccaaattgatcatcatatattgaaaaccaaattttctcaatttgatcatcatataactgcatggacaaggatttcatcggagtacaattaaattaatacagcatgggaaaatatgtgcatgctaagggtgtaattgtgcattgtgttttaaattgatgcatgcattgtgggataatgtgtgcatattgtgcatgtcatattgattgatgccgtttaaa

SEQ ID NO: 26601 - DNA, 1501 bp, Oryza sativa
attccttagttatggacttgaacaattcgtcatccataacctcatcctcaacctcatcctcctcatcactaacaagatcaacattaaatgacttaagaggagaaggtaccttagcattctcatcacttgagtagttgaagagtctcggtggtgatgagggcttgacggcgaacgtggcaactccttcttcatcacttgagcttgacttggagtcggagccaaagatcatcccaaggtgagcttggccataatgttcgctcttgctatgcttgtgcttctccttcttctcatccttcttcttatcttccttgatgtgggaaccatccttgaggtgggggcaatccgcaatgaagtgcccgggctctttgcacacgtagcacactcttgcagagtgtcttccacttgacttgttagagtagtgcttggaagatcctcccttgaagaagccgcttcgcctcatgaatttgccgaacttcttgacgaagagagccatctcttcatcatcgatctccgccttgctcttgctcttgcggttctcttcttcttcttcctttgccttcaaagccaagtcttccttcttgatgcttgcggttgagctttggttgatgtattgaatgacatccttggactcttgcacgagcatgtcatgggcaaggatgcgtccgagcaaatcatgaggtgtgagagtcttgtagtccggacgctcacgaatgatggtcaccaaggtaaagttccttggagtgattgctcgaaccatcttcttgaccacaacctcatcggtcatgtccttggagccaagtcccttgatctcattgacgatcttgctcaaccggtcgtacatgtcgcttgggctctcaccatctaacatcacaaatctctcaaattgccccttgaggatctccatcttggactcacgaacactatccgtgccttcatgcaagttccgaagcgtgtcccaaatcactttggcactctcaatgccatcacacggttgaactcacttccactcaaggcgctaagtattgcattagcggcttgagcgttcttgtgcttgttctcgtcgtcctccttggtgggatcttcgggattctacaaaacatagcctttttcgactattctccaaatagatgggttaatagacttcaaatgcatcttcatcttatgcttccaagcggcatagtccgtaccattgaagtacggagctttgccgctataggtactcacataagatatagatgtagagggatagtcataagggatattagctcccttaccaccatcgttcccatcccccgcttggcccgacatgatctctccaagcggttaagcctaattaggagattaggctctgataccaattgaaagtgtcaattaggcctagaggaggggtgaataggctaattcaaaaatcaattaaaagtggaagcagtaattttcggatatttccgaaatttttggatatatccgaaaatttttggagtcagcacaaatagcaaagtaa

SEQ ID NO: 26602 - DNA, 1501 bp, Oryza sativa
ataggttggctatcgggtccctttccaaatattactttcagatctttagcaaacatggtttttccattatgatgtttaggttagtacggtggtctgccttctcttcaaaatgtttgcctttctttcgttataccccttgtttgattatctagataggtcgttaagtgtagggcaattgttaatggtgatgaactacaacgctcgtaggttaaattgctcttgtttgttctcctcccacacatggcaccttctttcttccataaaagtttcagatcttcaaccaatgatcttaagtacacatcaatgtcgttaccaggttgctctagttcttgagtaataatcagcatcatgatgtacttccacttcatgcataaccaaggggggaggtcatagatacacatggtcacaggccaagtgctactaccgctgctcatctctccaatgattcatgccatctgtacttaaaccaaaccttatgttctgtgcatcctttccgtagtctttaaatgttctatcgatgtttcaccactacgaccatcaacagggtgtctcagcatcccgtcatgtttacgttcttctacgtgacaacaaatcattctagcatgagctttgtacttgaacaaacgcctcaaccatggtattatagggaaataccacatcatcttagaaggaaccctcttcttcaggcttcccatcaacatcaccagggtcatctcgtctaatcttgtataatagtgccttacaaactgggcatgcttctaggttctcgtactcctcaccgcgatagacgatacaattgttcggacatgcgtgtatcttctagacttccagtcctagagcgcagactaccttcttatctttgtatgttgtttcgagcaagtcgtttccctcagaaagaatattctttaggatttgataatccacactgtcgttttcttcaatagctttgtccacctcgcccatttgtattttctgcaaatccatcgtattgagcccagtccggaatgttatcgtcgtcttcttcatcttcttccattgcaacccctaactctccatgcaaggtccaacaattatagctaggcatgaatcccgactgcaacaagtagatatgaagagttcttgatgtagaatacaccttctagttttcacactttctgcatagacaaaatataaaactcttaggcttatgggcattggccacacttaaaaaataatgcacgccatcaataaactccttagaccgtcggtctgcggtgtacatctgtcgacgtttgatatcgcgactacgttatttagatggtatggggatcgttggtaccagggtatatgcgagattgaggtaaaagagatggagacagggatttctatataggttcgggcccattatatgacaggtaatagccctacatcctgttggccgcagctggtgttgctcctttattcatctgaatcacacaagtacaataattgggataactcatctagacgtcgtcgactaggc

SEQ ID NO: 26603 - DNA, 1501 bp, Oryza sativa
gctcaaccgcaagcatcaagaaggaagacttggctttgaaggcaaaggaagaagaagaagagaaccgcaagagcaagagcaaggcggagatcgatgatgaagagatggctctcttcgtcaagaagttcggcaaattcatgaggcgaagcggcttcttcaagggaggatcttccaagcactactctaacaagtcaagtggaagacactctgcaagagtgtgctacgtgtgcaaagagcccgggcacttcattgcggattgcccccacctcaaggatggttcccacatcaaggaagataagaagaaggatgagaagaaggagaagcacaagcatagcaagagcgaacattatggccaagctcaccttgggatgatctttggctccgactccaagtcaagctcaagtgatgaagaaggagttgccacgttcgccgtcaagccctcatcaccaccgagactcttcaactactcaagtgatgagaatgctaaggtaccttctcctcttaagtcatttaatgttgatcttgttagtgatgaggaggatgaggttgaggatgaggttatggatgacgaattgttcaagtccataactaaggaatccctaccacacttgagtgagttgcttgggagaattgaggaccaatatgtaactcttgagaggcaagagactttgctcattcatgagaaagagcggtctcatgaactcaagagtgagcttgctaaggagagagagaaaaatgaggcattggtacggctttacaagcaaaccaaagagtctcatgctaatcttgaggtggcgaacgctcaacttcaagagagagtggatggcttggacaaagcatacctcactcttgaagagaagttcaaaaccttaaagaatagtgtctctctccctagcgagccatcttgttctaaaattgtcccaagcaatgaaccatgtgtgagatgcaaagatattgatattgaagcttgtgctactaactctatttccttgagtgctttgcaaaagcaaaatgagaagcttatgggactccttcacaatggcttacttaagtgccatatggatagtaaggccctaaaggagtacctaggctatcaaagggacaacttctaccatcagggtcttgggtatgttcctccaccaaaagaaaaggtggacaagagtgtgctgatcaggaggccccaaggtcttagcaattttgttaaggccaaaagtatccttcctaatgattatgcttcacattgttcttttgatgcatcttatgttcttaggaagaatgctagttgtcgtgttgttgctaagtatgtaggcccaaggggcaagaatatttctatcaagagagtactttgggtgcctaagacacttgttactaacatgagaggacccaagcaagtatgggtacctaaaattagaaattgatctcttgtaggaatatgtctccggtggaagaagttgggtgattgataatggatgcacaaatcacatgatcggagaagaatcaa

SEQ ID NO: 26604 - DNA, 1501 bp, Oryza sativa
gggagttggggtgagaggaggaagaagaggaggggtgagaatgacatgtggggcctatcatttttaaattatttttttaactaacgtgtggggccacaaattttattatttttcaaatcaaattgccacgtaagcgccacatcatataaagaccgagtcaaattagctacgtacgcaccacgtcaacgaataccgccgtccaaaccgccatcagacctatattgcaccggttttaacagttaagggatccgttgtatctgattttctcgttgaaggatgaaaatcagattcgttgacaagttaagagaactaagatgaacttattccacacaaaaccagacatggaggctctgtcaaatacgtaaatcggcccaatatcatgctgaattgctgagtagcctactcaatatctagcccaacctttttccccctttccgtgatgaattcatatgcgtgcaaaatttatgtgatctctcctgaggcattcgctagctgtcacgattggatcctcgattaccttccatacttgagctatgatttactatatatgctgcacctaggtgtcatggcacctatcatttgcatgtgacttaaatagttatagaaaaaattaaaaaaattagtaacatcgtttgtgatgatacaagtctatacacaaacatgcaagactaaatttgatctacaactagagaaacaaaaataataaaatcagacattcaatagtacccgtacagtgcagataaaatttcttatttttgtttcttcatatatcgatcgaatttagacttgcatgtttgcatagtgacttatattatcatggattatcttatcaaattttatgtattttttatataattatttaaattacaggcatacacctaggtgccatgtcacctaggtgtaaaaaatactttctgttatagtgctggactcgataattttcatagttaagggaggcttataatatgtttttttgcgtttatgggatcaaaatggcctgtagttaaggcaggcataataagtgatgagttcatatacgtgcaactgcaaacttatctgatctctcgcgacattcactagctgtcacaattggatctccgattacctcccatacttgggctatgattttcctacaatgaattaaggtgcaaacgtggaggatgaaactaaaactcgtctagattcatgcagaaacatagataagtgttgcatttgagtcgctggcagaggatgaattccaacccaaatctgctgagatatcaattgccatgatacgtcgggtccagatcctctagagttgggtataactctatcgggtggagttggctaaatctgtgccattcggcatacttcaagggctaggcttaagccacattaatttatacttaaaaaccagtaactgaccatgcaacaaataatcttgtatcaacagcttgtcacgagatcatttttactgtataattagcacaaaaaattcaagattcatctattatttaaaaaa

SEQ ID NO: 26605 - DNA, 1501 bp, Oryza sativa
cggtggagctggagaagacgccgttcacggtgaaccggacggtgaccaacgtcgggccggcggagtcgacgtacacggcgaacgtgacgctggccgcggagacgtcgctgaagctgagcgtgtcgccggagacgctggtgttctccaaggccggggagaagaagacgttcgccgtgacggtgagcgggaggttcacgaaggcggcgcaggcggtggcggtgctggaagggagcctgagatgggtgtcgccggagcacgtcgtccggagtccggtggtgctctacatccccgtcgcttccgcaccgccgtcgccgccgatgccggcggttgggactcggcgcggagacaactgggcctgaagttcttcatgggctatgtacatgggtcgtacgctttgctgtgtgaatactaataactgggccgattttttactataatcctaatgggcttttgggttactctcgcacgcagtttcagcccatcagactgtactggaaaggattgagatactctacctgccactttgccttgttaataacgggttggtttggtttgagtcctatattggccttaccaatatttggcaatttcaatagtgtttattgtctatttggtttggagccaaattttggcatgcctaagaaaataggccatttcaacagttaatttaggctattttggtttcaatccaaacacaattttacctttgccaaaattagccatgacaaaagttaccaaaatttaacattgacaaaaattggtaaggccaatttaggccacgaaccaaaccagcccaacatgtgtgggtctagggttcatcgggcttacatattagtgatggaatcagtttacttcgaaggttgaggatcttgatccgtactataataacacattttacttagcttttgcaattgaattcaactgcatctactactagagtaagtactctagttttgctattttgcaagcttcacatcttccttaatataagctcgacagaagggcaggagaaatggaaagaagaacaggacagacagaaagaaaagcttgagctcggcatgaagccatggggatggagatcaggatggcacgagagcaccttgcagcttttatggtgctcttgctagctgaataacggccggtggaaggtgagctacaggaagattcgtccttatagcaataaacaatgtcagcatcggtgcacagaacctaactgttcgctgttaaacgcaaagcagctcttcagttcagttcagttcggttcagctcttcagttcagttcagttcggttaggttcagttgacagcaacaggagcatcacttactaaaccaacacaaaagtagataggacactacctctatccagattcgttgtaacatgtagtatctcatttactcataggttagttttttcttatgggatggagggaatactccgttccttttaaaatacagtgacctaaaatggatggggtaaattttaacccctatttatattcgt

SEQ ID NO: 26606 - DNA, 1501 bp, Oryza sativa
agcaaggcggtgaaagcaacaacgcccagagggaggaaaggagggatttatgtctctttttttttcttccaaaatatcttcctctactacatgtccatctacattggcatgcttcctttactctgggacaattgctattgctgctattatcgacctggaattcttaactattcttgaaatcgcatacaaaatttatgttaatggcacttgtacaataactggtggatgttagtagggcgagagcttgattgaaagaattcagaggtagcagggacaaaagaaggtataacccatggtttagagcggtaaatcatacttaccgttatatgttaatgttagattttgtactagcaattgaagagaagcacaacgattccttatataaataaatatatgttacaaaatatactatagattgtgattttcttaaatctcaaccacccgcccatctcccctctctagcaaacagagagagggacatgagttgtgacagcattgaactcaaggtgtggtggcggagttttctcccgcgactgtgacttgagagtgatataaggaagtcagcgataacaacatcgatgaacgggatgaaaggaggaagaaattatgggctttttttttccttccaaaatatctcaaatttgttatttttgtgttagtaaaaaaagttctacagcagaaacactaaaatatcccaaacagaaagccccaaaaaacttcttttgagattgatgaggcaccttggggttgggcccagccagcccagtggaggtggagtactctgctcatccccacaagccacagttctccctccaaaaaccaaaaaaaaaaagttggaaaatactgcttccttctactaccccagcaatacctacagccctggaacattggccatgccaaaaagttaggctttctttccattcattcattcattcatcagctagcaaagcaaagcattttctcagctcaagttgcttgctcctcttctttctttcttcctcctccccttccctttcaggactcctccccccacatcagtagctttcactgcccaaaccctctttgtgggtggcaaccctagattattaatgtcctcctcctcatcatcaccatctcctcctcttcttcctcccctgcttctctctccagattctcttctcatctggtcccttccttcccctgctttgcttgctcaggtaaaacctctcccctccttgcaagattctcccctttcttggcatgctccaagatttttctttcctcctacatcgccggcaagatcgcttctgttaatgtttccgcgccatttttttttgtttgcagctagctgatcgcacgtgggtagggtgagtgtgtgtgcgtgtgtggatgggagtccacgcaatgtcgtgccacggcggcggcggcggtggcggcgaaggggcactgtcgcggcaggggtcggtgtacagcctgacgctgaacgaggtggagagccacctgggcgagccgctgcggagca

SEQ ID NO: 26607 - DNA, 1501 bp, Oryza sativa
agctctacgtcctcgacgacgaggtgcacctcggcaacaaggcaagtcgatcgaacaatcttttagcgattatctttgctgtttaaggattaattaactgtgattgattcttgattgcttacaggtgatcaaggataagctgatggacgccatcgaggggcatgtgctgggagaagccaagctcatggccgtcttctaagacacgaactctctgcattttgacatccccagcggacggcgatacctcccgtgacgacgaccaacgacgagcccctatatcggcgatacctcccggccgcatcaacagccagagcaggaccaggagcgcgctcgccgacgacctcctcctccggccacctcccgccgccgccgacgccctccccttctcttgcgtcgctggtcggcgccgccagcagccgaacctctcgcccaccgctgctccgccggtgaagagaaaagtgaagaggagaagaagactgaagaggagaaaaagagatatgtgaagctgacatgtgagccgtatgattttttttaatttttttgctgactagtatgtcacgtcaggaaaaccgggcaaaaatactgccaaaggacctccggtggtgaacggtttgactgaatttaggggcagaaggttttgtggttgatggacctcgaaaaatctcgctgtgaagttgagggacctctggtgaacttattccctctcgacgcatcattactccgctacggcccatctaaccaattaagcccacagaagcgattcggctcggcctggcccatttaagacgctcctcttcttcctcttcctcttcccgtcccgctcccacctcgacttgaaaaccctttttcccttttccttttcccccggattcgcgtctccatcgttaaatcgcaatcaatgcgtatgatttgctttgatttttccccaaatttcttgaccgttggtagggcaaagccaccacgctcctccacttccctttcgtctccctccgccgcgagaggttcgcctcctctcccttcctgcgacttcgtttcgttttgggttcgtttttggtgtctcgggtgctttgcgaatctcaattctggggtttggatttggtgttgcgtccgggatcaagcgccaaatcaaggggttggtgcttctgaattctggggttaggtttgtctcctgtggcttgttgatgctttgctggcgtgttttggtttcatttagccttgcgtgtcacctgctcgatcaatttcctggcccaaactagtttgatgtgtggtttagttgcagagttccctgcaaaaggatacgtggaattgcttgaaacttcatttagatatcgcttttcctgcttggttcgttactcctgtttaattattattattggctattcctccctcgcacaagggtttgctattgtatatttgcagatcatctggtgtcattcagtagttgctacaagatttattctcgttgctacttctttgctgatcaagattcgctccttgtagg

SEQ ID NO: 26608 - DNA, 1501 bp, Oryza sativa
tcaatgctcaagcatacaggctaatatggtagtaggtaacaactacatctaccaaactaatttgcaaatttaatattgtaactagtccaagattgggacattccagttactcgacacaagcgtaacttgctattgcccaactcagaactgatttggcaggtaaaacaccactgaaattctaagagcttttttttttctaaaatcggagtgaccccataatccaaattaacttgcaaaagttagcactgtaactatccaatatcggaattttcaagttaataggaaagcacgaagagacgaaggaaggctgacccgcatagagtcgaatggcgtcgatccgatggatctcctgcacaagcgccggcagctccgcgctccgcagcgtctcctcgccatcatcctcctccactccgaatcccccgcctaccaccgataaaatccgttgaaacccgagcggaatccccgaagcaataatactgtaacagtgagcgtccctacaaatccagaacgaaacaaaagggggacaaaaaccgtactagggttcagagaagcgaacctcgggagcggatgcggcggagagatgcgcgagcgccggcggagcgcgcgagccaggaggcggatacggacgcgagctgcgcctcgaggcggcggagggatgcatccaggcccacgcactcgcggcgcaggagctcagcgagcgccggtgcggaggcgaggtcctcgggggaggcgaagtgcgcgtccaggaagctccgcaggctcgccggcggcggccgcggggacgccatggctgcccaagagagagaaacgcgaaccttttttctttttcttttttttctttttcgcccagaaaataaaatcagttctgggaagtggtcaagtggactggagacagcttcgccgatgggctaaattggcgggagcccaaaaaggttttgggcttcctatttgtgggccttctcagtggtaatgtgcagactttttcatctcggtgtgaaggggattgctatttagcgcgattgtgtttccaggctcccaggtcccagcgcattcttttttctttaaactttcgtctcgaatacttttgttcaaaaaatgttcacacgaaaacttttatgaatggaaaaaaaatgagttaagaactctgctgcactaaatagcaattccggtgtaaagcggtcgtttgatggaattatcatgggccggggccgtgttgttcggcgagaggtaaaagagtaaatttaaaagtacaagtacttcaaacaaactattgcaaaactatatatatttaaggaatcgtatcccaaagttatatatttagtgatgaaattatgaaagaactaccgatattagagtttataaccatagccctattaaagttataaaagttgtagctttgtaacagaaatgagtttaatcttcatttttttatacaatgctataatctacaattttatgaaaaatatggtgttaaatctgtacttttaggctgattaaagtt

SEQ ID NO: 26609 - DNA, 1501 bp, Oryza sativa
tgacctcccttgtggtcgtgcccggcaaagcatgccttaacacatttgtactggcgaacaatagccatcacctcatcgtagttccacatgagagctgcaaaagaagctgagccaggatccattgggagatgactgcataggatgacattttgccggcgtgctgatgcatcctggaggacatcattgagccatgacaactgctctttaccaactccaccattaaacatcacaaaccgccggtcaacgccaaccagaccgtcagggctgttcttgtcagagtttgggttcttttcttccaggaacttcattgcttcggcagtcactggatggtcacggggccagccaagtgcactgaagtcataagcgtccaggacaacaaatctgtactcgggacatggagagaagtcatagtatgcacgatcagaatcggttggcatcttcagcaacgatactagcttgccacgaggaaggttatagaggcaatggttcccaaacatgtggtaagttgggccatcaaatttctcaaactcatcaaggaccttctgcactgcccacaacgatttgtcctttgggcaatatccatcaatgatgtcaccaaagttgattgaaaacttgatgttgtgttgtttgttccatgtgctgacagccctttggaggacgctgatgctatgacggtagtagcgtgggacaccaaggaatgagcgaccatctggaatatcagcgtactggacatcagcaatgacaccgaaggaaaataagggttccctagaagatgcatggattactccatttgtcacagccatcatctctgtgatagaacctggaataggtttattcagaatattgaatcagttataatataagcaccatgccacaataacgaggaaaggatttgagcacggtctaaacaggtgttagaactctacgttgtacttttctactttaatgctactcttgcacattactgaagtcatagtctacactaacaaattcaccaaacaatttggtaaggctctgaatcttgatttccccttaatcagtcataatcccttttagaagtgtttgactagcagattagctccatatcatgatatgggagcgttcaaagtaaaatgaatctctttgtatctatatgtgatttttttttaattgccaaatgattgatattgaaagtctgaatttggattgcggtactaaaaactggcattcaagaaaactaaatttgtggtgattttcaagaacatcgaaagaacaacactgaaatgtagtacgattactaaaataaagaagtttgccgtttgccttgtgtagtattaaaattaatgtattgcaaagatagtgcgtgtttgccttgttgtatcaattttgacctgaagcaattatcagtgtacaaaaaaatgaagaaagtggggaaccctaattattacggagctggataatttgattaattatttgaaatataatcagaacaattgatcacgtgttgcgcaaaatcgaaaaa

SEQ ID NO: 26610 - DNA, 1501 bp, Oryza sativa
gaagtaggatcgatggagggatgattaaagtcttgcaaatcctcatagatatcttcaacagaagtaacactttccgatttgtaatcttctaaatgtgaaaatctctcagaagcatctagcagacctgcatggtttctacttgcattgcacagtgttgtaatcttgcatgtgtctcttgtatcctcttgagctagttggtggagatgttcatcctttacatcctcatatgggtaagtctcaaggatctcttttgttagtcttggcaaagatggtactgtagactgcggtcgaggcggccttcccaaattcgaaaccgcagatctggtgggagagttttgcttctgtctctcaccaaggatggtggcttcctgctctccatcaatgtatcgatctagaacttcattcttgttcaataaattggttagtcttgttgacctgcatcgaatggcaatgggagaactaacaggagagtgccctgttgagcatgaatagcatctcgaaccaggagagtcactttgcaggactgaatgtgcttttggatcctttattgtgtattctcttggggctggacgcctttttggtgaccatgcatagcagctgcaagtcagtacgcactgttaggaccagcaaaaaaaatacacactttattatcatcactcagatgaaaggaaatggtagagtcacaattgcacataattcacttaatgagtgaggattgcaggtccatctaaaactattctagttgaaatgagtgaagaattacattgggaaaatgggatttacaagtaactgaaatgcctaaagaaagctctgagtgcattggctgaacaatttataaggagggcaatcaccaccgtataattaagcatttaacaattatagctgataagctgaaatgagtaaagtttgcaagtgcacaatacttctccttttcttgtttctactaatatggataaaaaagggaatagggtgttgctaccatgtattggtttgatgatggcaaaaacatcctaggtttcaatgcactattgaactgttgatggtaatcaaaatgtaaaccaatcacttacttagcaacatgatcgggtgcatcagattcattaaacagagaagatgggacatcacccgagaagctgaagctccgatccttcaagaaactgttgccggctggtgatgagaaggacatagacctcctgagctgcttcggattagatggttcctcattgttcagatttcgacgccggctctttgatctacacacttttgtgacaggggaattggaagcggaactggagctgccattgctgtcacctccgtccaatgccttcttcttaatcctgctatcatcgtcacttggtgttttaccaccattcccagtgcttgcggtggatgatccaaagaaaaagaaccttctcatcttacaaatgttcagaacatccgcagatccccacaattgaatcagtccctacaaggagcgaatcttgatcagcaaagaagtagc

SEQ ID NO: 26611 - DNA, 216 bp, Oryza sativa
tgccagtggcggcccggcgcacctcccagcctcccctcccgttgcatcagccgtgacgcactacccgactcccgtggaactcatacccgcatgatgagcctatatcaatgccacattaattgccagtttgccacggtgcgctgaattactagattcgcacgagcaacagttagctagctatagccggcgccatcatgccctcgtcgacggccgtcg

SEQ ID NO: 26612 - DNA, 1501 bp, Oryza sativa
actaaaatgtggaatggttggcctgggttggcttgggacgagctgggacccagggtagggttgccaattcagtctgaatcatcgtaggccttgggttaaggcaggttcgtgtgggttcacggccttgattaataatcttgtatagctctaggatcgtctttataaaatatctttgggcaactaagtgtcttttaaatcctgtttactgcaaaccctaaccccttatattataacccccttgtactcccttgcatttattctgcacttgtgggtgtgtcttgttgagtacggtggttgtactcagtcttgctcaatttttcccaaacccagaagtggagttcctggaagatgaaggctttggtgtctagctcgtgcctgccgtcaagcgcctgtggtcgtcgccctagtcttcccctgtttcccgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcgtgacacagatcccttcaacgccgccggcaaataatttgccagtgcgctgtcgtctgctccggcagtgtagagtacaatggaatagacctgaaggaactcctcagggtcggtgcttccatcgtatttctctattgctcctggtcgaaatttctcaggccatcgaacctcttgtagggaacgagtgaaagctctgcacccgccgccaggagcggtgggttgtcggcgatcatgtgctcgtcgtggatgtctgtccgatgaggaagatgatgaagatgacgaggacgatgacgaatcactcggttttggggcagggttccgaggacgacgctcgggttctcgtgagcctcgtcgtcatccatcgttgttttcccagtgtcgacctccatcgtcgtcgtcattgcggcgtcgacctcaacttgtatcacccggcagccacagttcgcgattagcatgttctcggtggttgtggtgatcatcacggtctcggttctcgctcggatgtcctccttgttcttcgttctcgtgatgtcgcaaagagacgcgatgtggggaatgattttcgttgtctcacgtgcgtcgcgcttctcggcgaccattcagatggtcgcgcagatcactggtgccgcaaggcggaagggtggcttgacgaggtggcgtccgctgttcaggctgttccccattagcgccgccggtcggcggttgttctggtggtgccctggcagcggcctcctcgaacgcgttactgaggctggccactgattcccgtagtcgttccgtccactgatcgagatcagcattcaggacgggatcattagaggtttccctcagtattgcgttgatggttctgatatgttgggctggcgtagccaattgatcctccgcttccgtgttgccgcctccagacgtgctggtc

SEQ ID NO: 26613 - DNA, 562 bp, Oryza sativa
gtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccttattattattgttattgttattattaccttgttcaccctagaacaaacaaaaccccaactagtggacactctactcatggcaccactagtttagttttaggtagatgcttcgcaatttaattaggtaacattaggtggtttttcaactatagactttgggaaatattcatatcatctggatactatggaatggtttggttactgtggaattggcttcacaccgctccttctattcaaaatccccaaaatggttttaggctgggctcggggtgcatggttttgatagtagcacctcggccatataaggaccggt

SEQ ID NO: 26614 - DNA, 1501 bp, Oryza sativa
tcgtgagttagcggcttcatgctattaacagaaagtcgtagaacttctttgcagaatcactgacatcatgtcccattgcctcagcttctcatcgagcctacatggtttagagagattaatatgatggatgaaattgagttctatgataactatggaaggcacaaacaaacgaatttaatactagtaagatgaaaagttaaattttaaataaacctaagaaatatcaatgaaaatagttatcaaagaaatcaaaccatcgaattgactaaatgcgtcgaatttcaagtatttcagaaaaccattgaatttttggaaagtggaatttgaatacaattttctggtttctgagtaaaacaagaacaagtttgaaccgatatcaatcaagatctgacaatttttattaaaaccacggagagaagacgtgcaccattggttttagaaagtgaattagttttatggaaattaaatttccatgtcatactccccaaattttagggcccctttgaatcgtagggtagaaaaaacagaggaatacgaaaaattacaggattctgacagaaattgaagtgtaaaacataggattgcaaaacacaggagaaacacaggaatggtcgtttgattggagcgcaggaaaaacgctggaatcggatgagagagatagactcaaagaaaatttttcaagaggttggagctcttgctaaatttcctacaaaatccacatgcaatgtgccaatccataggaatttaataggatttggaaagctttaatcctttgaatcaaagggccaaataggaaaatttcctataggatttgaatcctatgaaattcctacataaatcctatgattcaaagggtccttaaaaggaagatatgtatagaatccaactatttagaaacattatactttatttttgttttttcagtatgtaattcaatgatttctgcctcaaaagaaaatgctacaatcagcaataaataagttaattaattaattaacagtacaaaaaatactgctcattatatggcgtctgtgtatatcgattggtctgggtgagttttgctatgagtactattttttatattcttctggtttacttttcacccgaggaactgtagcagtaacggaaagtttttcaggccgttgattgacgtgtggccctaagtaccggctggtccgttagttagttggaattaccgggtgtgtgtaccagaacacacgataaacatcagattccgttagattcggccaaaaaaatagcattcgcgccaccgtgaatattttggcgctaacgcatttctgttcgcgccaacgaaaatagcttggctgatggatgtgggccccaagatcccgggtgtaattggtaaatctcctaatgttacgtagtgtttaaaatgaacgctctgtaatgacatcagttacggggtgttcctactatacactccgtagtttactcagtgctagatcaaacatacggtaacattctgctcccacccgggaga

SEQ ID NO: 26615 - DNA, 1501 bp, Oryza sativa
cccagatcatacgatcaataacatactcggcggatcaatccccggataggagtagagtattacttcttattaagaaggcctgaatctgtataaaattccttgtctctcaacccatccacttttctagcttgatagccacccctttagtattgccgaaatctcatttcgacagtatgaatttgacatggtgggctacaaacctagaaccatatgtatttccgacttgtagttggccatcagtgtatatatatagaaattgagaagattagtatagattctactagcgatcatagtgatacatctaagaagtaaagctatcacttgtgggctttgtggaagggaataagaaaaaatatgaggtagcactataggaataagctattacgtttactagccaagaacatgtgtattgtaacggaaaatgaaatcagtttctagctcaattaggcacatatttagtcaaattaacacttttatgtttctccttattgaataagtagatgagttcgatgtttaagataaaccattagtgaaacgggagaggactcattggaggttggtgcaatactatagattgtagggcctaaatgtcagtggtagggggtagtgtgaaagaacagacaccaccactacagacatttgaagtagtatagattgaaaaagcaggtgatttcaaagtttaagataaaccaacagtgaaacgggagaggactcgttggaggttggtgtaatactatagattgtttggcctaaatatcagtggtaggggtagtgtggcagaatggacaccaccactacgaacattttaagtagaatagatgtactctattgcttaagtgtgaaagaacttacaaagttgttgatttatacataacagctttgtcaaatagccgtgagccccatggacaagtcagctcaggtttaaccgactactttagattttcagcaagctcataagctttaggcttatcataggtcacaacccgaagtgcttcgaagtaaagagcatgatcagtaagtattaaccttgccagcaaaggaaaagttgaaatccagtgatataaaaccgtaacaaggcaagttaaaaaaagcatgccagcatctaaacaacaagaaatcgtttctcctcactgagaaccagacatacctggccatgtcgaaatcctaacatgttcaagtactggttgagtcgtcaatgtttcatctatttctacaatcctttctcctctctgagaccgctggccagataaaatcaaggactcaaattgtcctttcattttcttaatctccctacatgagataaaacatactctcagtcctgactttatgaaacaagatccaacagaaagttatatgcttgcatatcctatcttcagaaaaacaaagggagtatagttgaacttattttggtaacaaaaattggcaaatatgttatcccatatttgtcgaggttacggataaggtataccctctatccttggataaacaatgagtactgata

SEQ ID NO: 26616 - DNA, 241 bp, Oryza sativa
gatgtaataaagatgtgtcttttatatcatgtttgtatggtgtaccccggcttttcctgggacggggattaatacactagcgttcgggaaaaggcaattttcccggtcgcgacaagctggtatctgagccatctcgactgtaggataagccaagtggatataacctaaggacctattttataaataaaactatttgtgaaagttccttttttctcctttcccctgtgctatctgcaaaagg

SEQ ID NO: 26617 - DNA, 494 bp, Oryza sativa
taccctttcatactcgcaaataataaaagattacagaggtagatagttcctctcaaaaaaaaatttcattctacatttccggtgctctgaaaattcaagtaaaatttgagggctccttttagaccaaggagaatttaacaaaaattctccgggccacatttgaatttttcttgcacgtattttagtgtttgccaatttcttttcgaattttaattaattctattattccttttaaagaatgatttttaatttcgggatgaatttatcaggacgtgacaaatccaccccccttacaagaatctcgtccccgagattcgaggaggctagcaagaagataggttgggcggtcttctcttcttgtctaacttcttccgctccgtcttctataacaaacttgcctaacaaaacttctccactctggactgcttggctcgatctcctgttgcagatggaatcttctcttcacctgacttttccctggttgtacctctagc

SEQ ID NO: 26618 - DNA, 1501 bp, Oryza sativa
gcactaccgtacttccacatgtctaatgggtaaggcttagtttgtggctcagtctagtcataaacaaaagtacacggattggagatggatgaagtcgggcgtcgatggacattctccagggcaaatgaagactacacgagctgcggcccggtagtcgagatgtcatacggcagagggttggtgccctgctgctaggggctcagttctgcctgcctgtcccgggtatcccggccgtaggtgggattgggtcggtactcttgtctaaggctaggatgggttggaaactatgtcacgtcttccgcccgtataccgtggtggtatgtggcacgtggtaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtctttaaatgctgtttactgcaaccctaaccctttatgttataattcccttgtactcccttgcatttattctgcattcgtgggtgtgtcttgttgagtacggtggttgtactcagtcttgcttaattttcccaagcccagatgaggagttcctggaagatgaaggctttggtgtctagctcgtgcctgccgtcaagcgcctgtggtcgtcgccctagtcttccgctgtttttcgttgtctttgagtgtgctgggccttcgttgcccatgtaataattttatttacgcttccgcttgttaaactctgaattgtatcaacttttggtgtaccttgcctcctgggacaaggaataatacacgcacgtcaggaacgcctgttgggtgatttccggtcgtgacaggatatacgataccaaatatagatagaatatctttatgaggactcgggttagattctaaacttgtatgccaggaaaatacccgggatcctagtcggttacgattgtattttatctgtaatcccatattccgttaggatatggactgtactttgtattacggatcccttcccctatataaggaggggtccgggttcctctcggggcgattctttttctcccaatcatacaatcgataacacactcggcggaatcatccccggacaggagtagggtattacttcttgaataagaaggcctgaacctgtataaaattccttgtctccaaacccatccactttcctagcttgatagccacctccttttattattgccgaaatcttgtttcgacagttggcgcgccaggtaggggtagcgtcaagttctcgccgactaagtgcga

SEQ ID NO: 26619 - DNA, 1501 bp, Oryza sativa; identical to SEQ ID NO: 26562

SEQ ID NO: 26620 - DNA, 1501 bp, Oryza sativa
tgggagccactcacccgggggccttcgtcgctgagcttgtccccgatggctgccacccttctcccctactcattgtcggctgacctggaggttgcgttgagatgggaaggaggtggaagaagattgccagttgatatgcggggtctacatgggtcccacactgactcaaccgtcaagtcaccaaaactggagagcgatactgtcttataaccaaatgtgacatggttttacaagattctggtattccggttcaaggacgggtttaacactcgatgacaagataaaggactgcaggtgaactttttccgagatgaaaaatttccagcctcatgggcctgtgcatatgacccataggccataggcaggccgcaggcggcagcagagcgacttccccaatccatcatcccgtctccgtcctcgcccgccgccgccgccgccgccgatctccatcctgcgaggtggcgccggcttccgccgcatcatcgctcaccgttgagcatcctaatccatcccatccgccctcctcgcccgccgcttccgccgatccccatcctagccatcaccatcacgcacgccacgccatccgcctccatccctcgccgccgccgtgcaccaccgccgtcatccgcctcttcctcttcttcttgctccacaagtaatctcatctccctcgatctcctcttctctccatttctctccgtgtagagaaaggaggtggagacaggggttggggaacaccgccgcgtagataaggcccttcttccattcggtatgcctatcatttttcgattttgcgcaacacgtgatcaattgttctgattatatttcaaataattaatcaaattatccagctccgtaataattagggttccccactttcttcatttttttgtacactgataattgcttcaggtcaaaattgatacaacaaggcaaacacgcactatctttgcaatacattaattttaatactacacaaggcaaacggcaaacttctttattttagtaatcgtactacatttcagtgttgttctttcgatgttcttgaaaatcaccacaaatttagttttcttgaatgccagtttttagtaccgcaatccaaattcagactttcaatatcaatcatttggcaattaaaaaaaaatcacatatagatacaaagagattcattttactttgaacgctcccatatcatgatatggagctaatctgctagtcaaacacttctaaaagggattatgactgattaaggggaaatcaagattcagagccttaccaaattgtttggtgaatttgttagtgtagactatgacttcagtaatgtgcaagagtagcattaaagtagaaaagtacaacgtagagttctaacacctgtttagaccgtgctcaaatcctttcctcgttattgtggcatggtgcttatattataactgattcaatattctgaataaacctattccaggttctatcacagagatgatggctgtgacaaatggagtaa

SEQ ID NO: 26621 - DNA, 641 bp, Oryza sativa
atttgttgcatttgatccttcctttgttaattgttatatcatgtccccttgtaaccatctagttgcgtctcgatattcgtgcaccctgtgcgagtatcgacggacgccttcaaaacttaaaatctgattaacaacttgggtaaaactttggttttacaaaagacttggaaaacccgacacctgggttggtgcttgcgaactaaatgaatttccaaaaccgcggaccggggaatgtaccgggtgtacggtttcccgctcttgcacttaaggaccgtttccttggaatttcatccaaacataagacaagtacgaccacatgggtggaatgggacacccctagctgagtaactagcttatcaggggagccttgatgccgagagacatgtggatccgccggggtggtgtcggggaggacccctgggcttcctggcacagtatggtttgggacctaacctgttgttggtctgggacccctctcgtcggcatatggtaaacctgtgtcggctttgaaaatgccttgtcatgaaagcttggaggtctcccgacgtggctgatccccacgggctgggtgatccgggttagtaaatgtcgtgtgggtaaagtgtaccccctctgcagaggttaacaaactgttcgaacag

SEQ ID NO: 26622 - DNA, 1501 bp, Oryza sativa
tctacaggatctgacaaggccttatcggctctgggcgtccccagccgaagatcccttaggttcctcggaggccttgttaagacggcgtaaagggacaataggataggtttcaacgctaggtgtcatcgtggtaagggatctctgggtaaaacacttggcgatattatgtacctgctatcaactttgttgaagtagaggtagtaggagaaatcgctacaccgctggtcgaggaccagatagtagtcgtaactcgaccacttaaagtggaagtagtgggagaaacgctacatcgttggtcgaggaccaggcagtagtcgtaactcgaccacttgaagtggaagtagtgggagaaatgctacatcgctggtcaaggaccaggcagtagtcgtgactcgaccactccaagtgaggcgagagagatcactacgttttactggttcgagaaccaggagtaggagtctcttaatcacctataggggcgctaaagttggtttattacatgtgcacatcatgtggccagcatgactcacatacccaacttatagcatatcctgatgtctgctcgcaatcatgtcgggtgatcaagccgacgacgttcgcgaggaattatccattaacaaccttttctcgagtagtccagcgatggccggtgctatgagataggtcgtcggtcttcgttgataggttgggtgcgataactccgcatttgtcaagaatgttctcaataatggagtgtactcgaccacaacctactcgagtgctcaattgttcctgaaaattattttctagaagcaagacatatagcagataatatcgagtatgtactcaaaaactgcgtggatcttctagcattatcaggatataacgatcagattaaatatcaggcattatgtaaaccgtaaacaagcatgatttatacagaagagaacggagcgagcccccagcgttagactgtagttgacctgacatcgaaagcactcgcacaatagatattgtataaaaaacatgctctaggtaaacataataaattattgatctgacaatgctatatgatctgaataggtacgataaattgcatataaaatattgcgtacctgtgtagatatatgacggatatatctacggaattaatagattaatttaaaaaaccaatctaccaattaccttactgcgtactcattcgatatcatgtgatctgacatctcttggtacgccgcggagcttgaggcttggtcgatctcgagagatcgagttgttgatgacgatgattccgatctcgtcgggggacatactccggttgggttagatctcctatagccgaagttgtcgagtagtatgttgtcggagaatccatcttcttaaacccatctcgtcgaaatcctagatcaccaaaatccccctacctggcacacactgtcgatgtttggtgtcgcaattctggtatttgtatagtatggggatcgtcgatactaggatatacgcgagactgaggtaaaagaga

SEQ ID NO: 26623 - DNA, 182 bp, Oryza sativa
ccattgaaaatgttaaggcaatcacgacgaggggaggtaagtccactcgtgatccgccgtatcctaaccttgcaggaactaatgggatatcaaaagaagcgtcatctaatgactcggctgacaaggagattcagccagaaaagaccgtgccgcaggagtactgcgacacgcggttgctgctg

SEQ ID NO: 26624 - DNA, 1501 bp, Oryza sativa
taggatatttcaaatttttagttgaaagttttaaattttaaatgtaaagtttttaaatcttgagttgaaagttttcaaattttggtttggatgttttaaatttgacttgaaagttttaaaattttgagttcaaagttttaaaattaagttgaaagttttcaaagtttgagttgaaagttttcaaatcttgagtgaaaagttttagtttttattagaaagtttactcaaaaatttgaaacttttcaaacttgattcattttaaaatttataagtatattcatttttttcaattcattttgaaattatttacttctaaagtattattcgtttaagttactgcttattatgtgcaaagatatatactgttaacttgcaaatatatgcttagcagaaagacggactctgaaataaatattgaaatcatcaatcagtagctctcaattaggcatccatgcatacatcttttaagcaagagaaaggacatgtatgtggtcaggcgggcggtcaagcttgaagactgacttacacgttgaccaaaaaagcacgcctaaccaactcaccccaattaccagtataatccttccctccctaaaaagaaaaaaaaaacaattctgttaattgatgtacctcgcgggagtactaattaattgagcctctgcctttcaaaagtgtagtgatccagtaaacaattctatccagccaaggcatgcatgcagatgagaaatgcatgaatgataccatctggtctcgctgtctggctgtttgatgagccctaattaacatcacatatactatttaatttaagcaactgatgatgatggaatgaataacccagcatatagtagtatgtagatatgtatagtggagtactctagtagaagatgcatatgatggaaaaagaacaagggatttttttttaaagacgagaacaaggaattgattcagctaatgtagacatatatgcatgcagcatctagctagccaagtcatccatcacatcatcagatcgatcagctaaccttaccttagtagctctctggttaattaattaggcacacgtggggaaatgaatctgtcgctaaaacggagtagtagtagtaagtgcacaaaccaatcggccaaaaaaacggggatcgatcgatatatactctacattatagactccttaagtccttattatatgatcgatttccccacctgaagccggataatcatgaaatagtccgcacaaattaatttcagtttctagaatctgaatatacacagatgcagaatgtgcatgcacctggaattaatcctgtacatacgagaaaacaaataatatgtcacattttgttctaaaacactgcgaggtggcattttaacggaaaggcaatatgcgtaatattttatccggtgtattgatctagtgagtggtattttatccaaatcacaagaatggagtgacatatcatttgttttctcatatatattattaggtgacggattcagaaaacttttt

SEQ ID NO: 26625 - DNA, 377 bp, Oryza sativa
ttctttaaagttttccggcaagttgaaaccagtcatgcactactctgttttcacaacaaaaagtgaaaacaaccaaggttagcctgcaaaggaaatgattatacagaggtaaatataaagtattagttcaagtaatctctattatgaatcttccccgccaacggcgccagaattgcttgttggtatttcttaacggcattacaagaaatataattcccaacaatggcgcagaaatatttctggtatattatggttacagagttcatccgcaagcgcatggatataccattgtagcatttcaccttagagtattccaatggtatcgtatttattttatcccgtgggaagatcatgtagagagaactcaactaataatt

SEQ ID NO: 26626 - DNA, 1501 bp, Oryza sativa
tctgggatgatgaatccggcagctcttccccaacttaactgtcatccagttcagtttctttaaagacgacctatctcactacacgtgcgggagttgttattatcacaaaaacataccgtcacggacaaattgtttcaaatctaaccaggcctttggaacatatatatgaatttcagaggattgtcggaagaattgcaataaatcctgcaaaagaatctataaaattcatatagtatttctttaaaacttattcctagcttattagtttgatgaatttcgtaagtatgtttgcattagaaattggtggtcaaattaagattatctaaaatgttgtgttttcttttggattgtgaactaatcgagtgagttgcatgctggctgctgtcttcatcaagacatgtataaaatcgatggaaaagccagaggtcgtggtgcaaaaccatcggcatggagtagttctcagtgtcacgtgaccaaaacaaaaaggatcatttcaatttcaataataataattataatactcctccttgattggtgattgcaacctgtccttgcttaccttggagacgaagagcatatccgttgagcttgcttggaattggatagcctaccatgcaatgcgtaccgctcctgcttccttgctgccgtaacttctaagaagcatccaattgaacacgtgcacgctagttgcacccttttttaaaacatttttaaaagaagaaaaaaaagtggactagtagtataaataatttctaggaaatacagtatatggtacacagcactagcattcagtttgacctgtacctagatcactagatggaggagctgtagtatcagattcatatgcgacaaggcatgatatgcagtgaaaagtggaaacgagaagtttgagcctcatcagttggcctaataagccaaggaaaaaccaaaatttgatttattttttaaacttgatttttttaagttgattttaaaatatttttaatgtattttattttagcgttaacttttaaatcgttacgaacaaatatataaaaaacttactaataaattaaatttttattcccttataaactgatgaggcttattagggaatatgggcaaccgatgaggcttagtcggttccatccattccttgccaacaaatatatactgtactatatacttgtgtgcagcgatatgtgtgcggtgcagtgtgtagcatgagcgttactaagtggtactcatccattgacaatcccaacatagtacattccatccgcgagcaatgctgcaatcgtggaatccacatccacacatgctgctttcttggagccgtcctattacgacttccctcacactgcaccagcactgccactacactcctatactagtagtagttctatgcatctactagacgacgacgactactactatcgaagtggagtagtatcaatgtatctcctccggaaaaaaaaaagaagagggttttgctgccatttctttgggctcttctcccctg

SEQ ID NO: 26627 - DNA, 1501 bp, Oryza sativa
gaagatgaacagattcattagaaggacaagtgagaaaattaagcagcagctgcattgtttatgcactgtgatctctcttatgttatttagaagagaagagaggacacacccgtctctctaaattgtaaacaccctggtaaccacgcatgtcgaatggaaccaccagtttctgcattgcattgcataattcgcattgcagcaaaaaaaaagaataatacaattaagcaaatttagaatgaaaagaagtgcagcgtgaaatactagtgagttgaggtgacctgtgggttttcacaaagccagcagaagtcggtcaatgcttcgagcctgacctgcaggtagtgaagaagatgattggaattgggaaggtgcaggtagtagtaatagagtagggttgagtagatacagattggggcacatgttcccaggaagcaagctcttgagaggtgacacagcctaccacctcgacgcatcctattgagtagtagtaggagtatgagaattgaactcctagcatggtagttgcagttagtagtagagagtagcgtcgtaccgaggaggcgggagacagggtagtggtgcgggaaggtgatgttggtgattccgtcgagggcgtaaatctccctgtagaactcctccatggccttgatggtgtccgcctcggggaccttggaagccgcgtggatccaaagccgccctgctttcaattcaattcatcaatcttaatcttattaatcttggattggaggaggaaggaaggaaagaaagggatagatagctaccggtgaggggcgatggccatgagcggccctcgacgcgcttgattccgtggacgagcagcgacgcccacggctggtgcatcgtcaggcaagggttccggagccttcccccgccgccgccgcgcatgccgccgccgccgtgcttccaatccaatcggaatcggaatcggaatcgggattgccgtcgaatcgctcctactcctacctactctttttttttttttgaactttactcctacctactcttggtcgaggggaagaaggatcatctcatctgtctgctcttgtcttgggccaactgtgtactgctatttgttagttgggccaaattaaggctttgtttgggcccaacatatattatatagactgtgagcgtctgattttttttgatagatagtactcctagatggtttcttcactcttaattaacaactggaactactcgtttcttatacaaagtgagtctaacttaactggctagattacttgtggtggaactatcccaccaagtttaaattctagatttaatacgagtgctcacgattacgtctaattatttatggcagacgacgtgtttgtagtgacttcgccaatcttaagtcaatcactggattatcattcaatggataagaaagctgctatattttttaaaaaaaataaaagaagaagaaagaaaatcgcgtgcgcctgaaatctacacattcgatgcatagataacatcattg

SEQ ID NO: 26628 - DNA, 843 bp, Oryza sativa
tccttgtgtgccatttcgtcgaacaggttgcaggcaggcggtattgcggcggtgggagaggaggcggcggcagcgtagaaggcgagcagggagcaggccaggacgggattggaggccaccaagccgcgccggcatgcctgggcgtgtatctggtaggccaagcgggcatcgcagcagcggaggagggcggagcaggcgagctcgtcggcggcggcggtggtcgggtggacggcgagaacgcggcggaagacagtgagcgcggcgtcgtggcgaccggagcgagcgtggtcagcgacggcggcggcccaggaggaggcagagcggcggaggcggaggcacatatcaatcgatcgatatgggttcattgaattcatttcatttcatgggttgggttgggtgggggattgcaatgcagactgcagttcccttctctctctccccctctctctctacaccttctctctcctcctgaaccttgcaggaactctctctctcaaaaaaaaaccttgcaggaagaactgaagacccaattcaaacaatccacattttgtgattttgatcaggtaggtcagtgctccagatcacctgaggaccaatttcttcgattcgagttgggaaatgctccctgattatccatcatttgcaaccttcaccaacatctctccaacaaatatgcctctccaacaaatatgcttctccaacaaattatgcttctgcagcgaattctccactcatctctctatcaaatgcctttgaactcattcctgcaacaaatactagtatgccttcatttattgtgcattttcctgtcgaacaaacaaatcgtcaattgcaaaccatatg

SEQ ID NO: 26629 - DNA, 461 bp, Oryza sativa
tgcatcataaagtgttaatgcacatacatgaatttttgtggtacaaattgttatacatagcgtaataaatgcattcgactcatatgcattatttgtcaaatattttttgtctaacaatatgtggaatgttcaacagaagtcaaggtaacaccatgttagaaaagaaagatgctatgcaataataagttttgatattcaaagaaacaagaacaataaggaaacaagctattaccattgcgtaggatggaattatcgagccaaaattgtagacatcaattctatcccatgatgcaatcgataccaccaacttatgtctgtaatatttgggaacacggtgatgatcaagaaagccaagaaagagggtgataaattatagctaaatctcacgatctggcattgccctcgatcgtatgaaaacaccaaatggaggcccctaacttgtgatgtatacttaattttgg

SEQ ID NO: 26630 - DNA, 469 bp, Oryza sativa
tcatagaaggaaaaagttaattttttaatagttaaataattggaatacataaactgtgtagactattaccggccaatatgtatgtactagcagcttctcccttgtttgaatccgctctccacccttcttgtagtagttgtatgcacagtatggattttttaccgtttcgtattaaggaggagatttaattgtaatgcattaataattagacatgcaatagtatcagaataacagattgttggaaattgtttgtatgtcttgtgattataatcaagggggtcaaggactgccacggagccgtgctttgggttgataatgaaacatatgtaatggttgctacatggtaaggaattgatggtgtagttagtcacgaatgagataacacagatatgttaaaagaaaggaaaaagtacgaattacccccccccccaacaatcgcggtcgaccaaattacccctctaaaccacaa

SEQ ID NO: 26631 - DNA, 160 bp, Oryza sativa
gagttaggaaagagaagaaaagaagtcagccttagttagttcatcgtatggataggtatgatatgatccctcagaatcttttttgcagatgttatcggtcggttcagttcgtcagttgggttatatatgaactaaaaaggatcagatctttttttacagg

SEQ ID NO: 26632 - DNA, 248 bp, Oryza sativa
cactcctgaaaccctagcaaaataaacgccgaagtcagagcgtcgtttcgtcttccctgccaaaactctcgccattttccccattctctgctacagtgtaaactacactggcggaagctagggttaacaaatcctctccgatccatcctcctgagctccacaaaaaccttccgcgcaaccaccgcatcgattccccatccatctccagccatatcttggaccaaatcacaccatccaattcgtattca

SEQ ID NO: 26633 - DNA, 717 bp, Oryza sativa
attgaccaaaacttggaattacatgaaattatcgggaaccagagggccagaggcccctatggctcagtacatatgtaagccagcccatgggaagatattgtgcgcactctctccatgaagaaattaacagcccatgttggcccactaaatattctactacctctgtcccaaaataagtgtagccatgggtacccatgtccgatgtttgactatccgttttatttaaaattttatgaaaaaattaaaaagaattaatcacacataaagtactattcatgtttatcatttaataacaataaaaatactaatcataaaaaaatttcaaataagacgaacagtcaaacgttaaacatgccggtaccaagttgcacttattttgagacggaggaagtatattttaactctttcctttcagacgactataactactgtgattaaaaaaaaacacttgaccgacgcgagaatggacgtccccatggtttttcattaagaataagcctcaacacccggactcaccacctatggatcaattcttaaccgttactttgaggcccttgcttccaacacgaggactcaccctatataggtcgaatcttaacacatgtttttatgtgggatcagagagagagatttttttttaactaggtctgaaattcaccaaggaacccaggaaaaaaagtgatgcttaagtgctcttgtggcaaagctcaccaagta

SEQ ID NO: 26634 - DNA, 1501 bp, Oryza sativa
cctatggctcagtacatatgtaagccagcccatgggaagatattgtgcgcactctctccatgaagaaattaacagcccatgttggcccactaaatattctactacctctgtcccaaaataagtgtagccatgggtacccatgtccgatgtttgactatccgttttatttaaaattttatgaaaaaattaaaaagaattaatcacacataaagtactattcatgtttatcatttaataacaataaaaatactaatcataaaaaaatttcaaataagacgaacagtcaaacgttaaacatgccggtaccaagttgcacttattttgagacggaggaagtatattttaactctttcctttcagacgactataactactgtgattaaaaaaaaacacttgaccgacgcgagaatggacgtccccatggtttttcattaagaataagcctcaacacccggactcaccacctatggatcaattcttaaccgttactttgaggcccttgcttccaacacgaggactcaccctatataggtcgaatcttaacacatgtttttatgtgggatcagagagagagatttttttttaactaggtctgaaattcaccaaggaacccaggaaaaaaagtgatgcttaagtgctcttgtggcaaagctcaccaagtatattaacataaaatgtatatgcattttggagcaattttttttataagtaaaatacaaacacaggcgctcacaatgcgctcacactcattcctatgaatacacacgcacactctacctctatgaagtcctcatagaatcatttgtgactctggtacaactaagatagtctctggtttctgtttctgtaactgtagttctgttccatatggttttactgaaatcaaccaacatgttatgttagtgaaggctgtatttgtatcaattagagatcggccagagattaattggcatgaaaaatattcttgcaaaaccaggacacatatatgcaatatgtagaacattaatgtttgccaacacatacatatttgtatactaaaatctgtatatatacaaacacaaccatgggcgtcatcatcagagggaaaaaaggttacgttcagtttataccatcgaagtttaattttctcatccttcgccatctaaccaatgcatgcagggatatgcatatatatatatatatatatatatatatatatatatatatatatatatatatataaacattgattgttaatggctttgggagagaatatggtgttacagcactgatcagtgagtgtttcactgaacaggccactacttgagcccagtgcctaagccttgtcttcacaagctgagggttgtcacctgttaagttgcatgcatcacaatttcacatcatcttagcagacaaaaacagtgacataaattaacacaaatagaatcaatattccaagagaaaggggataaatattgttcttttttttctttacctggactgcaaatcttccacgagtcca

SEQ ID NO: 26635 - DNA, 410 bp, Oryza sativa
ttggctcgatccattattcattgaataagtaataccaaaatgtagaatgaaccaatatctacatatatcatacattgttgttttttctccaatcaatataggggttgctcagattgtatccaaaataaaccttatcaaaatttgggtctagatcccctggagttggagccaactccaccggtagatttggctcaatcttaaccgttcttctgacttctacggctgggatcatggcacctactcttcttctaatcaactatcttaatcatatagatttagaggaaaatatttagtttttttgaagtacttcccaccataaccatgattattctccgaccaatagtatcaataaaacaacgctggccatcacaaaaccatataaataaacattagcattatgttcttcacca

SEQ ID NO: 26636 - DNA, 1501 bp, Oryza sativa
tccgagtcggaagttgtttattgttccaattactccatcatgtgaaatatagaatgcatcattgagaacatttcttcgcttcagcaattccagatgaacctgtgaaacttctatttttgccaaaattgcttctctttcttcctggtgagatgtcaactgaaactgaaagctattgaattcatgccaatacctttcttccaattcttcaaattctttagattttatttcaagatccttcatctcagaactaatttctgaatattgcttttcagcttcttcaatagcagcgttaagcttcttttcttcttcttcaatcttcagtttctcctcctgaaaaccagcatcgctgaggacattgtaggattcctgctccaaatgttgaagacaaacttcatgagctttaatgtcagcattaacatcttcaatctccttatccatcttatcagagagcaacctcatacagcccagacacattggctgctcaacctgagtttgtgacgtagcaatctcaaatgcccgttttaatacagtcacgttagagtgaaaactatttcctgttaacaaactgctggaattgatacttggtggtggcaactgcgcaccacctccttcagaagtagatgtcttgtatatggaagcagcagcaggtggaagcactatatatgaaccctccatcgctcttgttggctggttaggttcgatatgtggggctgctgcactcggtgggcgtgggggaattccatggccatgagatttgttttgcttggatagcacgacataagaattatccatcctgctagctcccataatacttccatgaacagaggatacatgcccagaggtggcctgagccgggagcttatcggcggcgaaggagtccacgccgacgacgacgagcgcgcggtggcactcctggcacttgaaccgcggtatcgacggatccaccccaccagccctgttgccggccgcggccgcggcgggggcttcatgtcgccggaatcaatgacgccgacgcgctcgcccacgctgtggtcttctctctctacttctcgagatttcctcctcccggaagctccaatttcatggcggccgcggaggtcgaatcggaggcggaggcggtgaaacaaggtcggcacagattcgtcgtcgcaggagcaaacagtcactgacatgtggagcccacctacaacggtccgcctctcccaggctgagctcacttacatctggtagctttcgtagatcatagaccagaccaacacaagtcttttctgataccactttgtaacgacctgataccactttgtaacggcccgcctctcacaggccgggctcacttacatctggtagctttcgtaggtcatagaccttttctgataccactttgtaacggcccgcctctcccaggccgggctcacttacatctggtagctttcgtaggtcatacactgtcctctcaggccgggctcacttacatctggtagctttcgtaggtcatagacgt

SEQ ID NO: 26637 - DNA, 575 bp, Oryza sativa
gggtaaaatttgaacttctacccactaacacgcttctctagtcacacaattgtgtcgtcaggttgttgaccatgaaaagttgagagccggactgattgcagtgcatgccccgtcaacagaaatgcatcccatatgcaaaagccaagaaagatagcctttttaaatactccctccgtcccataatataagggattttaatttttttcttacactgtttgaccattcgtcttattttttttaaaaaatagaattattatttattttatttgtgacttactttattatccaaagtactttaaacaaaactttttgttttttttatatttgcacaatttttttaataagacgaatggtcaaacagtgcaagaaaaaaaaaataaaatcccttatattatgggacggagggagtatacgttttcttgaacaaccgtcgttacttacaagcactactctgttagaacccacaacatgatctcaatatccaacagtcatgatcagttcttatcctagtcaattttagtgtacatagatgtcaaggagagctatcattttaaaccccgatttttaacctcaga

SEQ ID NO: 26638 - DNA, 1501 bp, Oryza sativa
gtcggatcacttgggcatggtttaatttgacggtcgtgatttatccccctaccaccacgacaccacctagcagtatctttaccgggcacacaatgaataatacaaacaaactgatgagcacgggccaaaatatgaacaccatgatttaatttacagcacatttgtattaaaattacattgcacttatatgccatatctattgtttttacaaatataattttagttataaagcactgtaattttagttataaatgcaacatttaacactttagacatctgaacggtttttcaaggagtgcatttgtactaaaacgacaaatattatagttaccaaaatttacggtgtatttgtactaaaattatagtgcacttacatgtcatatctactgtttttacaaatgtaattttagttgtaaagcactgtaattttagttataaatgcaacatttaacactttagatacctggacggtttctcaagcagtgcatttgtactaaaacgataaatattatagttaccaaaatttacagtgcatttgtactaaaattacagtgtacttacataccatatctacttttttacaaatgtaattttagttataaggcactgtaattttagttataaatgcaacatttgtgttaatctctactaaatactactctagtaaccaatacaatcacaagctacctgaacggtttctctgtactttatttttatggttggatgcaaatataaggggagaaaaaaatctgagtgattttttcttaaaaatcatacgacagatgcctagacaattattccatagagaaagatcagaggggagagagcaacgcaactgcgatgctcaggagtggtggtaaacgccgtgtgctaatcacatgaggcccagatcgcggcccgtacgagatagccactggcccagaccgcactgagatctcaacaaatttccggcccatatcagttgggggcagatgagatgagacgagaagacgaccagcgagagacacgaagaacagaggaaagcggtggcggaggcagagcacgagacatgtttctgtatctggagtggaaattttgttggatttaaggcgcatttcattctgtagaggcatttttatgcatacaacgggggcccttgattaacgcctcgctgctggtgcgccgtcctagctaggtagatatcatccaggaaaatctgggattattcaccacctaactcttgagttttggccgtctatcacccgtacgtcgcacgaaggcggccatgtgtttacctactgttctctcctgcctccacactttctggcacggtacaaaagccatacatagccacactgccacactcattgcgtgtgtgtcgaagacggccgggcgctgctagatctaccaagcactcgatcagctttcagctctgggtgttagccagcaagaacccatcggtcgatcgatcgatccatggcgcctgctgctcaggagctgctgctgcaagaagtgccgcagc

SEQ ID NO: 26639 - DNA, 1501 bp, Oryza sativa
ataatcccagattttcctggatgatatctacctagctaggacggcgcaccagcagcgaggcgttaatcaagggcccccgttgtatgcataaaaatgcctctacagaatgaaatgcgccttaaatccaacaaaatttccactccagatacagaaacatgtctcgtgctctgcctccgccaccgctttcctctgttcttcgtgtctctcgctggtcgtcttctcgtctcatctcatctgcccccaactgatatgggccggaaatttgttgagatctcagtgcggtctgggccagtggctatctcgtacgggccgcgatctgggcctcatgtgattagcacacggcgtttaccaccactcctgagcatcgcagttgcgttgctctctcccctctgatctttctctatggaataattgtctaggcatctgtcgtatgatttttaagaaaaaatcactcagatttttttctccccttatatttgcatccaaccataaaaataaagtacagagaaaccgttcaggtagcttgtgattgtattggttactagagtagtatttagtagagattaacacaaatgttgcatttataactaaaattacagtgccttataactaaaattacatttgtaaaaaagtagatatggtatgtaagtacactgtaattttagtacaaatgcactgtaaattttggtaactataatatttatcgttttagtacaaatgcactgcttgagaaaccgtccaggtatctaaagtgttaaatgttgcatttataactaaaattacagtgctttacaactaaaattacatttgtaaaaacagtagatatgacatgtaagtgcactataattttagtacaaatacaccgtaaattttggtaactataatatttgtcgttttagtacaaatgcactccttgaaaaaccgttcagatgtctaaagtgttaaatgttgcatttataactaaaattacagtgctttataactaaaattatatttgtaaaaacaatagatatggcatataagtgcaatgtaattttaatacaaatgtgctgtaaattaaatcatggtgttcatattttggcccgtgctcatcagtttgtttgtattattcattgtgtgcccggtaaagatactgctaggtggtgtcgtggtggtagggggataaatcacgaccgtcaaattaaaccatgcccaagtgatccgacgaaagcaaattcggtgatttgacgcaaaaaatctgtcgtgagacgtatagcaaaatcgttctctatctttgcagtaaaagcgctcggttaatgggtagtagtattttggcttatcggtgacttgacgggcgcgttacgtcagtggaggatatataaggccgcacaatccgcgccgccatcagttcgctctcgccaccaacaccaccgccatttccactcgctcgagagcaccagattagcggaggagataggggtccgcgactcgcgagggagaggaaagcaagcggagttgagga

SEQ ID NO: 26640 - DNA, 1501 bp, Oryza sativa
ccgcatctgttcgccagttcttccgaatctcgaggacgagattctatttaaggggggtaggtttgtcacaccctaaaaatcccaaatatataaattgttgtttaattagaattattagaattgattttaaaagcctagaagagaagatctaattttaaataataaattccaatataaaattgggccagataaaattttattaaatactttgcttgattctatagttcctagatttttctgggatttatttgagccaaggaagtatttttaataaatggaattgcatttcatgaataatttaaattggaaaagttttaaaaagtcttcttttggctttgggccgaaagtcggcccaaacctctctctctctctcctccccggcccaggtcagcccgcagtcgagcgccgcccgcgcgcgcgtcccgctcactgacaggtggggcccacttgtcagtcttcgtctacctccagccgccgccgcgcccgaaccctaactgagccgcgctgccgtctccttccaaattcattcatccctttcccgatccggtcaaattgatagaggggaaatgatccccgagatccactcaaacttttctcttttggaatcgtcggctaaaatcgtttggaaatccgtggattcgatctcgaatcagattcgtctctctctccgaaccctaacctttccatcgccgccgccggtcgccgtgggccttcgccgccgccccctagcctctataaaaggacccccggtgtctcctctacccgccaccaccctcgcttttgtctctcgtcaccggtagagccctagtgtcacgtcctgataaattcatcccaaaaataaaaatcgttctctaaaaaggaataatagaattaattaaaatttgaaaagaaattggcaaacactaaaatacgtacaagaaaaattcgaatgtggcccagagaatttttgttaaattctccttggtctaaaaggagccctcaaattttgcttgaattttcagagcaccggaaataattattaagcaacaaaaacaataatcaaagtttattaaaaagaaaacctaaaaataatcctccttttcctttgggccaagtctggcccaaagtctccctctctccccctcggcccgcagtccaagtccctctcccctccctttgtttttctctctttcctcccgggcagcccactccctcctcctccttcctcctggcctgcctcggcccagccgcccggcccaagccgcgcccttgcccgagtcgcagcgccctcctgtcgtagccgcgtgcgcacgagcgccgcacgtgcactgaccgcgcccccgcgtgggacccgcctgccaggcgcttcttcctcctcccgcacagctcttctctctctcccgtgaaccctagtttcttgctctctcgaatccgcgcgattcaagcgttggattccaaaattaattggggggaattaatcccctttccttcctctcccttttccccctaatctcccctttaa

SEQ ID NO: 26641 - DNA, 1501 bp, Oryza sativa
tcggaagcaaacaaaggcatgcatttacatcccaccactgatgtaaaccacatgcaagacccacacacacaaccaaacttaaacaagcaaactaacacaacgatctaagataacgacttgacaaggcattctaggttttccgggcatcggagttgattgaaggctcgttcggtgcgtctccatcatcttgagttgctccccactcgaccttggaatgggtgcgcttggattcttcttcatcatcatcacttacgttgacgaccggaggatccgctggggctgggatagtttctttttccaccacacgaacctttggcgccaactggtagcgaggaacgaatagagctctcttccttgcggtaagatgaaccctggccttttgcggtggtgcttctcccttcaacgcggctagctccttctctaaacgatccaccttgtcctccagcttgcaaatcttgccgcgattccggttttgcgatcctgagctgctatcacaatctcaccgcgggtctcatccatggcccacagcatctcaaccaaatgccttgtggtagcatcattctcaatccctgcaggttcaaggtagctgccacggtcacttccttggggttgacgaggatggtagcgatactcggtgtcggccaaccgatcattgtagctttcgcggagctcccccatggcgatccttgccacctcctgacaagcatgaatgtgaaactaatcacgaaagacattgttagacgcgaccataaccgcgggcacggctattcgaatagtttaaactatggccagaggtgtagcactgtacccacaagacacaacctcaacatcatgtcaaccatgcgtcgcgatacttaacaagtacccgaatatagattgtgacaataccctctatataatacaattcaaagcagtgcactgttcctggatcataatcacccccttataaacaaggtatggactacccagcgacccccgtgggcttatctctgccacttcacagtctggtgctctactatgaaccatactatacagaaagtaaagccattgcctacgctggcttgtggttggcacggtaaatgtttcacaaccgaaaatcgtgaaccggtccttaattgtcatgagcacaaccatcaaaaccatatgctcacaacccaccattatcaggttttagttggcaaattaattaattaaccaatcatgattaaccatcatgagctatcattaagccatcattaaataatagtgaagcataagttatcccaactatgtgctaatgtttctaagcatggctaagtaattatatctaatatccagctgaacccatatctcatgaattatttttgaaaaggaaaaggggattattgcgtcagcggactcggctcacggtggaccgggtgcacggcggcggttcacagaaacaaacggccgagatcgatctatccaaaacggatggacaagatctaacggtctacgaccggtctacggcggacggcgtcga

SEQ ID NO: 26642 - DNA, 1501 bp, Oryza sativa
caaaaataattcatgagatatgggttcagctggatattagatataattacttagccatgcttagaaacattagcacatagttgggataacttatgcttcactattatttaatgatggcttaatgatagctcatgatggttaatcatgattggttaattaattaatttgccaactaaaacctgataatggtgggttgtgagcatatggttttgatggttgtgctcatgacaattaaggaccggttcacgattttcggttgtgaaacatttaccgtgccaaccacaagccagcgtaggcaatggctttactttctgtatagtatggttcatagtagagcaccagactgtgaagtggcagagataagcccacgggggtcgctgggtagtccataccttgtttataagggggtgattatgatccaggaacagtgcactgctttgaattgtattatatagagggtattgtcacaatctatattcgggtacttgttaagtatcgcgacgcatggttgacatgatgttgaggttgtgtcttgtgggtacagtgctacacctctggccatagtttaaactattcgaatagccgtgcccgcggttatggtcgcgtctaacaatgtctttcgtgattagtttcacattcatgcttgtcaggaggtggcaaggatcgccatgggggagctccgcgaaagctacaatgatcggttggccgacaccgagtatcgctaccatcctcgtcaaccccaaggaagtgaccgtggcagctaccttgaacctgcagggattgagaatgatgctaccacaaggcatttggttgagatgctgtgggccatggatgagacccgcggtgagattgtgatagcagctcaggatcgcaaaaccggaatcgcggcaagatttgcaagctggaggacaaggtggatcgtttagagaaggagctagccgcgttgaagggagaagcaccaccgcaaaaggccagggttcatcttaccgcaaggaagagagctctattcgttcctcgctaccagttggcgccaaaggttcgtgtggtggaaaaagaaactatcccagccccagcggatcctccggtcgtcaacgtaagtgatgatgatgaagaagaatccaagcgcacccattccaaggtcgagtggggagcaactcaagatgatggagacgcaccgaacgagccttcaatcaactccgatgcccggaaaacctagaatgccttgtcaagtcgttatcttagatcgttgtgttagtttgcttgtttaagtttggttgtgtgtgtgggtcttgcatgtggtttacatcagtggtgggatgtaaatgcatgcctttgtttgcttccgagtgttaggaagttggtgagtttagtggtgtgagagtcttcagttttgtaataatgaaactcagttaagatcaataaaagttaagttagtaaaaattaattccctgtcctaagtagtttttcccgtttctctttttgtgttcctatctatgccaga

SEQ ID NO: 26643 - DNA, 895 bp, Oryza sativa
ttatatagggtggggggcaggattacaagatagaaaccttaaccaacacggtatcggcttcctaaatctactttacaatattatcaaatcaggactttaggccgctccataatataaaagaaaacgtaatacccaagtcatgatctgttacatattccatacatatatgttatcccctattactagtcggataaccatgccgtgtgggtatggggtacccataatctccacagtaggtaagtctgataaaatacgagtggaatttttgtactcgatgtactttgaatttcgagaatatatatttttttaagaaacacataaacgctctcacaacacgagcattgagattgacgaagtcaccacggaagcctcaagcacacgtgtcaaatcaaagatttgaatccagattgactggtttcaccacaagaaactatgggaatatacctgtgtatgttatctgaaataaaatgtgtggagtttaacaaatcgtaaaaatcaatctttttatttttgtgagagtgagtattgttttgagttacaaattatatttgaagtcaaatattaattagtagacatgaaaaaaaatgaaagacgattagacagtgaggggaaaaaaaattttaaaaaaaaagagcagacaggaacaaagagaaaaacagagaagaggggaccgatcgagaatttttttattatttaaacattttaataaatagatgcaacgggtaaaataaaaatataacaaatacaaaaatattaggttattaggattttagtttttcatgatatgagcccttaaagaagttgtcaaaaaaaaaaaggcccattagcccttacttttctgattcaagtgagtgaaccatgagtccatgatggcgaccacccggagcaacagcaa

SEQ ID NO: 26644 - DNA, 465 bp, Oryza sativa
caccgtccctttttgtttaaggcagtgcctcgtattcatgtaatgagggagaaatgtgtaatacagacaagttccatgaggattcttttggaagatgcggatatgtgattatgtgtataattgcttactgataaaggaaacctagggtctcatttcagaggaactatgttccaacctcgagttaataaccaacctgttgatggaaaagaaaaccaattaaactgtgttgggttaaaaagccaatgagacagtagttggggataggagtttggatacgctttttacagatcaagataaggattgttggatgaaacccataagggtacccgccatgcctctacatagataagttcggatatacctgcaaacagttaagaagatccaggagacatcaatatttgagaacataatagtcgatggttggtaattagtctatcaggtatcagaaaagggtcaaaggtgata

SEQ ID NO: 26645 - DNA, 835 bp, Oryza sativa
agtagggtattacctctcattgagagggcttgaacctgtctaaatcctttgtctctgcatccatccacttttaggtctcgtgcgctaccccgttttattattgccgaattcatgtttcgacagttggcgcgccaggtaggggatgcgtcgaattacctgtcgaaaagtgcgatggaatcaacttcagaagaagcccggagatcaatctcatcaatttcgacggctcaaatctttaatcgggtttatcgttccaatctaatttttattagattgatttttaatcgttgtttgatttcctgatattttgatgcatttcatatactcgatgagatcgagacacggccatcatcgtcgcctgctcgggtgcccttgccgtgtccgagtgctcctctcttcctttccttgcagttggacgtgttgctggagtagcacaggccgccaggagcaaattaaacacacgcatctgttgatttattaatcaacacgtatatgcagactggaattaatctactaattgctttctattgcatgtacacatgtgccgttcgattcctgtttccatgtatgacggttgatgtgctccgccggctacctccgataatggcgtcataccgaaagaacatcgagttagcagttagttgccggggcttatacatgttgcatggcgcgtcgccggctatcacccacgatccagcctcactgctcgacttgagtttttcgtttcaatttgttatcaataatcaatatatattagattgatttctaaactcagattaatttcttgctattttttgttgttgttcgcatataattacgcggcactactgaggcgaac

SEQ ID NO: 26646 - DNA, 255 bp, Oryza sativa
tcttccatatctgcttattaattgttctttcttatttttgcatattcttctcttggatgcaatcagttgcttttaaacatgcctgcttgaaacactgtcagttgggaaacatttcccacctcgaaaaagaaaaagatatatcctgcaccacagttccttcaacaattaggactttatatcttcatatcatgcaaagtattattattattatagtttccctctaacctatgtaatgccttctttatgtgttgcaga

SEQ ID NO: 26647 - DNA, 478 bp, Oryza sativa
attaggcctgggttaaccgaattgaccgaaatatagttaataagcgcaaaatcaacctgttaagcctattaagtatcatgtttgaacagttgaattttgatgttaagttgcaagtgctatctttgtgttctatatcatttgttgtttattttgtgactttttactgtcaaacatgtcctgaaactggggaattgctgccaaattttttactaccgaaacatgtcctgaaattgatcaatcagttcggtcatgacctaggaccgaaccaaaatgaccaaaaccaaatagcttggcctttatgattttgcattgaatttcggtcttgattttcggatggccaaaattcgagaaaaccaaagaatcaatccgaattaattgttcaaaccgaatggttacccatagccagaatggagctgctcaaatgtcacataatgtttttactggattttttttttggttacattctcttgttatacaa

SEQ ID NO: 26648 - DNA, 440 bp, Oryza sativa
caggtacttgacttccgtaagcaaaagaattatctttggttatcaagcacccacctccttagtccttaccttaccatatgtatctttcatggccttattgttattatatgtgaatgcatgccgcagcaaatagccaaggtcctttttaaagaacatatattaacaggtactgatcaaagaagctaatattaatctcttggcagctttctgatgtatctttacacacagttactaaaattatgcttttacccactaaaactgcatgagagttaagcatttgtgtgtccttttccctttttcttttaggattaatcagaactatgcttattaactttgcaccatggatattctatttttaacttgtgacagttgcgtgcatcaatttttctagcacctctcatgtttatgcggataacttctatcttggtttatttatcaga

SEQ ID NO: 26649 - DNA, 187 bp, Oryza sativa
ccgcccgtacactttactcaattctattcttttcgatgttaatggaggttaattacataaagtaagtttagggaaaataactacagttaacataatgattgcctcccaaaatggagttagctgtatgtgaggtgcatgtttactcagtaagtgataaccataagtatattgcttttttttttatgca

SEQ ID NO: 26650 - DNA, 426 bp, Oryza sativa
taaagaagacaccatttaggagacttggaaagcgtgcgaaaaaaatccaaaatatggaatcgggaaaaaaagagagggccttaaactccctttatcacccttgtcgtactaagagttctattgatattcgtcaatattgcactcacatttataacataatgattcctttcacctgtacggataaatagtacaaaatccaaatacgacataacacaaatacattataattattatgtaatcaactctcggtttcaacttaaacagagctaattagtgttgagaaaaacacaacccatggtgcttaattattctctcgctgcatcacctttaattttatttttatgttattaacaaaattaatcatcttcatatatgatttgatatgtggcaaagcggtagcgctacagcggttgtgatcaccttaga

SEQ ID NO: 26651 - DNA, 695 bp, Oryza sativa
gatatttttataatgagttctatctgagtataatacttatgctttgacaggcctggcagagaaattttcagaaatttaaatttttacttgatttgtttctaaatatttatccatttcaatggttgtgggaactactgaggtgaataatacatgagatgaaaaaaaatcattaataattacccagtcgccaacaacaaataagctcaggagaacagcactgtggagatctttcttgaatttcaaggcatagcaatcaaggcaagcaagtcccaagctccagagtgcctgtagtcccatcgatgcaatcaagtaactgaaattgagagttcaccaaaaactggttacttaacaggatactattcaatctgcaagttctgtcatagtgcagatcaaatggttttgctttgatggatgcatagacgaatgttcacatatgcaaacgactgccagattccttccacaaaatgaacacaccaatcttaacagcacagacaacactgagacttcctatgtcactcatcaaattaaatagagtaataaataggacaaacaaacaaagaacagattatcatgaatgattggcatgcctaccctacttaaacaatgaatgttggatatgagtaaagttgctcaatgttccagcaacataaaaattttaaatttcattatattgactacctttggtctctcctagt

SEQ ID NO: 26652 - DNA, 455 bp, Oryza sativa
catctctactgtagttatctgaattctgaaagcctgaacctctcgtcgtgtctcgtactctcgttcccctcccctcgcgtcgcctctccacttcgtctctataaagtcccacccaattctcgattcccaatccagcgcagcacaaagccctcctccttccaccgcagctgcgctacctacctccaagagggctggtccgctggtcgtggagaaggaagagagatcttccaggctgatccctcctattggtacggaagccctaaactcatcggagctttgccgcggccgcgagcgatcaaatcgaaatctttctttctttgttctttgatgctccaacctagtgtcggatttgattttgactgttgcaatggcagctttctccttcccgagcccgcttgaggatccccgccggagtagggattagggaggggagaacaggaggcggcgattcacca

SEQ ID NO: 26653 - DNA, 256 bp, Oryza sativa
caaagccgacttcaattcgccggtgtcccgggcgtccactgacaaagaggacccacttggaagaattattattatacagtagtactccaagaaggggatagatttttcaagtgaaaaataacagagcagtgcccctcagttcagttcagtccccggcagtgcacgatcccatccctcccgcatcggcaaggcaccgccgcgccgaccgctctccgcaccgcgacgcgacgcgacgcgaggcgaggcgaggcgagca

SEQ ID NO: 26654 - DNA, 333 bp, Oryza sativa
ccgggccggcccaagggagggaagggggacttttagggtttttctttttataaaatcattttaactttgtttatttcttaataattattatttgcgtctgaaaattccactaaaatttatttacgcattttaggcttttaggagatttacaaaaatcctctaagccttatttggcttttaactttacacattttaattgttggaggctttcacacggattttaattattctaggcatcatttaagggatatattttagagtcgttttgggacgtgacatatgggccagctgattttttggcccaatgcacggcagccttttagtgctcatagg

SEQ ID NO: 26655 - DNA, 1501 bp, Oryza sativa
cgccccggcggcctccgccccagccgccggccggcttgccagaagagaagagaagagtgagagagaggaggaagggagaggaggggaagagaatctgctgatgaggcacctgacatttggggcccacgtgggtcccacgctgactcagctgccacgtcggacaaaatcggggtcaaaaccgccgagggactggttttgtaagttgagaaatgtgttttatctagttttacggttgggggacgattttgtaactcaatgacaagttgagggaccttcgatgtactttttccaaaaatcatactccctccgggttgataatacttatcgttttggataatggcccggtcttcaaaaagtaactttgacaactattttctattataatatatatagaaatatcaacaaatatatgattttattgaaatactttttaagactaatctacatatatgattttcatatttttaagatgaatactttagaaattatttgtagtaaaagattttaaagtttgactttacccttatccaaaatgactaatattatcagcccggagagagtactccggtgccctgttgggtcactccgcgggttacttccaatccccgttcctatccccggtaatttacggggccctgccttcgctcatccgtgggtgagaattcacccttcccctggagccggaggggcaggtactggcaggtcgaaaattgccatccctatttgcgtaagctcagacgtgaaacaattcacatatcttggaactcttttgtatttctaacggttttcttgcacggctgcaaggtttgagttgagtgagaaccatggaattatttcttatgatcctttttacaccctatataaactatttaaatcattgagctttgtttgtttggttgttatgcaggatgttgaccgatgctttgtcttcaactgagattgatcaaagtctcgttgattgcttactataaggctctgtttgtatgtaaggttcccaactcctcctccttgttttccatgtgcacgctttttaaactgctaaacgatatgttttttcttaaaaaaagtttatatatgaaagttgcttaaaaaaattatatggatctatttttgaaaaaaaattagcaaaaattaattaatcacgcactaatggactgctctgttttccgtgctgaatggatgggttaggcaaacgatcagagccgtagattagagacttcatgcattcagaatttatctatgtgaagtctcggtttgtagtcacaaatgtaatatagtggcagatggtctggctgtttcatgctaagtatgttttcgacactggtccagagatatgcttacgagctacttcctccgtcccaaaaaagccaacctaggaggggtcaggggatgtgactcatcgtaatacaatgaatctagataatattgtattaggaggggtcacccctcctagattgttttttttggacgaaggaaataagccctagcctatagatggcca

SEQ ID NO: 26656 - DNA, 708 bp, Oryza sativa
ggcgtatgaattttgcattagtaacatgggtgataataacagaagaaaggcacaaaaaaaagtatttggaaacttctactccttcatttttatatttggcaaagaagattcatccattttatatatatggacagtgaactattagtactttagaagggagtacctatacatctttcgaaagatttttataatcgtatcacacagatttttaatctttggattaaaatccgatagatataataaaaagcaaaaagcaattaagaaacactataatggacactaaattaccatatcctcaagaaaaagaccaaatccaatacaaaatttaaaatttacatgcgaagattcaaaaattacagtgtaacttacaaaagttacagtgtaagtttcataaattacactataacttacaagaaaatgcactgtaaatttgagtgagaaaatcgagtgagagataagaaaaaatctttcgagtgagatatagcaaaatcgctttagaaaggttgatgacaccttcacaaaaaagaaggaagaaagtaggggcagatccgctctacttttagggcatgtataatccgcactactcaaaactaagtagcacttacccttcttgcttactaccacgtgctttacacctggtccaatattatctcgtttcaagacaagtaatataacaaacaattaacaaacacattttgggttttcagg

SEQ ID NO: 26657 - DNA, 1501 bp, Oryza sativa
ggcttcaacgcagacaacgacgacgccggctatggtgcagatgtaaatcgaatagcaacagctatggatttgtgtagattgatttcctgaataaccacaaaatcttgccgccgaatagattaattcggcgctttctctgatgattaatatgtagattaatttcggccttatggatggccagaagtttcgatttccaacgtagtcgccaaaaatcgtgttggcaactttttgtgacaagtcgataaacacgatcgcagcacctaaacgccaaccacctcgatttagccaaaaggccaaatcaagatgggttttgtagaaaacggctaaaccggctagcagagccgatttagagatcaaaatcagcctctatgccaatttagatcaatacgaggataactacccgtctcgtgagcaaaacggaagtttttcagcataaacccacaaagaggtgtcgcactctcgcagcggcggcggacaatcgacaaagatgaactaaaattaaggtaaaatagaaaacatggctgaaaagtaaaaaaaaaaaaagaaaaagcgattcattcaagtagattgtgtgttcaggggattacaattgaactgaccttgtcccttaaataggggttggtcttgccctctacaaaccctcctccacgtccaactcgggatataaaccaaaggaaacccgaaacatgctttcccaagcaaggaaacccaagacccgacgaaaacagactcaggctcggaccctcacggtctgaccggccacatacctgcggtcacaccggaatttaggccgcggtcagaccgcccacatacctccggtctgaccagcactgtgaaggaaacccggcactttccaaacgttggcaattttcccctatttcgtccataggtgctaaattttggtgtaaacaacttggtcatggctggctgtggaggccaggaggagacagatgttgtgcatgtgttgctgctgctggtactgttgaggcaggggagttgctggacttggtctagggaccgggaccatatgccaccgagcgctgttgcttgctcgtattttttttcccgattagagatcgggtttgcgtcgcaaaatgcctcgtcgacatctacgcgtctccgacatcggcatcaactccggcttcaacttcgtcgttccgctgtgtgcaacatcggcttgatcacccgttcaagtgcccggctacggcgacaccttgccgccgatcatcttcggctatgcgtctacgccatcaagcttcgggttgccgctacgtcgccccccttgggccatagtgccgttgcctgtggtcaacacctccactggttgttgcaatgctgagaggtgccctcctcagcatggctacatcaccgatcaacttctcaccgctgcatcgacatggagctgtagctgtgttgccctctcggaccgcagcttcgccactttcgtcgtcttcattgccgttcgcgcattgacaacctcgttgtgcacactggtcattgt

SEQ ID NO: 26658 - DNA, 359 bp, Oryza sativa
ggacccacgatggtgagcactcactttgatgtaaagttctacctttttttttcttagttatgcgtttgagcaaaggcaacatatttaaggagtatttaaggagctagtctgaattcattcctacggcataagaaaaatattttattcaaataatgactggaagttcctttattagaaaaatagacatgctcaaggcactcaaacattgcaaagatagtgtgttatttttagcacgtgaagacgctttttcatccaatgattgttttcaacaaaatatcaacacaaagataactgttttttgtagcaccctgacttccaatttgcttaacttttgttgccatgatttgccactttaaaga

SEQ ID NO: 26659 - DNA, 455 bp, Oryza sativa
ccgcattactggggtatcactgcagaattctgtaggcatggtcctcctagttctcgtctatgtttttgtttgaaacgattcgtgtatcaattttgcattaacagcattagtgaaaacagatcagcggcacaaaacagatgatttccgttcttgattcaattgggcaacctactgttatggaaacttgtatgatattcctccattttatatggactgatagtgaactactcgtttagataataagttgatgatcttccaccttctcaaaaaaagaaaaaagaaaaaaagtttacatagtaaaagacaaatctgcactactcagggccatgcgctggcaatcagaactcaaaactagcacttacctgtctttcttactactatatgctttacactagaccccaattttatcttgtttcaagacgagtaataattaataaacgcattttgggttttca

SEQ ID NO: 26660 - DNA, 1501 bp, Oryza sativa
aggcggaggacacagagattttatactagttcgggcctccaaggtggataatagccctacatccagtttttttttctttttcctctcttctcttttttttctttgccgaaaggcttacatagtgccgaagggcttacatgacagtatgtacatttttacaagttggcgatttgggtgccacccattctagacatagaagcgcttgagagagacagcattccaggaatggtcgaactcctcgccttcgagtgtcgctaggcgaaaagatcccgtcctggacttatgtttgatgaggtacggtccttcccactttgattcaagcttgccaaccgctactgggttcaccttcttccttaggacgagatgaccaggcatcagctctgtgggtcgaacttttttgttgtaagttgccgaagtgcttgtggcgtacttatgcatgtgctcgagcgcttcgactcttaccccttctaagagttcgagcgatacttcgcgcccctcttcgcccccagagaacatcacccttggtgagttagcccctagctctgctggggtcattgcctcatcgccataaagaagcataaacgggctaaacttggttggtcttgtgggggtcatctgaagggcccagagaaccgatagcaattcttctggccatttgcctttcgctgccccctcgagtcttttctttagtgcttctaggatcttgccatttgtacgttcggccgccccatttgattgcgggtgcgcgactgtcacgtcctgataaattcatcccgaaataaaaatcattttctaaaaggaataatagaattaattaaaattcgaaaagaatttggcaaacactaaaatacgtacaagaaaaattcgaatgtggcccggagaatttttgttaaattctccttggtctaaaaggagccctcaaattttacttgaattttcagagcaccggaaataattattaaacaacaaaaacaattatcaaagtttattaaaaagaaaaacctaaaaataaccctccttcctcctttgggccaagtctggcccaaagtcctccctctctcccctcggcccgtggccgaagtctccctttcctccctctctttctctccctctccttctctccctcctcttgggcccctcttcccctcccggcccactccctcctcctccctctctcccccaggccgcctcttcctcccttcccgcctgggccgcgtcccggcccaaaccgcgccacctagccgccccggcccaagctgagccgctcccctcccgcgcacgtgcgtcgcacgcgcgctgagcgcgcgccccgcgtggggcccacgcgccaggccggccgtcgtcttcttcctcctcccgcacggccctctctctctcccgtgaaaaccctacttcgttcctccctcgaatccgcgtgatttaagcgttggattccaaaattaattggggggttttaatccccattgaatcctcttcaattccccccaatttctcccttgat

SEQ ID NO: 26661 - DNA, 310 bp, Oryza sativa
acacagcatcagcccctctgtagctcgacgaggccggtggcttgtcgggagctcaaccaagctggcggcaggacaagaagtggatggcttggtcgttgccaccggatttgcttgcgccaccactggatccgtgcttcctcgctggcgccaccactgttgttgctttctacttcactaggattttcggcgcgcttcgcggcgcctccccaccgttcatttagggctatagagctaacgcagtattttagagttttatggcgaaggcattcaagcaaagcaaatagaattggaggatcttagtaatagcaga

SEQ ID NO: 26662 - DNA, 357 bp, Oryza sativa
gggacgtctcctttctattggaaaattttgctgctgctagtggccgtttcttcacataggtcgatggttgtgttattggcctagtaacctccctgtctggttgtgttccatgttgctgcaaaaataaaagaaaaatatggctgtgaatgtgcttggcttgtgcatgtagggaaactgttctatctataaacagatctaatttccctgccgttgtatttactaatcgatttgttgtacctatgtttatttgataagataagcgaggaaagcataatatatgtgtagaaatcagtttggagaatgagatgcggtggctgtggtacctggtatggatgaatatcagagcagcaatagcaa

SEQ ID NO: 26663 - DNA, 979 bp, Oryza sativa
cctcccgttgccgcccaccgctgccgcccgcgggctgccgccgccgccgctccagctagctcctgccgccaccgccgctcactccccgccgacagccgtaggggagaaagagaaagaaagagagaagggaggggagaagaaagggagaagatggcatgtgggacccacatgtcagtgggccccacaattgtgagtgaatgacaaacgggtcccatgtataactttttaattgaaatgccacctaagcgccatgtcagcacacagactaggtcaataccgtcacgtcagcgaaaccaccctccaaaaccgccgagggagtcaaattgcatcggttttgatagtttgggggtcaagatatccgattttgtggtttagggtcacggattagattttaatcacttttgagggtcaccaaatgaacttattcctagagcaattaactattccttccgtttcaagttagaagacgttttgactttggtaaaagtcaaactgctatatgtttgttttattttgtagaaaaaagtagtaatatttttcacccaagactaatatattataaaaatttattcaattatagatttaatgaaactatactggtgttataaatattactacttttttctatagagttagtcaaacttatagtactttgactttgactaaagtcaaaacgtcttataacctggaacggagggagtaccgttcggacttttttttttcatgaagcaagaacaaaacgcaatagtgttagaaatgtacgtatagtgagttggacctagaactgttttcaaaccctaggcatggaagaagtctagaaaggcatgaattaaggtcttattcggtttgaaggaaaaacaaaggatttggatcctaaggattaattcctacatgtgccattcggcttataggaatgaggaataggaaaccaaaggaatttttcttttccattcaagttgtagagaggaaacatagaaaa

SEQ ID NO: 26664 - DNA, 409 bp, Oryza sativa
agaattttatttctttttatgccacatgtagccaagcctcctcttgctctatacaggttcaaagtacgctaaacacaacacatacgcatatatgctctgacttttcaagctgaagtgttttatatgctagctacgcgttccacttgtcaatctcttttttctactctgaaactgcgcagagatgatcactccaacattttgactgtgtacttgaccatatcaaagtgctagcttagtatattaattccttttgtttggccatcaagttagtaattaattccaagttgatcatgcagcaacaaaaactatctgtcattaattctgaagaattattaatcctttaatttcaagcttgttcagttctgattgattggtttggttgcaggtgagggagggcagccgtgcacga

SEQ ID NO: 26665 - DNA, 542 bp, Oryza sativa
gttttcttaaaaattcttctttaattactactataatcaagtagatgatcggttaaagtaatcctatttaaactaggagccccacttataaaccaattttatgggccaagcccacaaaacttgcttataaatgaggacttgagtgccgatctgctatatatttactcccttcaggttgcaaataattatcttttaaaaaaaacattgatgctacaatgctagacttaaaaactttgactataaataattactgatatacgtatataacacatgcatagattaatcttaaaatgtacttcaataatgttatatatttactgatactttttatatattacaatagaaatagtgaaaacttattttgtggagaccgtatctttatcaaaacgataactatttttaaatttgaaagaaaacgtaactaaacatatgtggtcgttcatgtacataatttattactcgatcgaagtaaatgttcttcctttgatgataaattgtcaacttaatcgtaagtgcattgattgatcagaaagcagcgaagc

SEQ ID NO: 26666 - DNA, 199 bp, Oryza sativa
cttccaaaaacttttttgctctggtattccaaagacaagggacggaagacattgaaacaatctctagtctctacctttacatctcccttgtaaattctaattcatatttcgtagcatcacaaatatacaagctcaatagttttcaggaaactacgttcagagtttaaacgctgttggaccttggaggaagtacccgcta

SEQ ID NO: 26667 - DNA, 882 bp, Oryza sativa
gcgtggtaacgtatatacacacgtcactgcatacgtaacatcgtactcatacacccatgttcaatgaagcagaaactagcgagacatcctaaaattttattaaaacttgaaagtccatcagtttcaaaaatattttggggttggaacggaaatatgctagggccatatggtattatggcaagtcgtctcgtttccattttaacatttttagcttacttttaattcttataggcatatgggacaaggagctataaacttgtaacttggacgtttatagcttgatcataacattggtgctaagaattttaactataaacattatagttttatgataattttattgttaaatatgtggttttgtaatacttaatcttaaatcaatagttttgtgacaaattcagtgttaaatctataatttaataatacaacatcttaaatgtgaagttttgtgatagtttgataaaaatatattaagttttgtaaaaattactctattaaaaaaaggaaatgtgtgctatgctccctatcttgctagtccagggaccaaataaaacacatatacttgaacaactatcagtccattgcagcaacacttaataaacagccaccaggttaattcaagtagcatatgacagtataaataatagaatcaaacgtagataagttcacatatcaccgaactcgcgtacactggttcagtacacatgtctcgcacaacttttatggtagtctatggctcataaaccgacttgctaatacaccaacacaaattaatcaagcttgaaccttaaccggcatcgcatgccgatcccgtcttttgacgttgcagtaattttccgttcattagcctctgcatacttaccactgcagcttaagcgttca

SEQ ID NO: 26668 - DNA, 1501 bp, Oryza sativa
ttcatccttccatacatccatttatctatgactactcacacaaacacccaactacttcttgaaaatagcataaaaagtaagaaagtgcaaacatagaccatcttttcaagccacttaagctgctacatcaccctaatgtccacttgtgcattgcctacaactccagcagcccgatcctgcatgatagcctgtggagctgcagtagggaaaccaccaagtggtgccactgcctgtaggtgacctgcatgaattggagcaagggcaagatgtgtccgcactccagtgtccaacatttcatccttccactgataatactgacagcctccaatctgaaagccaaaccatcaacacattgtgagcaaacaataacaaaaaacccaaagacaatatgtgagcagagaatgaaacacaaactgctaaataagggcacttgtgaaatgcacaattgttattcttttctgttgtcgagatgaatcggtttgcaagcacatggcagttgcggcaaagcacccgcttcaccctaccaccatagctgctagattcttgggaaatggctggagaagaagagaggtgaatgagatgaagatggaggagttggaagtacaagggctgatgtgttttatataggaggagaagggctcagtaggtgccaaacaacacttcctttgccgccaacagtatagcctttggtgccaaaaatacaggcatgtggctgcttccgaatggcacagaaggaaacaaacttcatcaaatggcctctcaagcctaagggcaactaagtcactacgcagcgccgttacccactgttacgaccaaaaacggacggaatggtgtggagggcacgatatagttcgacgatggtagagaagaaggctcgaactttttagtggcacagaggcagacaccatctttcttaatggcgcatagggaaaaatctcctcttccaaggtttctccaccttccgcatcgcatacagtcgccgccgtccccggatgcgctcacttcccctcctccgccacgctgcttccccatatccctcgctcacgcgctctagccgtcttctcctctccatcccgcgtgtgctcgctgcaggcccgccatctcagccacgctcgcttctcctccccgcgccgttccgccttctcctccatctctccgcttcctcttgtgtgaatagtcggccaccacctcctcctcctcctccgcttcctcttctgggaatcgttgccactagatgggaatagaatttgactcaacaaaaaaacacccatctataaaggcaaccaggtgagccgtcacatcaacacgctgatgcaaggaaccgatggaatatatctgcacactttgcttcgctcggtagcccatatttattcatcagttctagatcccctaattcatgaagcgctgattgtatatgatctttggctctgatacttcggtcaatcagttctatcttttatgaagcattctttaatatcgtctgattacttgaagtttcttt

SEQ ID NO: 26669 - DNA, 215 bp, Oryza sativa
tctgtacattgatatggagcccaactatacccctactccttctaatccttagaaccaaggtgggagtgaagaaagggaatgtgacagttctagtgatgatgaatgccatgagactgacttttattatgaatcatctgataatgaagtagaagacattgatgatgaaattaaagacagggagccagaaaatatgcttgatgctttttatgataaga

SEQ ID NO: 26670 - DNA, 532 bp, Oryza sativa
gcccatccagatcaatgtcagaacaacctgacttgactttaggacaatgaaattcatgtatgttcctaagcgattgctgatgattaggactagtcccctttgctacttgtagaactgtggaatacacagtaccgatactatccgagtgttggttgccaatcattcgtacaaactaatgaatctccagttgcgttcaacaatatgcgaaacaacgaattaatttacatgagtataaactcactagcatatattgcatccctacattcttgttccgtcaacagaacattgttgtattgatgtaaaatagtacagacgtattctctaattgagcataaatgcggtgaacagaaaaataaccaagagaaccgttgtccattttttatctactcctcccttcctggatgtttggagctaatacctagctaaattaaatgccttttcaggaacctcacttcttggtggcggttgaatctgaaatttccaaactcggaaggctagtaggcaatggccgtggcactagaggcagggagga

SEQ ID NO: 26671 - DNA, 1109 bp, Oryza sativa
ccctccgtcaaattttaagtgtaaccatgagttttcgtgcccaactttgatcgtccgtcttatttaaatttttttataattagtatttctgttgttatgagatggtaaaacgtgaataatactttatacgtgacttatgtttttaatttttttaaagaaaatttcaaataagacgggcgatcaaagttgagcacggaaaagcatggctgcacttaaaataggacggagggagtatatgtgtatgtgtatcctaagaaaccattatcagtttgctaatgatgcatggctgccgtgatagatgtatatgtgtatgcgtttgagtttgagtttacacatatcagttccactttcctactaaaattgtaaaattgtagactgatggtggtgtagttttagttgtggccataggtgcgtgtctttcttgcgcttgagccgtgataattaggaaactaatcctataatactatacaagtgatccccacttagtgtagttattaggttttgtttggcaaatgagatagagaaataatatcccacccttcaaagggtaatattgtatcctagccatccatttttcacacctcatttaaacttagccattcatccatttccctttcccaatcccaaacacaccctaaggattttcctgggctgaggttaagccacgtcacccgtttatttctagcgcttgaagctaagcccaacacagcccatatcctagaggtttttccctgtgtgccattaagaaagatggtgtctgcatctgtgctactaaaatgttcgagcctccctctctgccatcgtcgaactttatcatgaactccacactattccgtcgctattctgtttgggattatccgtttggcagctctgacatgtcggcctaggcaggaaaaatgtcactcttgccctttcagtcgctggcatattggaacccctgttgaccggtgcttatcgtcatccccctcagtgtcactctctgttctccctcgattcccctctctccgcggcggcgaaactctagcggcggtgaaaccttagcggcaacgggaaggagcatgggagcgtggatctgatcttgcatcgaaaggaacgaggaggagcaggca

SEQ ID NO: 26672 - DNA, 254 bp, Oryza sativa
caattgacagatgtgagcgagatggaaccggcaagttgtgcatcaatctcggaggcctcgatgggagcatcatcaacacaagtagaggctgcaactttgtccttgactgctgaatcctactccctccgtcccaaaatataagggattttgggtggaagggacgtattctagtactatgaatctagacatactccttgtccagattcgtagtactagaatacgtcacatccaactaaaatcccttatatttaagg

SEQ ID NO: 26673 - DNA, 566 bp, Oryza sativa
tcctgcagccccctcctgttgttcaccgtcttatgtcgaatttgtgtatttcgggaaatattagaacaaacacacgaaactttaatttttaaaccattgttcaaaataagcgatcagtaaccatggatgtgtagagctcgttgagtagtataaagtagactaggtaatcgaagtccgaatgaagtctcgatgtggaccgttagatctcttttctagtaactacctgcttcactaaacatactagtacataataaaccatacacgttttagtttattagctgattgtagtgggtcaacgtgatgacggagtagatctactaggtatctctagctagacaaaatatatgcaattaataataatgataattaactagcgcgtattcgagtgatgacttgtcgacttaaattatatttatatctcataaaaaaaacttttcatactagaacttcttttatttgttcaaattcgttgggaaaaaaatgaaggaattcctcaagtaaccataaatgatcataaaacactatttgttcaaattaaggttgaaaacggggcgggtatttccagc

SEQ ID NO: 26674 - DNA, 292 bp, Oryza sativa
tagccttctggtaatttacataggcgctaatctttagttgtaaactagagcatatcatagtgttgacaccgttaacacttaacacatagataccaatctaagtgtaaaatattaatcttagaacatacgtagtagatactaaactttaggtgtaaattagcacttggcaaactggttttcccaaaggagcaatcaaagcggtgtgacatataaactgattagtaaccggtggtgtgacaagcaaagatgtttcagcaataataacatagctaaagcatgtataccttgcagt

SEQ ID NO: 26675 - DNA, 1501 bp, Oryza sativa
ctagctagacaaaatatatgcaattaataataatgataattaactagcgcgtattcgagtgatgacttgtcgacttaaattatatttatatctcataaaaaaaacttttcatactagaacttcttttatttgttcaaattcgttgggaaaaaaatgaaggaattcctcaagtaaccataaatgatcataaaacactatttgttcaaattaaggttgaaaacggggcgggtatttccagccctcccgcccggccatattatttcgggacaaattcgggtacccgcgacttttcacgaatatcgggttcgaatacgggtcttttttggcggatatgagattgggttcgggaacatggtatccgacggatacgggttgtccggtaaaaaatcagggtattacccggataattatacggatattacccgtattatgtttttgcgaggtactttttggtaccatgtattagttctactatgatgtattgtagcctatttatttcctaaggtcctaatggcctaatataatcgtattatggatatatagaattgttaaatggttattgtctatgtgatatataagattgttgcttcgacatgatatcctaataaatattcgtaaccgatagtgcacgtatctattttggtacgtattcgtttcgtatttttgcccgatattatccaagtttgtatctgtattcggcactatccgtatccgacccgattccgattataaaatatgggttaaggtatgggaagggtgagatccgaccgaacccgacccgttttcacacctagttcaaattcattgggaaaaaaatgaaggaattcctcaagtaaccacaaatgatcgtaaaacacgaagtgagcgtaactcacctgtcaattagattccttgggtgaaaccaacccatccggattcaaattctagatttaatatggatgatcgtatttacggctaattattatttcattggtaggcgatgtactccacgatagcgaggcgtcatggtaacttcgtcaatcacaaaatataaaatgtaccggcacagtcttacgatgtgctcatgttagtaagatgcgcacgtgttgtgatcgcttacgattgactgtgtttctttaaaaaaaatcataaaacaaatgcatgcgcacatatttttgaataaatcggcggggaaggggtgccaaattgatacaacgcgttatttacgcactgattaggtcttcgtgatttgctccggtcagctcgctttgctagttgctcgtgcaaaatagtccacgtgcacgtctcttctttgattttctggaagaaagtgacgcctttgggatttccatgtgtctaaaaagctttcgcgaacgctttgacctatttctcatatggcacagggatgatatgatggtgacatataaatagtgatgtactttcttcatactccctcctccctgaaaaactactttcgggtttatatgcaaacccaaaagtaggttttttttgacggaaaaag

SEQ ID NO: 26676 - DNA, 1501 bp, Oryza sativa
taagagacaaattaagaaaagtggcgggtttaacccccacaagatcttacaatagacaacaccaaaactaaaaaaacacaaacacatgctcacgtcaacctctctacggagctagcattattgccatagcggaaaactcactagtcttgatgcccctgccgaacactaaagggcgccctcgctagcgacagcttggaggacaacttccacattagggacaactccattgaaaacacaatcatttctatgtttccaaatctcccaagcgaccaaaataatcatcaagttgagcccattttttctcaaccggcctttcgctgctcttgaccaccaactagagaaaactctagagttatgatcgggaagtgtggaatataaaccaagcctttccaaaatcgaagtccaaacttgactactgaacacaaattgaccgaaatatgttgtatggattcatcatcttggtcacaaagggggcaagccgctggatgaggcaagcctcacttggcaaggcggtcggctgtccaacatctattgtaaaccgcaagtcacataaaaagcttgtatagcccccaattattccaattccttctccatggggcaaaccggatggtcccaacaaaaagagatgcataagctgatttagaagtgtaaacaccagatccaatatgcttctattggcgatgatctagctcctcatacaagattaccccttgcaatgctatccaaacatggagatattccgtaataaccataactgtcaaaggctctttgatgtccgagacccatttttggttgaccaagttctttaccaccttttagcaatcaactaaaaaaggtttggagctatttccgtgatagactttccctcaagacatctgtttgtcccaaagagagtggagagtccatacccccatgggaaaacattgccattttaaaaagtttaggtgccatgcgaggaacttgcacaggcattccctgccaagcacgagtgctatctgtcttttggaaccaaagccacctgattcgaagtgtccaattgtcacgcccggaaattcactagtaatttccgaacttatttgtgcataaaatcctcgtccaggaatcagccaaggtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacaacaaatatgcaagtgcacaaggataccaaaggatagcctaatataggctcatttgcaaaagcagcatttagcaaaacatttaagagaagtaaaacagtggagtaattaatcagaaattttaatcaacactgaacaacacacccatgctgcacagg

SEQ ID NO: 26677 - DNA, 1304 bp, Oryza sativa
cgcaccagcagtagcattgaatatttagaggacattaaaaaaagagaagtcgataaagaaatgaaactagattataaccaataaactaaatactatcccatctcaaaataaaacaatttctaattctgtatccgaacatatctttatttttttacatagttaaaagtcattacactttagaactgaggtagtcatccatagctatgaggttttctttgaattggaaatgcccgaggaggaatcggaaatgaaaagatagatgaagatgatcagtgttttttttccccgaatacacaagagatctgtatatcatttcattaagagacaaattaagaaaagtggcgggtttaacccccacaagatcttacaatagacaacaccaaaactaaaaaaacacaaacacatgctcacgtcaacctctctacggagctagcattattgccatagcggaaaactcactagtcttgatgcccctgccgaacactaaagggcgccctcgctagcgacagcttggaggacaacttccacattagggacaactccattgaaaacacaatcatttctatgtttccaaatctcccaagcgaccaaaataatcatcaagttgagcccattttttctcaaccggcctttcgctgctcttgaccaccaactagagaaaactctagagttatgatcgggaagtgtggaatataaaccaagcctttccaaaatcgaagtccaaacttgactactgaacacaaattgaccgaaatatgttgtatggattcatcatcttggtcacaaagggggcaagccgctggatgaggcaagcctcacttggcaaggcggtcggctgtccaacatctattgtaaaccgcaagtcacataaaaagcttgtatagcccccaattattccaattccttctccatggggcaaaccggatggtcccaacaaaaagagatgcataagctgatttagaagtgtaaacaccagatccaatatgcttctattggcgatgatctagctcctcatacaagattaccccttgcaatgctatccaaacatggagatattccgtaataaccataactgtcaaaggctctttgatgtccgagacccatttttggttgaccaagttctttaccaccttttagcaatcaactaaaaaaggtttggagctatttccgtgatagactttccctcaagacatctgtttgtcccaaagagagtggagagtccatacccccatgggaaaacattgccattttaaaaagtttaggtgccatgcgaggaacttgcacaggcattccctgccaagcac

SEQ ID NO: 26678 - DNA, 269 bp, Oryza sativa
cctgcatacgcatgcttctgtaaagttgcaacaagatcagagtttacccctatatatagtgaacttggagtcttggatcatcatccatcttcttcttcccattgagtccattcatccacatttttcttctgaactcgcacacaagaggtcacgagaactgctcatgagggtacacactcgattctctggttcttctgaacttttttacatcgaatgacaaatgctaattcagcaatcgttgctgctgctggttctacttcggtttcagg

SEQ ID NO: 26679 - DNA, 528 bp, Oryza sativa
attagatagatggtttaagtctatagcaaaacagcaaagttagtctattccaaagcttttgcgcactagttagccacaatcttgtaaataccctattactttatgtaataatatctccttcaaagctatgtctaaatgtatgtaaagacgatccagattattgaaattgtatcaatctactgatctagggcttgatacaattttaatatgtcggttaccgaatcattagttttgggacccgacagtttcctatatgtaggtaattttcagggcaacatattggcttcgacagtgggttcaactacaaaagtatgaggaagatggagttttcctgaatgttgcatgtcgtaatcttgaaacaatggttatgcaacttttcgccaactatggatggagattcaccaatagactggaatattgttttccttgtcatgttaggtcttctttaaattttggttggttggcttgctttattttggactacgtctttttaagtttgctactttttgtaataattagctgtagctc

SEQ ID NO: 26680 - DNA, 615 bp, Oryza sativa
ttattggaattaattattaacccatcctttgatcttaaacccatcctttgattcttgatccaaattcttccttttgatctagccactgatttaattcctgtggcttgatttcctcttcggcacaagaatagtattattgcaaatattgtgaataattgctcttgtgctaagaaaataccaatttatattcttcactcaactttccctattagccacaaataattcttcaaatacttctactatcaaatttaggattcaaatcctatttattttacctccaaccattctcctccaaacatatatatatattgaggaattatattgttaattcccctctcatttgagtgcattaaattccaccatattccacttccaaaaatattgcactcaaattagaaatatctcttttggaaattagatccaaatataatttcctttcaaccttccctattcaaattatctccaaatatattttcctttcaaaatcttctattcaaattccttccaaataaaaattctcctctaaatcaaattattcagccccaggaaaaattagactttcttccttctacgtttgggccgaattctccctttccttcttttcctttcctcagt

SEQ ID NO: 26681 - DNA, 371 bp, Oryza sativa
cagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttattgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagata

SEQ ID NO: 26682 - DNA, 252 bp, Oryza sativa
atgttccagtctaagcatccgagagctcctggttcagctcttgatgatttcccactttgttgctgttagatatgtcatattatgtccagttattcagtgcttgcttatatgcatctatctttcttccatatttctatagtagctcgtgcctctgttctttatgctttccctctccattatatattcatccatatgtttttccgaatgtgtctatattttgctcctttcgtttcttggtgtatagaaatgaca

SEQ ID NO: 26683 - DNA, 1501 bp, Oryza sativa
aggggacacagaacaatagatcaagacacaagatcaacatacaagccaacatgcgccaagacaagacgccggatatcgacttcagagataagcatagctagtcccctacggtgtctacggatactatcaggagagacataacgatgtctttgatctcgccggatgcagattcgaggaggaaggctactctgttgtcgactacgagtcagcacttcagaccgccaagtcgacaacagttatataggctaccccaaatattgtactggtgcgattttggtgaataagagcaacgaccggcttcggccaacaggagtagggttattacctgacaattcaggggcccgaacctatataaaaatcctcgtccccatctcttttacctaagtctcgcatatatcctggtaccaacgatccccatactatgcaaataccgtagtcgtgacatcaaacgtcgacaaatacaatttaaaattaacttaaatttggaattaaatataagcaatattgataagagtaaatataagaacccaatagtagattaattaaaaaatccgaaatttgacgggccgtagaggagtatagttgcatcgtttgacgggacttctaaaaattaataataaactctaaaaactataaggtccaatttttaaaggtttggaacttctaaaaaatataaaaaaaccaacgataattatgtttgatttttaaaatagcaatggcaataaagagaagatgcagtggacggttgtagaggagtataatggcagcatttaatgggacttctaaaaattatacaaaagaaccctaataggacgataaactctaaaaactataagtttttaagatctaatttttaaaggttctaagaagaatgaatagaaacggtggtagatcaagcaagctaataaagaataatatgacagaagtaagtggtagcaacttatgtgacttttaagaactataaaattacaaacacgaggatgataagatttggtctttcaaaatctcaagatatcgagataaatttttaataaatcttaagtaaaatcatattaaaaaatatataattttatatgggtgctagccgcgcaattgcgcgggcagtttaaaaaactctgtcacgtataaccagccccagacgcaaccacggtggttgcatccaagcgaaggatttcataattaagtcattaatggccaatttggctctaatgggacttgttaattaattttctcctgattcttgccagctaaacccaccatcctacaccttacccatgagagggatgggatggcatctcaatctatgggcgccgggcggttgatgaggcagacaaaactgatcaattttcttttgttgcattgtgaatgagcccaagctagtagaaaaggagtcatccggacctcgtctgaagtccgggctcctgcaggcagcattatacccatcaatacacaaacccaatcaaccccagcaactttccgggccatcggacgagctggtcca

SEQ ID NO: 26684 - DNA, 1501 bp, Oryza sativa
ttccttcacagagccgatctgaccgctgcctatgggtcggtcttaccggtggtgtgtggccggtcagaccgattccaagttgaatttcaccaagtctcgggtttccttgcttgggtttccttgcttggtgaggtatttttaaagttctaattggtctctaccctgagtttgatgtggaggagattgtaggaggcaagaccaacccctttataaggaacaagaccaaggccggttcaattgaacacacaatctactttgaacacaattagccaattgaatcactttttcaatatcatgtctacttttttgcttagttctagcctagttttgttcatctttgtcgatttgcgcagtaaatcgcccaccttcgctgtgagagtgcgaaatccctctgtaggttcggcccgtaaaccctgttcgcccacaagacgggtgtttatccttgtttcatctaaattggctccgctagcctgtttaatcttgcaaaacccatcttggtttagctttgtctagatcaaggtgtttgacgactccatatcaccgcaaggcatttaggtgtctcgatcgtgcttgtcgacttgagcaaacaagttgtcaacacctgtgctgaacaaagtagagattatttcctcaccccattgactattttagtagcttccattcaagaatagcttctattatgctactcagcggtcctagctgtactcataactatattattttgataagtttgatctttttctttagcagcattagatgattgcctttctcatttttttatacaggaaagaggctagctgggagcattataagtgagaagcttgctgcttgtgtgaacatagtgcctggtgagaactacatcctctcttctttttttgtgtttttttttctgtccgcagctatcgatgcactgaactatgcctggtgggaactacgtcctctctcttttttctctatctgcatctatagatgcactgaactaagcgaacaagcaaattggctggactttatatagtggagttcaatgcgaatccatcatattcagttctgtttccatggaaattctgcatattgaactttggtcaactgaatgttcaaaaacaactttaaccaactggcttctctatttcttgagaaacgtaatcaatgaagtgctcatatttgtctagtaatcagaatttctaacagttgccttgccatgactatggtaatgcgggaaaaggtgttcacctgtatgaccatgtggcatttgacaattctgaaacattgatgcagacatgtgcctcttcctgtaagcatcatttggccatgtcgagctccacaacaacagcactgttggaattacacttgatgaaaggggctcaatttagaacatcgcgggatgaaactcacactaattaatgtcatgggctttgggccgggagtcctaggcccatgagatagaattagggtttgttaggattagataaggtttgttaggattagattaagtagccctcca

SEQ ID NO: 26685 - DNA, 178 bp, Oryza sativa
ctcgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcagg

SEQ ID NO: 26686 - DNA, 422 bp, Oryza sativa
tgccgcccggccagagggcggcaaggggccgcctgcaaaatggccggccccgactggcttttttgcattcgggccccttgccgccctcggcaagggttttcctgcaaaaaaccctccctctgtcaccgcccgttcctctcccgtttgccacgtcagcttgccgccccagaggtgggcggcagggtctatttttgtaaattttttttgccgatatattatttctgtaaatattttaaaaaaaatctaaaaccgaaaaaaattcggtaggttcccatcttcccaaccgaactcagcccaaaagcccaaacatccaaaggccgaagcgggcccaactcccatgcatgtaggccgaagctcccagaagatgccactcctcccctccccgctcggatctctctccgccgccgccaccgccgccccac

SEQ ID NO: 26687 - DNA, 1501 bp, Oryza sativa
cggattcgtccgattttgtgcccgcgatcctcgccggcgcaatcaatggcggccgagatctccgcgccggtttccatctcctccggccgctttccctctctcccgacgctatttaattgttccccgtgcctctctcctccgtttccgccgttcgccgctcgctctcaccgtcggaatcgcgctcgcgccgctttcctctctctccgccgtcgccgacgagttccggttcgccgccgccgtcgctccggacttcctcccctctcggcgtcgcctccttcggcttcgccgcgtcgtcgtcgaccccgtccgctcctccgtttcgctcgccgaccgtcggagcgccgtcgtcctcgtcgtcccgaaccgcgccgccgccttcctccgtttcggccgccgttcccgtcgtcgccgtcgaccggggtgagccgaaggccgctccattcgcttcccccttccctcctctctctcgggtgccgctccgccgcgccggtggtcgccggcggtgaccatcggggcgcgggcgcgtccccctcctgtcggccgtgccggcgaggctgcttttcgggcgcgccctcgcggctgccaagtgggcccggccgtcagccgcccgcgcccgcgggtgcggctgacgcgtgggtacccacggcgccggccgccgccagccgcgtgctcccggtccaccgtggaccgagaggctgacgcgtgggccccactcccgtggacccggtccgcgcgccctctccctcggctgacgcaataaacccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagtttagtagagtaaaagccttttctttttcgttagtcgtgtagacgctgcagcttcggaagatccgctcttcgtggaagttgaagccggtgtttgggaaagcgagcaaggcaagtcacatcatccttgagcatattgaaccccagtttataaaattattttgatttaaattattgcattaccgctttatttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtgattttataactttagactttgggaattctcatatcatttggacactatggaattgttggtttatggtggaattggacatacacctctcttcccctttcaaaacccctaaaacctgttttcggtggggtttgggtgcatgccagttgtgggaagtagcaccccggccactataaggattaa

SEQ ID NO: 26688 - DNA, 241 bp, Oryza sativa
atgtgactattgagttaaatagtgtgtattttttaaaaatttgtttgaataaatgcattatatttttagggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacagata

SEQ ID NO: 26689 - DNA, 1501 bp, Oryza sativa
atctttaaaaattcataactaattcatttgaactcagtttaatgtggttcaagttgcaaaaattatataaaataaagatctacatattaaaattgtccataaatagaattaaatttatttaattctttttaaatgggctttaattagatttaatcttgtaaaattcataataaattcttatgaagtcagaatgaggccgttcaagtctcataattcatctaaaattatgatctacatgtttgtttactttatatgtactgtttatttggtttttattagtctttttcttcgttttgcgtgttagcttgtcgtttccgtcgttgcgaaggttcgtgagtgcgccggaagtgttcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttgcattgattactttattccttgataccttgggttattataacttgacaagttgagctttatatattggttcagctagatattagatatgattgcttagccatgcttagaaacattagcacactattgggataacttatgactcattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttacctttcgtatagcatggttcattgcggggcaccagactgagaagtggcggagataagcccacgggggtcgctggggagtccatgccttatttataagggggtgattatgatccaggaatggtgcactgcggtggattgtgttatgcaaggggtaatgtcacagcccctttccgaggtaccgtggtggtactgaggcacatggtgacatgatgtggggctgtgtcttgtgggtacagtggtacacctctggccagagtaaaactattcgaatagccgtgcccacggttatgggcgggttgagcaatgtttttcgtgattagtcccacacttctcacaataattatggatgttatatctggtaataatttgcttagctcctggattggagattagatctgtacagccgggtatggttgtttcagaatggttgggcctgagcagcatgggcgtgttgttcagtgttgattaaaatttctgattaattactccactgttttacttctcttaaatgttttgctaaatgctgcttttgcaaatgagcctatattatgccaacctttggtatctttgcgcacttgcatatttgctgtgtggcttgctgagtatgtcatatgctcaccttgcaataatcaa

SEQ ID NO: 26690 - DNA, 1501 bp, Oryza sativa
cctcgcagccgttgagcggcgagatgctccactctaggcggcatctgcatcatctttctcggtcagtttcttttctttcctgaattgccttctcttgctttgcttacgcccgtttacagtgagagccatgcgcttttgcggtgaatttctccatcttgattgggaccaactttggatttggggggttttgaatcttgttcgagatgtcttaatagggtttttgaagtttttgtaatttcagacgactccccaactggggaaaaaaattgaaactgatattagttgggattattttttttaattatactagaatcagaactgaggaacggaattttgatcccaatgtagaaaacagtacgattttaatttcagcagtaacgacttatgttacgcatcttattcaataataaatttctcagaaactatataactagtttttttttgaaactataactttttttcattggtttcacataaatacacgtttagaagggatttgcagaagtataccaatgtcgcataatggaagcgtggcgagtgtgcgagaccgcgaattcacatccctaactagcgcactcgcgcgattaatagattaattagcgacattagcaattaattaattactgttatttctttaattagcataatcagtaattattaactgctaatcacgatgattaatcactaatcaggaggccatgtcactggttggctacttggctctgcgcgaccgcgcaatctcacgccatggctctgagactgtggtgggtcccgcgatctcgcaacggttcaacgatatcatgacgttttagtagtcccactcaacaatgacaatatatttgtgtcaaaaaaaattgtatcccggatatttctgagaaaaaaatgaacagtatattttcaaatttaattcgacaaaactatcgtataattacaggattatgctataatgttgtaatgctacagatatgaacccaaattaatcacaaaccatatgcttataagccacataacaaaactattaaattacagattttgtgctaactttatcacaagactactgattcaaagtttcatcgagataacagtgctaaggatggaacgtcaacaatctgtagctatgtgataaattcgatggtaaattagtacttgtgaacagtgcagcctaacgtatagtattggaataaatttgcgccagatatatgagtcagatgctaaggtttgcctatgctctttggtgatagatttgcctacggatgcaaggtcatgccaagcatcattggagtaaaaaatgagaagaataagagtaagttcgactggcactgccacttctcttatgctaatgattctttctgcacctccaactataccctggccaagcaattttccattataaaaggtatgtgtaggtcacacatgaggcttttctcgaaaaaaacaaaagatatgtggtggtttactgaaggtgtcagcgataactgtcccactgttgatgtacatcctg

SEQ ID NO: 26691 - DNA, 1214 bp, Oryza sativa
acaaagaagataacacaacattctatttattcacaaacttgcatcatataaaagagattaaatagctgtagtattccacctttcattccaatttttatgatttaaaggagatcgagtgattgtagtatgccaccacaacatatattttccgattcggtttattcatgagattaaattggacttgtgtagaattaaaagagtaactaaaataattgcatatgagtgtaggatgtgcacctgcttcacgatgatgggatcatccctgctacgattcacaacataattaagcattgaatcaagatgatctctcactgctatgtacccatatatctgtactgggccactatacatatgtattttagccaacttaattgagaaaatttgcatcatgcgagttgaaaaatgcacagtgcatgtatccctattaggttgacagtccataggttgtgaaagcatcatcggctccaagcaagcttcaccaaagacaactaaattaatacatttggcaaatgtttgttataaaaaatacagatacgctttttaatacatatttatgcaaaattacagaaaaccattgtctgatagaaaaaagttatatatggtttgcaatatgttcaacaaaacttgaactgatttgttctgaccagagttacttcatttcttaatagcccacacctcaagataatttctctggaacatccgtagtacatttatatttcaacacaaaagaacctcaattcttataaagagctagcataacaaaataggaaagagaattcaataacttactctcatgacgatcagcaatttgaaatacttggataaaaccagggcaaaacttgtatatagaaccatcacggtggctactgccttctaatattgttgcaggatgtacatcaacagtgggacagttatcgctgacaccttcagtaaaccaccacatatcttttgtttttttcgagaaaagcctcatgtgtgacctacacataccttttataatggaaaattgcttggccagggtatagttggaggtgcagaaagaatcattagcataagagaagtggcagtgccagtcgaacttactcttattcttctcattttttactccaatgatgcttggcatgaccttgcatccgtaggcaaatctatcaccaaagagcataggcaaaccttagcatctgactcatatatctggcgcaaatttattccaatac

SEQ ID NO: 26692 - DNA, 1339 bp, Oryza sativa
ggatagaatgggagagattagggtttggattcgaattcaaatttgatattcaaactcgagggtttagggatgtatcaggggaaactcaaggagaagtcatggaaaagattcaaaagaaatacttgggtatttgttctcgggaacatagggtggagtcaaggaaaggattcgaggcgggatttgaaaaattctggattcgtagaagtatttggcgaggattcaaaggaaggatttgaatttcagaatttgatttcggagactcgaattgtaaggggaatttggatgagggggaggattttgatttcgatgagagggaacaacgggattaaattgggatccttggcacaacttagactctcacgcaaagaacgaaaattttcgcaattaggattttgccgagttagtttttaacgactcacgaaaagcggagcgttacagatccacccccccttacaagaatctcgaccccgagattcgaaggtggaccacacacacgaaaccaaaaagggatcttcagacttcttcacaacttcagactctgctagtctttctttatctcgagaatgcatacttgccacaaaacggtctggtactctgactcacttagcattcttcatcttattgtggctctgctcttgcctgtggaacctgttcttctcctgctctttcaacctgctcgagattcacaacttttccatttgtttctacttgcacatggttcagacgaccttgtccaacgggcggtgaggtcaacgaggcagaaccactgtttggtggctttgaactttttggtccagatacgttgggaaggcttgttgtttgttgaacttgttttgacttgactttctgagggcacttcatcttggctttctgagggcaatcccacgaatagtgtcccatctcatggcaggtgaaacattcgactcctgccttatgaccacgtctttttgaaggtgtagggcatggtacggagttgcttccttcatggctattactgttgatcattgtggcttgctgaccaggttctgacatagtcgaaagagacgtagaaccggaaccatttgaatgctgagatgctttctgatagtattgtgttggcgagtttgtttttcgacacaaaccttcttttgcttggatccctagggacattactttgcgtctcttgtattcttgcatctttttcttttcttggatgtcttggcacatgtcacaggatgcttttgctcttttgtcatcagggaaggttggacgtactgcattaacattttgcaaattcgggcttccttggggatagaagggcatccttgaggtgctcatattagcttgtagtagtgcatcc

SEQ ID NO: 26693 - DNA, 1501 bp, Oryza sativa
catgcggatcgatctgacgcgtggactatacagctgcatggatgtagattgatcgaggtggtcggccggattgaattagaccaagcgacgtcgacggagatcatgtgccggcggctggttgctgcaggtcacgtgtagctgctcgccgatccggaagtccaaacagcacacgaccgatcggcgcgatatctcgatctggcaggcgctcaacgctctgatgagacgcgccctccgtcctccttgcggcggtgatgcagcccactgcgacggtggatgacgcgcgtgtacgatccggtcatgttgatgattgattccatcgcactttaccgacggaaactcgacgcacccctacctggcgcgtcatctgtcgaaacatgaattcggcaataataaaagggggtagcgcacgagacctagaagtggatggatgcggagacaaaggatttagacaggttcaggccctaataccctactcctgtttggggatttgaatccgccgggtgtagtatagatctgacgatctagttgtgtctcatgccccctagagggcctcctgcccaccttatataggatggggagcaggattacaagatagaaaccttaaccaatacggtatcggtacaatattatcaaatcaagactttaggccgctccataatataaaagtaaacgtaatacccaagttatgatctgttacatattccatagatataagctatcccctaaaactagtcggataaccatgccgtatgggttagggtacccataatctccacagattgttttggacaggtccatacggactacccaagtcattataccaaaaagagtaatttgcatgttgttgaacttgcttgctagcgcaatttactcttttatatagaatgtttagatttttaccattccattgccctccatcactcgtgttttttttattttttttctagatgcaatagtcaataaaaaatacattaaaggtattttctaagacattaaaaaaagccacaaccatagcaaaccaaggaaaaaaaatactatctctttccatacaattggtgatccttgaactcgatgcctcttgctctaatcataccactcttatgtcatatctagttacttagggtcgattaaaattccaaaaagtacctctacaggaattgaaatacctcgagaatatgcctttacatattagtcaaattttaaagtgttgaaaaaaacatgcatttacaagataaatttgagaaaatatgaataaaaatatctctaaagtgtctctacattaaaaatattttaggcaacatttaaagtgtctttaaaaatatatacacctataactcttgattttacaaactggttaggttttcttgtggtggaaccagatcaccactcgagttcaaatcctagactatgggtgcttgtattttacggctaattattccaccagggtacatatgttatacaacgtgtgggtgctatcgataatgcaaatgggtgtctatag

SEQ ID NO: 26694 - DNA, 1501 bp, Oryza sativa
ccgtaaaactcctctatatttatgcactcttgtgacgaaacattttgtgctagctcatgtagcaaatcatgcattacataatactgactattgcgatcagttaccttcatgaggaaaccattacctattagctcatccaaatacttcaatcctattgcttcagctctatcgttttgatatccagaatctataatgcctattgcttcccaaaaacaagtaatttctaaattattaaaccggtggtcctcagggtaaagggcgcaatacgaaaaacacttttttagatagtaaggaaggtagtcgtagctaatttttagtgctggcataatgtcaacgttactttgcagatttttccactcatccatttccagaacttctgtccaacattcatgggaaaggttgttcttcaataaacgatcaacagtttttgctgctagtggggaacctctcaatttctttgaaatttctttcgcaataccaatcaagtcgcgtttgtaacactcaggtttgtcttgaccaaatatacactcttcaaagaatgtgaagaattcactatcctcgagaccctgcagttgtattgtctcggttgttttcaacatttgtgctatagatggaaatcgagttgtgacaagaataacgctgcctttggcttccccttttgtgaatggagctactagatttttccactctgcctcactaccgcatttccacatatcatccaagacaagtaaaaacatttgtgatttcaatctttctgcaatagctttttggagctgatccaaattggaagagttatgcaccgcttcgcttcccgcgcttttatcgtgaggtatgcactttaggatctcctgagtgagcctaagcacatcgaaattagtagacacacaaacccagaccttgatagggaagtaggcatctgttcttttgtcattgtagaggtgttgggcgaaagttgtttttccaattcctccagggccaactatgggcaaaaccgatagtgttccactcggaatattgcagttagtcaagtcatgaagagtttgtctaaagattatttccctcccaaacaatttatcctgcgtaatcgttgagctagtgggaggccgctccagggatgtatcccattctcctgcagtttggttaatttggagcaatctagatatacacgtacacaagtcatgtatgccctttaccactgacttgattttattggacatgtctactcgattgaatggcaagttgccaacctggtcaatgacgtcaccatgggagttggctgtatcttgcgagtcgtcggcatcatgtcgtgctcgtgcagaagaacaaaaaaagcatgaaaaccagttaccggcagtatgacgaagagcatggcggccgtggagggcatgacctcggaggccaccatctgcctccggtatgacctcatgggtgccatcaatctgatcctggatgatgaagtagtggatctcgtccaatgcatcctcggcctcgtcggctttct

SEQ ID NO: 26695 - DNA, 1021 bp, Oryza sativa
agtgttagcttagctcctcttatcctctcctgcaatattaatattaccatttgcaagttaggaggggataaattaaaatttctaactcagttccttcttgctcacatcgcacatagctccatccaaaaacacacctgcagccctgacattatatgttgtaggagactttggtgcacaccgacaagtgtgtccttgtagtacgtttacatggatatttgttaaggcccatttgagtctatgaagataaaagatcaagtatgggtacgtaaaatgaaaatgctattaacacataattaattgagttttttaaaacataaaattttgatttatttatatgatatttcaaagcaacttctatatagagaattttcgtacaaaatgtaccgtttaacagtttgaaaagtgtgctaacggaaataaaagtaaaatctataacttaaatcaaaaaataagggtagggcccgaaacactatgtagcaacagtactcaagtccatcgtagcgctttatcgtaggtacattccatctaggacatcaaaagcaattcaagctgtggatttgtagcctaacctgcgggtatgcttttccctgatggctggccggaagcagagaggagctgatcactcaaacagattttctagactagttttcaatgtggattttagttttaacaatcattttggatggtgaaagaaattgaataaaccgttcccatatcccatttttctctccaattgttctaatatttcttcttcctattatacgtcctcctcatacattttgtcgatgaggctgatcgatccctatccatctctccttttaagtgcatgcatctattgataactttttttttgttcatgccgtcaaacacgatcgaaaacacctaattcttttcagtaataaggagtcgcctaccacctcaatctaaacaaatccaaaccaagatgggttttgaagatcaaagctggctaatggagctgatttagacagaagagagataaacacccatctcgtgagcagaa

SEQ ID NO: 26696 - DNA, 577 bp, Oryza sativa
agggtttatatagggttggaagggggagagggcggccggaggggaaggaaaccgacgcggcgctctcaggctccatcaatggcgccggcgggattaggggagggtttccaaacgaatccaagggagagagggagggaaaattggggggaaagggagagggaatcacggggaataattccccctattgattgcacgcggggaggacgggatgcggcggattcggcggcggcggcggcgcttggcgcgggcggagcggcgggatcggctggaggaaggggatgacgggtgggccccacccgtcagcgagggtggcaggcgggcccgcccgtcagcggcgcgcgcgcggggggaggccggatgggccgcgggggagaggagagagggggagggagatgggccggattcggcccaagagagggaagggggatttttagggtttttctttttataaaacattttcaactttgtttatttcttaataattactatttgtgctctgaaaattccactaaaatttatttacacattttaggcttttaggaaatatacaaaaatcctctaagccttatttgacttt

SEQ ID NO: 26697 - DNA, 1501 bp, Oryza sativa
ggggcaattcggccactccacccaggtaagaaaataaaaagaccagactgtgtgctagtagcagtagtactgctatttttgtgtaatatgtggctatgtgctagtattgaaacgataagaaacaatggggctttatactttatctagcaaatcaaagatcgacgtgatcactattatttcttttgttacaattcaggctagttctaaaattgagtaggttttagtatatacttcctccgtttcacaatgtaaatcattctagtattttccacattcatattgatattaatgaatctagacatatagaatgacttacattgtgaaacggagggagggagtaacttttttgttgttgtaaatctacacaagatttatctaaattcaatagataattaactctattacattaacgtaaacattgcttgctacctgatgtagatacatcatacatggtgctttggacaaccaaattaataacaggaggtacttaattaatgacaaaaagtaaagacattgaaataattatatcttcaactcaccgtaatggacaaaacatttaaaatagcccgtttaaattaagactagaattattttgatatagatgtatttagcgtaccattttacatgcttcttagccatttattagaatttaagttagttgaaaattatagagaatcaagggacctatttagtagagatccggcttcaattctcaccttaggccaaacaatttcagctccatctggaaaaagagggtgaagcgggctctcataaaataaactaagacatgaagtcgggtttagactgtttcataactccattccagatctaattcttgaagttaaacttataatttagagctctatcaaacatatcctacatgtattcattcatagcatgacgtattagcgtttattatagtgcaatatagtcctctctccgtcccacaatagttatcattctagattatttaggatggattaaggtttaattaaaaaatttataataccccgtattaaataatatctaatgagaagtgaaaaggttattgagggtaaaatatgaaaatttttgaatataaaatgatttatgggacaaccagtactctatattaacaagtactatttgagaacaaaacttaaatagtattataggacggtatataagtattataggacggagatagcgtttttttctattcgaaatatttcaaaacggggagctatgctccgttccgactgcaaaaccgcagtcggcggaagacaacagaacaaaaccggcgttgagaaggggggaggggcaatcccgtcattccacgcgagcccgagttgcacggcaccaccaccgccttcttccttcactcgacccgaccgccgtctcgtccgtctcccccgcttcctccgcctccaaaacccccccatcccaacccgacctcctcctcgccctcccctcgcgcttcgcttcgctccgatccgaccgccgccgccgccgccgccacagc

SEQ ID NO: 26698 - DNA, 1501 bp, Oryza sativa
ccgcacgctgccgcccatcgcccacgcgccgccgcccacgcccatccccacgcgccgctgcaacgccgcgcccatcgccatgcaccgccgcccacgcccgtccccacacaccgttgcaatgcctcagtagcggcctcgctgttaaaggaggaagagagaggaagagaaagagatgagggcaatttggtcatgccatgtaaaaaagtaggccccttctcgcttagtcagcacaaaaatattaatttaatgaatgaagtgtcccctagcaaataaccacattttgagagtgtctttccccaaaagtgacttcgtgcggtgccctacagctaaaaccacaaagtcgtgatatcttgtagcaaaatttgccaaaaaaataattaatctaaacatataagttggccatagctgtatacagtatacgtaacatgtaacttgtttttgtttgtctgcaaatttaaatggcaaagtttcataattagttggagttgaaaattatattttgtatagctgatttgattaccttaggaacattacaaatggttgtccacaagcacgagcagggaaagtctcctactacagcatatctgacttaatcaattccctggaagaaacaatgcttttgatctgttcttcacacgtcttcctgaccaatttgttaaacaattcaataaaaataccttctttacctatatgcacactctttttctgctaaatattaattgctattgtatactagtagtgcactatacttactttatactccatcatgcagataacccatgagccagtactggtgttttactactctgatctaccagctatttggttccttgatgtgaatgtaaactggaaggagcaatgcaagaagcttccttttcattgccaatggcactggttgaacatgctcttgtcttcctgtagaagtgttgctggcatttgtgatttctgtacttgattttactgataaaaagtgtggatcatgcaatttattgataggggcaatgtttgccggttgaaaaaaatgagatgtgatttgttaattgtgatcgttcgggattacaatttaaacagataatatgctttcagagaggagatcgggtaggttacatcaaaaggaattattctcttgtcatgaaaattggaattaaaatgtacgtagaatcgtgtgttcagctggtagaaaatgctaccagataactgatgcaacagaaacagtagagtttcaagagctattagtctaagaataattgatattgtgcaagaaacgtgattgtccctgatgaatttcaaaaaagaatttttaaagcacctccagagcttcacactgccaagaagctctctctgtatcagatgtggcacatctagcttgattagaaactagaaaggttaactccaagcagcagatctgcaacacccgccaaggaatattttgatggaatattttgcttgcttatttgcactcttggaattaattgataaaggaaacaagctatgggcctaa

SEQ ID NO: 26699 - DNA, 1501 bp, Oryza sativa
agtatggtctgggacctaacctgttgttggtctgggacccctcttgttggcatatggtaaacctgtgttggctttcgaaatgccttgtcatgaaagcctcaaggtctccagacgtggccgttctgcacgggctgggttatccgggttagtaatgtcgtgtgggtaaagtgtaccccctctgcagaggttattaaactgttcgaacagccgtacccacggtcatgggcggatgtgaggtgattcctagcgtagttttgtttgactactgctttgtgaaattgctgttgtggaatgggatcgatgtttggaaaatctgcggctgatgggatcagccaggcccgggtggccgtttgaaagctgttggccgggtgccaaccttgaatcaattcaaagactgatatattgcacatactccgaccagacgagacgcactgtctcatccgtgtcgtttgagaagcactcacttagctaattcgaaaaggagtttaaataaaatcaattgcaaaaacaacagcctttcccttgaagcctgcattaaacacctaattcccatggcttgctgagtactcctgtactcacccttgctctatataaataatcccccccagttgctgaagaagatgaagtggatcctgctgatgaggagttcttccaggagcaagtcggctacgatgagttttagggtttcggcctagttcccaagtcacgcctatgatgattggtccaagtcttggcttccgctttccccttttgtaatgcagttgtgagctcgggatctgtccgcagcccaacatgactgtactcctactctgtaataaagagacctctgttgctatgatattctgtcttcctgtgataccagcattgtttcctgggactggtatcgatgaacaggttaatttggagcgtcacgggctagttccgttcggggctagttcgggacgtgacaaaagatggtatcagagcacaggcttggccctagggcgaaacccgacgtttaggacgaccctaaggatactaagttctacttgcgaaaagctaaggcttccttttttgctttctttattttcaatagtttattgctaaaatggttacttatctttcctctccctttcaaaattgtagatggcagtgaacgccagcttcagttcccacggttttggtgagggtcaccacgtcgctcagcttcgtgacctcgcccgcttccttggcttctcgtgtcctgagtacacggggtactctgtggaccgtgttccctctcgttatgagctttcggtgtacctttaccctcgtggaggtatacacggggctggccttcgcccacaccacttcactgtggccaggcccactctccagatcgcgtaccaggacctctcctagactgcacttcgtcgcttggcccacgactacagccaccgcctcgggggctctgcctttcggcagctcctgcgccttccttctggccgcactgacactaggtacccttgcccgtacagcgagt

SEQ ID NO: 26700 - DNA, 341 bp, Oryza sativa
agtcgaggggccgaagcagaactgccatgctgcaaactgaagcagaatcgtttgcagcgaggtggagcgcatcgaggaggacacgctgccgactctatcggactagatctgcataacgaagaagagtagatcaggcgatagggctagatctggggataccagcaatggaaatcttgtgaatttatctctagcttgttccaatctctgcatttgaatgactaattagagcgattttctagctattctatgccagtgtgactcgatttgtgtgtgtcgcaatgttggctgtttctgaaaagaagtctcggtctttgcctctgatgatgacatctggttggcca

SEQ ID NO: 26701 - DNA, 1246 bp, Oryza sativa
cacagaagaacaggaagaggcacttcagctcctcacctccctccaatgcctgaaattccggaagtgccttcgtctgcagtccctccccgaagggttgcattgcctttattctctctataaactaaatatcgctggatgtccggaaatcatgtcgctgcccaaggacggcttcccggtctcattggaacgtctaagaatacgagactgcagcatcgatttaatggttcaagtcaaggaattagaagcatcaaacccagatttacatatacggctccactagcaaacttaccacccaaggtaaaacaaggtgctctcccaactcctacatcttttttccccatttcgtctctaacctttcgaactaactaaaactcgttttttattgtttgttgttaatgatgtagctatccagcaccattgcctcatctggaacctttcagagttcttccatcatcgtatagctgacaatgtaaatgcgaattacacgacaacacatgaagataaagagctctggatggcagagcagccactttggctttcagacataatggatgtcctttgtctattatccaatcaatgttatattgatcattacaattttggtaacttacgttctctgtcattacacttctttccatctcaaactgcatggtgaattttggcaggttgcagctgcgtgatatcgaaatccacctgcacttgtatgatctgtacagatccaatagcgacattttgccaatcagccgtgctggttttttttagaaaatagattaaaccggcctctacatccaaaatagatacacagccaggccgtgctggttagtaaatatgcttatgtcgttttgctatttttttctttttggactgaaactagtatagtattgtagaatgtcccgctcttggtcttactttctgcttattactagtagagtgctcgtgcgttgctacgggaattttgttgatcacgggaaaacaaaatctggcaatccaaaagaaactacaagtcatagttgttctaagattaatttaaaagcaagatatatgttataattacagaagcgtagtataacctttttggcgcataaaacaatctcatggcgtttattaaattataaaaagcaacataaatagaagacagctaatctccaggtacgctttcttgatgaccctcgcacggacaatccaccattttcagtgtatgtgatccatttgtacctcgtggaaccgaacaattctgatgtgacca

SEQ ID NO: 26702 - DNA, 1501 bp, Oryza sativa
aactaagtgagtgcttctcaaacgacacggatgagacagtgcatctcgtccggtcggagtatgtgcaaggtatcagtcttttgaattggtcaaggttggcacccggccaacggcttttaaacggccacccgggcctggctgatcccatcagccgcaggttttccaaacatcgaacccaaaccacatcagcaaatttcacaaaacagtagtcaaacaaaactacgctaggaatcacctcacatccgcccatgaccgtgggcacggctgttcgaacagtttaataacctctgcagagggggtacactttacccacacgacattactaacccggatcatccagcccgtgcagaatggccacgactagagaccttaaggctttcatgacaaggcatttcgaaagccgacacaggttcaccatatgccaacgagaggggtcccagaccaacaccagattaggtcccagaccatactgtgccaggaaacccgggggttctccccgacaccaccccgttgaatccacatgtctcttggcatcatggctccccccgtttagctagttactcagccaggggtgtcccattccacccatgtggtcgcacttgtcttatgttcggatgaaattccaaggaaacggtccttaagtgcaagagcgggaaaccgtacacccggtacgttccccggtccgtgattttggaaattcatttagttcgtaagcaccgacccaggtgtcgggttttccaagtcttttgtaaaacccaagttttacccaaggtgtttctcagtttttaagtttgaaggcgaccgtcgatactcgtgcagagtgcacgattactgaggcgcaactaggtggttacaagggaacatgatataacgattaacaaaggaaggatcagatgcaataagctaggtaggcccatcggtctgccttgcagacggggcaatcctatcaatgcataatattttgcaagcaatataattaagttcaaatataggctcaatatgttcaaaggtggcttgccttgctcgagatcttgagcttgatcctcgaaatccacgcactgcgggtcttcgggctccgaaactacacgtgaaacgggacaactcaacaaacggcgaaaataaagccctattattaacctctaagcgtaccattagatagatctcgagatttgaggaattttggaagttgaacggagtcaaacggtcatacggttgagaagatattgaatttctaagattattggatttttgatctaaaggaaaaggatttaattaaacccttttggaaaagaaaaagaaagagggaggggaaatagacttccctcgggcggctagggcgcggcccgagagaaaaaggcgcggctcggccgagcttaatgggccagccggcccgagaaggcggcccaaggcacgcgcgagaggggaggagagagggagccgatgggccgggtccttctcgcgtggtcccaagtgggacccgcttgtcggtggctcggctcac

SEQ ID NO: 26703 - DNA, 1501 bp, Oryza sativa
tgatcttcacggggaatggttggtcgcaatgcttgttccataatcttttgtttgaggaatgaactaaaactttggtgccacttttgttcagtgcacagtactttctttgagctatacacattccccttggtgtgtaactgcaaccagttcactctagtttagatgtctagctgatattaccataatatagttgttttttttttaattctggttgacataagagcaaggataatagtgagctataagcaagctatatgcttatgtggaagagagagataaacaaaagtggggagtgttggctcttatgcaagagctaactacacacaagctccaagaaatatgcattaaattcatagtgagaaagagagaggatgaaaaaaataaagataaccttatagctaacctattatacatgttagctttaacattgactaatactccctccgtcccaaaaaaagtgaatctaggactgaatgtgacatattctagtacaacgaatctagacatacaggatgtgtgacatccagtattacgttggttttttatgagatggagggagtagtaagtagtgagctctactattaaacttgctctaagccttgttgtttttactcagtaacatacatattgaaatattgaatttcacattcatatgccctagaagtgaaccaaggtttggagaacttgagtggagccagcctaaagtgcttttttttttctcttgaaatttgtctggaggtttattagttatctcctaaggaagaactatttagttccaaagtttgatggttgttctcattcttatctaaaatatcttctatatcaaccaaactagagaattatctggttccctctctgtactgaccactttttgtgattttaaggtccatgacatcatcccaacttcattgctactgggtttttgagttgcccatatgtatttatgtacaattacctgcaaaatatctgtatggtggttcaatattttaatagagaatgagttatgatttgcaacagttttttttttcttctgaaatgttcccctaagccttcctacttttgatattctctataatcttgtcattgtattatttctgactactcaaatgtgtatccatggtaaccatagccttaaaattcttttatgctgcttcgtttgctttgttttccctgtcatttgaactgcattctgttctgcatttgagcacatgacacacaataggtgtgcgtgctgtattatccatgaaatcttagtcctgcactttagagaacttctctatttttactgtcatcatgtgaagaaacagtactccaagatcacagtgagacaaaatatatacgtattttctgtatatatgttgtagcactcaaaatgtgtgatgaattttgtggcagtattggcattcatctgttttgtctttctcatgtagcttacaaacttgtttctttcatgaacacaacttactaacctgtcatgcctatttacttcaactactgcagg

SEQ ID NO: 26704 - DNA, 225 bp, Oryza sativa
atcacttcgggaaatttataaatatattatattacttagtccatggaaattttggatattttttcttgtatttattattacacaaataaaaattaaacataattacatatattggtatcgatcggtaacaaacttatagagaaatgtttaacaacggtgtctactactagtagaaattaatagccgctcatcttttctaattacatggatcatatctatttatac

SEQ ID NO: 26705 - DNA, 1501 bp, Oryza sativa
aggtaaactcgtctaagatgcttattaatatttcaacagaaatttccatagatctgaccaaaaaacgattcaacgtcgaccgaaaatatggaatctgatggagtaccaaagagtgtacaagcaaaaatgaggatataattaatatatatatatatgtatatatatatcttgcattttgcaatcataatactgtttgcaattaattatctaagcatagtggaactagttaatgtttatgaatagattggtcgaataatatatagttttcatgttaattgccctcaggtagccgtttaaatggttcgaattaatgagcttaagggggaataagtattattagagagaaattcaaggaggagatcaggatctgatccgaccatatgtatacttcctccgtactcgtaaaggaaaatcgtttaagacaatgtttaagtcaaaccttacgaatataaatcatgaataactcttaagttgttgagtttgaaaatataaaaattatatgaatagatttgtcttgaaaaatactttcataaaagtatacatatatcactttttaataaatatttttatagaaacaagaagtcaaagttgtgttttggagatcgtgtcgctgttcaaaacaacttcctttacgagtacggagggattatactcctatgtaccaacgagcatagatgtggacagtgtaggtaagaaacttacgttttctacaagtacctgcaaattaccgtgcaattgtgtgataacacaaggggactctcaatttaatcggttaagttgaagtatatacgtactagcttttcttagaagatggtaaaaaaaggcaaagaaaaaaaaaagcatgccctgcgcgcagctgcgctttattaatttgatgaaagaaatgcatacgccggaccaatgtacatggatcacgcacactttaatttataaaactatatgcatgtgacaaatgacaatcaacccaagcaagcaccgagcacatctaaacaaatcataaaattaagtgaaagaaaactaaatatgatttcatctatggtgttaaaaaaataacctaggtttgtgtatagaaactcgaaatatctgtcaaattaactgtggttaataaaagaaagacttgtttaaaggtggtgctacactaattctgtgtgttcacatttgattaattaagtcatgacttctgtgtaatgagtcctagctgttataattgacttggtagtatttgtgacattacttgcatgtaagggcaatgtagaaggacaaaaaatattggtaattgtctacacttgatagtcttcattcctacatttaaaaaactcaaaacaaagttaggagaaatattatattcgttacagttccatttgcatgttagctaaactggagtcatgcttaaccgtggttagattattaacccatcaggatactttgtggattccataggcatgcatatatatatgcctgtgaattataagactaccaaatatttattgtatcgtttatt

SEQ ID NO: 26706 - DNA, 175 bp, Oryza sativa
tctttacaaaatggctttgggcaactaagtgacttttaaatgctgtttactgcaaaacttaatccctatattattattcccttgtacctcccttgcattaatcatgcatctgccggtgtggcttgctgagtactgtggttgtactcattcttgctcaatccttcccctcttcagt

SEQ ID NO: 26707 - DNA, 247 bp, Oryza sativa
cttatttaaataaattccacacgatttatgaattaatctttagcctatgtctgagtgtgtgtaaataacatagagctgcttcttgttataataggagtatagcgctatgtctgagtgtgtgttaaggagtaactcctggctagcttcttgttataacaaaaagaaatccccaattaagcaaattaagctctatagtgtagacacagcagcaactagctaataactagctagctgatctatcaaaaca

SEQ ID NO: 26708 - DNA, 1501 bp, Oryza sativa
gagttggagctgttgcaacgcgggctataggactgcttcgggatgcatggatgacaattcgctgaggagcaagcttctgattgcagggagttgcgtggactgacgtgctggcagctatgtctctcggttttgggtacttgtcggcgaaatgacccattccttgacaattgaagcaacatatatcttcccggactcggcattttcttttctcattttgattcctctgtcctggcactggagttaggctgaaactgtaatcttggcgaggatttgtgttgccttgatgcttctctccgttggaactggcgggttggttggccatcttcttcgtcagcagcaaactgaattgacaatcttttggtacatgatcagttccttcacaaaagaaacaagtgatcctgctcgttggacacctgtcgggtggatggtcttcctcacaatgaacgcatgtagtggcacacgagctggcaacatgaccgatttctccacaacgagagcatgccttacgttccattttattctggttgaaaccttggggagacttctcatcttcatcatctgaggagacttgatctgaatcttcactatcagacactctacctccattagctaaaagatgctctgtcaactgtggtgcacctcggaaggtatttcttctctgacgttttgtcattcctggtggaggccattctgtgctggtaatgatcatcttacggacttcatcttcagttcgcattggtgtttttcttttctgctgaggaccctcctgtcacgtcctgataaattcatcccgaattaaaaatcattcgctaaaaggaataatagaattaattaaaattcgaaaagaaattggcaaacactaaaatacgtgcaagaaaaattcaaatgtggcccggagaatttttgttaaattctccttggtctaaaaggagccctcaaattttacttgaatttttatagcaccggaaataattattaagcaacaaaaacaattaacaaagtttattaaaaagaaaaacctaaaaataaccctccttcctcctttgggccaagtctggcccaaagtcctccctctctcccctcggcccgcggccgaagtctcccattcctccctctctttctctccctctccttctctccctcctcttgggcccccttcccctcggcccagcaccctcctccctctctctcccgggctgtctctccccccccctcccggcctgcccggcccaagccgcacccccccctccaggccgagccgccctcccgcccgtgccgcgcgcgtgcgcgcgctgacgacgccgcctgaccgcgtggggcccacgcgccaggtcgtcatcgtcttcctcccccagccggccttctctctctctctctccccggaaaccaagcgccgttcctcccttaaatccacgcgaatcaatgcccttctttccaaattgattaggggaaattaaaccccattgaatcctcttcaattccccccaatttccctcttgaa

SEQ ID NO: 26709 - DNA, 1501 bp, Oryza sativa
aggagttcctggaagatgaaggctttggcgtctagttcgtgcctgccgtcaagcgtctgtggtcgtcgccctagtcttccgctgtttcccgtttgtctttttgtgtgctgggccttcgccgcccatgtaataaagtaactatttatgcttccgcttgataaactctgaaatgtatcatcttttggtgtaccttgcctcctgggacaaggaataatacacgcacgtaaggaatgcccgttgggttatttccggtcgtgacaagttggtatcagagccagcttgaccctaggacgagccttagatcccaagccttagcaatattttcaaaataaaaatcctttcttatttgtgaaaatcctctagtctctctctgtcctgctgcttcatttatcgtcaaaatctgacctttaaaatgttgcttttctcttttgtttttgtttgtagatggccggcagcatcaaccgtcgtggtctggacctgactggtttcgttttggagctgcggggcatgtgcgttgtcttggggtatccgcatggagtggactaccagggcaagcagctcctggagcaggaaggtgacgatgcagagccccacgctgcctaggaggtcactgcagtgatcctcactggctcacccgagaggacttcgttggcagtcaccgcgggtggagattccttctccgccgcttgccagaacgccgcactcctcgccatcggcactcttcaccagcgctacccggacgagttgcagcactcgccctaccgctaccaccctcgtcgcggaggagcccgcgactacgccaccttccaagatgctagctcggaggatgacgctaccatcatgcacctggcgcgcatggtggaggcgtacgacgcggcccgtatcgacttccaccagatggtgcgccgtgggttggtcaagaacaacatgaagatcctggagctgcgtcaggagaatctgcagctgaagaaggacctagacgcggtggaggcgcagctgtgtcagctcaagatcgcccagggagaggtctgtcgccccaagcgccgtcgcgtctgccgcagccagaagatcaccgcccgcaagagtacctccaggcccaagcttgttcgtcagtccttggcatggacctgtttcgtcgagacccctcgtgccgagcccgcgcccgtggttcctcaggaggagggagcctctggcgttggtagcacggagggtgcgctgctgctcaccttccgccctggcccgtcgcaaaagtagacgagcagttagtaggcttgcgcgtgtgttcttctcgtttgtttttctgctagagtcgtgtggggcatggttataccggtgtgtggtataactgtgtcggagcctgtctttattttattggcttaagcaacttgaaccttaatgaaccaatttaatagcagtattaaattcaagaattttggtagtcgtgggtgattagctttaatagtctgttctctctcttggctggttctgtatgggatatttc

SEQ ID NO: 26710 - DNA, 1060 bp, Oryza sativa
cccgatccaaagcgtctattgaccgtggtcttgcgtacgtggcacaccacgtggacgataatatggtgttttttcctttccccttttctttttcctcctattcttttatcttcttcctccactaaagccacctcgagctcccccgcgtcgaacaggccgaagaagagagaaatgaaagaggaagaagggagaaaaaataaataaataaataaataaataataataataataataataataataataataataataataataatgtgccatgttgtcgtttacatgtcatgccacgtaggcaagaccacggttaaacaacgctttggatcaggatgatacaataaatcaagtttagagacctcaatgcacactttgcaagttcgtggacgtagataaaacctgcttgtatatttaaggaccgctagtgcaatttactcttataaattttgaatccatgtttgataattaaatagttcaaataatctataaatgtgattatttgtattaaaaaggtaagcatgaaccactacaaagatagcaaagataatatttgtgtttaataatattgacgctgtttttgaaatgaacatcaaatgtttcatattgttatagcaaataaaaagttataacattatagtttagtttggaaggctatatatgatctagaaaaggtaaaacaaaaccgccaccaatataacgctgtaacatctagtcattgtgacttgttggagtgcgaggaaacaattctagactgcattgccatcaggcaacaggtaatccaactgtccagacatggcattttcagactagtacttttctacattgaacgggactagtgcattagaaaattttactagcgacgaagacatgatgtggttgatttaaagccgcgtcctaatattccatctggcatttttttctaccgcaacccaagtcatgttgactcagcaggatgcgaatctagcaatatacaagtgagaaacagctgaagaggagaccaaactaccaaaacggacaaagtaattctacagatggatagaatcaaatttatttgatgggt

SEQ ID NO: 26711 - DNA, 1501 bp, Oryza sativa
aaaaaggaaacataaataggggatgtgtggggtggcttttataggcggtggtggtttagtgggcccgatggcggctagggcagtgtgcgcggcagaggaagggtggcggctagttagggtggcggcgctgtcttttggagaggataaaaacaacggtaggtagaattggatagggatacgaccagcgtgaacagtgtgaggccgggtatgataagaaaatgggggacgcggtggccgatgcagcggcggcgcgagttcgaagatgggtataggaaaggtgtgaaccggaaacggctcacgggtaaaggagggagaggaaggaattttgtttaattgactcctgatgatttctttggtttataaatgttaccacctctgctctaaaaattcctctaaaaatcttgttaatgcatttaaacataaggaatttcgaagaaaattctaccatgctgattcagctaattcacaatccagattaacataaatgttttctctaggtaatttattaatgaattagggaccaaggaaaaatgggaaactttcgggtgtgacaaacctacccctaaacagaatctcgaccctgagattcggaagagctgtcgaagagttgcggatgggcggcttttaactcatcttctgtttcccaagttgcttcgtcctccaagtgatgactccaataaactcggcagaatctgattaccttgtttctagttcttctctcactggttttggggcgagttggcttctccacatacgtcaagtcctcttggatttcgatattatcgggactcgccccctcaggtacttttaaacacttcttcagttatgacatgtgaaaaacatcatggatgctagtcatgttgggtggaagctcctggtaagcaacttctcttcttcgttccaagattctgtgtggtcttacaaagcgtggtgccaatttgcctttggtctgaaaatgatgaactcccctgagtggagtgccacgaagatagacataatctcctgcctcaaaactaagcgctggggcctgggtgggtgctgcagccgcagccactggtggtggcattgagcctcgacctcggtggccccgttggcgtctctagcgtcgcagtaggaaaagagggccggaggtggggcgtggtgccgtcggtggccatgcggcggacgatggagaaggccatgccggggtagcggcggtggccatccatcctcctcaccttctcgtctgaaaactggcttctgaaacacaggatcaggccaaattttcttcttcttcttcttctttttaaatttataaccatgcagatgattttcagcaatcacaaatttaatcacccaattctgtagtgcaatgagacattgatcagcgatgcggtttgttgttgtaatcacatacaagaacattttgttcgtttttgctccatgtgtagtggttcaaactgcgatgggtatcgaggttgctcttctgaatctcaaggtactgtactgcaatgttcagagg

SEQ ID NO: 26712 - DNA, 216 bp, Oryza sativa
agtgaagaggcaactcaagcctcggagtcctgaaaagaagatacctattgacccgtgctatgaagaacttctttaagggaatgtccacaacaaacaaggaggcctcacagatatcggactatgaccgaacacttcagaaagcctatcacaagaagtccaaaccaatccctcagcttggagaacaacaaacaaggaggcctcacagatatcggacta

SEQ ID NO: 26713 - DNA, 375 bp, Oryza sativa
gtgattcctagcgtagttttgtttgactactgttttgtgaaatttgctgatgtggtttgggttcgatgtttggaaaacctgcggctgatgggatcagccaggcccgggtggccgtttaaaagccgttggccgggtgccaaccttgaccaattcaaaagactgataccttgcacatactccgaccggacgagatgcactgtctcatccgtgtcgtttgagaagcactcacttagttgtttcagaaaagagtttaaataaaatcaattgcaaaaacaacagcctttccttgaagcctgcattaaacacttatttcccatggcttgctgagtactcccgtactcaccattgctctatataaataatccccctcccagt

SEQ ID NO: 26714 - DNA, 437 bp, Oryza sativa
ggtattacttcttgaataagaaggcctgaacctgtataaatccttggtctccaaacccattcacttctccagcttgatagccacccccttttattattgccgaaatctagtttcgacactttgatgtgacgggatgatgttgatgcccaacaaatagccatggcgcgctatcttcttttttccaatttctttatgtatgttgggtttctctagtttgagttagctgctctgatgtcaaaatggagggatatggcaccattctgataaccgagacagagctagaggaagttaaactctggaatgcttccatttctctactggaaatgggggaggttgtgacattgtgtcctccctttcttaaagaagaaaaacaaaaacaaaaaaacaatcagccgctagtggggttgcttgcattgaagcccagctgcaagccacaa

SEQ ID NO: 26715 - DNA, 1501 bp, Oryza sativa
tctcgcggtgccgcctccgtcatcgtcatcgcagcggcgtgttccacgtcgtcccgtctccgtgcagccactgctggctgtccctcatcgccccctcgccggccccggtcgtcgtcgtcctcgtcctctcgtcgttcccgatcgtcgtggcgttcgtccctccgtcgagccgttctcgtccgtcgtccgcgttcgtcaagcgagccgctgcagccccgtcctcgtcttcgtcctcggctccgcgtcgtcaagccttgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccgtcctctcgcttccccgtcctcgtcctttcggtgtcgcccgtgctcgttgtgcggttgtcggccccggtacccgtgtaccggtgtcggtagtcgttcacgcgtgcgggtggtgaccgtgtagtgtccgtgttagtgtgcccgctcggtagccgcgtgatttccacgtgtgcaggccgtgtggtgtttagtggagtccgtttgtcggccactcgcctcggttgacacacggggtctgcttccgtcgacccgaggaccgtctctgtgtacccggtctaccgcggtcctttaggttgacatgtggggtccgcatgtcaacggcgcagccttcctgtcttttccaggctagcgcttacacctgttttatagttgcaaagcttaattataataatccgcaaatctccatataacagcattaaacttcggatgatcatatcttggtcatgcgagctccgaatcgacccgttcaagtctcttaatgtttgatataacctaaagaaccctgtgctttctttttatgtattgttattgcttctttataggcttgtagctttgcttgtgtgcttcgcgtagctttcgtcgttccggaggttcccgaagcgtggttcgtggttgtcgccgaaggttcggaaggccgttctctctgagcaaggcaagtcacatcatccttgagcatattgaatcccagtttataaaattattttgatttaaattaatgcatgatcgctttatttaaattcccgcgttatcactgttttatttagccatgcctatttacctttgttaagacattattattgctactgttattattaccttgttcaccctaggataaacaaaaccccaactagtgggtactctattcatggttccactagtatgaatttaggtagatgcttcgctgattaataggacaacattaggtggttttataattttagactttgggaatattcatatcatttggacactatggaattgttggtttatggtggaattggacatacacctctcttcctctttcaaaacccctaaaacatgttttcggtggggtttgggtgcatgccagttgtgggaagtagcaccccggccactataaggattaa

SEQ ID NO: 26716 - DNA, 1079 bp, Oryza sativa
atagatcttgactctattttaaacatgtttttattaatgtcttctttgcgtttgaaaccagccttgagtttgcgagaaaaactttgtcacgataatggaataatggagtttgttcgtatctatttatactatatttgattttttaaccaagataaagtgcttcttttaaatactaccacaataatctccagagcaccgtattattgattatattttgacaaatatctataattttgtgtctgtttttttccataacctattgttcataatcatgaggcaccttattaatttggagaatgcatctatgtacagtaactaatttattgaagtatacttgtagtcacgtcaatagggtgtatgacatacatccatcaaattattgctgccatgtttgaattcctcaactataagaaaatatataatgagtagtttattccatatgttacttgattgtttatttattgtcaaagctatttggcaaagaaaaaacatacatatatggccagaaatctcatgatcgattaaggggttgtattatagcaagatcattagcttgaaatatttttcataatttttttcacatctatgtaatatttatgttgcccacttctcggatactaatgaaatagttctgaaaattcaaaaaaagagaggtaagaatctattctcaaacaaattaaaattaaatcagatctacttagaaaaacacattgtttcatttattttatatatgtagatttaaattagctttgtatagtcgtcaagtgatatttgatgccttaaatatgatgtgaaattatttaaaatattatcataacattgattattatatgtcagtctatgtgttgtgatgtatttagaacatagacatgtatatcggcgtcgagcgtgcgccacttcctgtagtacgattggtgtccgcttgggaaactaggccggcgactgagtagagcacggcgccagctagtgcccatgccggtgacgtcgttgaataacatatgttggaagaaagttgcaaatatacttatattttcaaaaatttacatttatatacctgcatgagacggatttgtaaaagt

SEQ ID NO: 26717 - DNA, 1501 bp, Oryza sativa
tgtgtgatgagcaagggcactatgcaaggaactgtcctcagcagaaaagaaaagcaccaatgcgaaccgaagatgaagtccgtaagatgatcattaccagcacagaatggcctccaccaggaatgacaaaatgtcagagaagaaattcctcccgaggtgcacaacagttgacagagcatcttttagctaatggaggtagagtgtctggtagtgaagattcagatcaagtctcctcagatgatgaagatgagaagtctccccaaggttttaaccagaataaaatagaacttaaggcatgctctcgttgtggagaaatcggtcatgttgccagctcgtgtgccactacatgcgttcattgtgaggaagaccatccacccgacaggtgtccaacgagcaggatcacttgtttcttttgtgaaggaactgatcatgtaccaaaagattgtcaattcagtttgctgctgacgaagaagatggccaaccaacccgccagttccaacggagagaagcatcaagatggatgaagtcgggggtcgatggacattctccagggcaaatgaaggctacacgagctgcggcccggtagtcgagatgtcatggcagagggttggtgccctgctgctagggtgctcagtcctgcctgcctgtcccgggtgtcccggccgtagggggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtaaaacctattcgaatagccgcgccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcgtaggccttgggttaaggcaggttcgtgtgggttcacggccttgattaataacattgtatagctctaggatcgtgtttacaaaatagcttgagcaactaaatgtctttaaatgctgtttacttcaaccctaacccctctatgttataattcccttgtactcccttgcatttattctgcacttgtgggtgtgtcttgttgagtacggtggttgtactcagtcttgctcaatttttcccaagcccagaagaggagctccttgaagatgaaggctttggtgtctagctcgtgcctgccgtcaagtgcctgtggtcgtcgccctagtcttccgctgtttctcgtttgtctttgtgtgtgctgggccttcgctgcccatgtaataaattaactatttacgcttccgcttgttaaactctgatttgtatcaacttttgctgtaccttgcctcctgggacaaggattaatgcacgcacgtaaggaatgcccgttgggttatttccggtcgtgacacac

SEQ ID NO: 26718 - DNA, 1005 bp, Oryza sativa
ttttcttcgattaaacggcagaggagcacaacgccactgcacacggaacaccgcactcgcatcttcacgaatatatgtgcataatatttctgggcataatattcgttatgaaaactaaactcattatgaaaacttatttgtatgtgcataatattcgtggacacctagatttaaaccacccaatcagttgcgctttccaattttaccacgaaattttattccgtcttgtcctaattctgttgccagggcaagattggtcgtcgtcctcgccgccatggcgccgttcttgcagtccaagtgggcgacgcttctccgaatccaaagtaaaaaaacaacacagacacacataaaacacacacgaattggttcttgcgattaattcatatcggacaggaacacgatctgagattcgttggatggccgttaattgcaggcgaggtggagatggtgaaggacgcggcggagacggcggcggaggtggtggaggaggtggccgcggcggtggagaaggcgtcggcggaggtggcggaggcggagcagctgccggagcacggggcgctgcggcgggcggcggcgctggtggagcgcgcgtccagggaggtcgccgaggaggctcatctcgcccacgacatcatccacaaggttagtactaaccattaattaatccttatctgatcacagttttgcagcttccataacagaggagtaagaaatctgctattttgcccaacactggattactgaaaacgatggtactccatggctttaagcaacactgaaaccctgacctttatgttgcttctactctattctactaatgtctccgtcccaaaatacatactactacaatgatatagataatttaacatacattaagactttttatggaaaaaaaaggctatattggcacttattaaatgatgtggatagtggagtgatattcgagagtatatcataggaagaaatttaaatgaaagatgatgcatgagataactaatactttag

SEQ ID NO: 26719 - DNA, 1501 bp, Oryza sativa
agtatatttatagcatgttttgagtgcgtgctttgtttgtcgtatagaattccgcagttccgaagctcccgtttattatgaagtggtcactaaagttcctccagctcaggagcaaggcaagtcatacatacgcattgatcatattgtacctattttgtaaattcctcgcttttttcttaaaatcgcattgttttataatgtcacgagggatggatacgtaatgtaactcagcctttgttattctatatcattgatagcttgggatataaaatgattagatgattggtttaggtgatgcttagccatgcttagatcaattagtacactatgggttccacacgaattcttagtccttaatttaatgatggaataccaccatgatattaattaaactaaaacatgacaaatggttggttgtgggtccatggttttgatagtagcaccccatggcaattaaggacctgttcttgggaaacactggaggaattacccgtacttaccacaagtcaacgtgggcaatgattggatttggagtgtagcttctttctaaccgagtaccaacgatagggtgggcgtgatgaagtaggatgggtcctgcgacgacctctgctacttccaaatccacctaggcacgagtgggggttgtccactgctggtttatgggtgggggcaaaacctgatgtgggtgcgatttgttaggaagggttatatgaagggtcctgtcagaacctctttccaaggtagcatggtggtattgaggcgcatggtaccatgtcgtgggctgtcttgtgggtaaagttgtatacctctgatcagagtaaagctattcgaatagtcgtgcccgtggctatgggcggtcaaccagattcactgtgattagtctcaccttaataatttgatatattgaactggtttagtgttgggcatgtttcaatgtgatttagcgttgagcagtgatgtttaatattgattaatttatatctactattttactatattcaaattgtgatatgaaaatgttgcttatgcaaataacccatagctctcctttggtattattctgcatcgtgccttctattggttgttgttatggcttgttaaatacagtgggtagtactcggtcttattttatttttcccccaacacttagaagcaaagtattattcggatgaagattattgggaagagtaggcttgttgcggtcttgcggacgtcaaggatgcctgtggatttggagacgctatgttttcccaagagatggatgattagctaattcgattatttatttccgctgcatatgtaagacttatttatatttttgtaagacatggatctgtgtattaatattgtcgtttgtgtatcttggctagtctggacagagatttcaatacacattctgcttaaaattcggatcagcgaatttttggacgtgacaggctactagctgggagtctgggacccctgagctctagctcctgcccgcccgtcgcccatcatggca

SEQ ID NO: 26720 - DNA, 1501 bp, Oryza sativa
cggttcacggcggacggccttgatgacgccagcaatgacgtcaccgacggcggcggcggctcggcgaggcagacggctcgggcggcgcacgctcaccggcgaacggcggcaccacggcaccaacggagggcaccagcacgtagaggacaacacggcgaacacaccggtgaccaaaacggcggcggagaaggaacggacgacgacggcgacgagaaggaagcggcggctaccttcgggttgtcgacggcgacgaagctccggcgggttccgacggctgcgaaggggcggacggggacggcggcgacttggcgatgacgacggcggtcttcccgagcgacggcgacggctggaacgacggcggcgcacggctgaagcggcggcggcgaaggcaaagctagggcacacggcgctagggctactccggcgacgagaggcgaaggcgagggtggcggcgagtagaggagacaccgggggtccttttaaaggggctcggaggcgacggcggaggcccacggcgacggcaacggcgaaggaaactcgcggcttggagagaggaaagccgatccgattcgaactcgaatccatcgatttccaaaccgatttagccgaagtttccaaaggagaaaaggtagaggagatcccgaagatcatttcccctctatcaattcagccggaaacggaaaggagcggccggattggaaagcggctgtcgcgaccgggaaaattgccttttcccgaacgctagtgtattaatccccgtcccaggaaaagccggggtacaccacacaaacatgatataaaagacacatctttattatatcgacaatatttacattattacaaaggcacttaaggcctgacaatcaaaaataaacagcagcggactagcgggcctacggctccatcttcacaggcgctcaactggggtataagccaggactccccctaagacatcttctccaaagcttctcttactgaagaggggaaggattgagcaagaatgagtacaaccacagtactcagcaagccacaccggcagatgcatgattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacataacccttcacccatcctagc

SEQ ID NO: 26721 - DNA, 771 bp, Oryza sativa
gacaaagtttttctcgcaaactcaaggctggtttcaaacgcaaagaagacattaataaaaacatgtttaaaatagagtcaagatctattttaaaaatatcatctacatgtaaacatttataataaaaattcaagcaacactatctagttcttttaaaagaccagagtggtggtgatgagtaccaccgtcatctaacatgtaggcccatgaaatcggtggaccccgcattccccacatgagcgttctgtttgctctctttagttttctagccgtttgaaatttgagcaagatgagaagcttcacgtttttatgaagtgcaccacttcatccaagtaaagataagatattttttcctgaccaagataactgataattatatttttatcttaaataaatcgttgcaatgcacgaatattttacttgtaaccagataaattggatcagggtttcggaaaggcaaagtaccacagcaaatcaatcataaggaggaaacaacgtcgtccatcataaacctggaaagagatccatgtgaacacgatcaagtgaccaacgacgggtgcagtataaccaaaataatcaacaattagggaagcaagcggaacgggtttgcaagcttcgaggcttgctaatcataggattacaaaccataaccacaaccacaaaacagaagtgcataacagagagtatctaaaaataatatgtgcataaaagagagcagcagtaatagacgcagccggctgcgagttcttttcacccccatttctcttcaga

SEQ ID NO: 26722 - DNA, 392 bp, Oryza sativa
ggaatttaaataaagcaataatgcagtaatttaaatcaaaataatttgataaactgggattcaatatgttcaagtatgatgtgacttgccttgctcgctttcccaaacgccggcttcaacttccacgaagagcggatcttccgaagctgcagcgtctacacgaccaacggaaaagaaaaggcttttactctaataaactccatacaacaagcaggaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaattaaaaaatcgggtttattgcgtcagc

SEQ ID NO: 26723 - DNA, 1501 bp, Oryza sativa
tctgtctcacagattttcttggttcctgtgcttaagctggctgcaagcttatagcccgtttctcatctctctcatctcctctcttatccacatcagtatttgatcttcttacagccctctattatatttgctctaagtgcagttgtgggttcatatgtctaacgtttcaacatctgttttatttaaaaaaattataaaaaaataagtcacgcatgaagtactattcacattttatcatctaataacaataaaaaatactaattataaacaaattaaataagacggtgaaacgttggacattgaaacccacaactacacttaaaatgatacggggaaataaattgagtaaattgcaatttggaccatcttttattattcaagttttagtttggacactctgtatttcatcttttcactttgaactcaccagctgatcagagttgcgcttagccatcgttgtagtttttttttctccttttccttgctgcagcttttgttttgctttttctctcttcccctggtttggtttggaccggtctgcgggtgaagtaaaaagatgaccggtctaattaaaccagggaaagggagaaaaagagtttttgttacaaaacgcaatccaaggaaaaaaaaagtttagaccggtctggctgattgcgttgtgtaaaaaaattctttttttctaatatattggcgtgcaatttttctgtgcgttcgcgagaaaacgttgaactcaccctacctctattgagctgcatctagcctctcctctagcacaattgttaagattaaaaacaatttacagccggtcacaatggaagtggcaactcgaagagatttcacagagctgtagcgaccggagtttgattttttttttccggtgcaaaagttttggtaccaatggaaaaggtcccatgttgaaccagattattgtagaagattatccatacgattatatatacaaattaaatatattgataaataaacttaatgaatgaataacttagaatgagtggatctaaatgtataaggaagtttctttgtagaaaatatagttttagagaggtagggaacgactaattcgtgacaacaatccaattaagttgctggaaataaccatgcctaaattctcccactaaatataacttatgggcttcataggttgataatatcgaatagaccattatgggctgggccgtacccaatcatcatggaccagctctttttcgttttcgagattctttgtccctgtaatcagtccatcgtggtgagattagattccatgattggacaaaagtgtgttaatctgtacgcttatgagcttttgtggtacgtttaagaccatatttcaagcgttcgatatattgtgagttcatgacctgtgagcagagtacattttacggatgcgtaatcctaagtaagcacatacggagtatattgtaggggagaaaaagaaacggtggaaaagcatggaactaatagcgtcttcgggaaaatggtgcca

SEQ ID NO: 26724 - DNA, 1501 bp, Oryza sativa
tagcgtaaaacactagaaaagaatatattagacggtagtctagtatcatagtgttacacacacacacacacacacacacacacacacacacacacacatatatatatatatatatatatatatatacacacacacacacacacacacacacacacacacacacacacacacacacacacacacacacacacacacacacacttctcatatgtacgcagaaaatatactgaaaacatcatataagatcggttggttggttggttccaccgtacccacatgcgtgtactacaccaaaaagtgatggcaaaatgtggtttagttaccaacttttttactataacccggtggtggaatcagctgcgtcaatatatagttgctcgagctgccacaccaaagtatgtgggatgctagtgttatctagtcaggctctacaaaatttctacatgctagttctatcgttggttatccttatctggagaaaaactcaccattatttgatcctaggttcctaacacaagcatagcaaatcaagttcaacaagctagcaagcttacacatcctcctaaaccacaaaaatacaaccactagacactagtccacaatcatcaataaacaattaaggagaaaaagccacataaacattcaaggcaagaaggaatgttttcctcccacaaacctctctatcaaatctctctacatgcacccctcttgccctgcccaattgcatagaaaaccaaagattaattgaacactacaaccccctaattagctacttgcaaatacttaatcattgggtctcattcccccaagcacaaaatccagccacccccaatctttctcctttgtgggaccttcatgtcgtccttcatttcaatttcttggctatagctaccctaaccttggctctttgcttgctccaatttccactctataaaacccctccctagcttagcttagcttcctccatctccattggccacccaccaccattgtcttctcctcccatattcttcacctcgctcgtcgtcgtcttcctcccccgccgccggccggtgcgggctggtgttcgttcacacttaccggccagccaccgcacgccattgctggcattggaaggtgatggcgctggaggcggtggtttactcccacggcggccatttcggcgggtacggcggcgggctgatgggcggcgccccggcggcgccgtgggatgtcttcgcagccgccggtggcggcgggagctgggacgatcccggcctgttcgcggcagaggcgtctcttgatgtgatccagggcgtggatgagtgggaggtggatcaggatcagcatgcttcttcttcttctaaggtggcggcgcggccgcctgtgaaggcggcggcggcggcggggaagagaaagaggcggcgggcgaaggcggcgaagaaccgggaggagatcgagagccagcggatgacccacattgccgtcgagcgaaaccgccgccgccagatgaacgagtacc

SEQ ID NO: 26725 - DNA, 727 bp, Oryza sativa
cccaggcaccggcactgctccaccgatcgtcccagctaccgattctcttccgcgggtgccacccgcagcagcaccttgcacgccatggccttggtggctcgcaccgcctccgagcagatcgatgccgactgcagcgccctcgtggctgggaggtgagtggagtggataaggacgcccactcggcccttccctctccatatccactcgtgagtggccggctcggctcagctcagcttggttattacgtgtgttggtttctttaaaaaaaccaaaacctataatatattataggtatcggttttttattaactaacacctataatatattataggtgtcagttttttaaaaaaactagcacatatagtattggtgctagtttttctctagaaccggcccctatttcttcccaaaggtgtcgattctaaccgatggtgctctgtgggtatgcgtttgtggtgggaaaagcactataggtgccggttttaactgtttcaggacctatagtgtcgtatcctttgtgtgtttctgtagtggttcaaaaatcaaaatattgtagtatatataattacctggtatctagttgtattgtagtagtattgcgccaaaatttactttttgtgcatatgaaaaatgctcactacaagatcaaaccatttgaggttggttggttaggttggtgtgtgtatccacaatgcattattgccccgaaaaaatggtagcaaaagt

SEQ ID NO: 26726 - DNA, 1501 bp, Oryza sativa
acagatgtaaattttgaaatgtgggtttgatctgatttatcttctgatggtgcattgattttgaaattcgataaatttagaattgatatgaaaacaaataaaaagattaccctttgggcgtaggaaggtggcatgagggagcggagcacggcgaggtactcgttcatctggcggcggcggtttcgctcgacggcaatgtgggtcatccgctggctctcgatctcctcccggttcttcgccgccttcgcccgccgcctctttctcttccccgccgccgccgccgccttcacaggcggccgcgccgccaccttagaagaagaagaagcatgctgatcctgatccacctcccactcatccacgccctggatcacatcaagagacgcctctgccgcgaacaggccgggatcgtcccagctcccgccgccaccggcggctgcgaagacatcccacggcgccgccggggcgccgcccatcagcccgccgccgtacccgccgaaatggccgccgtgggagtaaaccaccgcctccagcgccatcaccttccaatgccagcaatggcgtgcggtggctggccggtaagtgtgaacgaacaccagcccgcaccggccggcggcgggggaggaagacgacgacgagcgaggtgaagaatatgggaggagaagacaatggtggtgggtggccaatggagatggaggaagctaagctaagctagggaggggttttatagagtggaaattggagcaagcaaagagccaaggttagggtagctatagccaagaaattgaaatgaaggacgacatgaaggtcccacaaaggagaaagattgggggtggctggattttgtgcttgggggaatgagacccaatgattaagtatttgcaagtagctaattagggggttgtagtgttcaattaatctttggttttctatgcaattgggcagggcaagaggggtgcatgtagagagatttgatagagaggtttgtgggaggaaaacattccttcttgccttgaatgtttatgtggctttttctccttaattgtttattgatgattgtggactagtgtctagtggttgtatttttgtggtttaggaggatgtgtaagcttgctagcttgttgaacttgatttgctatgcttgtgttaggaacctaggatcaaataatggtgagtttttctccagataaggataaccaacgatagaactagcatgtagaaattttgtagagcctgactagataacactagcatcccacatactttggtgtggcagctcgagcaactatatattgacgcagctgattccaccaccgggttatagtaaaaaagttggtaactaaaccacattttgccatcactttttggtgtagtacacgcatgtgggtacggtggaaccaaccaaccaaccgatcttatatgatgttttcagtatattttctgcgtacatatgagaagtgtgtgtgtgtgtgtgtgtgtgtgtgtgtgtgtgtgtgtgtgtgtg

SEQ ID NO: 26727 - DNA, 1501 bp, Oryza sativa
ggtcactggctccagagctgaccaatggctccgaagcagatcaagggctccggagcgaccaggggcccaaaatactcaagcatggagaaatggatcacgagcgtagtggggcaccataaatacgcactatgcgtctgccaaccacctctgacatcctaacaagggcaggcagcatccgctattatccgggggcacgcctttacccggataatagccatcaccctcgggaagcgtcactgcttttgtcacctgggattttaccgattgcccaagggctggcccatcagccagccaagttacatctgatttaggtagggcaaagatgtaattccctcttgtatcctgtatataaatatgtaagcattgcccaagttggaggcagattgaataaagaatacacattgaatacgttgtttggactcttttccaacagtggtggctctgatggtggtagcggcggctctggtggcggtggccatgacaagagccacataaagtgcttcaattgtgacgaatttggccactactccacgtagtgcccacaccctaagaagaagaataccgaaactcatcttgcgtagacgaaggatgccggcccagctttgttgctcgccatgacagaggcggtgcagaacacgccgcgtcaaggcgtgcactgtgggctggtcgtgcacgaggaccatgtatggccgcgcctgatgctggcaggcaatggcgccgccgccggtgatgtctggtacctatacaatggtgctagtaatcacatgaatggagatcgtcgaaaattccgggagctggacaaaaccgtgacggggcaagtcaggttcggcgatgcctcatcggtgcagataatagagaagggttcaatccttttctcattcaaaaatggcgaccagtggctactcgacgatgtctactacattgccagcctctgctgcaacatggtgagtctggggcaactcaccgaaactagccaccgagtcatgatggatggggatgacctcgaggtgttcgacaaaatcactgtcgattggtgatcagggtgagaagaaccgtgaacaggttgtatcgcatcgagctgaagttggcgtcccctgtgtgtttgctggccagtctcgactctcgacgacctggtgtggctctggcatgcccggctcgggcacgtgaacttctaggcgttgaagcatttggtggacaaggagatggcgacaggggtgcccgcagtccaccatccaaatcaattgtgccaagcatgttttgtggctaagccgatccggcagccgttcccagcgattgccaattatcgagcagagacaccgctcgagctgctccacatggacttatgtgggccgatcaccccatcaacactggccggtaatcgatactttatgttgatcgttgatgatttttctcgttggatgtgggtgtttgtgatcaagtctaaggaccaagcgctcacggcattcgagaaattcaaaccgttgccagagaacatggcagg

SEQ ID NO: 26728 - DNA, 278 bp, Oryza sativa
aattcctgcagcccgtgtcattgttgcatgtcctatatcatctttagttttggaaaaatgacaactcgaatgacaatattattagcctcaatatttacgagcatctgaatgtgttgtggatcactatatcatgactccaccacgtacacagcttcaagtagttctagattagaacttacaggaccgtctataatagagtcctacatactatataaaccagtaatatgtgatcgagttacgtacgctggaagtagataattaatcacgaaagagaaaaa

SEQ ID NO: 26729 - DNA, 1501 bp, Oryza sativa
ttacatattttttgagtgtcctgtgataaattttgcctatatttaaagctgcttggtccaagctctatgtaccattgcagggaggcccggagtacagggttaatttgcaattttaggctcaaatttcatgtccaacggtaggtctaggttggatgtgtgcgcgttataaaattgagttttttatttagattggaaaattttgttcagattcagcaaacaatagctattcaaatttcaacattttctttaattttctgcaatttgataaatttttaaattttacaaacctacgcgcaaaaagtacaactctgctatctcactttagcactgtagtcttttgcaacaagaggttggaaaaaaatgttctgttcaattatgttaatagattttatttttagtctaactgcatcttaacccatctgttaatcataattggacttggaggacatcatatgtaccagaaacagtttatgataacatcatatgtaattttcagggcaacatattggcttcgacggtgggcccaactccaaaagtgtgaggaagatgaagaattcatgtctgctgcatatcgtaaccttgagtcaacggttatgcaacttttaccaaccatggatacggagattcaccaatagactggaataatgtttttcttgtcatgttaggatttcttttatttttggttggtgtgcttgtttaattttggactgtgcctttttagtgtgctacttcttgtaataattggctgtatctctcatgagcaaaggccgggatgtttcattccattatctagaaaaatgtcaatttcaccctttttctgaatttaattttgacaccatcaaaaaactgttcatgctcattaaatcaataatattcacaaaatacagtctgaatattttgtttctgaaagagaatgctacctgatgttttcaaaacaattgaaaatatgaattcgaaaggttcattgcacatttaattagatatgctaacagaaccattcttataatattcaggtttactatcgttggcagcactaagtgccttgcattttgaacacataacagacagcacacataaagctttcttatgacactttctttagagtatatacttgagttaaacaaatgctcccaatatcacgaaacatttatacatgatatgctaactataacatcaaaaataaaatgctgacaatgtgcttgtaactcactacaatataatgttacggtaacattttgtttccattattactaacactactggagaactgatctttgctggatcggctgaaaaccacaataattacggtttcagaaagaaccaggactaaaaatcatctttagccccggttgaaaaccccacagccattctatgatctttagtctcggttgggaacaccaactgttactaaaaatcatttttagccccggttgaaaaattgtccgtccccctactctttttattcccgattggaaccaccaaccgggactaaaaatcggcg

SEQ ID NO: 26730 - DNA, 1501 bp, Oryza sativa
atgtgctagctctatttcaacatatagatggacataatccaaatccaaaaggttgtttctttttgtgaaactacagcatttgtaagtacttgctcaactaagactgctactatcatgatgttctctacttataaaagctctatttgattttttttgtttgcctcagatcgattactaactgacatacgatgttatatttgttctcatcaaagatttaaggcgctttcaaccttgcaagctgccctttatatgtatcaagctcactatattgttctaattctttcctgaacaatttaatttggacgtactacatgaaaacagtaccataagaacaatcacacagaattaaagcggtataaactaaagtatgtagtacatgttataggtattatattctccttgttttttgtaggataagaaaccttccaaaaaggaaaatttaaggtatgttgttggtatagtactatatatatatatatatactattcttatgttttctaagaacattttgtttcttcaaggacaattaattatgtggaccaattgttttgatcagcctatgatataataataaatacatttgctttccataatacataaggtggtcaatatatatgttgcgaacagctagctagtcatcaaaaaaagttgtagggactagggccggtgacattgtaacaaaatttggtactaacagaaaaggaaatcttgctgttttgtgtagatgtattattagcttcaatttggtcatttaatgtattttgttttgtttgtttcatgatgtcttcaattaatatacatgacatactttcactatgaaatctcgctgatttctcgtgatatttcgctatctcggtgcctctagagatattattaccctggtaaaaaaatttgagttcagtcaatttctttttatttattgattaaattattcaaaccacttctaattcaaataaaatatgataaaaaacaatttctctcagcgagattttcatcaagattttgacatttcacgagatttcgctgtgtcaggccctcccaagattttagtctttaatttcgttttattccagtagttagtacatacaatgacaagaacagaatgtgctctttaagtatttaaggaaaaagtatatgtttattctgctaaagaaaatctctaactaaggaacttctctcaaaaattttcatcccactttcctgtcgcttcgctccctaatggtatctgttttttttttcttttttctatttgtgcaagtctatgcatgccaagtctttttttatgttgtagttttgtggagcaatagaggaaaatatagggtacaaaacaaaatactttagaagttatgcaagaccactttcatgcattttcatatcttgaggatttaaacatgccttcactgtaccaatctatgatagttcaggaaagtgaggcaaataaaaaatcttttaactgtttaaattttcagcgaaataattcaggtaaataaagcttagcact

SEQ ID NO: 26731 - DNA, 1501 bp, Oryza sativa
cgagaaaccgtcggtactccctccgtttctaccccctgcttgccgcgaaggtttaattagaaggaaaaatgtgcatcgtaaattatatataagtacaatgtaagattaaaaactaccgtaagtaaaaaaacagatatttgaagtttgttcacgtcaatatgagtagaacttttacctgcagtacacctctacaaatactcctaagctacaatggacataataaattaccataattgtataaatgactcttctattttttagctatcaaccaaatatataaaaataataataattagatagatattcataactctcgagtatatatccaatatccaatttttaatttgtttaaactattatttatttagatgttatcatatgtttctgtacaaaaattataatacgtcacctggatatagcaaacccaagaaaagaattatcagggcatcacttggatatataccctttcttttaattgcgatcctagcaaaaaattatcagggtactacacatataaattatgtaattgttgattgatatatattgattaatatgacatgaatatagctagaatcgaataatctacccaggaaggtgaatgtagaaaggccaatgtatcttttacataccaatcaaacaacaataagatatataaaaaaatgtacatatattttatcatcttaaaccatttaagaaacatacaccgtgaataattttcatataaaagaataatttatctagtggtcacaatgaaacattaaaaataaaataaacatgtattatgtgatcttaagttattccataaaactgcatagctatattagatcgatggtgttaaaataaaaattataaatgaaactatgaaaataaatttatgcataaatttaatttatctaggtccatactcctacactttaaatgtcatccaaattgtcatacaacatatactgcatcatcatacattactttgcaagcatgcatagaaaaattagatatataatatgtaagtgaaaagaacagatttaactatcaataacataaattataaaaaaaatattgtacctttagttggatgcaacaatatctaattaattatgtcttttgaaatatgctcaactgacgagataaattaaatcggctgatttgtatataagaattctaaaatatagtatacattatcatttaatggacttaaaggtaaaagaaacaaatgaatattactatggcttctatatcttttagatataaagataaatttgtctattttatatgcgtagaccattaaaaatgtgaatactcctatatatgaatattaataggcctcgagcatgttcattgttcctatgcatgcataaccaacttaaaaatccatttagattttctgatataatttactatgtatgagtattaatattatttagattgactatactttttcttttaactactgtacgggtctcacgtatcatagagaaacaatgtgtagggtaaatatattttt

SEQ ID NO: 26732 - DNA, 1501 bp, Oryza sativa
caagcaaatcatctgacaattgcaccatctatcctaaaataatttggtttgcacagatgaaataactataagccaaattatgccacaaacacacttctctctcttgttgtgaacattggtgtgtggcactgtgagatcatcgacagtcagactgtcagaggcatcagcagcatcaccaaggtgtgtttagttcacggtaaaattagaagtttggttgaaattgaaatgatgtgacgaaaaagttagaagtttgtctgtatgaaagttttgatatgatggaaaatttgaaagtttgaagattggaactaaactcggcccaaactacataatttctctactgtcacagggagatcgtcgacagtcagactgtcagacggtcattgagtacaaatttgtttatgaaactgatactgcaaactagcttgtacgtactattgcactaggtacagcatcgtgtgcaatccctgaaaacagcactcagctcgctggttaggtttgtctgcaatctagaccacactatcacgggacatgatgaacctcgtggaaaccgagcgatgctgtcgagatagagaccggacagtagttacagactgcaagaatcctgatgccttccatgcctcaagcacaatccgggaggaactgtcaaatgcatgcctgaactcattgtgttgacatgttgtttcataaaggaccggtcgatagtgtatttcatttttcaccaccaattcccttgtagtttatatagctagctagatggccaactaacatgatacatatttagttatttttgttattttacagtccttaattagaaattatcagaaggtggcatattttttaatatttacactaaattctttcttgcctatcactatctttgaaggatcgtaaaatttctcagttcatgccaactaatttttattgcgtaaagtccagttactttcctgttacagctaagttaccatattccacttcttgcactactggagaatgcctcttctctcctggttcacacccccctgtagtcccgggttacaaaccgggagaaggaatccaggactaaagatagcgatctttagtcccggtttaaatacctgggagtagagatgttatcaaccgggactaaaaatcatctacaaattaagagggaaaaaggaaaaaaaaagaaaaacatcggccggccggccctaatcgtgcgcctggccactggccgcaccctctgcgccgctgcctgtcgtcgagcgctgccgcccgccatgcccctccgcgccagccgccgcgcggccctccgtgctaccgccagccgcgcctccccacatccaccgctcgctccactgctgctcgagaggataggatagagagaggaatgggagagatagagagaggaaagggagatgataagaaaagagaggaggaggataacggaaaaggtggttgctagaggataagtccgagggaatatatattatgcgccgatttttagtcccggttggtggttcca

SEQ ID NO: 26733 - DNA, 914 bp, Oryza sativa
ttgattagcatgtgatgtgcatgtgtatagtgagtatgcataaaacatgctatgtattcataaatttaatctctactttatcctttatcattgaaatgatcaatatcatatatttctaacccttgtatcgttgctcaactttcatatctttctctacaatcactatgtcccattctataaatttttactgaacatatgtctgtctaaatagcattctcacatatgtgtgtgtgtgtgtgtttacgtagtatgctaattaacacatgaatcgacaagattaatcaggcactcctccactcttttcctaacaaaaagatatctttcatcttttcctctctctagtcactggaaacacccattgcaagtcttgcacaagtcaccttatccattttcccctccaatctcccaccacaagtcttgtaagtgcagttcgatcatgtttctgccaattgccttcgatacatagtgcttccctcaccatcaccatgttggcactagcaagacccaccagtcatcccctcccaactacctccctctcctcttcatcttacatacatgatgttatcatctcccatcttcatcaactcggcactagtatcctcacactcccctctttgaaaggttgatcagtggagatcttttactgctatatcctaactcccgcttgcgaaccacatagaatctctcacacttgccattaaccccactcaccaccctcttcttcgtcctcgcggctccagcaataatatcacttgcacctgatcacctacccgtctctgccacccaagctttccctctaaacctgatcttatagtgccccctaccaagggaaataatccggcctagggctatactaataactttgtttatttaaatttgtcgacgggggataaccgcagactgtatattgaggg

SEQ ID NO: 26734 - DNA, 294 bp, Oryza sativa
aagaaatggagtaaattgtggtttgggagtaagatttttaccaaactttcactaagactacccatatctaatattttcattgaaagccatgtatatttgtccccattttctttaccatggtatatttatccccttttgcactttggaccaccctctctccatctatctcttctccacctctggttccctaccaccaccattcggaccttgattgacaaggcgtctgtgtgctccttttctcttgaaccgcgacattcttcctcccaatcccatttctccatcatgcctcttagc

SEQ ID NO: 26735 - DNA, 1501 bp, Oryza sativa
atacatgtctctttctacctatatatataaaagaatggtgcttcatgtttctctggcgacaatttgttatggtctggcatttcattagtttaatttgcacagaacatcttttaaaatactacctgaatcagtttatcctttttcttcaagtctacaagaaggcaaatacaaaaacaattattacagatacatctatattctatactatcctgtacattttgaaatggagcagaagaatccaatggtgtgtcttgatttccatggtaacaatttacagtgtaagaaagtaaataggtaagttaccatatgtaaagttattgttgagcgctggatatatacgtgcttctatcctgcttcagttttataattaccagaaaatagaaaaacaatgtacagttggcctgtagagcatcatttaacaacaaatttatatcttgcctccaagttaaacaaaattccacaattgcagggatctttgtttcagctcaatggaagacctgactgacagctgaattctccacaggacttgttgcattttttttaattgataatcaaatttgacaggatttcattagctgtctgttgacctaggctgtcatttatcttcatccaaatcagaccgaaaaaatgtttaattttgtactgccagaaacagcaatcatcacagcaatgaaacaactgtagacatctcaccatttacataatcagaatctgaataaatttgaagcggttgcaccaagatggaaatggttccttcagttttaatgtttgcctgctagttcaaaagatttcgctgcagaaacatgaatgcattttgttttttgctttgacaacctaattcatctgttgatcctctgtagcaaagcatcgaccagacctgaaattgtactgcctaatgtatgagtatcggaccactaacaataacttctttcatcagggtcagtatgttcccccaattaagctaactcccacatcttttatcaatccttttgcttccatatctgaccgcagtcgctcgtaatcactccatttgcccgctgaagcatagatgttagagagcatgacataagatcttggatttccatggtcagattcagtgagtattttcccaacagattcaccaagtttagaatttccatgaaacctacaggctccaagcaatgactcaagcaaacttttggatggtctgaatggcatcgttgtaacaatatcatatgcttcatccaagtgtccagttcggcccaatagatctaccatgcatgcataatgctccattcttggtgtgatgccatgatctgcaagcattgatctgaataatgttcttccttgctcgagaaatccacttcgactgcaggctgataaaacactaacaaaagttatgtcatcaggcttgattcctgaagataccatcatcaagaaaaggtcaagggcagacccaccatccccatgcatactgtaggcattaatcattgtactccaagagacagaatctttttccatc

SEQ ID NO: 26736 - DNA, 187 bp, Oryza sativa
aaaaaatctggaacatcaaagtcccccttaagattagaaatctttttttggctttttctgaaaaataaaatcttaactaaagataacttgtataaaaaaggctggaaaaaaggggataagttgtgtcagttttgctgtagggaggagacccttcaacatttgttttttgattgccctcttgcaaaga

SEQ ID NO: 26737 - DNA, 816 bp, Oryza sativa
gtttagtcacatatatacttatcaaataaaagcctttttccgggctttctcaggagcatattaatcaattttacaatttttttgtgtgtatgagtatagaaatcctattaatatatgaaaaggagaatacaaccaaacaccatgcaggacacacaattagcataatagaaaccgcctcatcagagcagtgatactactttgaatcacaataattcatcaccgatcaccgccaattcatattacgaaccagcagtaagattacttaggttccatatcggttcttgttgagaacagagagtgaaatatgtatcagctgccagttcttaacatgaatcagtagtcatactcaaaactagttcatgttaatgaaccggtactgacagacacatgttgataataaacaacaaaacagttataccgaaacgactggaccgtccagtccattaagtacccaatacctgtagttttttcaaaaaaaaaaaagaaccgatgatttttaatatagataaagacaaactttatatcaagagattttttactgtacttcagggtgtgcagtactaaatcgggaccgtcgatttggcaacatccaacagttgaaaatagtctgtaccacgtgggaccgtagatcctgattgagacggtacggtaggtgggagggttgttttgtactttcgcattctcttccacattacgcacgcggcatctctttcgctctcatctcttttgcgttcttttccttctcaccgcacgcggcattgcagtgagagaaggggcaatacgaaacgaaccgtaaatctccatcgcatggttagg

SEQ ID NO: 26738 - DNA, 226 bp, Oryza sativa
gtaaaaatatatgtgtacatgaaagtatatttaacaatgaatcaaatgatatgaaaagaataactaattacttaaattttttgaaaataagacgaatggtcaaacacgtactaaaaagtcaacggtgtcaaacattttaaaacggagggagtataaattaaaatccattgtaagttcatttttactttcattcctataataactgaatctgccctaacatgatagt

SEQ ID NO: 26739 - DNA, 171 bp, Oryza sativa
ataaaaaaaatcaatttctagatgaacctaaacaagcatgtatccaagttcatcccccaaaagttatctatttttaggatagagggagtgcaataagtaggaacttaggcccttcacagtgctccaccctggagcgttccttcgtcccaccacgtagacttcgtgatgtca

SEQ ID NO: 26740 - DNA, 320 bp, Oryza sativa
ccgctttcttctctctcttatctttttttctcgatatgtggttatagctggcttatagcctactattgtacctgctctaaggataaaattcagacttttcccaaataattaaatattccattcgtcctaaaatataagcacttttagattttgacacggtattcgagattctactttgaccaacgatatctataaaaataagatgttttaaataaaaagagttgcatattgtgatagtttgtttaattataaatctactagtaacatcaattttacatgattgatcttttttatatttttcaatagccaaaattataaat

SEQ ID NO: 26741 - DNA, 500 bp, Oryza sativa
ttcctgcagcccttctcgtcccttatttcatttcatcttctattttaacatatactttaaagtacaaatgtatagttctatactctacgctactcctagtataaaaccataataatccaaccatatttaaattcacaattcaaattcgattcttttaaaaaaaataaaatggaaatacaaatcctagtagcatgtattcatagctcgggtgaaacgagcttctgctactgtagcgcttccatgcattttctcacatgtgttgatttttcccgtcttctcatccacccatagaccagctacttctctcacgaagcaacaaccaagcaaaacaacaaaaaagctgcatagcacatcgcatgtatcactttccccattcttctaagtcccacaatcgcagctgctagtgctaccctgctactactttctcaattttgcagcctgcaacaacacttgaatcatccagtgcctcgacgccatcgcatgactcggccactgggcca

SEQ ID NO: 26742 - DNA, 1501 bp, Oryza sativa
aggcgatcctagcggggcttcagctccactccacaggcaaaactcaactggggtctgagccttggtcttccaacttcgtcttcagctcagaagcactacacttctgaaaaggaggaataatagcaaggctaagtacaaccaccgtactcagcaagccacaccaacgatgcagacgtgtaaggggatacaaggacggtttgtggctatttgcataaatgcggttgtaaatcattttattgagcaaaacagtaaaacagttgagtaattaaggtaatattaaatctccactgatcaacgctacaccacgttgaacaggcccaaccaacccacctgaactacagtacattgagtcgatttattaggggtaagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatctacaccacgctaaggtttcatccccacccctcaaatggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgtttgtggtaagcactgtaagtcttccagggtttcccgtgaaccggtccttaattgccatgggtgcgaccagcaaaaccatgcacccacagcccaccattcagtcgcattttagttagataattacgaccatgaaatatggccagatgtctcaagcacgcagctcaacaagatactagaatgtctaatactgcaattatcccatcgactgagctagtggtaattaagcatggctaagcatatagttctagctaggtcatcaaagtaacacaagctaggcgatttattacccatggttgacaaaggacagatatcaagtaaacatggcacaagcgagcagataggtaaaccctgatcccatgtaattaccaaaacatgcatatttatttgcaaacggtaaaacatttgtaaattgggaacaacatgctcaaggggaatgtgtgacttgccttgcttcttcacttggattttctaaactcttttcctcgcgaccgcgatcttccgaaacgacggattctacacgctggcacgcaaaatgaggaaaaaccctaacaaaaccaaagaaacagtacataaaaagtaaacaaacatgtataactcaattttagatgaattttgcaatttgaatggcccaattcggagttcgaatgaattagatatgaattttagaagtattgagccatttaaatggatttctataattatgaatgatttattgcgcaattatcaattattatctcaaagg

SEQ ID NO: 26743 - DNA, 331 bp, Oryza sativa
taaattaataagtgcttgtccatcctttcatacattaaaattaaatgataggctaagtctctttaagagcagagatctaggtctttttaaaacagagtttttttagtaaggccttgtttagttttcaaaaatgtcacatcaaatctttagatacatgtatggatcattaaatatagataaaataaaaaactaattgcacagtttgtatgaaaatcgcaagatgaatcttttgagcttaattagtcaatgattagcgataagtgctacagtcacccatatatgctaatgatggattaattaggcttaataaattcgtttcgtggtttccagg

SEQ ID NO: 26744 - DNA, 1501 bp, Oryza sativa
gatctaatctccaaaccaggagctaagcaaattattaccaggtatagcatctataattattgtgagaggtgtgagactaatcacgaaaaacattgttcaacccgcccataaccgcgggcacggctattcgaatagttttactctggccagaggtgtaccactgtacccacaagacacagccccacaacatgtcaccatgtgcctcagtaccaccacggtacctcggaaaggagctgtgacaataccccttgcacaacacaatccaccacagcgcacctttcctggatcataatcacccccttataaacaaggcatggactccccagcgacccccgtgggcttatctccgccacttctcagtctggtgctccgcaatgaatcatgctatacaaaaggtaaagccgttgtccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagttagtcataagttatcccaatagtgtgctactgtttctaagcatggctaagcaatcatatctaatatctagctgaaccaatatatatagctcaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatcggtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcaaatgaatttattatgaattttacaagattaaatctatttaaagcccatttaaaaaggattaaataaatttaattcaatttatggacaattttaatatgtagatctttattttatataatttttgcaacttgaaccacattaaactgagttacaatgaattagttatgaattttcaaagattaaatcggattaaaacacttatatggattttaattgaattatgacgcaataatgaattatttttgaaaaggaaaaggaggattattgcgtcagcggctagggtttgcggtggaccgggtgcacggcggcggttcacggaaacgaacggccgagatcgatcttatccaaaacggatggccgagatcgaacggtccacgaccggctcacgggaaacggcaacgatgacgtcagcgg

SEQ ID NO: 26745 - DNA, 1501 bp, Oryza sativa
gttcttgttcttgttcttgtttaggtgaattgggtgtgttcttgttcatgtgaattggtcggggtgaaagggagctgctcggctcgatgcattagctcggatgcattgagcctgctttttttttattcgtgaaaccttaaagatgctggttctaaaacataaaaaaccgacatctttacccatatagatgcttgttctaaaatcggcaccgatgaccaaagttatccgtatcgcctccatggtgctgtttggacaaataggcacctaagggggttcccaaacggcaccgattagctatcctagtgagagtgagtatttcatatatagatccaagggcatgacctattttatagcacaactcttttttttcaacgattatagtgaggtaattagtaatgaaaatttatgaactactttacagtctatatcattatactccctccgtttaatattataagtcgtttgttttttctcctcgtcaaacttcttttaagtttgaacaaatttttggaaaaatatagttgtattttcaacgcaaaacaaattattatcaaaatatattcaatgttagattaatgaaactaattcgatattttagatgttatttttttatatacttgttgaaacttaataaagtttgattatgacttataatatgaaatggagggtgtacaaaataaaaagatgaccgttcattcgtgtgaggtttcttcctactagttaattaaatgatggaagcaggttgggtgatataaatgtgcagttctctataattgaaacaaattgcaaatgcctcatatattaatggagcgaggaaattaatatatctttgtcgtcggaatgaaaagaatattggaaaattggtttgacatttaatggtctcatacaactagtgaagagaaccagtacaaacaaccaatctggaccagctgctgtgccatcgtatgcactgtctaaatgacttttcacacagcaaaagccatcaatatgtgtaccctcttccaaccggcgacgattagttggttcctattgttttctatgcacagtagacatattcatgttcgtcgcttgtgttgtgtgttccttcacggctgctccctttcatagacactattgctatgtagagatggggagaaatgaccatcacaatgaacacggtcaccgttaatcggtgatacgtcgctgtcaaggacgacggtcggaaggcacatggaatacctagctgttgttaactaatccctcgatctaaaaatatttgtcgccgttgacttttttttaaatgtttgaccgtttattttatttaaaaaatttaagtaattattaattcttttcctatcatttgattcattgttaaatatacttttatgtatatttaaaaatatatatgttttaaatatatattaaaaatatatatttttaatatatatttttaaaaatttttaaaaacggtcaaacatgcttaaaaatatcaacggcgtcaaacatctagagaaaaaggatt

SEQ ID NO: 26746 - DNA, 1501 bp, Oryza sativa
ggcgattccaatttttgtagacaaataatctgtcggtgattcattggcaacacatgtagccgctagtatcggcaaagatgcatatatcttcctttgcgcgcggaggaattgaaaaaaaattagagtacgcgggaggacttccgaaggaaaaaaaaaattgaagtacgagcgcgggaggaatagggggtgcggagccaaaacaaaaaaaataaataaaattgaagtgtaccacccaaccttttctgctcctaaaccctatatatctcctcctcccttctcccaaatccgccgccaccaccgtatctcgtcgcatccttggccccatcgccacctcctctcgatctcgttgccgccgcacacatcgacctcaaagtccccaaggctcgtcctccacaccagttctcctccccttgagaacactctccttcctccccaaacggcgcctcagcgaccatctccacattttccccaaactctgctgggaaggtagtttctgctcctcctccctcaccctggacccccctagatctgtaagaacactggggaaataaatatttcatcgattaagtcctactatgagatactagctgactgcaagtttgacccatgaaacacactcttttttgaaggactagtagacaaaatcagggttaagtacatgcatggggttactgttgcaagaacctagctttgatcatagaaatctggatagcatagatatgcatctgttactaaaatgttactacaagtaaacaagatctcaagttataaagcaagaaaaagtagggtatgtatagtcttatgtctttaccaaatttagtaactgcagttccttgtccatacaaatactgatattcttgacatatagataattaaaatcaaaatctagacttagtcatggacttaggaatttgtaccggaactcaagcacagatttaatgtatcacgaagcataagaactatagcaattctgtcaattaggttagtttaatagtagataaatcagccatcaattaataaacagcatgatatatttcaaaatttctagaatcaccatataattgcatttgggtgaaaagctgcacatgctccttataggaatctttttattgttttctggaataaagctgctttaaaatttcagcgtatgtcaatatctataatcaacagaggtgaaataactgaggcatgcatgctgctatgtcttgtttaggttgagaagacaatgaattgatccaacaactctgtgctttggtggacgggatccttgtgctggtctacttcttcaattatcggtatgatttctttgtttgcatgaaaccaaatttaactattatgtatcttcttgtgcttgaccttttaatttgttgattcatgcttcactaatggcttgtgatatgatgtgtggttgccctaattgaaaactataatcccttctaaataaaaataagtttcatgtttgcgtccttagatatgaattagttttgtgatgtttttattt

SEQ ID NO: 26747 - DNA, 1272 bp, Oryza sativa
ggccaacaacttttcaaacggccatccgggcctagctgatcccatcgactgcagatttttcaaacaccgaacccccttttcacacagcaatttcacaagcagtagtcaaaccaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggttccagaccaacaacaggttatgtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccggtacgtttcccggtccgcggttttggaaattcatttagttcgcaagcaccgacccaggtgtcgggttttccaagtcttttgtaaaactccagttttacccaagttgttactcagattttaagtttgaaggcgaccgtcgatactggcacagggtgcacgaatatcgaggcgcaactggatggttacaaggggacatggtatagcaattaacaatggaaggatcaaatgcaacaagttaggtaggtctgccaatctgccttgcagacagaacaacagattaagtgcaatcctatcaatgcataatattttgcaagcaatataattagatttcaaatataggctcaagatgttcaaaggtggcttgccttgctcgagatctggagcttgatcctcgaaatcctcgcactgcgggtcttcgggctccgaaactatacgcaaaacgggacaactcaacaaacggcgaaaataaagccctattaatgacctctaagcgtgccattagatagatctcgagatttgagaaattttggaatttgaacggagtcaaacggatttacggtggggaagatattgaatttctaagattattggatttttggtctaaaggaaaaggatttaattaaatcctttttggaaaagaaaagaaaagaaaaagggagagggagggaatatagacttccctcgggcggctagggcgcggccagagaga

SEQ ID NO: 26748 - DNA, 1018 bp, Oryza sativa
ataaaatagctctgcattttacatggtgactttctttactttaaatacgacttgtaactatatgtccatacatttgtacaggaggaacaatcaactctgttactgttgaatggctggagcaaaccacgacaaaatcaaacaagtgatggctagaaaagctagtttcgacaacaatgttacaaactcattagtttcagaacttttagttttatcagacaacttgtatttcagcatttggaaatttaacatactcatattgtcatcattactttgggtatctgaaatatattatgtcttattcgcggaaatatcagacatcataattcttgtgcgcatgagttgcaagggttttgccatttaacatatatttctactcatgttgcaatagtaccaaatgatccatccaattactgatgtaacacaatttcttttctataaaagctagaagaaattcatttcattgtaataatacttattgccacaaaaatattttagtggcaataacccatatgatatattgccacgattaatgctatgtggcaataacatatattagatattgcaacgaaactattttgtggcaagcacaactaatgccacgcacgaagtggtggcaataattatttgttgcaacgatgttaagtgttgcaatatgtttttttgccacgattattttgtggcattatcaaagtttgttgccactagataaaaattgttgcaataacctattgctactgtttctattgccacggctagcaacggttttaaaatggtggcaatatgtatctattgccacgattttagcattgttgccacgatttttttcgtagcaacaaatcattttcctagtagtgatagagaggtttacattttaaaagagagcgattaactttgcaaataaagtttaaatccaagttaaaagaaattaagagaaggcaacatcacttcaacagaagaatcgagaagagtgcaactaaaatattttgcaaaacattttccctgaaaatttgagtctgtc

SEQ ID NO: 26749 - DNA, 1501 bp, Oryza sativa
aatttggtgataaaattgcttgtacatctgtaattttgcagttgatggcttgttgttttgcaagtattttcatgtacgaatctaaaggtatcactgtacatgcataatacaaaatatttatgttggcttaattattagttaaaatttaaaaataattttgaattttctattacatgcaagtcctatatttttgtaaggaagcagtgtgttattaaaacgtggcaggtcaactattgttattttttggacctgccacgtgagacaaaataagagtcaatggacaaaagcgccagaactgagaagcagcaacatagatacattgttggggcgacaaaagaatttgactagcattatcgatggttgacagtcacaaactttggattgtagaagcaaatgtgttcaaatgagtctcatgcatgccgcctagctagtcgtcgatcgctccatagccgccaggcgccggccagcccgccactttattgctccatagccgccccttgttttctcacattgttctttaagcttcttaacacgcataaccaccgtttaaaattactttaggggtaacatgactggcattataaaatttaaggaattggatcactgctggagaaaccatctttcgtcggtcggccgaattccacaatagtcccggatgcaataaaaaccggggctaaagatgatctttagtcccggttcaaaagggtaacgggcatatttgatctttagtcccggttggtaacagatgatctttagtcccagttcaaatgctgtcagggcatgtcaggccccccccgggatctttagtcccggtaactttagtcccggttggtaataccaaccgggactaaagatcccggggatctttagccccggttggttaccaaccaggactaaagtcccacccctatatatatatcttcttcctcctctagctgctcgagcaagcttcaaaatttcttcaaaaaagaggggaggtcatgccaaaatttatagtgaatttattttggtgattacatacaaatcggaggtgcctaaaaggtttgcaacttcatcctccaatattttttttgtcatattacatttgcagctatgttttgcacacttttttatctccaaaatttagttgtaagttgatgagagagaaaatttgtgtggggaagaaagaatatatagaaatttagttcatttgctaaagaaggttttataaaatagttgagaaggaaaactctagtgaaagttaatcttaaataatagaaaacaaactaaaatgaaaattaaaagaagtaaaacacattaaaattagtttaaaactttagaaatagtaaataagaattatttgatgtaatattttatgatttttgtatgaataaagatatgtcattattgtatgactgttgaaacagtttgtaattatgttataattattgtatgactgtcattattgtaagaataattatttgtgtacggtttttttcgactcatgtagatggatcggcct

SEQ ID NO: 26750 - DNA, 1501 bp, Oryza sativa
aataaaataataaaattaattgatttgaatattttaaatctggatatggattttcaaatttgaagttgaaagttttaaaagttcaattgaaagttttgaatttgatatgaaaattttcaaagtttgggttgaggtttgaaaagttttgagttcaaagtttcatatatcgagtcaatagtttcaaaatatgagttgaatattttaaattggagttgaaagttttaaattttgagttgaaaattttgaaaatatgaattgaaagttttaaatttttagttgaaagtttgaatttgaaatgttctaaaatacatatgaagatttttaaaattgagttataactataaaaaatttcaatcaattttaattcactcaatagaataagaaaaaaagcatatttgtttggccctatagacccatagaagtcgacagaaaatggagcaaagcacaactgtgtgccaaataggtttctcgcactattttttccaagaaaagtcacgagacaactagggaaagaatgcttcagttcttgaaaatagtgaaacacaattggatcaccagatgaaacaatttgctttaacatacaaaacaaatgatttaaagccatggcaacatcaacaagatctgagtgaaatcgaagatgaaaaagaaacaccataaaaacaccccattgaaacactttgatcttactaatgaacatccatatacatagactgaaacatcaaaaaatcacccaagaaaataccagctagatccacttgttccttctctccgatggttagccagatcattggcgactacacagtgtcagttgcgggggggccctgtgccacaccgtgagggcagcagccacggccgccgcggggctggggctgccagatcggggctagggatgtggttgctgctaccgtcaccatagccacttgcggtctctggccaagcggggaatgaggttgcggctttcggagttacctcgtataagttcttattctacagtacaaatcatttgttacatgctcatgatcatgtttttattgtagactatgttccattatgagtacttaagcataagaacttcaatacaaagaaaataatgatggtggttaaaattctataatgtcaatcaagaacccaatgtcaagcagcaaatttacttttctttttctttaaaaaaaactgtttgtaaatatacatatataatttttatgtatgtataaattattgtaggattctatcagttaggctcttcatggcacctttttttcctctaaggctgttgctatgaacctgtcagctatttttaatttcatgattacctgagattattcttaaaaagccaaaattggcttttctgaggaatattgaagaagcccactatctagaattttccgtagtatgcccgggggtacggtgttcccctcgcacgtgacaatgtgtaaattagcagcattgtgaaatggaaagcatctccactatgtacaatataatttggttctgcttccag

SEQ ID NO: 26751 - DNA, 1146 bp, Oryza sativa
tgtcatcatctgagtctgattatccaacacctgagcgatcgttgggttctcatgcggtggagatgaactgctgttagatacatcactggcacgtgctccaccgatctgctcttcgctgccactgacgttgttggattcacgggaaccattcctgtcttcaccatctagagggggatatgtagaaatatgagaaaaatgaaggaaaacagggggcttagaaactaatctttcttataaatttaggtgcaattatcttaatcttgattaaaacaccgaaaaagaggcacgcaactcctaattaaagcagccataccactgacacatgatatcgaccgccgactaacccacaaccaacaaacctaagcacggaaagtagcaagcaaacaaaaataagaagacgataaagctaagggcggcgactctgaagctcggagcgacgcttgcgatcgaagaacaggtctgacatctaaaatagacaagggataggaatcaacacatgctcaaatccaaataaacaaagcaacaaatgactcaaacaaataactgagcatggcgatttttatgcatagaacatttttcatgaacccagataaagatactaatgcatctgactaaacaataaattaatgcataaaatagatgcatagttataatgatatgcataaaatctccccatcgaacctatacactacttagtgcatatcacccaataattcccgaccgactgtcgaataaattccgaataaactttccctagtcgagaaatccaattaaatgagcgaccaagatttttcccacaaatcaaaagaacataccccaaaattttcccgaaacaaatccaagtgcaaagagcatatgcagatgaaaaggtttcagagggcttttaggttttccagttggcttgtcctacggtcaaggtcggctctgataccaacttgtcacgcctagaaattcacgaaccagaatttctaagctgaatatgcattaaacccttgtccaggaccaaccagggtacacaaacgacaattattgacatacagatccacgtcttacaaaaatataaaagattacaaatgcagcggaaaagataaaagcgagctaagcttgaagacttgactcctgcagcgagcgattccattccacagg

SEQ ID NO: 26752 - DNA, 1252 bp, Oryza sativa
tctcgcaaaatagtccaggggttatggaatgagttttgtcagtaatttatgtttaatactcctaaatagcaatattttatatagctatttaaccccggaggatctaaagaaggccattgccgtcctattccttgaaaagatcaagtggaagtggtcactcatcagtcagtcctgcccttggtcttcacagtactagtcaagaagagaagaaggtgccatgcatcttgcagcagcggggagcgcgggcgtcgacttgactgatccagcattacacagcattatttcgcggcgtcctgtgctgtggccgatcgggtacggcctcgaccttgtcgccgtgagatgagataagatggttcgcgtccccgtcggccgccgactcgattggctcagcagctcactccacccgcgccgtcggccacccgtcaccgtcgttttctccggagaagcactcgttggtgcttgcatcaataaagaagttttgagtcgaccggcttccactgctctcttccgaatgcagcagtgtgtcgtaacgggattgggattccctgcggtttcactatggtgtgttctttcgaaggggttgagaactccttgttccgtactgaaaacagagcgacagattaacacgtgattaattaagtattggctataaaaaacttttaaatataaaataatatgattttctaaagcaactttcatatataaactttttacaaaacgcgtaccatttagcggtttgaaaaacgtgcacgcgaaaaacgagaaaaatgagttagaaactcaccggaaagaacacggcaggactgcaaggtaaggtactatacacaataggagatatcccatccttttatgaattgaccagatcattagctacagtgtcgatgaaaagtacccatcaatttttgctatagtgggctacaaacgtattttgaacattggattcggatctatcaccctcttgactgtataagttgtagtcgtaccgactacacctgattcaaatccgtagtaatgatactggtaatcggtaagaccgaacaattcggttgggtcttttgaaaattttggttatccaaatttaaatatatagaatagctgataaataattgcacaaattacaaatgaatgttggaagcattgcctctcttacaagttggaccaatgttttcatagtaaaatattacaagataataattgttagggttatggataaagtataccctctatccttaatatatgttgtatactaaca

SEQ ID NO: 26753 - DNA, 1501 bp, Oryza sativa
tgctatccgctacgcttctcctggacagacagatttcggcagatgcttctgattgtgtagtagggtgaaactgtgttatttttgtcaaatatggctgattatgttatgatggcaatacctataatttatcaaataccatatttatcttcctgcttgaaatcacaaaagctaatctgctacttgtggtaggtagatccaatgatttagtagaataattaccaaaaaagtttgtagctttgagtgcataccacatagaacaagacatgagaaaaccaattttataataattcttcggctttctactttgcacgagaacactatacaagttccagttctacacgatagaactactgtggtgcatatagacatctaaatgtttgcctatgatccatatccccacaactaccatagcctaagtagcaaagcatgaccttaattacagctaaaacctttgcctaaaatttacataatcctgacctaaaacccttttcatcaagcatttctcaaaactcaagactttacatgaaaatttagccaaattcaactagcgccatagaaaaacatatcgaatctccatgcagcttaaatctcacctccaagctccccgtgcttgcccatctcctgaagatcgtatacgtagtcgacaatacgcttctgttcggccgcgctaaacacaccgcaatgaagttccaggccagcgaggatattgacgagccgaccattgaccctctcaaaacagatgaaatccttcctccgcaccacgttccggaaccgcctcagctcccgctgctccctcgtcagctgcacacccggcctaccagcctcgctcccttcctcgccgtcatcagccgcggatgccgccgcgtcctcctctgccgcggcggagagctcgtcctcctgagccatgtctgcccacgacttccgcgggttctccgccggctgagggttctgctttgctgctcctgctccggtggcagctgcggcggatccgagtcccatccgctgggcttgaacggcaaatgctgcgggtgagccgtagccggatcggactcccaccccgagggctcatgctgatcgatccgcggcggcgggcgacgacggggattcctcggctgtcagagtcgaggtgaacgggggggcgtaagaggcaacagcacaaaaaccctaactacggcgaacccagcacacgggattgttaccttgcgggggcagcagggaggagacgcggctgcggagggagtcggcgcagaaggcgcaaaggcccgcggagaggaaggggagccacgtggtgaggaactccccggcgatggcgagctcgtcggcgttgtacccctgcacgagcgccatcgcgtcggcctcgccgccggcggaggcggaggaggaggcgtccatcgaagcgtctctcgctgccgtgtgggccccaccctccctgtgcctcgatgtgataactagtactagtacccctagcttctagttgttggtatccggataatcctggccg

SEQ ID NO: 26754 - DNA, 384 bp, Oryza sativa
ctgtgaatgatagtgtgtgtgttttgggctagactttatcaaatataatgcggcctgcgtgccttaaatcgtttgggccaatggcccatgtaatcaggagataaatactcaagagagagaatggctgtggccaacctggcaaaagaaatcgaatctatctctctccaaactctatctctcctctgcctcagctctgtttctcttcgtccccaactccgatctcgtctaaatctctctctctcgtcggcggcgagtttcgcggtggcatagtgttacagtggtatcagagccaggttgtgggcgtcgccgtgcgttggattcttactgattcgccacggcgcccgcaaaactttcagcccctttgaagcaagctaatggactcca

SEQ ID NO: 26755 - DNA, 335 bp, Oryza sativa
accactaatgggcgcataatcgagtttagggacgttaaaatataatttgagagtataaggacctagatgacacacctcgacaagtttgaggaccgtcgatgcacttcactctaaagaaaaactagcgagtcaattgcacagcggtcttttatccggacccgtgccgagcctccgctcatgttccgattttccctgatccgaccgatagcaaaaagtaaaagtatctgcagagtcatgtatacgtaaatatgttgtcatgttccatgtaaataaaaaaaatgatcacactgtagtcacgcaaatgattaatctgtcatgggcacgagtgggtataa

SEQ ID NO: 26756 - DNA, 185 bp, Oryza sativa
attcctgcagcccagaactgcatgcagaaggttcgaggggaattttgtcgatgacattgaagcagaaccgagatagagggagaacacagttgccgttgtgacatgtcagggtagggatgaaaacggatcggaaacggacgtaaactagctttatcatattcgttttcattttttttggaatcaga

SEQ ID NO: 26757 - DNA, 1197 bp, Oryza sativa
gttgctgtttgatcgatcatatagtgcttttcattacgttttactatgtcatatggctgtgtcctcttaacagataataataataaacgagtcgatgccatttgcaaagaaatgtgtagttatgtgtcttactatgaaacaagatttgtccttctgtatcgtggatcgatgccatctctattctcttagcactttgtaacatgtggttagtgcacaattggaaaaatgaatcttctgtccatattattctcatgttgatagaatgtactgaactcctggcctgtagttcaatggaaatcttggactcaagccctcatttgttgatctaggtaagtgacttggtgggtctaaactatgtgttcctgaagtttacggatggcatatctgataaaaagtcagcaccagtttcgtatcttgcatgtaaggcgggaggacatatgtgacaaaatggccttcaggacaagcattgtgagtattgtattgccttccctttgtatcctgtctatggtggtaaattgaccttcagcagccaaaatacttaacggttgtttggcggggttttggttttctttggtgtccctgtcatggattgtgagtttgagatgaggattgagcttcttaggaactgaaaaggacatgatgattgtctgtactattattgttaatcagcatagtttccattggatgtaagttagcatcaatcttattgttcagacagctcttctctgagcctattgtcgaacaatgcaagatctcagttttgataactgtacgctacactatgagctattgctcactcatctgcaacatctgattgatttgggattttatgggttttctgttgtcatattgcaactaaagtttcttttcaaggtgattttacctgttcacatttttgtgcatcttctgtaatgtgattatgtgaaccaaatattctagttcgccctaccatgtaaatgaagtaatgccatgcatttcaagtctccaagtcctgcccatgatcttcaatattgtgagggtaagacttcttcacatttcacaactacaaattcatggtcatgtgtaagttactttcaaacatgaatatttccataccgattgtgaatcaaatcacaaacatactgtacgtattgctgcatttactatatctgactttgaaaatgttcaagtggcatttggttctgtgatcaatgtact

SEQ ID NO: 26758 - DNA, 1501 bp, Oryza sativa
tttactttccactatttgccatattgaaatgtttgaattaaaagcttgtgataagtttattatagcgttaatactaaagctttggtccaaaataaaatcaaaggttgtgtttgactgattagaattcatacatgcatgttcttcaacaataaacggacacatatacacacacaaaccttaaacgtgacacggtagataatttgttatagatgtataattactagctcatgtgggtgcacagattctgactagttcatttaatcggttaccaagaaataaaataagtgtccctaatattgcaggacacatattgccaaatctgaaggatgcatccataaaccattaggattgacaaatcaatgctgcattccaagagtccaacatcattttggtcgtctgtaatcctaattcattatatcagtgtggaacagtgtcacaagtcgaacaagcgaactcagggaagagagaagagggggttcactctgctagcaaatacaagatgaaatgtgctagcagtattaccttgtaatagtcatcaagctgaaggcctaccacatcaaccggcttgagaaatggctcggcccattcatgagatgtgatctggaagaaaaggaaatcaagaaaaatattgagtgcatatcatgcgcatttcatttggaaagctagtagtgtgttttgagtgtcgagttcaactacgatcaatcaatatgaatttgagaggaaacaatggagcaagaccatacaaatttatcagcatatcatcaagctagatatatctgtctattttgaaggatgttttctatacatggttatggagcaaaattagaatcaaaactagcggcagaaatcttaattaaactgcacttatttatcattggaaataacagtagccacacgtgcacaagaccggacaataaatagctttctagattttttttcagttagacctatcaggtacagtagccatgcactatccaaaattagcctgcaaattaaaagcttttgcaccaagcacattctgaagcatgattcaggatacactaaatactttgagttatccatgccagcaagcaagaacaacatagatcaatgcatttgtcggatttttcttttttttttttcctctcgagatgtggttaagaaagatcacctggcgcacaatcgtgccaaactggcgcataagatcaggcatccctttggaaaggctgctatccttgcgaccagccttccggccaccactgccatgtttcttcccgtcgtagaatcccaccacttcattcaccctcctctccagctgcaatccacataaatctccaatcaaacctctacgccccaattatccgaatacaataaatgcaaaacaaagaaaaaaaaactgtaccctactgtttccctaaccaaaatccccaaaaccgcatactacagcgaggcgagaaggaactcgaaaatccttccgctgaagaatctcatctaccaggctaagcagcgagacggactactt

SEQ ID NO: 26759 - DNA, 1501 bp, Oryza sativa
caccacccttcaccgctggagtcgcgaccaccgtcacctcgccagctcatcgcgcctcgcgttgctcggcgcgagtgaagagatggaaaagagagatgagaaaagaggggaaagagagtgtgacgtgacacctgacatgtagggcccacgtgggtcccacgctgactcagccgccacgtaaatcaaaacccgggtcaaaaccaccgagggatctctggtgaccggttttgtatagttagagaaccccgcatatttggtattgcggttcgaggacgttttcgtatctcggtgacaagttcagggacctccggtgcacttttccttctctggaaggagccgaggcctactaagcccacgcaaaccttgcctacgctaagcagcccactagcccacacagcccacgcaaaccaagtcgaaccgagcagaagcgtacactgcaaggatcctcggcccactagcccgtacaggcccaaaataaaatgagggaaaaagagagaaaaaaaaaccggcatgttggccatccgcgtcggcgaggtcggtgagtcgccgcctcgccggagaccatgccgccgccgcggaccgcctccctccccggcgctcggtgctcgggggtgctcggtggtgggcgtaggcgagaggggtgccggtgatcaggatctgcggccgcactcccgccacggaatccccaaaacccgccgcctccgccgcggcctctcttctccggccttccccgggggagcaccctcgctgatcgcccatagtggtggccccgctagctcgtcggtaatccctaaacctcggatgttaaaccctatctgaccgctagttctggtgcgcagttgcgcacacgggcgctttctgaatgcataatccgcgacatggtttgatccgagatatgtattcccaaattactgagatcgcgtccctgttatcctatattttttttcagcgcagatatgcagatgaaatggcttaagctagttgccttagcgaatcgacaagcaattggaggggccattttggccagctgaagaaaaaactggcatgtttgtggttgggtgaaggtgggggactgaccgactgatgagttatttcagttgattgagttacctcctttttgtttattgattgtgaaagggatcctgtctctgaattacaaacatagagtgcttgaaaaaatttaagtctcttcgacttgtcgcttgtcaactaggcccttgtttagttcctaactttttcttcaaacttccaacttttccatcacatcaaaactttcctacacatataaacttccaacttttttcttcaaacttccaattttagtcaaattttcaattttgacgtggaactaaacacaccctagatcttgaaatcctgatatctacggaaatagaggcaagtgaggttctagatttcctttgtgctaagatgaattgaatgctcgccattctttcactaatatagtgctgatatttaactgaagcattttgtgaacacacaa

SEQ ID NO: 26760 - DNA, 1501 bp, Oryza sativa
ttatgcggagggtcttgtcacaatttccccctttgcagtatcatggtgatacttcggggcatggcgacatgtgtggaatcgtgtcttgtgggtagagttgtacacctctggccagagtaaaactattcgaatagacgtgcccgcagttatgggcgatcaaccagattcaccgtgattagtctcacccctagtttagcttaatgaactgttgtagttcaggtggttggttgggcccgttgcaacatgtgtagcgttggacagtgattggttaatattgactaattactacaattgttttacatctttcaactactgtttttaaatgtatgctttattgcaaatgaacccttagcctcctttggttatatcctacatcatacctcctcttccggtatgacttgctgagtacagtgagtagtacttagtcttgctctcttttcccccacaccagagttgaagttcttctcagttggagatgtctcgaagaagttggtttcgtcgctgccgtcaaggatgcctgtggaatggaatcgctcgctgcaggagtcaagtcttcaagcttagctcgcttttatcttttccgctgcatttgtaatcttttatatttttgtaagacgtggatctgtatgtcaataattgtcgtttgtgtaccctggttggtcctggacaagggtttaatgcatattcagcttagaaattctggttcgtgaatttctaggcgtgacaagttggtatcagagccgaccttgaccgtaggacaagccaactggaaaacctaaaagccctctgaaaccttttcatctgcatatgctctttgcacttggatttgtttcgggaaaattttggggtatgttcttttgatttgtgggaaaaatcttggtcgctcatttaattggatttctcgactagggaaagtttattcggaatttattcgacagtcggtcgggaattattgggtgatatgcactaagtagtgtataggttcgatggggagattttatgcatatcattataactatgcatctattttatgcattaatttattgtttagtcagatgcattagtatctttatctgggttcatgaaaaatgttctatgcataaaaatcgccatgctcagttatttgtttgagtcatttgttgctttgtttatttggatttgagcatgtgttgattcctatcccttgtctattttagatgtcagacctgttcttcgatcgcaagcgtcgctccgagcttcagagtcgccgcccttagctttatcgtcttcttatttttgtttgcttgctactttccgtgcttaggtttgttggttgtgggttagtcggcggtcgatatcatgtgtcagtggtatggctgctttaattaggagttgcgtgcctctttttcggtgttttaatcaagattaagataattgcacctaaatttataagaaagattagtttctaagccccctgttttccttcatttttctcatatttctacatatccccctctagatg

SEQ ID NO: 26761 - DNA, 1501 bp, Oryza sativa
ctcgttgtggcagcaccgtcagacgcctccttggcgactttctccttcagcgacgccgccacctgatggtccacgagcggcccgatgatgtcagtcagagggagagcctacgcttcatgaagtcataatgcgatcccggaagaaaaatgcaaaaggaccgctgagtacacttacattgatggcagcttcgcgctcggctgcccctttcttgcaaagggggacggggacgttgctcaccattgtcgggccactgatcatcagttggccgacgcggcgctccacggttgcgctgtccaagcctgtagatcgagaccagaattcgataagtcaggaagaacacgcacataaggtagtcaatttaactaaaaataaaaataccccgaggagaaacctgggtcgcgtcctccggcccagaataatcaaaggctgggtgggctcgagcctggagcggctggatccgcctaccaatgaagtcggcaacgatttcataccccgacaaccaccgtactcggaggtcatcaatgatatcgatgaaagattggaggaatggggtcaaggcgggtttggtggtccaagatgaaatcttgtctggttgctccttaggaacaatgaagaccagatctaaatcttctatctgaagatagaaccacctcccctgccatttgctgcgagatgaggggcactggaaggggatgtatcgcgacttcaggccatcccgaagtcggaaaccgacacatccgaacacctttttgggttccatctagcgcaactcatagtaaaagcggaagaggtcaagaaacggctctaccccaatgtaggcctcacaaagatgcgaaaagatactcaggaaggcgatggaattggagttcaaatggagcaaggaaaggctgtagaaattcaagaccaagagaagaaattcagaaggcggaggaagaaagccacagagaatatagtcctcgatcgcaaccatgcgacccaggacaggctggggttcagtacctcctgcttctctctccatggtcccgcgatcgggaagggcgccatcctcctgcagcttcttcagcgacgcgctggtggaggtagacttgtcgagatccaatgccgccggggatcgccggagaagacgagggacgcttggaggctagagagttttttcacaacaggcggactttaaattggatccccaaaactcccttaaatagacgcacttccgacggtgcgaattccaaggaaaggagagagatggccgccggaaatttctgggtccattacgcgcggcagtttttcggacttcaatttaaattcactcatgaccgttgagcttcacctggcgttgtcgatcactccttgtctctcgatcctcacaccgagaatgacgacaacctcgacatcagaagtcgcgatcggtttcacgagttcatttaagcagaagtcgggggctactgtcagggttacgagtaaggtataccctctacccttcgatatacgtcatatatcgata

SEQ ID NO: 26762 - DNA, 195 bp, Oryza sativa
gaggatatgtgtcacgcccagaaattcatgaaccagaatttctaagctgaatgtgcattaaacccctatccaaaaccagtcagggtacacaaacgacaattgttgacatacagatccacgtcttacaaaaatataaaagattacaaatgcagcggaaaagataaaagcgagctaagcctgaagacttgactcctg

SEQ ID NO: 26763 - DNA, 1108 bp, Oryza sativa
agttatacgtgttagattgtattgttctcccctcattactcctgctttgaaatcctactgctttatttcatcaacaggagttcatgtggagatatgagatttgttttgctgtctccattggtattggacttaaaagagagaataatgttgtagcagtcataagagaaatacggtactctagttgccattctggtgatctcattttgtcaaacatatcgagagacgcgtcatacattttgtgatatcaggcgagaatgttcttgttaaataatgtgttcgttgcctgaaaatctgcagaaaggttgctgtggtctgcaatatgatactcctaactgaactctctgtatcagtacacatgctagtgatcacagggcaaggtccaaaggggaagaattcttggctgcacaactgtttcaaacttaatactttcctccgtttcacaatgtaagtcattctagcattttcaacattcatattgatcttaatgaatctagacatatttaatatcaatatgaatatgggaaatgctagaatgacttacattgtgaaacggagggagtagttatatcaggtgcacatgttccgtatgcgttggcccatgtttgttatcttcaaaaaagcttcaaaaattattgggaactgggactggaacttgtactcttcctctcaaaggtcaaaggctcaaagcaaccctggtggtgacaacctaccgtacttcctacacaaaaaaaaaaaaactgcagaatgtttcgtcagaaaaaaatgaatgaacgctttctgtgagagatggggattggtaggcgaaaaatagtttcttggtagcccaaataagctgccacagattgtaacaaacctgcttgacatttactgttctcacaaaggctgcaggatttcgttgctgaaacagatgaaaatgtgaaacaactccaaacattagcagtgcctatctatcatcataaactcttcatttttatgaacatatgaacaaagaacctgtttgctaagctccagcttctatcattcagtaagtgccacaatttagttcagggtcttgggacctagtactattcaaaattcagaggccaaattgaatggttgcaagtaagca

SEQ ID NO: 26764 - DNA, 1501 bp, Oryza sativa
aaacagctcaacaaatgtatcgctcagtttggactcagttattcctcaaaaccatatatagttttgttcatgctcttgctttcatggtatcctcatgctaggtagatacctgaagcataaaaaatagccacacaattttataagtaaagcctgtgtatccatttaatttaaatttagctagtaccagtatgtaatggaaaaacacatactagagcaaattaagctagcttcacaccatcaaaataagaaccacacataatacatgttggattgagccaccagaatgcaaaatgtgtaaaaatgacttcaggagaaaatgatcctctgtccagagtctccattgaaaaagtaagggttttctgaagcccattgagctcaaacatatttaaaagatcaaaacaatgaatgaaaaacaagagattagtccaacgaacaaccacaatttaaagtttgagtaatggcgttcctttcatgaggtcaaatctcctactgttttctgtcaaaaaattttcactcggtatgatatataataatataacactctatttgttaccaatcacaccggattatgacattgtcaaatgcatccgagaaattgtaatgtatagagctatattatgaaacccctcaaatgataaaacaaatatccgaccataaatctccacaaactgtaaaaggacaggctctcagggcattcacatcaacaagctggcattgattgaaataagtattgatcttgtaacacaatctggaaggaattgtgtgttcacaaaatgcttcagttaaatatcagcactatattagtgaaagaatggcgagcattcaattcatcttagcacaaaggaaatctagaacctcacttgcctctatttccgtagatatcaggatttcaagatctagggtgtgtttagttccacgtcaaaattgaaaatttgactaaaattggaagtttgaagaaaaaagttggaagtttatatgtgtaggaaagttttgatgtgatggaaaagttggaagtttgaagaaaaagttaggaactaaacaagggcctagttgacaagcgacaagtcgaagagacttaaattttttcaagcactctatgtttgtaattcagagacaggatccctttcacaatcaataaacaaaaaggaggtaactcaatcaactgaaataactcatcagtcggtcagtcccccaccttcacccaaccacaaacatgccagttttttcttcagctggccaaaatggcccctccaattgcttgtcgattcgctaaggcaactagcttaagccatttcatctgcatatctgcgctgaaaaaaaatataggataacagggacgcgatctcagtaatttgggaatacatatctcggatcaaaccatgtcgcggattatgcattcagaaagcgcccgtgtgcgcaactgcgcaccagaactagcggtcagatagggtttaacatccgaggtttagggattaccgacgagctagcggggccaccacta

SEQ ID NO: 26765 - DNA, 549 bp, Oryza sativa
atccgagacgaccaaaatctctccagcctcgctactctgccggccggccggctgttcgtcgtgcacgtaagaaaaattcagacaaaagatatatacagacatacagtacatatatactccgaatatgagtatatgatatggatgatgatataatacatagtagaaaaaacatccctttgtaagaattaaattaggcatctttttcaccgagaagaacgatctttttttattcatggaactaattggtacttctagctactccccgtcctaaaatatactacctccatcacaaaatgttactatctaggatgagatttgacacattttagaacaacgaatttagacagaacctctgtccagattcattatcttaggatgagtcaaatccggttctcgttgtcttaggatgggatttcaaatcccatcttaaatagcaacattttgtgacaaagggagtaagagattttggatatatgggacaagctgatactggaaggctgagaacaaaagaaatcacagtttattgcctgtgcttcttcgacctccagc

SEQ ID NO: 26766 - DNA, 1501 bp, Oryza sativa
tgattggtgagaaggatagggatgggttgaggggaagagacaaatatactaagtttcggtgaaattgttcggaaaagtaaaatactacttccgtcccaaaataagtgcagccatgggaatccgtatccaacgtttgaccgtccgttttatttgaaaaatttatgaaaaaattagtcacacaaagtactattcatgttttatcatctaataacaataaaagtactaatcataaaaacattttaaataagatgaacggtcaaacgttagatataaatattgtaaaactgcacttattttgtgacggaggtagtagacttttttttctaaatcaaaaccacatgataaatttaaaaccccacagatgcatgtggttggtctatgtttctttgagccgtgttaggagatgcacgcgtgcgtgtatgaatatgagtgtggtgtttagtatgtgagcatgtgtttgttaaaacaaatttatagtgaacagaaactcatcgccatcaaatcacatgccacaacgaaactcaattcctgaccaaaacaaagaagagaattctcaaaatattcggtactagttcgttattagaaatgtcaaagccaacattagttgggtgagccaaacttaattaattgagaagcactaaccaaataaatcttcatgaagccgtgttcccggaatactagagttttgaactgacgtctaatatcaaaacactgatccttaacatgtactctatcaaaatgatctcgaagtctcgatatcctaagtacactttgcttgttttttagatgtgcgaattccaactcggttgacgactactaggagagtacacgggctcacagttgtgccgcgagtatctgactgattttatcttgacaaagtccgttgcgatccccatattcccatccgattttcccgtcgagccctgcagaaatctttcaacagaaacagcgaactagtagtagatgtcatcagggaaaagaaaatgaaaaaaagaacaaaaaaaaaaaacagaacgaagacagcggcatgcatcgcagcataggccggtcaagaagacgatggccctgacgaggcgcctcctcatcgatctctcgtcaagacgccgccttttcaacgccggcaaattctccaccacgcacaagaagaaaccagtgctccatgaaggtataaatttaattataattattaatgttgttgtgttggttagagaatatatatatatttagttcctctgatccctgccatgatcgagttaatccgttcttggatgacgaattaactgacgaccgcggctcaatcgatcgatctgcagggagggagcaggggtgttgttgaaatggagcagcagctcgtttctttgatttgatctttggcagtaagtaattcggggtttgaatttattatttttgttttgggcgaatttcattccagcggtgagtttggctggattcttgcgctgctcgcgcgcgctggtgtcgtggatggtggcggagaggaaga

SEQ ID NO: 26767 - DNA, 637 bp, Oryza sativa
atttccagccacactataccgttgtacatcctcagctgtgcatgtaacaatattagcaataataccgatataaacacacccaactcaggggagggagggcatttccgctttgtccatgcagccaaatcacaggcctgaccaccgcccacttccacagaaaaaaccaaaaaaaagaggccaccacggagggcaataccgtcattccacagctcccccaaaaaaggcacccgcgggtcgggtcgggacgggaggcaaaagcaaacaaaacataaagctctcgagcgcgcgcgttctcccctcccctacccctacccctgccacgtcaccgatccgcgtgacccatccctccccgcgccgtccgatggcggcggatcgactcatcccagccgtccatcctcatcttctcacttcccctctcacacaggtgacacagccgagcttaacaataaaaaaaaatggagagaaaaaaaaaagaaataaagaaggcgagcccatccatctcctcttccttccttcctcctccatattttcttatctattcctgatccaaatccatctcttcttcttcatatatcctcctcttcgtgagcgaaaattccccatcccctctcccccaccccctcctcctcctccgcca

SEQ ID NO: 26768 - DNA, 1501 bp, Oryza sativa
tgcccttattctgcgccagtacaccgtactgacagacacgttatcctgcacaacccaaccgttgtgtcgtacgtagttcttggctgcttctgccggggcactaggtcggccgtcttcgtccacttccgttatgatgtgttgaccctctagcttcttcgcggcaccttgttgtccgcgtgccctcttctgtcagcggagggttgacttccactagcctcctcctcctcgttcccctccacatccctctccacgttcccctcctggttcctctccgcatccctctccatgttccattcctcgttcaagtactggtttggatcctcgttcccctcttctttgttccagtactggctgcttccctctgcgattgtatcgtacaatatctgttcctcatcgcaatcagccatctgttcatacaagaaatatttgctaagtctataggtcatatttgctttaacaatcatatatgctaacaatcatatatgctaagtctaagtgtcgtatattagaaccctagataataattaaaactataccaatcttgtattaaaactctaacaatcatatatgctaagcctaagtgtcgtatattagaaccctagataatcatatatgctaagtctaattacaaatctaataatcttatattaaaactctaataatcttgtattaaaactctaataatcttatattaaaaatctaatagtcttatataattagtcctatattaaaaatctaataatcttatattaaaactctaacaatcacatatgctaagtctaagtgtcgtatattagaactccaataatcatatatgctaagtctaagtgtcgtacattagaaccctagataatcatatatgctatgtctaagtgtcgtatattaaatctaatagtcttatattattagtcctatattacaaatctaataatcttatattaaaactctaacagtcatatatgctaagtctaagtgtcgtatattagaactgaaataatcatatatgctaagtctaagtgtcgtacattagaaccctagataatcatatatgctatgtctaagtgtcgtatattaaatctaatagtcttatattattagtcctatattacaaatctaataatcttatattaaaactctaacaatcatatatgctaagtctaagtgtcatatattagaattcaaataatcatatatgctacacattagaaccctagataatcatatatgctatgtctaagtgtcgtatattaaatttaatagtcctaattatattaaaaatctaacaatcatatatttacatcacttgcctgcgcgaattctgtcacaccctaaaaatcctaaatatataaattgttgtttaaatggaattattagaatttattttaaaagcctagaagagaagatctaattttaattaataaattccaacataaaatggggccagttaaaatttcattaaatactttgcttaattctataattcctagatttttctgggatt

SEQ ID NO: 26769 - DNA, 421 bp, Oryza sativa
cagagaaagaaaaagaaagaaaaaatgggaggaaaaggggaggaaccaaaaaaagaggattacttgtggggcccatatgtcagtggaccccacaaaatttatgtgtgtgaatgacaaacgggtcccacatatatgttttttattcaaataccacctaagcgccacgtcaaccccacgtactaggtcaacaccaccacatcagcgccatgtcagcaaaaccgcccctccaaaaccacccagggagttaaattgcactggtttcaatagtttgggggtctagatatctggttttgtggtttagggtcatgaattagattcgggtcacttgtaagggagtcaaagtgaacttattccttcctactgaaacgagctgcagaatttggaataagttcactttgggtgcctctatttctcgtccagt

SEQ ID NO: 26770 - DNA, 1501 bp, Oryza sativa
acgcgccgcggcggcgcgtggtggagccgctgctccggctccggagaaccgggagcccgtttggacggtagcaagcgctggagctgtacgcattactgcaaatggcggtcgctacctgccggattcgcctcgcccaatcgcctgcttcgttcgacaagcggatggggctgtgcgattccgttcactgtagatgcggcactgtagcggtagagctcgctcatcagctcgccgattgggtggctccagtccagcagcgccacctcacagggcaaatcgctgtgaatccctgactttaatgggctaaagatggagaatccgcttccgtattggctgcatgtgcacgggataataaaaaagtctcctgctctgatgggcatgttagtttttgtctctacactcggtgtgtgcgattgtaaatagtggacgcatgggcaccgcactgctggactggtatttgtccgccatgatttggagttttgttggattgtgtagacgaatttgggttaggtttttatattatatgattccatctcacgcggtaattagtactggtgcgtggtcatgcagtgttgtcaggttatgatgtgctctggctagtttttatttacacttcatcagacttcagtaagtaaaggttcatggccttagttatcttagggaattttgattatagtgttgtaatctggaatcccaagttgtgtgataaccgttttgtttattttcagtgttttttattatcctgtatcggagggtggtgaactactgcttctaagaatgtaatttagtttagtcagtgagcacaggagccttagttttctcaactaattggcattgcttgttaggagttcgccaaaagttgatttaggacataaggggttttcccactttcccagagcttgattcactgctaaactgcactctcctgagtttctttgtagcttcttagccatcatctagagctggttattgccttttagtttcttaaagttgatttttactcaatttcttaaagtctgttgatggtataaactatgaaaaggtaaatgcacaatttgctgaatatcttttccagactgttggacgataaccactttgagctggtgcacatccttatcaagatggctgtttctttaaaatcaagtggcagtttttgtagcacaccgcctcagtggctgcattcaacaagggatcgaattttatacggttattctcattcaaatgccaaagagtgcacttgcaagaaaacaaaaaggcctgctccactgtgtgttaaagctacttccacgaaagtggaattagatttcaatgatccatcttggaagcagaagtttcaggaagactgggataaacgttttaatttgccacgtattacagacatatatgatttgaaaccaaggccaaccacattctcactcaagaaaaacaggtttttttttgtgtctttaactgaattggctagctttcccttaagctgctaaagatgtgaacaatactttcttat

SEQ ID NO: 26771 - DNA, 1501 bp, Oryza sativa
  unsure (1)..(1501): unsure at all n locations
gccggcgacgagaaggaaaggttggggaaaaacgaatccgaatcaaactcgaatccgcctatttccaaaggaaattgaccggagtttctataagagaaaaggaagaggagatcgaggagattatttcccctcaaaagattcggccggagaaggaaaggatcggccgaatttggcagaagacggccctgccttgcgatagggcttngggnggnggnggnttgnngaagacgatggatccgacaagcgggccccacctgtcagcgaccgaacgcgcgcgcgcggctgcggactgggccggactgggccgagggaaagagagagagggttttgggccggctttcggcccaaagccaaaagaagactttttaaaacctttttcaatttaaattattttttaaatgcaatttcatttattaaaaatacttccttagctcaaataaatcccagaaaaatctaggaattatagaattaagcaaagtatttaatgaaattttatctggcccaattttatattgagatttaacaaattaaaattagatcttctcttctaggcttttaaaattatttctaataattccttttaaacaacaatttataatttaaggatttttaaacaagaaaagctcttaacaaaaataattagatcattaatgatcaaataattactgaactgttctttgtatcatttaggaattgagctccgaaagatccgagaatatttcagagagttgacttaatcatggagaatttaataaaaattaaatccatccatgctttatatttaggaaattttatttcccacatttaacttcacttgtaaattaaagaacatttaatataaattctattaatgatttattaaataatttataaatcctgaaacgaaaatcaggatgtgacaaatctaccccccttacaaagaatctcgtcccgagattcggaacggctagaaagaaaagggcataggtaaactgcagtctatcttattccataactccgataattattctaaggctttaaagaaaactactgccgctttgaaactggtggctgagttgtaacacttgaagacacaactcttgaagacgcaactggcactgcattggctcctgtgacaacaatgttgttaacctgaccttgcggctgctgatgcttcggcttcggacactctcttgcaaagtggcctggcttgtaacagttgaaacatacctgctgctcccttccactactgttattctcttgagactgaccttgctgaactagcaccggctgattagcttgctcgatgttaacttctttgctttcattagtctctaatttgatctcaccaccgatgttcaactgttgcgactgtcctggaccagcgggaaaagattcaccaatttggagtggcttgatacgctgcctctggctactaccttgtgcctcctggaatacagtcattttccttttacggttatccatcctattcttcttgtcttcaagtcgaattgctttgtca

SEQ ID NO: 26772 - DNA, 1501 bp, Oryza sativa
cagaaattttaatcaacactgaacagcagacccatgctgcacaggcccgaccatcctgaacaaccatacccggctgtacagatctaatctccaaaccaggagctaagcaaattattaccagttataacatcaataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacataaacaaggcatggactccccagcgacccccgtgggcttatctccgccacttctcagtctggtgctccgtaatgaatcatgttatacaaaaggtaaagccgttgcccacgctggcttgtggttggcacggttaatgtttcacaacagtagctcgcgaaccggtccttaattgtcatgagcatgactctcaaaaccatgtgctcacaacccaccattatcaagttttagttggcaagtaattaattaaccaatcacgattgaccatcgtgaactaccattaaatataaccataagtgatagtgaaacattagttatcccaattgtgtgctaatgtttctaagcatggctaagcaattatatctagtatctagttgaaccaatatatataaagctcaactagtccaattataatcacccaaggtatcaaggaataaagtaatcaagaacaaaaggtccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaacacttccgacgcactcgcgaaccttcgcaacgacggaaacgacaagctatcacgcaaaacgaggaaaaagactaataaaaaccaaataaacaatacataaaaagtaaacaaacatgtaggtcataattttagatgaattaggagacttgaacggcctcattctgacttcaaatgaatttattatgaattttacaagattaaatctatttaaagcccatttaaaaagaattaaataaatttaattcaatttatggacaattttaatatgtagatctttattttatacaacttttgcaacttgaaccacattaaactgagttcaaatgtgaatttttaaagattaaatcggattaaaacacttatatggattttaattgaattatgacgcaataatgaattatttttgaaaaggaaaagaatgattattgtgtcagcggctagggtttgcggtggaccgggtgcacggcggcggttcacgggaacggacggccgagatcaaccctatccaaaacggacggccgagatcgaacggtccacgaccggctcacgggagagggcgacga

SEQ ID NO: 26773 - DNA, 1501 bp, Oryza sativa
ttcaagctagacaaacttcaattacttcaagcagctgtacagcttgtctcttctcaggcgccggccggccggcagccagcgtgcatatggtccacggctgatagatcatagataggagtagtatatatatactgatagattgtagctgcatctgcgtgtacaagttgatcaaagattcaaccgaggaatggatgtacatatgttctcgatcgatcgatcgatcgatcagatcatcagtatagtacagggtacctgcacagagcgatagatacactactgacaggcatgcagatcgggcagcagatgatgagtgtcgtgcagtgtcgcatgcattcagatcatccagagcctgcatctgcatgtagtacatgcttttgcattgacgtacttggttaattttgtgatcgatcgagctggccgttcaaaatcagcatgggcgcctggctgcattgcctgcccctgcaagagtgcagttgtgtgtttggcgatcggtcgactcgtcgtcgtcttcgtcaggctgtggccacgaccagtcctcccctctcgctgctgtcggcaacggagagacgatcagacgacgaccttaattggccggcctgcatatatatagtttcttgtactacctccgtcccatattacttgtctttttgagtttttgtttattaatgtttgatcattcgtcttattcaaaaaaaattgaaattattatttattttgtttgtcatttgctttattatcaaaagtactttacatatgacttatctttttttataattgcactaatttttcaaataaaacgaatggtcaaacgttgcaaataaaaagtcaaaaacgtcacctattatgggacagagggagtactgcgttacatgcatgtaatctattccctcctccgtccttaaatattctacaccgttgacttttttaaatatattttaccgtttatcttattaaaaaaaattaagtaattattaattattttcctatcatttgattcattgttaaatgtactttcatgtatacatatggttttatatatttcacaaaagtttttgaataaaacgaacgatcaaatattttttaaaaagttaatggtatcaaatatttaaggacagagggagtatatacttatctgattctctgttccgaggtagagtagtatcagctatatatgcctgcatccaaggacgaacgagaatgaacggctgcaggtaataacttagttttgaagctatatatatgaaccccatctggtcttgtcatggtctcgttctataatttcatggatcgggaccgaccgaccaaccaatcgagatcgatcggtcaaagctatacacgcatgatgcataattgcatatgtgtgtcctcctcaaaaaaataattgcatatgtgtatatgtagccaatttaacgaggcagacagggaactaaattgcatgccatatcgcgtcgctttcgccccccgtcgtgtttgtacatatgcattcagggtttgggctgcc

SEQ ID NO: 26774 - DNA, 1501 bp, Oryza sativa
ctggaccggcggaacattggacttatcccttcgccggagatcgaagacgatgcagccccgcgtcgggtgccaagttccgccggaacgtaaaaacaaaagtagaagtaaaaaagggtggcgatgcgccgaattgtattgatcgtgaagatagattacatagaccccgggtgtacatatttatacccatgggctgatacaagtccttgtcggataagaaagaaagtttactaaagataaaaggaaaagataaagtccttataggacactaaacacactttcctaaagataaaaggaaactaacaaactattcctaattaatagataacttgccatgtcgtattctctttgaactcggtctcttatgtataagcttcatttagtagatcaatttccttaaccgaatatagcaagaatccgacaactgacgacttgacaactctcgtcggcgaatctcaggacttcgaagccgatgctgactctaagccgatgactactccgagcttaccaaatttcactgttaacaataacttcttaactaactgtatcaaaatcgtacctacattgcaagttgttgcatttatatgatcactcataaagttcctatactaagttacaccttcttgccaagttgttgcactagaacgctcatttctcgtgttcttgtactagaacacacccacttgtcaagttgttgtactcggatgttcaattttcaagttcttgcactggattgttgtaccgtgggtagatgaggggtattggttaatgggtagatgaggggtattgaagtaataaaatttctcgatttgttgattgatagtgggtagtagtaagaatgtaagagttggtttattttaagacaaattttaaaatttagaagttggtttattttgagactaatggagcaagtagagtagtactaagagcaagtttaatagtatagctcactactagctccaattcatctatagccaatctaatagctaattcatacaatagctatttactatactattaatatatggtcccacctgtcatacacacattacgtcttaaagtccgtactgcagctggctacagatctatagcatgctgctcttctctcttatcttttatctcattagagcaggtacaatagcagactaatagcctgcttacctaatattttaacatatatgagagagagggaaagcagagagagcaaagcggacgacaatccagtcgccggctcaagcacgagcgcctaggcgctctggccccctgtaggatcgagatgtcgactagagggggggtgaataggcgatttaaaattaaatgacacctaatcaaaactaacctaagttgctaggattggtgagggtcaactctaactaagcaactaagttatgttttgcaaacctagggtgatagtggctcaatcatatctctaggaaagtaaatcacactcctatgttaatgtttagcaatcctagggtgatatgatctcaagtatgtctctaga

SEQ ID NO: 26775 - DNA, 1501 bp, Oryza sativa
agaaatatggacaggcgaggcgcagacagtggtaaaacactgcaacacgcagagttcgaggacgtagattgtcgcacggttgcaagcagaacgccgcggtcgctcgccgtaaatcgatgaaaaacctaccaacctacctctacggctctacctgaggagggaacgaggaattgaggagcaaccgaacaaacgaaaagggaagaaactcgcctcctagtactctcctagcacagcaaatactacatccgtccaaaaataagtgcagccgtagatatccgtgcccaacgtttgaccgtccgtcttatttgaaaaatttatgaaaaatttaaaaatatttagtcacacataaaatactattcatgttttattatctaataacaataaaaataccaatcataaaattttttcaaataagacaaacggtcaaacgttgaacatgaatcgtgtaaaactgcacttattttgggacggagggagtacttgctgtgctaattaattagcaacgcggctgcgctgcgactgcgagccgagagagacaggcagacacgcagtgcgaaggcagcggtgtacgtcgtcgcgtagcacggcacacggcagacggggcgcaggacgcacggaggctggcgagaggacggacaaggtcagcagcgtgcgtacgtgcgtgttttgtactacacctctttgctgttgtgagttaaaacaagacgaatggcatgatgatgatatgatgatgagtcgtcgattatccttgagattttcagaggtggcgatcgatggcccccttgccccctgaatataatcctgatgacctgatcacgcacgcacgtatggtattgcacgtcaaagatcggtaggaccaacgtccaaaccttgaaaccctgaactgaaacacaggccggctcctacctaaattaagttgttggtagcacgtccccggagacacggctctcctccatcgagcgcgatgcgcccaatgaccatcagattcttccactgatccgctagctgcgtactcatattgcaccaacgcgcacgcaacgccttgccggttgcggcctctcctgccactgagacggacgtagtcgtagtcgtcgtagtggggggcaaagggcaaaggagacgacggggggccacgaccacgagcggcgcggcgcgaggattttataaggcgcgggcgggtcgtccaccggcacctagcgtcgctgtggtgacgagacggaggctgaactgtccgcgtcgggggcgggcggtggacgacgtggacatgtcacgtcacatcatatatatatatctccacaggatcatacatccatcgcgcgcagcctagctaccaccacacctgatcgagccgagccggcggactcgaagcatcacccaatccgtccgcccgaaacgggccgagatttttccgcataatatcgagggttgattggatccatattactacaaattaaatataccatttcagataaatgacactactatttgcgatattggctgc

SEQ ID NO: 26776 - DNA, 1501 bp, Oryza sativa
tttttaatacatgggattacatatttttctcttggttggttgattttttgggtagacattggaggagggaagggagggataacgatctttttttaaaagagaaaatccaaaaatgccaatgataaaaactcgatttcaagaaatatcattgttgagtacgagtttcataaaataccattgtacaagcacttttgtcttagaaatatcatcgtcgttagggttccaaacaacatttcgttaagtgctataggatgaacagtgcacttaatggtacataatggacaaaatcctaatagtgatgatatttttgagacaagatcgtttgtacagtggtattttatgaaacttgctatttcttaaatttaggtgtttgtcaatcatatttcttgaaatattttgtcttgttttgaggtagtgtagatacgcagcgcagtggtgtgtcttttgtgtaattgcaaagaagaaaaattaaagttggactccttttggctactgggttggactattgaaagttcagattggtgtttaagcttattataactaagcttagatgcatgcatgatcttgctttaatttaacaactgcccttgataggtctgcaattccccacaagatttggttgcttggttggtagggttcatgggatcctaagcccctaacaaataatagcattgtccactgtcatggcatgatggcaatattatactccctccgtttcgaaatatttgtcaccattgactttttagcacatgtttgaccgttcgtcttattaaaaaaattataaaatatataaaactatatgtgtacatgaaagtatatttaacaataaatcaaatgatatgaaaaaaataaataattacttaaattttttgaataagacgaatggtcaaacaagtactaaaaagttaacggtgtcaaatattttgaaacggagggagtacaaaccaactcagatatcagttcctcctcatctctactcttgtagtttctccacctttaccacattgtatatattttaacacctaccgtaagcatgatgctaagattcctcctttcccgatttgatcacttaagcatgaatcattgagtaatcacaacggtttccaccacaagtagtagtagtagtataattgtttagcgttgcaagagacaacatgcatctgctctaagtactccagcttttactaacctcttatctaatctttgggctagtttggttagttgtttttgactttacaaatgctgccttcttgtgagcaactctaaactgtaaacttccttattttttatttggcaaaatttgctacaagacaatgaaagattttggcatttgctgtgagacactcgaagattgtgaatcttttcatggacactgtaaaaagtgataattagccgccggacacttctcccattattttattatttccgaccaaaacggagaaagaaagagtggtgtaagtaccaaaatgcccctggacactatttctcttttccttccagc

SEQ ID NO: 26777 - DNA, 1501 bp, Oryza sativa
aagcaaatgacaaacaaaataaataataatttcaattttttttgaataagacgaatgatcaaacattaataaacaaaaactcaaaaagacaagtaatatgggacggaggtagtacaagaaactatatatatgcaggccggccaattaaggtcgtcgtctgatcgtctctccgttgccgacagcagcgagaggggaggactggtcgtggccacagcctgacgaagacgacgacgagtcgaccgatcgccaaacacacaactgcactcttgcaggggcaggcaatgcagccaggcgcccatgctgattttgaacggccagctcgatcgatcacaaaattaaccaagtacgtcaatgcaaaagcatgtactacatgcagatgcaggctctggatgatctgaatgcatgcgacactgcacgacactcatcatctgctgcccgatctgcatgcctgtcagtagtgtatctatcgctctgtgcaggtaccctgtactatactgatgatctgatcgatcgatcgatcgatcgagaacatatgtacatccattcctcggttgaatctttgatcaacttgtacacgcagatgcagctacaatctatcagtatatatatactactcctatctatgatctatcagccgtggaccatatgcacgctggctgccggccggccggcgcctgagaagagacaagctgtacagctgcttgaagtaattgaagtttgtctagcttgaagctgagctgaatgcctgaaaccctgaagcaagctagctaggttgcgtcgctgcaggccggctgcagctaaactaggagctatatatgtactaggtagcactagcagcagctgctgcattgcgacgtcgatcggagaggggacgggcatgtgtaggggtccggccgtcgcgcatgccgctagctgctgggaggaggcgcagtcatatgcatgcatgcaaacacacatactcagctcagattgctgttcatttcactgttcgatccatccacttttcccatcttgcattgcccttgtgggccggggcgaggtcgacctagctccctctcgatcgatctcaccgccggcagccaccacgccatggccgccggcgaggagatagctagctgcaaatcgcattgctgcaggtgttgctgctgaaaattggagcggtgattcgatcgaagagttctattaattgttaattgggatggacggctagctgagctcctgttttaatttcttctgaatcattgatcgaaccgaatcaataatactgctcgatctctcgttggttcgtcagtaattctctttcctgcagtacctatcaagcaaagcaagcatatatgaatatgacacgctgattggatataatattacacagcatgatcgagcatgttgatccagtcgtctgctagtgcatgccaatactactgcagtatcatcatcgacactgccgttgtttcagtactgtaatatcgacctatggattgttgacctagttctactgccc

SEQ ID NO: 26778 - DNA, 306 bp, Oryza sativa
tgtagatcccaattttagaaaaattgagagacttgaaccaactaaatctgagctaagatgaattagttattaatttttaaagattaaatcggattaaatcatttatatagattttaattcgattatgacgcaataaagaattatttttgaaaaggaaaaaggatttattgcgtcagcggggctcgggttcacggtggaccgggtgcacagaagcggtctacggaacgaacggctgagatctaatctaaacaaaacgaacggccaagatctaaccgatctaccacgggtctacggctgacgtggtgc

SEQ ID NO: 26779 - DNA, 1501 bp, Oryza sativa
cactatcaatcaacaaatcgagaaattttattacttcaatacccctcatctacccattaaccaatacccctcatctacccacggtacaacaatccagtgcaagaacttgaaaattgaacatccgagtacaacaacttgacaagtgggtgtgttctagtacaagaacacgagaaatgagcgttctagtgcaacaacttggcaagaaggtgtaacttagtataggaactttatgagtgatcatataaatgcaacaacttgcaatgtaggtacgattttgatacagttagttaagaagttattgttaacagtgaaatttggtaagctcggagtagtcatcggcttagagtcagcatcggcttcgaagtcctgagattcgccgacgagagttgtcaagtcgtcagttgtcggattcttgctatattcggttaaggaaattgatctactaaatgaagcttatacataagagaccgagttcaaagagaatacgacatggcaagttatctattaattaggaatagtttgttagtttccttttatctttaggaaagtgtgtttagtgtcctataaggactttatcttttccttttatctttagtaaactttctttcttatccgacaaggacttgtatcagcccatgggtataaatatgtacacccggggtctatgtaatctatcttcacgatcaatacaattcggcgcatcgccacccttttttacttctacttttgtttttacgttccggcggaacttggcacccgacgcggggctgcatcgtcttcgatctccggcgaagggataagtccaatgttccgccggtccaggcaattgtatcgtctacgtcggcgttgttcaaggctgcatcagtacattcgacctcttagattgctctggtttggatgatatatttgcctacctatttatcatgtctctgttaatctagtcttagcatatcaatttagctctatcggctgcttctcgttttagggtttctgccggtatcggctaaatcgcgttgctagattagattagcttagacatctaccaccctgaaaacttagtcaacggcttgattgtctagatattatgtttcttttcatacttagtgttgcatcagttaagtttgatctactaagtcgtgcttagaaccataatctctagcctgcttcttgattgccaataagggtttcatcggggtttcagccggtgagttatctggatgttgcatcggctcataaggattgcatatacatataagttggatttagccgatgacaacaaaggtttcactgtttaatctaatcttgtggatttcatgacatcggacctccagccgatgtgtgctttaaccttcggattgatgcttatttattatatcttgtttctagccaattggtttctactcgactatattgttattacatcatcaacagccgattgcctttatatcattatctacattggatatatagccgattgcttacactctatcgctatcggctg

SEQ ID NO: 26780 - DNA, 1501 bp, Oryza sativa
ttaaccgtgccaaccacaagccagcgtgggcaacggctttaccttttgtatagcatgattcattgcggagcaccagactgagaagtggcggagataagcccacgggggtcgctggggagtccatgccttggtttataagggggtgattatgatccaggaatggtgcactgtggtgagttgtgttatgcaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagtagagcaatgtttttcgtgattagtctcacacctctcacaataattattgatgttataactggtaataatttgcttagctcctggtttagagattagatctgtacagccgggtatggttgttcaggatggtcgggcctgtgcagcatgggtgtgctgttcagtgttgattaaaatttctgattaactactctactgttttatttctcttaaatattttgctaaacgctgcttttgcaaatgagtctatattatgccatcctttggtatccttgtgcacttgcatatttgctgtgtggcttgttgagtatgtcatatgctcattcttgcaataatcaatcaacctcagttgaagaaaaagaatccagaaggagaagacgtttggcttataccccagttgagctgcctgtgggagtggagccggagcttcgctagattttattttccgctgcagttttcttcatggtgaggactaagtgcctcttaagtaagtatttatcgttgtagttaatttgatgaatctgtatattaaattgttagtttgtgtacctcggctgattcctggacgaggattttatgcacaaataagttcggaaattactagtgaatttccgggcgtgacaagttggtatcagagccatctcgactataggataagccaaatggtcaaaccttaaggactaattttccgaaaacatgatttgtgaaaatttctcctttcttccttatctagaattctttgcaaattgtttcattgtctactctcctctctcgttcaacttgagtagttctgaaactagttgttgaaactagaagatgttgatgaggtcaacttatggaggtcagtaaagtggatcgaggaagaaccgaagtgccaactggtcaagatggaatgaagtttgcatcctaccttagaacctatgccaccaaagtgactttgaagaatagttagtaggatagaacgtttgttgcttgcttgtgtgtaggtatggttgcattcccgtcattggtgtggttcaatgatgagtgtgtaactatactaggttgcttgcttaatcaacttgaacaatataatggtctacacacatcagatcagtgttaacctggttaaggtcttgtctttagtgtaacccctctccttctatcttctctaatatgcaacaga

SEQ ID NO: 26781 - DNA, 1501 bp, Oryza sativa
aataagatatatatatatatatatatatatatatatatatatatatatatatatatatatacacaatatctagaataaatgaaatactagtaattccctacatttagagggcgcacttattggtctcaattggttaattagttcattaattatctaggatgtgaagcaaaactaaaacacataccttagcttgcacctataaaaacatgctttagtcaaagggatgacacatttacatgtataattaatgttgatatacaacaatcaaattctagttcagaaaacataggtttgtactgtagaaacaaaacatacatgtcatggttacaatatggcaacaatatagttgcagctgctgaagatcatgttccttggagtgcatagcatatattgtatcaaagtgtgtggatcatgcataatgctccacattttgatatttgacatgtaattcatatatttaatatataaactaattcgtatgtgaagaaaacttacaaatgcatataacattttattcccacattggtagcatcatcatagtatccacgtgattatactcatgcctatatggcatatttggttggttgtatcaggctggcttgcttctctgggtgcaacttctaaatcgacggctctagtggtcaacttctaaatttgtcatttgcaacgtgtcaggtcatacaatggttctatccttgcctcagcaaaatcatcacgcaacgccaaagcaaccgtaaccggtaacgtatcacactatctgcagtgatacgtcttatctatcccttccgtactaagccccaattccaaaagaagtcttctaaaaaaagaatagattgatagacaaatagagtaacgcacacaggcacttatttgatgctccatttggtgtacgccgcggcgtgaatacgtaccaccctatcttgtagtatctacagatggcgagtagataaggtaacgcacaatgtagtcgccaatttgatgcttcgttcaggttcaggtgttacggtgtgaatacgcaccagtctattctataagatagggtaactaacgcgcatcctataagatagagtaaagcacatgtatagtcacttatttgaccctccgttgggcatcgcggcgtgagtacgtaccacccacaccctatctctgattctccccaaaatccatactttggtagtgtcttgacaacgttatactagtagccatagtgacgtggccgtggtggcaatggtggaggtgcaaaggctataagaacacggtcaacacaacacggccgcaaatcagccatgtcagcgatcgagcgaggtgtgacatagcaagagatagagacgtgggcagcaccagccagccaccgaggtgctcctcctcgtcagacagcccagcccagggcccgctcccccatggtgggtcccaccgcaccaccccctggtgggccccactccccccttccccaatatacgcgcttgtattttaacccttctcctctcctctcgtctcctcc

SEQ ID NO: 26782 - DNA, 1501 bp, Oryza sativa
cttgttttatattaaaagtactaatattttttttacaaacttactcaaacttattaaatggattataatatgaaatggatggagaaatggttttactacaataaaattgaaaaataaaacatgaaacatgagctaaagggttattcacgcttaggccaaactattcgaagttatccgaaatagtttacaccaattaggccaatgtacatgttctctaaagaaatgtcaatgcagatagagccatagtctctaatctaatctttgtgatcccaatcagtaatgccactcttggatgacttgcaaacagcagcatgcatgattagttagctgttgataagccaagcaaaccgatcgatctgtgtcactaatccatgtccacaaaaatctaaattggaaatgccaacccccactgaccaatatgcaaagaccaaagataattaattgagagtaacgtatgccaacgcaacctgtcatttcttttgcccaccactgctactatttcttgaccggtctattaccaacttgttaataatggtttagttatcatatctcggaataaagagagaaaatgatggaaaagttacaacctgatgacactttcggctatctttgattgggttttcagagataagatcctcatctcaatggccatcacctaatgtttcgctcacacattatacctttctcgattatgagatgcatcatctttggtctaccatggacccggtgtatgtatcaagattatccggaatacaagatgggcataacagctactttgccaattttccttgaggaggcactttttaagacttggttgacaatgctttggattataattttgcattttagaatttgaggttagaaataattggttttattcgtcactttcgatgcccaagtctcttttcatggttgctaagacgatggataaaagatctaagaagtcaaactttaaaaatccaaaaacacttcaggttaagatactactccctccgttttacaatgtagcattacctgcatacatatgtatgtgcctaaatttattaacatctatataaatatgagcaatgctagaaaatctttcattatgaaatagaggaagtagtattgacgacttggcctcctccttgattttagccaaaaggtttcctgtcgagagcttcttttgctgaaatgttctacggttcctttcattctatattcccaggctactaggagtgtaagcgtgcgcatggtttcagaaaagatgataatagcgatagtgaagtatgatagtgaagtattgggttgtgaggctaccggccaagactcgaactctggcttaaaaataaaagctccttagtaggtatgtgttataaaaaatgtgagttaagaaccggcgtttgggttacgggtcctcatatgggtatgagccggctatcagatgccttttctcgatctttagtgcaatgttttcgtgatattttctcccttatatctagttcttttttatgatactagc

SEQ ID NO: 26783 - DNA, 460 bp, Oryza sativa
ggccagcccaagccgactcctccctcctccctaacccctccgggtcaccgacaggtggggcccacctgtcggccccttcttccacctcccgccgtcgaaaccgccgcctactgccgccggtttccccgcttcccgcgcccactccgcccatgccgcacgcccacgtcgccgctcaccttccccacaccttccgctagctcgcgcgcctgcaaatggcgggggatttgctcttttcccccactctctctctcctcctccacttcccccacgtcgccggctaaatcggccaccttcccggcctcgtccgcccctcccgaggccttataaaccatccctccattcccctccaccttttcctctttccaccgctccctcccgtgccctctatcgctcccacgccgccacacccgccgccgccgccttttccactcctccggccgccgctcgccgccgctggagc

SEQ ID NO: 26784 - DNA, 414 bp, Oryza sativa
agctcggtaccctggttattttaaaagcatcatgatctacagtaaagcaactgccatttggttattattgtaaccaatttctttttgtttttaataagaagcatgtaatgtgcagagtttcaggtttacattttatactacatgtctagcataaattaatcatgtttccacctgttcctgctatactacaatttttcctagtttagtcatggatactgtatgcatttgtgacatacaaagaagaaaataaggttgttttctactagttattctcacttttggcggtggttggtgacaatttcatcttgcttgtgtttttccctagttgacacaaccaaactgaaaaacaccacaaatgtgttgaaactttattgatctttttgctgatctgtcacctgaacttgccattccagt

SEQ ID NO: 26785 - DNA, 1501 bp, Oryza sativa
gataatataaatgattgaaaagcaaacaaaataatttataagtaaagcttttatatttgtattattagcggtttaaaatcaaatctggatcaagaatatactacatgcaatgaaaaaaccccaaactgatcaactctgaaattatggtccaaaatttaagttttgattgtggctcataagccaacaaacagacgtagacagtgagaaggctatgttctttggggaaggttggaaacctttccttctaaacacgcaaaacagaacaagggaataacacatgattaattaagtattagctaaataaattaataagattttaaaaagcaaagctttttgagaaaaaaaacacaccatttaataatttgatgagtatgagcgcggaaaaacaagagaggataagttgaaaaaaatacttgcactatcccaaaatataatgagttttggtttgttgatatatatcctaacattacgaatctggatatgctctgcccatactactaaaatatatttcatccaacctgggagtagtatagaacacggcctatagttaggctagaacacgtgcacagtgagggcccggtttggtagctactacgtgccggtgccggccatcgtcgtcgcagatcgatcgggaactggtcaagcaagctaacctagccaagataatggagcaagggccaagagctaagcatgcaaaatgcaatgcaacccagctgccaaccttcagtatctcgctagcctggcgctcccgtactctctcctctccttcattcccaatcaccagctcctgcccccacatgtactcataggcttagcttagccttttgacctacctaccttctcttgttagctagctaagtttcacctcatgaaccctagctttggttggtccattatttcatttttctcacaccaagaaatcaatcaaagaaagagcctcactacggtgatatctattggtagtagaaattaatttgaaccattaatctcatttgattgaagggttcagatatttttatactaccaccctagttattacaaacgtggaggccattattatccaaaaaaaatatatgcggagaagtataatcattatttagtagtgactaaactattatttcttcttttttgtttttttatggaatatgaacaataccatgaccacacattgatctagccaaaaaaaacatatataacactgttaccctaatcattgtattagtaaattactgatttacccttaatataccaccagtagagagcaccggagtatcgctcccaaagaaaataccaaatgggtgcatgcatgctagagtactataccaaaatctagctagttgcagatatgagatagctacctataggaggagtagagatgatatatacataaatgtagagtaaattcaataataataactagtggagtagtagtatgtaataggtgtgtctgtatgtgtcataaaacccaatataatgtgtggtaattgcatatatggcccaa

SEQ ID NO: 26786 - DNA, 1501 bp, Oryza sativa
caaatgaacaaaaatagcttcgtcgcagctcaattccatgaccaccatcaccagcaaaacgtatagtccccaatccgatacgatatcccaatcaaccaaccgagtggaggaggcaagtcacctggagagccggcgcggaggagtccggggcggcggcgtacgcgagccgcatccccccgccgggagcttctacgacgacgggcgccgcggcggaggtggtggcggtgaccgcgcagtggacgcggaaggggcccccgcgggagaaggagcacctcgacgacgaggaaggggccgaggtggacgaagacgacgacgacggtaaagaagaagtagagtggtggtggtgcgcgtgggggcagggcgcccacttgaagtgcggcgcgaggcacgccattggcggcggcggcggcggtggcggggaggagaccggccgccgaatcacctggggtcggcggcctccatcgccggagacggtggtggtagtggaggtggaggtggaggcgaggcgaggcgacggtggagatggcgtttgggtttggctcgggttgatctggataagggaaggaggaggaggtcagctcggctaaagctggggggattcgtgggccgtttgggccggcctgactttctccgtgggatttcaaatcgggcccatccaagatctcatatgtgggccattaggaccgttggaaaacggaaaaagtacaccgaaggtccctcaacttgtcattaaattacaaaatcgtccctcccccaaccgtaaaaccagatatacggggtcccttaactatacaaaaccggtcacccgagatccttcggtgggtttgacccggttttggtctcagcgtgggacccacgtggaccccacgtgttagctgggcacgtcatcaccctctcccctctccttttctcctctctctcactcttctcttatcttctctgggcgactgggcgacaaggcgagcaccgctgcggaggcgccgcgtcggcgggcgagaccggtgcggcgtcggcgggagagagcggtggcggagaggcggcgccgacgactccgcgccgctcggccttgtcgtcggcggcggctccgagcgcgagggaggagggcgcgggcctcgtcgtcggcgttggcggcgggggtggcctctccggcggcggcggtggcgggtagggggcggctcctccggctgcgacggcgcgggagaggctggcggcgagggtgtatgaggaggaaggcgccgtccgcggtttcctgctgcttccccttcaccgtcgtcgagctcgtcggcctcgccggcaccggcacgtcggcgcggcacagggggcacgtcgtccgcaggcgagcgcgcgcaccgtctccccttcctcgacggcgcgcaggcacaccgcgcactccgccgccgctgccgccgccgcactacctccgcggcggggcgggagcacgaagcagggcagccgcgcaatggcggcggagtcgaggtgcctcgacgcctactggcctact

SEQ ID NO: 26787 - DNA, 221 bp, Oryza sativa
ctgatgtcaaaatgtggttgttgtgtcaaattcatcctaccgaccatgaactgtaagcagtctaacatgtctggcacatttcagttactgtttgttttatgttgagctcaggtacatgaaactaaaattatgttgacttatgttgcttccattcagagatcagcaagtcgtgctaagctgaatagctggctccctattctttattgttcgttttgagagca

SEQ ID NO: 26788 - DNA, 1094 bp, Oryza sativa
caacgtccgaataggcggaatagctgctaaataatgcaatatttctaccttagtgttaaaatgcaaaagtttcgttgttgctaaaagaaaacgagcatgcagttcgtacttacccccttttttttttgactggagcaaacaaattaattgatgaaataatcgcgttgagtttataccctcattatggttatttattttattacatgacgttgtaaacattttgacacatgtttgatcattcattttattaaaaaacattatcattatttattttattgcgacttggtttatcatattataggtactttgcacaaaagttttaaataacctaaatagtgaaacatgtgtaaaaagtcaatagcttcatctattaaaaaccgaaggtattatcatttaaacatgatctctcccttgacaactttgactattattttcaaacaatgtcaaagtgaatagattcgaaggtaagatattactatagttctttcgattagatttaatctaatgataaataataggttatttaaaaattattgttggtcaaagttgtacaattcagagtcaaaaccgacaagtatttcttaatgagtaactatacgagcataacggtagtagaattaacaccaatggtatataacatgtcaaatggatacaccaactaatcatatttcttgacaatcgcagaaggtggatacatcaagataaaacgtaagtccaagatcatcagttcttttccgaacacagcacagttcattatgcatcaccaacaaaagtctaaataaatattatttgtgtatttttttttcaggtagcacatttgcagtagtaatagttttcacagtcatgctgattgctcttatcattgcactcatgagatacatgagcaaaaagagcaaagctgatgagaccattgactcaacaagatcttctcaaggttgataaacgataaccccccctacaacacatgaattctgacaaacttcagatacaaatcaacctgcacaacatcatctactaactactaactttcattatccaccaagacaacaaggttcatggggaggtgatcaacaggtggtcagggctgtacaagt

SEQ ID NO: 26789 - DNA, 1501 bp, Oryza sativa
tctcgaggacgcacatgccgaaggagtagacgtcggcgagctcgtcgtaggactcctcgtacacctcgggagccatgaactccggcgtgcctacgcagcgagtgtggtcgccgccgccgccggcggcggagaggcggaacgcagcgaggccgaggtcgccgatcttgacctccctctggttgccgttgacgaagatgttgtcgcacttgaggtcgcggtggatggtgggcggcgagtgtgcgtggaggtaggcgagcccgtcgaggatctgtgcgcaccagcgccgcaccgccgccacgctcacccgccggtgcttctccctgtactgacggagcgtgccggagacgaagagctcgatgacgaagttgagggcgccgcgtggcgcgtcgacccagtaggccagtaggcgtcgaggcacctcgactccgccgccattgcgcggctgccctgcttcgtgctcccgccccgccgcggaggtagtgcggcggcggcagcggcggcggagtgcgcggtgtgcctgcgcgccgtcgaggaaggggagacggtgcgcgcgctcgcctgcggacgacgtgccccctgtgccgcgccgacgtgccggtgccggcgaggccgacgagctcgacgacggtgaaggggaagcagcaggaaaccgcggacggcgccttcctcctcatacaccctcgccgccagcctctcccgcgccgtcgcagccggaggagccgccccctacccgccaccgccgccgccggagaggccacccccgccgccaacgccgacgacgaggcccgcgccctcctccctcgcgctcggagccgccgccgacgacaaggccgagcggcgcggagtcgtcggcgccgcctctccgccaccgctctctcccgccgacgccgcaccggtctcgcccgccgacgcggcgcctccgcagcggtgctcgccttgtcgcccagtcgcccagagaagataagagaagagtgagagagaggagaaaaggagaggggagagggtgatgacgtgcccagctaacacgtggggtccacgtgggtcccacgctgagaccaaaaccgggtcaaacccaccgaaggatctcgggtgaccggttttgtatagttaagggaccccgtatatctggttttacggttgggggagggacgattttgtaatttaatgacaagttgagggaccttcggtgtactttttccgttttccaacggtcctaatggcccacatatgagatcttggatgggcccgatttgaaatcccacggagaaagtcaggccggcccaaacggcccacgaatccccccagctttagccgagctgacctcctcctccttcccttatccagatcaacccgagccaaacccaaacgccatctccaccgtcgcctcgcctcgcctccacctccacctccactaccaccaccgtctccggcgatggaggccgccgaccccaggtgattcggcggccggtctcctccccgccaccgccgccgccgccgccaa

SEQ ID NO: 26790 - DNA, 1501 bp, Oryza sativa
gcagtagtcgtaactcgaccactagaagtggaaatagtgggagaaacgctacatcgctggtcgaggaccaggcagtagtcgtaactcgaccacttaaaatggaaagtgggagaaacactacatcactggtcgaggaccaggcaatagtcgtaactcgaccacttaaagttaaggtgcgagagattgctacatactggtgcgagaaccagtgaacgagcagaattatctctcgaacaccaatggaagttgcggtgtgagagattgctgcgtactggtgcgagaaccaatgagcgagcggaattatctctcgaacaccaatggacgctgcggtgtgagagattgctgcgtactggtgcgagaacgagtgagcgagcagaattatttctcgaacaccaatggaagttgcggtgtgagtgattgctgcgtactggtgcgagaaccagtgagcgagcggaattatctctcgaacaccaatggaagtgctagagttggtctattgcaagtatatctcatgtggccagcatgactcacgtacccaacttatagcatatccggatgtccgttcgcaatcatgtcgggtgatcaagccgacgacgttcgcgaggaattatccgttaacaaccttttctcgagtagtccagccatggccggtgctatgagataagtcgtcggtcttcgttggcaggttgggtgcgataactccgcatttgtggagaatgttctcgataatggagtgtactcgaccataacctactcgagtgctcagttgttcctgaaaaatattttctagaaggcaagatatatagcagagaatatcgaatatgtattcaaaaaactgcatggatcttctagtattatcaggatataacgagcagatgtaaatatcatgcattatgtaaaccgtaaacaagcatgatttatacagaagagaacggagcgagccccagcgttggaccgtagttggcctaacatcggggatgcttgcacaacgtatattgtataagaaacatgctctaggtaaacataataaattatagatctgacaatgctgtatgatctgaataggtacgataaattgcatataaaatattacgtacctttgtagatacatgccggatgtatctacgaaattagtagatcaatttgaaaaaccaaattaccttattgcgtactcgttcgacatcatatgatctgacatcttttggtacgccgcgtatcttgaggcttggatgatctcgatagaccaagttgtcgatgacgatgatggttccgatctggtcggaagatgtatttcagttaggttagatctcctcacatccgaagtcaccgagtagcttgttatcggagagtccatctcttaaacccatctcgtcgaaatcctagagcaccaaaatccccctacctggtgcgccactgtcgacgttggatgtcgcaactacggtatttggacagtatggggatcgttggtgctaggatatacgcgagactgaggtaaaagaga

SEQ ID NO: 26791 - DNA, 173 bp, Oryza sativa
ttagtgtaaagtatgtaatggtaagcgtgttcgatctaatttcactcttgaatgttccaaaccaacaacctaatcccacatccgcctactgcccagctctccactagcgcactaaaagcaaatgaacaaaaatagcttcgtcgcagctcaattccatgaccaccatcaccagc

SEQ ID NO: 26792 - DNA, 585 bp, Oryza sativa
  unsure (1)..(585): unsure at all n locations
tgtgtcattttggatgactagctggtacagncgttcatcatagaagaagcatctgactctttcatgcatactccacttggctcgggggnnnnnnnnnnnnnnnnnnnnnntccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataag

SEQ ID NO: 26793 - DNA, 342 bp, Oryza sativa
cgatgcttgatttgcgcgctggaacagcacatcatcaattaactggcaggactcgcatggacgatttgaaacctcaagaactaaactgagcccaaagcgaaactttatggtccatgtcagctattcacccctaaaaaaaagggactagttcacttggctgggtgtgttgatgatgacaacaggtggcgtggtttggttgtatctgaatgttgggagaagacattcagtgtggctccatggatgggttaggttggattagagctgagtaagagacaatccctcagatcatgggaaagaaaaagagatgaagacgctaaaggaataggagaaagacggaaggaa

SEQ ID NO: 26794 - DNA, 299 bp, Oryza sativa
  unsure (1)..(299): unsure at all n locations
cgcgcgcccttgaatagactcggcnnnnnnnnnnnnnnnnnnnnnncttcatttcacacctctcttcattacagggttccttacttataaagatcatacatgccagcctggccgcttggccgaattacacaacacacatgcgcacacacccacccgacacgttactgtaaacgtcatcctggcattgtagctcgtcacgcgtgtggcacaagcgtgacatcccgccaccgccgctgtcgctgccgccaccccctcctctttctcatccctatccccaacacaaccaccttctatcaagg

SEQ ID NO: 26795 - DNA, 669 bp, Oryza sativa
cgattcgggagacggagtacatactaccgcaacaggagaggtttaatcctggagaaggaagatagttaagagagagacaaaggaaccttgccgtattaataccttaagtgacactaggtgataaaatgagcgaagggaataaaattactccaaatgttcaaaagcgacaacggcctgtaaaccaggaaaaaggagttatcctagaaagaattggaacagtacattattgcaaaattaaaacggaataaaacgctggaaaagaagaagatgaaccagatgaacatagtacagataatactggaaggggatccgcgtaaaaattagcagatgcgagaaagaacccgaaaatgttctagtgcaaggaatatatattggcaagatgtgcaaaacaagcagaaaaacatgccaaagaaaggtggctagagtctgatcatgaataatgaagtaagtagcgaaaacgttagtaacgaggtgtgaatacagaaaaaatataaaatagaagagaggaaaaacgaaatggcagctatgatttcttagaaaataacatcaatcgcaagaaggaaatgccatgcactggacagaaggcagaaaaagttaaaaatagattatccaaaatgcgtagaaagagtgcgtgagagatagtaccgaaccttcttacttcaattagtc

SEQ ID NO: 26796 - DNA, 1501 bp, Oryza sativa
gggttatagccgagtatatatgaacctacagggtcgcacgcttaatgggccggaataaggggattggatataaatgcaatatgagcttaattcggatagggatccgaataggagtcctacgggccttggaggcccgagtgatggatcctatatattcgtgaggggtgtgactggcggaggcattgtatcacgtgagaaaccctagccgtcacttccctccccgagcaaaaccctagccgcgcgcgggtgctagcacatctgcgcgtggcgttccatccctgtacgtgtggataccggtagaggtgccgctggtttgcagtgctgatcggcgtgggagtacggcgagcagaacgcacgaggaggagaaggtcgagccggtgcgatcgactatttcctctacatcgacgcgcgctacttcgcgagagttccttcgacttctcagcgtcttcttccgcttgacagcgcgtcgagtgataacgatctatgatctaatacttgcatggttcctggtttacgaggtagaaaattttgatttatgctatcgtagcctacgcgtattccaacagtggtatcagagccgccttgtatagttgatgatctagatcattgcatataattgatatgcggatgtagtagatgagatctattatgttgtatatgagttcttaggtgatcggaacatgagatgaaccgatagccgcatgggttgatgagatcaatcggtatgtgtgttggtgactttactggaatgtctagtactcaccaaggacgagcgcgattgtgttcatcggatagtccgatgtccactggaaccgcacgccaatgagaaaaacgagccaatgagattgactcggtttcggcataatttgtttacgccgttaaggttttcacatggcgaatcgtagatgagatctatgtaccccgtgaccttttcagggcgccgtgtgcgttgccccttagatttcgcttggggtttttatatctatcttactttattgttgttatatatttgatatgacatggtaggatatattccctcaaaaaaaattaagtataatttatgctcttctaataattgcacttattacggttgtgatcataagtgatgggtttgccatagcaaagtgtcactttttatcatgataaaataggatagatgtcggacatctatatgcggagattattggtttacttgacaaggttatcaaaacagttttgaaccttggggcataggttgggttggatatggagatgtcaccccaacagcacaagagtcacatatgatgtgattagcaaggtgttgcttacctattttgatagttgtctagctgtgatgccaaagctcaatagacactaataaaatgaggatcttgactcactatgttactagagggaattttgtttcacaatacatagtgggagtatcttttgttaaattgtttaatgaaaggttaaatgtaaacatggtgctgattttgcatacatatatttctattgtaca

SEQ ID NO: 26797 - DNA, 1501 bp, Oryza sativa
caagatctcatgtgtttctcttcttctctctaaaaattcctatgtttttcctatagtgctaccaaacaatatttttctgaaaaaaaattcgatggatcaacttctggaagattcaacgaggcatgacaacctacttgtatgttttttctattcccatgatttctgaatcttgcattccaaaatgagtcctaaatgatgatgcttgtgaaaagtagtatcatgtaataaaaaaaacaaatatcatggtgtacaacatgttgcagaaaattattcataaactttggctatgaataacttgtgaaatatttgctcaaaaatatggaacccatatatataggtaacattaaaatgtactttccatcatacatttattaatatttatatattacgatagaaaatagtgaccaaagtatttttagatcgtatcgtcactcggaacgacaattattttgaaccgggaggaggggagtacatagttttacaagagtgctaaaagcctaaaaagaatttctcttgtaaaagaaaaacaaaagtgtagtaagctgaactgctgatcctacgcgcatgccatggtgtgcgacagcgcggtactgaactggcagtcccatggattcagcggcccagggctgaggctcatcagggaaggattaaagagcaagggaacaagagagaagggggtctatgcatgtcatacactactactgcccttggaaatatgcaggcaagccttaaatgcccacactagtagtagtagatctttaaagctggccagctttgaccttttcctcttctttttttattttgctcaaaggcatgcatttgcacctgcttgctgcacctttctttctttccttgaagctgtaaaaaaaatgaaatgaaaaagaacagtacagcagctctcatgaatgacatgaccatgcaaggttgtagttataactaaaacactgtgttctttctcaccttctttgcagatgcatatatgctttaggcctgtgactgtgagtgctgttcttgtgtgcggggagagctagcttgctgcttttgcactgtgtgccctttatttattttgagccatgtaacatcagtacattgtcatttgtcatcagatcagcatatatatacatgaacctccaagaagacaaaattaattactctctccgttttttaatatacgacgccgttgattttttaagatacatttgataatacatatttattttatcatgatttgatttatcgttaaatatgacttaaatatttttatatttacaaaacagttaaataagaaaaatggttaaatgtttataaaaaaattataagtgtcatatatattaaaaaaacagaggtagcatgtagcttgaggtaatcatattctctctccatctacaaaagttacacatattactattgacaccaagattaagaagaaattaaatcatcttggatgttactccctccatacttataaaggaagtcgtttaggacaatgtttaagtcaaac

SEQ ID NO: 26798 - DNA, 293 bp, Oryza sativa
cgtgattgtaatcagtgtgcagcagtccatcattttgacgtccccatgcccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagca

SEQ ID NO: 26799 - DNA, 314 bp, Oryza sativa
ccgtccagtagcacctactgttgcagcagttcatcatttccataccatttttccgtaacaaaactaattaactattaactaggtaaactattgcaatgaaaagaaagttttttggtggttatagaattctcgtatttcttcgactccaataccaaaagaaagaaaaaaatgaagtaaaaaaaacgcattttctgtaaagtaacattaaggactctgcttttacttattttttcttttacctaaaagaagcagctccaaatcaaaactgaatccattctatctaacgagcagcacttatcttatctttaccggta

SEQ ID NO: 26800 - DNA, 292 bp, Oryza sativa
  unsure (1)..(292): unsure at all n locations
cgccccctgattgacgtcctctgcngtagttcatcaaattcgaaatgaaacccggttggagtcatatgggttttcttctatgttttagctagccagctatggcgcctatataaatcccccacacgaacgaacaaaacgatcgatgtgtcgaagtggacaagctgattaactaatcagctttccctttcggttgcgcacgtacgtacgatacgacaatggcgccgccgtcgctaccgattcttctcgtcttgctctccctgtcgtcgtcgctgtactccttctctgcggcagc

SEQ ID NO: 26801 - DNA, 1501 bp, Oryza sativa
ttcgtcggcgaggggggtgtagaaccagtcgctcttccagtcatcccacttcttgcggaggacgcagggaatgtagcggttcagcaccggcgcccgcggctggaggtagcaaccaccgaccaccgacggcggcgacaccggctgtacggtgaagaaccaccggaacagccgaagggataagcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgccgggcatccctcgcccagcgagactatctcccggccggtggcagattccggcatgaagcggcgcggcagcccggcctgtctctcgttcacgatgcgggaaggcggcagcacgctaccgtcaagcggagcggagccccgtgccatgacgccggaagaagagatgtttgagagcgagcgcgtgtggcgaaggtagggcacaggaaacaaggagttagggcgcaagcggcgaagacaaggggaataatggcgagaggaaggaagcaaatctcttcctcggcgactttatacccttgccaacgctgtgcccggctcctcatttctcgcgcccactatcttgccccctcgtttctcgcgcccacgcttccactaatcccattcgcccgtttgcggtgcatgaggtggatatgcggctgtggcagtcgagatggaacatctcgtgcgcgcattaattacgctcgccgaccgaagcgccatcaccatatctccaagaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcgggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcactcgtttatccggtctgtgaccagtcacagaccgatcagatcgtgggttaggtgacgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattg

SEQ ID NO: 26802 - DNA, 1501 bp, Oryza sativa
cgtatcatatccttgtagaaaattaactgtgaataataccgatgagtacatttcctagtacatttcactcgaagatgtatcatagcactcgtccgtgaattgcaaaaattactcgcaataacccagcttgaagtagtaccactggtaagttaaactctcttgcacctagtattaattaattaattaattacaacaaatcgaacacaaatatatatgtaccaaggatatattataacatttactggtactactgatatatatataagatttatgttattaaagaagatgtacatttctattgtttgccaacctccatttcatgactggctcatctcacaatggatccaagtcatgcatccaccatggattagtatagactactatatagaaacttacaaattaagatgatcagttccaaaccctaacaacgaattaaaactcaaaaagaagaagagagaatataactagatttaactatgctagatcaacaccagctttgtgcttttgatgatctaaatcaccaaggattgattggctttgttcttcaaggctagtcacatttattgtcaccttttttttgtcccctcatttttttttccttttttcacttgcactaaaagaactcactcgggtcccccaatggcaccaccacgtccatgagccccacctcgccgtggcccatgccgtcgtcgagcagccagctctccagcatggagaacgccggcggcggcgacgacgacggcgcgccggcggtctcctcgtccttcgtcttgctggtgaccgtcgagccgtcgggcgtcggcgccgtggcgccgccgctgtggctggcctccccgtacagcaccgacgccgccgacgacctcgacccggaggacggcgtcgtcgtcgtcttgccgccgccgccgccggggcgcatccagccctccaggagccgcgcgatgttctcggcgctggatgcgtacgacgtcgccgcctgcgacgacggcggcgccgtggcgcccgacgacgagtccagcggcttggccggcggcgaggggtccagcgagagcgcgtcgcggagcgcctggcgcgcggtgtggatgtccgtctgcaggcgccgctcccactgccccttcggcgcagccgccctggtcttcacctcgccggcgccacctccctcgccgtagtcgccgccgccgccggtggcgctcatcttcttgagcttcttcttgaggtgcgtgttccagtagttcttgatgtcgttgtccgtcctctccggcaagtaggacgcgatcgccgcccacctaaccaaaaatcaagaaccgccaaaaaaaaaaaacgcaagcgcgcactttaattagggctccaaaaaccaacccatccatcaatcactcaacctcgatcgccaagaatttcatcttccgattcacgaaacgacgtaaattaaaccaaaaaaaaaattacctgttgccgaggagggcctggaggtggacgatgagcttctcctcctggtcggtgaagt

SEQ ID NO: 26803 - DNA, 1083 bp, Oryza sativa
ctgacgacatgaccagtgtcagaccggtcacaaatcagtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgtcacctaacccacgatctgatcggtctgtgactggtcacagaccggataaacgagtgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcttggagatatggtgatggcgcttcggtcggcgagcgtaattaatgcgcgcacgagatgttccatctcgactgccacagccgcatatccacctcatgcaccgcaaacgggcgaatgggattagtggaagcgtgggcgcgagaaacgagggggcaagatagtgggcgcgagaaatgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcgtca

SEQ ID NO: 26804 - DNA, 195 bp, Oryza sativa
ccgacctcgtccacccctccgtttcgctcgccgaccgccggaacgccgtcgaccccgtcgacccgagccggggggccgccttcctgcgctccggacgactttttcgtcgtcgccgtcgacctaaggtgagccggggaccgccgccccttttcccccttcccttcccctctctcgggcggcgctccgccgtgccta

SEQ ID NO: 26805 - DNA, 1274 bp, Oryza sativa
gtgatttccccctctttatggcgcgcggggacggcgggatgcggcggattcggcggcagcggcggcgctagggcacgggcgggcggcgggtgcggcgcgaggacagggatgacaggtgggccccacccgtcagcgagggtggcgggtgggcccgcccgtcagcggcgcgcgcgcggggagaggccgagtgggccgcggggaggaggagagggagggaaggagctgggccgagccggcccagtaagggaaggggggggaaagaagactttttaggatttttctttttataaaaccattctaactttgtttatttcttaataattattatttgtgctctgaaaattccactaaaatttgagggctccttttagaccaaggagaatttaagaaaaattctccgggccacatttgaatttttcttatacgcattttagtgtttaccaatttcttttcgaattttaattaattctattattccttttagagaatgatttttatttcgggatgaatttatcaggacgtgacactctgattatctgtccattgaggctgaagaaaattttacactacctttatctgctcaagcagctcacttcttcccttctagatatcgagctgattaatgaaaatgatgtttggtcttacatttggggaagtatgaaatattcttcacagaaattctatgcactgaatttcagagttattaagccaccagttcattttctatggttatggaagtgcaaagtagtttcaaaagtaaaaggtttttgggtggctactcatgatgaatagattaaacaccaagttcatgctagatcataagaattgtgctcctccgaattgtgatctttcttgtgttctttgtcaatcggcagctgttgaagacctcatgcatctgttctttttatgcccgtttgcccaaaatcgttggagtcttctaggcattatatgggatactaatctatctttggaagcaatgtttataagggctaaattggattatcaggggagctgtttcatggagaaattcctttatgctacttggcatatatggaagcaaagaaatgggttcatttttgagcaaaagatcccttctttcatcacttggaggcaactcttaaagggtgacctcttccttctgttgtttagaatttctgcgagatatcacgatataatcataagttggattaatgggttgtaactttgttcttgttttcttaataaagtttttctaacagtgggggcctcccctgctatgttctttcaaaaaaaaa

SEQ ID NO: 26806 - DNA, 735 bp, Oryza sativa
tttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccttattattattgttattgttattattaccttgttcaccctagaacaaacaaaaccccaactagtggacactctactcatggcaccactagtttagttttaggtagatgcttcgcaatttaattaggtaacattaggtggtttttcaactatagactttgggaaatattcatatcatctggatactatggaatggtttggttactgtggaattggcttcacaccgctccttctattcaaaatccccaaaatggttttaggctgggctcggggtgcatggttttgatagtagcacctcggccatataaggaccggt

SEQ ID NO: 26807 - DNA, 1501 bp, Oryza sativa
aaagtgacctggcttgtaacagttgaaacatacctgctgctcccttccactactgttattctcttgagactgatcctgctgaactggcaccggttgattagcttgctcgatgtttacttcattgctttcattagtctctgattcgatctcaccaccgatgttcaactgttgcgactgtccttgaccagcggaaaaagattcaccaatttggagtggctcgatacgctgtctctggcgactaccttgtgcctcctggaaaacagtcattttccttttacggttatccatcctgttcttcttgtcttccagtcgaattgctttgtcaaccaactcctgaaaatcctcatagtcatgagagatcaacataactgacagctcatcctttaagccttccaagaacttctcctgcctttcctcgtcagtacgcacatcttctggagcatagcgagctagacgattgaactcatgaagatattccgtcacggtacgatccttttgcttaagtgcccggaactcacgcttcttcaaagcaacaacacctgcaggtatatgtgtcttcttgaatgcttcagtgaactccgcccaagtgattggttgtccttctgctctgttcatccggaaatgatcccaccattccgaagcagatccttgcaactgatgtgaagcgaaaacaactttctcctgatccgtgcactggagcaattccaacttcttctcaacagcgtgcaaccaatcacctgcttccactgggttggtagtgctagagaaggtaggtggcttcacacgaagaaaatcaactaacttgttctggggcggcggaggattgacattgttgttcccttgctggttctgcatttgttgcactaacaggttgatcaattgggtctgttgagccagcacttgagcaaaggttgggttctcttcattgttattgtttccacttccactggcgcgagtgttcaccatctgttgcagattagagaagataggaggagagaggttacactaaagacaagaccttaaccaggttaccactgatctggtgtgtgtagttcattatattgttcaagttgattaagcaagcaacctagtatagtcacacactcatcaatgaactactccaatgcaactatacctacacacaaaacaaacaacaaacgttctaccctactaactattcttcaaagacactttggcggcataggttctaaggtaggatgccaacttcattctatcttgacatctgggcacttcggtccttcctcgatccactttactgacctctacaagtagacctcattggcgtcttcaggtttcaaccactagtttcagaactactcaagttgaacgagagaggagagtagacaatgaaacaatttgcaaagaattctagataaggaagaaaggaaaatttttcacaaattatgttttcggaaaattagtccttaaggtttgaccacttggcttatcctacagtcgagatggctctgataccaacttg

SEQ ID NO: 26808 - DNA, 163 bp, Oryza sativa
tggagatcgtaaaactccagaacatccatgaagaaagaagaaaatggcggaaccagccctgccatagcaaaagggaggaagaagacggaccgccccgggtagcgtggcgccgggcatccttcgcccagcgagactatctcctggccggtcgcagattccggca

SEQ ID NO: 26809 - DNA, 377 bp, Oryza sativa
cgcgcgaatcgggacgtgccggttcgttttgcctggagatatggtgatggcgcttcggtcggcgagcgtaattaacgcgcgcacgagatgttccatctcgactgccacagccgcatatccacctcatgcaccgtaaacgggcgaatgggataagtggaagagtgggcgcgagaatcgagggggcaagatagtgggcgcgagaaacgaggagccgggcacagcgttggcaagggtataaagtcgccgaggaagagatttgcttcctttctctcgccattattccccttgtcttcgccgcttgcgccctaactccttgtttcatgtgccctaccttcgccacacgcgctcgctctcaaacatctcttcttccggcgtca

SEQ ID NO: 26810 - DNA, 1501 bp, Oryza sativa
ccttctgacgtgaagtagcatcctttccagccagggagacgcgatccaatcttttcaataagaggcaagaaatccactttcctaagctttcgaaaatgtaaaggtaagcctaggtagcggcaggggaaggatttcaaagttccagggaaaggagtaatgacatgtgtcaagtcggtggtgtcgcaacggataggatagatttcagtcttgttcaggtttgtgtggaggcctaaagcttgggcaaataaattaagaacccttttaactgcatcaatctcaatagggtcgggcttgacaaacaaagcgatgtcatcagcgtatagagagcatcgaaacctgctaaaacgccctccaattggagtgagcagggaggcctcttccgcaacttgaaagagtttgtgcagcggctccatagtgagaataaacaggagcggagatagaggatctccttgccgaagtcctttggcatgctgcaatgcagtgcctggcgaaccgttaagtagaacctgggagaggaggttgcgagaaggtttgagatccaattcctccatctggtaccaaaaccgtacctttgaagtacttcaagcaagtatggccatcccactgtatcaaaagccttggtgatgtcaacttttagaaagagggtttctgtatggcttctatgtaaggtacgcactaggttctgaacgaacaggaaattgtcatgaattgccctttttctgacaaaagcactttgattttgagaaactaattcatttaggcacggagcaagtctatttgcaaggattttagccaagatctttgcgaagctgtgtattaggcttataaggagacagtgttctgggccagtcgccccttctttcttcgggatgaggcatatgaaggctgagttcagcctttccagttgatttgtgttcgtggccaagaaggattgagcagctagcaaaatattgtctttgattatctcccaagcaattttaaaaaaagctccaatgaaaccatctggccgggtgacttttcggacggcatggagaatactgtttgttttagttcttcttctgtgatatcgtcttcttgatcgtctagatcgaaggatgtgaagttgagtgcttcccaattgaggcaagactgtctttgtgatggagttcccagcttatccaaaaagaagcgaaaaagagtatcagccttatcctaggccgagactgctaaaccgtttggggactgcagggtctggatgaagttttttctcctacgggagtttgctttgatatgaaagaatttggaattaacatcaccttcctttaaccacgttaacctcgatcattgtcgaatctgtatcttattaaggacagccaagcctaggatctttgcttttaaatcatcgcgaaagatgcgttcattagctgtcagatttctcgtctcctgcgcaacatccagcagttttcccaattagcgttgctttaattcccaaagtaaagcgtgtataggtagctagctgctt

SEQ ID NO: 26811 - DNA, 549 bp, Oryza sativa
tgggtgatatgtgaatggaattgggagggtatgttcaattttgcaggatatgtgaatttgtcaaattttttaaataacatgtaggaggttatgttaacatatttttaaaaaaattgtggaggatatgtttgcctttttaattttttgttaaacaacatgtcgaggaaatgtaattgtgaattagtgcactacttgataataacttttcaaattttgtacaaatttgtttgtactaattaatttagcttaatagtaagtagtaattaattttgcaatttaattttgtctgtactaattaatttagcataatagtaagtactaattaataacatatctatactagcataatagtaagtagtaattaatttcgcaatttaaagttgtttgtactaatttgagtaatttaaaatgtgagggataactttttcttttatgttagaggtttcaaacgatggccgatagtactaaagggactgaagagaagggtttagaggagcaagagtagtcccttgctattgtggttggtccggaaccaacggtcccaccaga

SEQ ID NO: 26812 - DNA, 486 bp, Oryza sativa
agtagttggtgtttgtttgcttcttctagagatgagtgagtcagtgagagcagatgccgttggacagttattgtctaaggagtatggtgtccggtcttttttcacataatactataatttcagattatataattttcacaaatatcaatttctactttttaaggagtacatgccaagttgccaatttgattttagtgtttgggtattagcggaacagcttattaacgattaaataattagttatattttcttagtgatacaaaagcaaatacttaaaaataaacatgagaaaaaacctaaaattaactctaagtttaaatttaattttaaagtttagcttatgttggtaatgtaaaggctaaacggtggggctgaacagggttttagaagtaaagaattaaaggttttctttccccgaaaaagataaaggggttttaaaattcggttcttgattgagtttagatttcttggaatataaaagatata

SEQ ID NO: 26813 - DNA, 1501 bp, Oryza sativa
tcccgtaggagaaaaaacttcatccagaccctgcagtccccaaacggtttagcagtctcggcctaggataaggctgatactctttttcgcttctttttggataagctgggaactccatcacaaagacagtcttgcctcaattgggaagcactcaacttcacatccttcgatctagacgatcaagaagacgatatcacagaagaagaactaaaacaaacagtattctccatgccgtccgaaaagtcacccggccagatggtttcattggagctttttttaaaattgcttgggagataatcaaagacaatattttgctagctgctcaatccttcttggccacgaacacaaatcaactggaaaggctgaactcagccttcatatgcctcatcccgaagaaagaaggggcgactggcccagaacactgtctccttataagcctaatacacagcttcgcaaagatcttggctaaaatccttgcaaatagacttgctccgtgcctaaatgaattagtttctcaaaatcaaagtgcttttgtcagaaaaagggcaattcatgacaatttcctgttcgttcagaacctagtgcgtaccttacatagaagccatacagaaaccctctttctaaaagttgacatcaccaaggcttttgatacagtgggatggccatacttgcttgaagtacttcaaaggtacggttttggtaccagatggaggaattggatctcaaaccttctcgcaacctcctctcccaggttctacttaacggttcgccaggcactgcattgcagcatgccaaaggacttcggcaaggagatcctctatctccgctcctgtttattctcactatggagccgctgcacaaactctttcaagttgcggaagaggcctccctgctcactccaattggagggcgttttagcaggtttcgatgctctctatacgctgatgacatcgctttgtttgtcaagcccgaccctattgagattgatgcagttaaaagggttcttaatttatttgcccaagctttaggcctccacacaaacctgaacaagactgaaatctatcctatccgttgcgacaccaccgacttgacacatgtcattactcctttccctggaactttgaaatccttcccctgccgctacctaggcttacctttacattttcgaaagcttaggaaagtggatttcttgcctcttattgaaaagattggatcgcgtctccctggctggaaaggatgctacttcacgtcagaagggagaataattcttgtgcaatcagtgttgagtgcattgccgacctttcatctaactgcccttcaagctcccaaatgggtaatcagcagaatagatcgttaccgcagatccttcttatggaagggagaagacccagacaaaacaaatccgggaagtagcttggtaaattggggtacagtctgtagaccaaaaattttaggaggccttggaattccagaccttgagaaattttctcgcgctctaaga

SEQ ID NO: 26814 - DNA, 255 bp, Oryza sativa
taaagttctttgagaactacatgataacctgtgtgtctgctggatggaaccattctggatttgctacaggtgtccaattctgaaaccaccttatttccttgtactttcttttgatcctttatgctttatgttcaaaaaatctactttatactctatatcacatatagtctgtgcatttcaggtgtttattttgtttcaaaaataaaaccattactgatgagcttagctgtgatgtttctagttcttattttcaga

SEQ ID NO: 26815 - DNA, 1501 bp, Oryza sativa
gttctacttaacggttcgccaggcactgcattgcagcatgccaaaggacttcggcaaggagatcctctatctccgctcctgtttattctcactatggagccgctgcacaaactctttcaagttgcggaagaggcctccctgctcactccaattggagggcgttttagcaggtttcgatgctctctatacgctgatgacatcgctttgtttgtcaagcccgaccctattgagattgatgcagttaaaagggttcttaatttatttgcccaagctttaggcctccacacaaacctgaacaagactgaaatctatcctatccgttgcgacaccaccgacttgacacatgtcattactcctttccctggaactttgaaatccttcccctgccgctacctaggcttacctttacattttcgaaagcttaggaaagtggatttcttgcctcttattgaaaagattggatcgcgtctccctggctggaaaggatgctacttcacgtcagaagggagaataattcttgtgcaatcagtgttgagtgcattgccgacctttcatctaactgcccttcaagctcccaaatgggtaatcagcagaatagatcgttaccgcagatccttcttatggaagggagaagacccagacaaaacaaatccgggaagtagcttggtaaattggggtacagtctgtagaccaaaaattttaggaggccttggaattccagaccttgagaaattttctcgcgctctaagactacggtggctctggttcaaatggaaagaggacaacaattcttgggttggaatggatttaccttgcgatgactgcgacaaaagactctttcaggctgccactacaataactgtgggtaatggagaaaaaaataaatttttggcatgataagtggctgcaaaatgcatgtccaaaagatattgcacccctgtgtttctacctagctaagcgcaaacagagatcggttaaaacggaattgacaaacaattcttggctcctttcctttcggcaaataactacaattgaagaaatcaacgatcttgtctagcttgggggaatgctgcaaaatgttcagcttctaccgcaaaccaatgacgacatcatttggaacctgaatgaatcgggatcctactctgcaaacaatgcttatttatttcagttccaagggtccttctcttcgattgattttcattccatttggaggtgcccagctgaaccaaagatgtgcttctttggatggctaatccttcaccaaaaaactctcacggcccaaaatcttttgcgccggcactggccatgcaagtggatttgtagcctgtgtggagaggcgtttgaagacactaaccatctcttcaatgtttgccccatcttcagaaaaatttggcttatggtgtgccaatggcaaaacatcccgggggcacagcctgtagatgacaacgcagcttggtgggctgatctcaatcaactacaccctaaacctttcaaattcagg

SEQ ID NO: 26816 - DNA, 281 bp, Oryza sativa
cgatgtgaatacactacccatggtacagagcacattattttcaccgcgctaactctctactcatgccaacggaaatcaaatacagcctctacagttcatgaaacaacgtttttatcctcataaaaaaaactgattaatggggacaaattaatgctataatctgaaaatctccacaacgcataaattaaactctatcctgtttaggagtccatctgacaacaaaaccgccacctaaatttcaaatcgtaaaacacaccttttaaattttggttttccatata

SEQ ID NO: 26817 - DNA, 1501 bp, Oryza sativa
aatggtgggttgtgagcacatggttttgagagtcgtgctcatgacaattaaggaccggttcacgattttcggttgtgaaacattaaccgtgccaaccacaagccagcgtaggcaacggctttaccttttgtatagcatggttcattgcggagcaccagactgagaagtggcggagataagcccacgggggtcgctggggagtccatgccttgtttataagggggtgactatgatccgggaacagtgcactgtggtggattgtgttgtgcgaggggtaatgtcacagctcttttccgaggtaccgtggtggtattgaggcgcatggtgacatgttgtggggctgtgtcttgtgggtacagtggtacacctctggccagagtaaaactattcgaatagccgtgcccgcggtcatgggcgggtctaacaatgtctttcgtgattagtctcacacttctcaccataataaaagatgttataattggtaataatttgtttagctcctggtttggagatagatctgtgcagccggatatggttgttcagaatggttgggcctgtgcagcatgggtgtgctgttcagtgttgattaatattgatgattaattaccctattgttttataattctcaaatgtttgctaaatgctgcttttgcaaatgagccctatattatgccatcctttggtatccttgtgcacttgcatatttgctgtgtggcttgttgagtatgtcatatgctcattcttgcaataatcaatcaaacctgagttgaagacaagttgcgaaggagaagacgtttggcttataccctagttgagctgcctgtgggagtggagccggagcttcgctagaccgtaattccactgctgttttcttttcttttgtaagtatgtaacgttattattatgatggatttgtatattaaattgtcagtttgtgtacctcggctgattcctggacgaggattttatgcacaaataagttcggaaattactagtgaatttccgggcgtgacaatcaacatgcacaaagggttgtttgggatctgtgtgacttgccttgctggccttggaattgttcaaagtcttctcctgcaaaatcggactctctggaaacgtcggaatctaagcataaaagagaaaaatcaccaaaacagtacataaacaatcataaacagcacatgtggatatttttaacatgtagatctcaattttagagaaattgagagacttgaaccagctaaatctgagctaagatgaattagttattaatttttaaagattaaatcggattaaatcatttatatagattttcattggattatgacgcaataaagaattatttttgaaaaggaaaaaggatttattgcgtcagcggggctcgggttcacggtggaccgagtgcacagaagcagtctcggaacgaacggctgagatctaatctaaacaaaacgaaaggccgagatctaaccgatctaccacgggtctacggctgatgtggcgc

SEQ ID NO: 26818 - DNA, 279 bp, Oryza sativa
  unsure (1)..(279): unsure at all n locations
gtgatgctttcttgatggtacagtagttcatcaccgtcagcttccagaacagtcccatattggatcggtcaccaatgctgccagtatcgttcgtcctccacgacggcgataatttcgatctcgtcggaagacatactccggtcggatttgatcttccccacagtgaagtcgtcgagtagtttattgttggagaattcatctcttgaacccatctcttcaaaatcctgaagcacccaaaanattccccttttccgccctttaaaaccctttttttggggg

SEQ ID NO: 26819 - DNA, 1501 bp, Oryza sativa
tgcacaaggataccaaaggatggcataatatagggctcatttgcaaaagcagcatttagcaaacatttgagaattataaaacaatagggtaattaatcatcaatattaatcaacactgaacagcacacccatgctgcacaggcccaaccattctgaacaaccatatccggctgcacagatctatctccaaaccaggagctaaacaaattattaccaattataacatcttttattatggtgagaagtgtgagactaatcacgaaagacattgttagacccgcccatgaccgcgggcacggctattcgaatagttttactctggccagaggtgtaccactgtacccacaagacacagccccacaacatgtcaccatgcgcctcaataccaccacggtacctcggaaaagagctgtgacattacccctcgcacaacacaatccaccacagtgcactgttcccggatcatagtcacccccttataaacaaggcatggactccccagcgacccccgtgggcttatctccgccacttctcagtctggtgctccgcaatgaaccatgctatacaaaaggtaaagccgttgcctacgctggcttgtggttggcacggttaatgtttcacaaccgaaaatcgtgaaccggtccttaattgtcatgagcacgactctcaaaaccatgtgctcacaacccaccattatcaagttttagttggcaagtaattaattaaccaatcacgattggccatcgtgagctatcattatgccatcattaaataatagagaaacattaattatcccaatagtgtgctaatgtttctaagcatggctaagcaattatatctaatacatctagttgaaccaatatataaatccaactagtcaaattataacccgaggtaatcaagacatagggtaatcaatgcaaactggccataacaaaggaatagggtcacaccacccggtgacattcaaaaataaatgcacagttgaaataaatagagaatttaaatataggatcaacatgctcaaaggaattgtttgggatctgtgtgacttgccttgctggccttggaactcctcaaattcttctcctgcgaaaacggactctccggaaacgtcggaatctaaatagaaaagagcaaaaacaccaaaacagcacataaacaagtacgaacagtacatgtggatatttttaacatgtagatatcaattttagaaaaatttagagacttgaaccaactaaatccgagctaagatgaattagttatgaatttttaaagattaaatcggattaaatcaattatatgggttttaattgaattatgacgcaataatgaattatttttgaaaaggaaaaatgggtttattgcgtcagcggctagggtttgcggtggaccgagtgcacggcggcggctcacagaaacgaacggccgagatctctccatccaaaacggacagccgagatcgactggtccacggccggaccacgagagacgacgacga

SEQ ID NO: 26820 - DNA, 421 bp, Oryza sativa
atgtagagtagtatttagtcatataagcacggtgcttagttcattagataccatcatttggggtaatatacagtggttctcaggatcattagttttggtcacaagtccgtctggcaatcctacatacgccaagacaattcgcaggatatcgtctttagggataagctcggctagtccctcacggtgtctccggatactgcaagagaaccggaaagtgctatctctgatctcgccgggcacggattcgaggaggaagactaccctgttgtcgactacgagtcagaactttagacagccatgtcgacaacagttagataggctaccccaaatattgtactggtgtgattatggtaaataaagagcaacgaccggcttcggccaacagggtgtagggttattacctgacaattcaggggcccga

SEQ ID NO: 26821 - DNA, 289 bp, Oryza sativa
atgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgaggacatgatttgtgaaaggagaaataaaattaaacaactgttttcgactggggtggacggaggatttgggtggtatctggaaaaggctagtaccgtccccggtcaattaaggaccgagcca

SEQ ID NO: 26822 - DNA, 1501 bp, Oryza sativa
attttggaggtggtggaggaaagcagtcatcatgttggcctgctgggcgaggatttgggtgagaatggcattggtatctggtggtggtggaggaggcgaaggagaaggtggaggtgggttgccctggtggttgtggttgctgccttcaggttggttgccatcaccggtggcagcatttctcctggtcgtcaccatctgaaaaccccacacagaaccagcaaacagagaaagagctaacaattaaaactaaccacccacaactaccataattcttgaatttattactgctattaaatgggttcattaaagttcaagttgcttaggcaaataaataaagacaggctccgacacagttatgccacacaccggcatgaccatgccccacacgacccaacaagaagacaaacgaggaagaacacacgcgcaagcctactaactgctcgtctaccgctgcgacgggccaggacggaaggtgagcaacagcgcatcctccgtgctaccaacgccggaggcttccccctcctggggaaccacgggcgcgggctcggcacgaggggtctcgacgaagcaagtccacgccagggactgacgaacaagctcgggcctggaggtgctcttgcgggcggtgatcttctggctgcggcagacgcggcgacgcttggggcggcagacctctccctgggcgatcttgagctgatgcagctgcgcctccaccgcgtctaggtccttcttgagctgcaggttctcctgacgcagctccaggatcttcatgttgttctcgaccatcccacggcgtaccatctggtggaagtcgatgcgagccgcgtcgtacgcctccaccatgcgcgccaggtgcacgatggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagagcgacgttctggcaagcggcggggaaggaatctccacccgcggtgactgccagcgaagtccgctcgggagagccagagaggatcactgcagtgacctcccaaccagcgtggggctctgcatcgtcaccctcctgctccggaagcggcctggcctggtagtccactccatgtggataccccaagaccacgcacatgcctcgcagctccaagacgaagccagtcatgtgcaaaccacgacgggtgacgctgccggccatctacaaacaaaaacaaaaagaaaagacaacattttaaaggtcagattttggcgataaatgaagcagcaagatagagagagactagacagttttcacaaataacaaaggatttttatttttgaaaatattgctaaggcttgggatctacggctcgtcctagggtcaagggtggctctgataccaacttgtcacgaccggaaataacccaacgggcgttcctgacgtgcgtgcattaatccttgtccca

SEQ ID NO: 26823 - DNA, 1501 bp, Oryza sativa
gagctccttgaagatgaaggctttggtgtctagctcgtgcctgccgtcaagcgcctgtggtcgtcgccctactcttccgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaagttggtatcagagccacccttgaccctaggacgagccgtagatcccaagccttagcaatattttcaaaaataaaaatcctttgttatttgtgaaaactgtctagtctctctctatcttgctgcttcatttatcgccaaaatctgacctttaaaatgttgtcttttctttttgtttttgtttgtagatggccggcagcgtcacccgtcgtggtttgcacatgactggcttcgtcttggagctgcgaggcatgtgcgtggtcttggggtatccacatggagtggactaccaggccaggccgcttccggagcaggagggtgacgatgcagagccccacgctggttgggaggtcactgcagtgatcctctctggctctcccgagcggacttcgctggcagtcaccgcgggtggagattccttccccgccgcttgccagaacgtcgctctcctcgccatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgcatcgacttccaccagatggtacgccgtgggatggtcgagaacaacatgaagatcctggagctgcgtcaggagaacctgcagctcaagaaggacctagacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggaggatgcgctgttgctcaccttccgtcctggcccgtcgcagcggtagacgagcagttagtaggcttgcgcgtgtgttcttcctcgtttgtcttcttgttgggtcgtgtggggcatggtcatgccggtgtgtggcataactgtgtcggagcctgtctttatttatttgcctaagcaacttgaactttaatgaacccatttaatagcagtaataaattcaagaattatggtagttgtgggtggttagttttaattgttagctctttctctgtttgctggttctgtgtggggttttc

SEQ ID NO: 26824 - DNA, 1501 bp, Oryza sativa
gattgccgaggaggattttgcctaagggaaattgcttctttgattccagggcttcggctacaaattgccaattggttgtaggaccatagctggatccacagaagaggaacttttctagccacattagtaagaaagctacatgctcccgaggagtgataggccctttgcccatatatgccgctacatagccagaccaacctcctatgcttttggtcttgaagtcaaattggttcttggtattcatactcatagggttagccgatgaagttacatctaatccagtgatcatggtggtgttgatcaaagttggagtcatcggtccatggttgaacagaaaggcattgatggtgctggaccagaaataggtagcggcagccatcagaggtccgtccttagctgagttggctatggtaagggcaagcgcttggccgattccgatcttatcccaatgaacttttttgttggccatacgcgcttgtaccatgtaatccagctcttctcgggtgggttttctcaagtgatggccaagatttaaaggtgttcttccagtgatgtagatctgggttggctaatctgaaaggaatcctatttgtttcaccaataatgaactcggtgggatcaaggttgccgattggaccaagaaaataatgattctcgtgagataggcttggaattgcgatcaaattagaaagatgttgcaaatccaaaagaaccgagaagaagaaaacaagatgaggaaaagggaaatcaatccgatacgggaaaaggagatctaaccgatgggaactcacctcatcgtactcggttgacggcacagtaggcaggttgtcggaggacgacatcactgcaggcggagatctggccggagatggaatcgccctgggatcgccttttgcgtcggaggaatcgccggagagagagagagggcaaaatttgcttcagcggtgaaaacggaagaagatgatgtgagatttcttgggggtaacggttagtatttaaagcatgggagtaacggtcggaaaatgacaagagcggatttctttcggaatcggcatatggaaaatccgaaacattatccaatattccggacttggggggcatgtgttaacgaccaagtttggtaatattagtatcggagaagaagactgaatcgaagcggaatcgaaggtgaagatcgttgcggaaacagagtaagaatcggttggagtccaaatcggctacgatcagaatcggctgagtccgagtcagactgggtaagccgatacagctgattccgacaatacgatttggtgtgcgacatcgggttcagttgatatgcttcaagatgattgccacacattaatagagtcctaagaaggcaattgtctctattaattaggatattttatgtaatttccttagagatatgtttgggcaaaagtctgccgcaaagacttatggtatcttagggtttgttagatataagagtcgtgtccggtatggacatagtttgtaattttcg

SEQ ID NO: 26825 - DNA, 1501 bp, Oryza sativa
attctattgtctccaaggaaatttttcttgctaattctgatccgaaaggtacgcatcttaatcgtgataagcgcggaattcttccttttcaaattagaaccgatctgggctggtttgttttcggtgtttgggctctgatcacctcatccgggattgctgctcggaggttagatgtttgcattgtaaaagtctgggccatattaaaaagttttgcccttctgttgggcttgttaagtctccatggcccaataaagtggtgtctgctaggggcttgggaaaaaaactgtctgtcccaaaaaaggagcaacctttgcgcattaaaactccacctaatcaggtctgggttaaaaaaaataagaaacccccttcgtcttctccttaagttgctcgctctctagtagtggcgtcagaatcgcagcctcaacctaatcctttccctgctccaatggcaaatactaaccttaatccccatcgcttcctgcgtgcggggcaagtggtacatcaaggtggtgatcgtgtgccaagaatcaacctctctgctgctaccaagccgccaaggtctcatgaagagtatgccagctttggttgagcccatcttgccggaggaactttgggatgatcatcggattctaatttctgaatacattgagcaggtgcagcactttactgttcgccgtagttttcctcatgcttcagctgtgggtctattcaagtttggttctgccatggttagggacctgctagtttatgctcccccttttatgtatgatggtatacatcaggtcaactttgtcagacatgatcagagtcctaactggcgtgctgctccatttactagaactgtctggtttttattgctcgatttccccctagattacatcaacatgcagtacatttgtctggttgtctcttctttcgggcagttggaggaatggtatcaaaatgacccaatagagggcaaagttttggtcagagctatgttcaaggactttgattcagtcccaaggaaaattgttcttcaagatcccacaagtggtgctggtgaatcctggaccatctctgtttttaccttggagggtgattttgctgatatttttccccctgatgaagaccttccccctactggtccaaataatgatgaaaatcctgatggtaatgatgatgacgatggtaatcaagataatatttggcaatttggcccacatcctgtggttcttgcagaaagaagaccaggcttggaatcaggctgctgtgggccatcaggccatggaccttgaacaagctgctcctgagaacatgggccagattgataacaaccatggctggaatctggttgctaacagaggtttaattttcacccttgctgatgctttcaaagatgccttcaattcctggtatgccaactctctggcaaattcagcccttcatcctgcaaagcttaattttaatttgggaaatgaaattgtgccgtatgattctatttcttttgaatcttctgcta

SEQ ID NO: 26826 - DNA, 1501 bp, Oryza sativa
gccacccaggtcaatgagcttccaatgccagaagaggatgtccccttttgtcatgattgcagagagcaaggacactatgccctgaattgtccatgggtatatgtcaaagaagccccttcccttggtttagcagggcagacatcgctaaaccagcctcctcacaccaagtcaagcttgcagcctagtgtgcaaagtagagagctcaacggagagaatccattgaatcccgggaaatgctttcctcctagcctctcgtaccacgtggggtcacatactaagcaagccaaaggcaagaagagtaagaatcagaagagaaaagcaccgatgcgaactgaagcagaagtacgtaagatgactattaccagcaccgaatggcctccagcagggataactattcctagacgtcaaagaggaaatactttccgaggtgcacgacagttgacccagcacctcctaagccatggtggcagagtatctgatagtgaagggtcagatcaagtctcctcggatgatgaagatgagtctccccgacatctcggcgaggaagagatggaatcaaaggcatgcacccgttgcggggaaattggacacgttgctagcatgtgtctcacactctgcactcattgtgaagaagaccatccaccaggggagtgtcccacccgcaaggtcacatgttttctgtgcgaaggtgcaaaccatgtgcccaaggattgccaactcagggtgttgttgaccaagaccgcagaaatccaacgaacaaccctacgattgtctcatcagctagtcagctccaacagcaacatcgacgatatcatccccagcaccaatgctcctcctgctgcacctgactctgcaataaatcatagcgataataccttcaacaccaaccattctctgcaccgacagcctcagcaaagaattgtcgtcgatgaaagaagttgtgtctctccccgacctactccaggccaagcaaagggcaatcaacctccggagggcgataccgagcagaagaccgttattcgcctcaaccagcaatcagaaggaaacttctccggtgaataatagcaatatgcagtcctatcacatcatcacagaaccaatcaaggatgcagtcactagaacaatgccagctatgtatccatgtttgtggtttccagttcgctacttatcaatgtgtaatcgaaagtttgcagcaatcatgtaataaataaatatattcatgcctgtaaacagtgagcttgctatgtttagggatgattcatgttgaggatacaatgtatcgatgataagcaccttccctttttgtttaaggcagtgccttgtattcgtgtaataagggagaaatgtgtaatacagacaagttctaagaggattcttttggaagatgcggatatgtgatcaggtgtataattgtttactgacaaaggagacctagggtctcgtgtcagaggaactatattctaacctcgagttaataaccaacctgtggatggaaaagaaa

SEQ ID NO: 26827 - DNA, 695 bp, Oryza sativa
ttaaagagcatataacttcaaatggctaaacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttaatttaaattaatgcattatcgctttatttaaattcccgcgttatcactgttttatttagccatgcctatttacctttgttatgacctcattattattgctattgttactattaccttgttcaccctaggataaacaaaaccccaactagtgggtactctatttatggttccactagtatgaatttaggtagatgcttcgctgattaattaggcaatattaggtggttttataactttagactttgggaattctcatatcatttggacactatgaaattgttggattatggtggaattggacatacacctctcttcctctttcaaaacccctaaaacctgttttcggtggggtttgggtgcatgccagttgtgggaagtagcaccccggccactataaggattaa

SEQ ID NO: 26828 - DNA, 1501 bp, Oryza sativa
gtcacaaagctgcactgactaccttcagggaaatacattgcttgctatctgtatctatgccactagggtttaattgccgatgatcatctttagtgcttcctcgagatggggagcatccaaattgttcttctgccatatcacctttgacccttttctgatacctgatagactaattaccaaccatcgactactatgttctcaattattgatgtctcctggatcttcttaactgtttgcaggtatatccgaacttatcaatgtagaggcatggcgggtacccttatgggtttcatccaacaagccttatcttgatctgtaaaaggcgtatccaaactcctatccccaactactgtctcattggctttttaacccaacacagtttaattggttttcttttccatccacaggttggttattaactcgaggttagaatatagttcctctgacacgagaccctaggtctcctttgtcagtaaacaattatacacctgatcacatatccgcatcttccaaaagaatcctcttagaacttgtctgtattacacatttctcccttattacacgaatacaaggcactgccttaaacaaaaagggaaggtgcttatcatcgatacattgtatcctcaacatgaatcatccctaaacatagcaagctcactgtttacaggcatgaatatatttatttattacatgattgctgcaaactttcgattacacattgataagtagcgaactggaaaccacaaacatggatacatagctggcattgttctagtgactgcatccttgattggttctgtgatgatgtgataggactgcatattgctattattcaccggagaagtttccttctgattgctggttgaggcgaataacggtcttctgctcggtatcgccctccggaggttgattgccctttgcttggcctggagtaggtcggggagagacacaacttctttcatcgacgacaattctttgctgaggctgtcggtgcagagaatggttggtgttgaaggtattatcgctatgatttattgcagagtcaggtgcagcaggaggagcattggtgctggggatgatatcgtcgatgttgctgttggagctgactagctgatgagacaatcgtagggttgttcgttggatttctgcggtcttggtcaacaacaccctgagttggcaatccttgggcacatggtttgcaccttcgcacagaaaacatgtgaccttgcgggtgggacactcccctggtggatggtcttcttcacaatgagtgcagagtgtgagacacatgctagcaacgtgtccaatttccccgcaacgggtgcatgcctttgattccatctcttcctcgccgagatgtcggggagactcatcttcatcatccgaggagacttgatctgacccttcactatcagatactctgccaccatggcttaggaggtgctgggtcaactgtcgtgcacctcggaaagtatttcctctttgacgtctaggaatagtt

SEQ ID NO: 26829 - DNA, 1501 bp, Oryza sativa
ctacaggatctgacaaggccttatcggctctgggcgtccccagccgaagatcccttaggttcctcggaggccttgttaagacggcgtaaagggacaataggataggtttcaacgctaggtgtcatcgtggtaagggatctctgggtaaaacacttggcgatattatgtacctgctatcaactttgttgaagtagaggtagtaggagaaatcgctacaccgctggtcgaggaccagatagtagtcgtaactcgaccacttaaagtggaagtagtgggagaaacgctacatcgttggtcgaggaccaggcagtagtcgtaactcgaccacttgaagtggaagtagtgggagaaatgctacatcgctggtcaaggaccaggcagtagtcgtgactcgaccactccaagtgaggcgagagagatcactacgttttactggttcgagaaccaggagtaggagtctcttaatcacctataggggcgctaaagttggtttattacatgtgcacatcatgtggccagcatgactcacatacccaacttatagcatatcctgatgtctgctcgcaatcatgtcgggtgatcaagccgacgacgttcgcgaggaattatccattaacaaccttttctcgagtagtccagcgatggccggtgctatgagataggtcgtcggtcttcgttgataggttgggtgcgataactccgcatttgtcaagaatgttctcgataatggagtgtactcgaccacaacctactcgagtgctcaattgttcctgaaaattattttctagaaggcaagacatatagcagataatatcgagtatgtactcaaaaactgcgtggatcttctagcattatcaggatataacgatcagattaaatatcaggcattatgtaaaccgtaaacaagcatgatttatacagaagagaacggagcgagcccccagcgttagactgtagttgacctgacatcgaaagcactcgcacaatagatattgtataaaaaacatgctctaggtaaacataataaattattgatctgacaatgctatatgatctgaataggtacgataaattgcatataaaatattgcgtacctgtgtagatatatgacggatatatctacggaattaatagattaatttaaaaaaccaatctaccaattaccttactgcgtactcattcgatatcatgtgatctgacatctcttggtacgccgcggagcttgaggcttggtcgatctcgagagatcgagttgttgatgacgatgattccgatctcgtcgggggacatactccggttgggttagatctcctatagccgaagttgtcgagtagtatgttgtcggagaatccatcttcttaaacccatctcgtcgaaatcctagatcaccaaaatccccctacctggcacacactgtcgatgtttggtgtcgcaattctggtatttgtatagtatggggatcgtcgatactaggatatacgcgagactgaggtaaaagaga

SEQ ID NO: 26830 - DNA, 1501 bp, Oryza sativa; identical to SEQ ID NO: 26624

SEQ ID NO: 26831 - DNA, 280 bp, Oryza sativa
cccattacagagagagcggctattccaataggttacactctgttcaatggtgtacgtcttacctctcaagccatgtcttcctcacgtgcatccacgtgtgacatagctccttggcatatgtacgtaagacatgccatagtctcgagcccatcgtagccatagacgagagtactgacgcacggtacttacgtccggaacccctagacagtcagtcattagtgagctcatagcagcagcgcgtcagccatgtgccatgacatctggtataccggtcagaagc

SEQ ID NO: 26832 - DNA, 1501 bp, Oryza sativa; identical to SEQ ID NO: 26626

SEQ ID NO: 26833 - DNA, 377 bp, Oryza sativa
atagggggagtgtgcgcccaaaccgacttaaggacttcactcaatgtcagttcattccgtatacagtacaaccacatatgctagtatgggatagcccaagcttagtaagttgtttatggtttagccttacattctggtaggccggtgtgtatgagttcatataattcagaggagcttcctatttaccccgacgtggtagtttaggtgactaagtgtgtccaatacaacggtattgtgccacgtggtgggttcccgttgtgtccgtcaccacggcgttaagtttaaggcgtgggcccaccacttaacggttctaggccatatatcgagtatggcttaggatggagtaacacgtatcgtgctggtgtaaggctaaatca

SEQ ID NO: 26834 - DNA, 1501 bp, Oryza sativa; identical to SEQ ID NO: 26627

SEQ ID NO: 26835 - DNA, 1501 bp, Oryza sativa
taggcctgccatctcgtaagcatcctgatacagcgaaccgaagtaattttcttcataaccaatctatatacatcatatctttatcatatctttctggtttcatataattattaacgtttaaattagaacatgttctttaaaatatatctttgactatatttttatataacatttaccataaagacaaatctatatatgttgtaaactaaatatttttttaagttattgatagttaaagttataaatatttaaccttaaccttatctaaaacgtaaagaatcatataatcagaaggagttgttgtacttcggcactcaacatttaatttatcatgtggcgaattgatcaactaagaaaatggcatgttttgcaaagcaaaaatttatattaaaatattataagagggcattttgtatatgtttggcaactgttttttctcttttataccagcattatatggtcttggacattaaataggaaagaaaataaaatggaaagtcatatttacgacataagctaagaggcaaagaaagaagatgagtctagatatgagatatgggcttgagggtccatgagctctacgctcctgacccctgtcgtacattttgttcgtactaagattgtacgtaaaatatcgtattcatagcatttcctgaaccaaattgctcgtgtaccactgccacatgccgttgctctagacctacacttgcattaacattacattcaataagctgattaatcgaagaagacccatcttaaaagaatgcattattctgccttccacgtccttccttcaagtgtagcaaagctgtaaaccaccgatgtcttggctcaaataacaacactcaatggtttaacagtgagtttttttatggcgtctttttatttcctttggtccaatatgatgggcatttgactacaaagttttggcacgggctgaatgttaccattgccaaaatacaggaaatactccgtacaatatagctatggagcattgtatacaagcaatcacatccaatttttacgctatcaatctgtttaacaaaatttaactgtggtaaccaaaaatccaaaccataccatactggaggccttcatttggaaaggagagaaaatgaagccattaggatcaatggaaatttctggagtcctacatttcctttgtcacggacacaatgctacaaattttcagcatacatccacttacggtcagaatactcaccacaaatcgcatggacatctacaagcggcaacctcatgcgggagccaataaccaagcgtagttcagcatcatatgatatcaagccccagcatcctttcacccttgcaatggagattgggctttgttctcattgaatccatacatcccatacccatagtgatctatgtcagcaatagcaaggctcaaaccgtaataaaactactggtataatgcatcccaacggtatgcaaagcaacttctctgttccgactaccaacaggacaacaggcaagcaaaagt

SEQ ID NO: 26836 - DNA, 404 bp, Oryza sativa
ctcggtacccgccattcggctagctttattgatatgataaaattgttacatcatttaccagatgatttagaatatagccagggggttcatcaacccaaatacaagaaagcattttgtataaactttattagatgagcaatataagtttctagtaatggcacacaaacatgaaagcattttgtttctccaaaaaaaaaaaaactgaaagcattttgctttcagtggctttcctttacatttccaacactgagccaggcccggcccggcccataaagactcccttggcttattgccttcttccattcattgcactacacgcagtccacagacgcttccttcgtacgcttcaccggagtgggtggagacgagacgcgagcaaacccaaaaccctcgcggcgacgcca

SEQ ID NO: 26837 - DNA, 553 bp, Oryza sativa
ggggacagccgcggcggtggcgggggacagcgacggtagcggtgggggatgggcgcggcggcggcgattgaggcgacagggggacgggtgcggcgacggcagcggtagcgggggatagacgcggcggcggcggcagcggcgtcgacgggggacgggcacacggcggcggtggaggcgacgagggacggacgcggcagcaacgggggacgcgaatcgcgtttatgaagaggagctatcccgttgggggacggtatcccgtccctagcattcccgtataattaattcagtattaatttataaaattttgatgaataaatttgttggatttttttaagcaatttaattttcacacgaaacaccgtttagcagtttaaaaaatgtgttaatgaaaaatgatgaatagctaatccaaactactccttccgtttcacaatgtaagactttctagcattgctcacatttatatagatgctaacgaatttagacattattatatatatataaattcattagcatctatataagataatgctataaagtttccattgcgaaa

SEQ ID NO: 26838 - DNA, 397 bp, Oryza sativa
aaataacatgtgctgagaagagaagagtcgatcctagccgaagcaaccggtgttatggaataaactggagtaattgtttgtcccacttgtcagaacatgcaagagaagggattgaggtggaaaaaaaaagagaaagtgtgatcgtttattctgtgggtcccaccgttagctctcggtaggacactgtgaatctctaaatatcgaaatctatgcggatccacgtgcaaatagcccctccacgtggccctgcgcgattccagcttagatcaacggtgagagatcgctgcggtggaccttgttgtatatacgaagtttgagggttttttttttttcaaaatcagtcaatcccaaattcccacttcactcggtttcctcctctcttgcctcgccgccgcca

SEQ ID NO: 26839 - DNA, 1501 bp, Oryza sativa
gtcagccgccccactcctcctccctctctctctctctctctccgcgcgcctcttgggctgcctccttgtgcccgcgccggcccaatggctcggccgagcctccttcaaccctttgggccgcaccaatgccacccgaaacaagtctaatatacatccctccttgattttcctttccaaaaaggatttaatacatcctttttcctttgttccataaatcaattccttattccaaaattccatgtcccgcttgtcagttgtcacgccccgaactagtcctgaccggaactagcccgtgacgctccaaattaacctattaatcgataccagtcccaggaaacagtgctggtatcacagggagacagaatatcacagcaacagaggtctctttattatagagtagagatacagtcatgttgggctgcggacagatcccgagctcacaactgcattacaaaagggaaacggaagccaggacttggaccaaacaacacaggcgcggcttgggaactaggccgaaaccctaaaactcatcgtagccagcttgctcctggaagaactcctcatcagcaggatccgcttcatcttctttagcaactgggggagattatttatatagagcaagggtgagtacgggggtactcagcaagccatgggaaataagtgtttaatgcatgcttcaaggaaaggctgttgtttttgcaattgattttatttgaactcctttctgaaaacaactaagtgagtgcttctcaaacgacacggatgagacagtgcgtctcgtccggtcggagtatgtgcaatgtatcagtctttagaattgaatcaaggttggcacccggccaacagcttttcaaacagccacccgggccaacaactttcaaatggccacccgggcctagctgatcccatcagctgcagatctttcaaacatcgaacccctttccacaacagcaatttcacaagcagtagtcaaacaaaactacgctaggaatcacctcacatccgcccatgaccgtgggcatggctgttcgaacagtttgttaacctctgcagagggggtacactttacccacacgacattactaacccggatcacccagcccgtggggatcagccacgtcgggagacctccaagctttcatgacaaggcattttcaaagccgacacaggtttaccatatgccgacgagaggggtcccagaccaacaacaggttaggtcccaaaccatactgtgccaggaagcccaggggtcctccccgacaccaccccggcggatccacatgtctctcggcatcaaggctcccctgataagctagttactcagctaggggtgtcccattccacccatgtggtcgtacttgtcttatgtttggatgaaattccaaggaaacggtccttaagtgcaagagcgggaaaccgtacacccggtacattccccggtccgcggttttggaaattcatttagttcgcaagcaccaacccaggtgtcgggttttccaag

SEQ ID NO: 26840 - DNA, 820 bp, Oryza sativa
cctattaagacctgtgccgggatgtcacattctcaccccccttaagataccgacgtcctcgttggtcaacccaggccaggaacatcccctattagcaccacgtatatacaaacaattttcggcgtatatatacgtatagttgcaagggtcggctctgataccatctgtgatgccccacactctccgaggcccactttgtcctcactcgtgcgcacccgggaaaaatttcccagtcggtcacctatcccgaaattgctccaggccaagcacgcttaatctcagagttctttcaaaatcggcttccggaaaagaagttgcaacttgttggtatgagtattctattaattctattaagcccttagctgggatgccacacaggctccaattggagagaatttagcccaacatctaccagatgcacctgaagatgtaacaacataatgcccaaaacactttttttttctgaaatagaagcttgtcttagaaaaaaagtttacaataccactttagcaatttcacgagggaaagtgtctgatctgaattcaaatcttataaggttcgtgacagtactaccaattaattgctacatagagacacaaaatggttgggatactcacaaaaaatgggattttgttttcagtcaaatcattttatgatgcaatgaaaatagaaacaagtggttaccctttcaagaagatgtgaatttaaaatttcagttaaactcgaagtgttcatttggttagcacttatcttgactaaagataacctcattaaaaggggatagaaaaaagagaacatgcggagagcgcgtggagcctca

SEQ ID NO: 26841 - DNA, 1501 bp, Oryza sativa
gtcaaataatttataatatgaaacggatggagtattcaactattcatgtctcatgcaactatgcaagtttgttgtactgtcgaaaacaaattaaatgagagtatatattgtaccttaattttttaatatatgatgttgttgatttttattcatgtttgaccatttgttttattaaaaaaataaagtaaatatgttttttttattgtagcttgatttatcattaagtaaatacgaaggcttatcttattaaggtgggcttgggtgatggatttgaggctgattgccgagcgagctagaagaggagatcgaccaggcgggagagatgcactacacgcggcgcaagatatagggcggccggatgacgagacagcgtcggagtcggattacacgaaacgacacggacgcgtcggagtccaatggagagggccccgatcgatcggctccaaatgggctcttgtgcatacctgtgcccgatacgcggcacgtgttcacccaaataatccaacggcttgagcgttctcggctcggctcccaggcggaccggagtcggctcaaccgcacccatcgtccgtcgccgccgttgccttcgtcgtcccgcgtcgcctctcctgtcgtcgacctccggggtcctttgccagatgacagcatgacgacgatcgaggaagccgccaagctccggcgagcactcgatcgattcgtgggaacgcttccagataaaccatcctatctatctcaatctccgatttggttgcgttgtcttatcactcttcaaacaatagaattcttcatgttaggaacgtacgatgggatcgaggcttctgatgacaaagtgacgaactgatgatgagcatcagaaggaatcttcagacaacctccaactccaagtatccaagcaaagcaagaattcaacaatctgaataatggaagcaattccgggccgaagggtatgagaaattggggtttcacattctctatcataatggcactatcactatagacataaatatgtggggcaataaaagggtgagacccacgtaccagtgactgtaatgatagtgacattatggtagagaatcctcaaccgagaaattgaaggttagatcggatctacttcaaaagtggaatatgaaggcaggaggaaatacacactttggccaaaacattctaatttttttgctagtgagtttgtgccagatgggtgtctgtgctagttgccgaaattttttagttctttttctgcacggataccctgcagagttgacatgcaggatggtaaaacgtagtattctcaaagcgatggtgaggatttttagggttcaatgacggacgaatgctttatcaatcagtttgtaccttgtacgaatcgctgttgcgaacgacggaggcaacgccggcagaagatgacggagcgacgtagggcgacaaaggcaacgtcagcggagggattatccttactctaaaattgttgtctaattccttgaatcctttctcaatacttgat

SEQ ID NO: 26842 - DNA, 204 bp, Oryza sativa
cctattaagacctgtgccgggatgtcacattctcaccccccttaagataccgacgtcctcgttggtcaacccaggccaggaacatcccctattagcaccacgtatatacaaacaattttcggcgtatatatacgtatagttgcaagggtcggctctgataccatctgtgatgccccacactctccgaggcccactttgtcctca

SEQ ID NO: 26843 - DNA, 880 bp, Oryza sativa
gcacttgcatatttgctgtgtgccttgctgagtatgtcatatgctcacctggcaataaccaatcaccgtcagttgaagaaaaaggatccacagggagaagtcgtttggcttatacaccagttgacctgcctgtgggagtggagccggagcttcgctagattttattttccgctgcagttttcttcttgatgaggactaagtgcctcataagtaagtatttatcgttttagttaatttgatgaatctgtatattaaattgtcagtttgtgtacctcggttgattcctggacgaggattttatgcacaaattagttcggaaattactagtgaatttccgggcgtgacaagttggtatcagagccatctcgactgtaggataagccaagtggtcaaaccttaaggactaattttccgaaaacataatttgtgaaaaattttcctttcttccttatctagaattctttgcaaattgtttcattgtctactctcctctctcgttcaacttgagtagttctgaaactagtggttgaaacctgaagacgccaatgaggtctacttgtagaggtcagtaaagtggatcgaggaaggaccgaagtgcccagatgtcaagatagaatgaagttggcatcctaccttagaacctatgccgccaaagtgtctttgaagaatagttagtagggtagaacgtttgttgtttgttttgtgtgtaggtatagttgcattggagtagttcattgatgagtgtgtgactatactaggttgcttgcttaatcaacttgaacaatataatgaactacacacaccagatcagtggtaacctggttaaggtcttgtctttagtgtaacctctctcctcctatcttctctaatctgcaacaga

SEQ ID NO: 26844 - DNA, 1501 bp, Oryza sativa
taaatgtaagccctctggtacatgatctcaaccatcttgtttgccatttaattcatgcgctaattaaactgtcttgcagaggattcatcttaggaacgaagccaaaacggtaaccttagaaaggttagtccctcatctcggaaccctcgaagccaccaggaatcaactgcacgaagcgaaagaacttgccaggaagaatgaacattatctgaaagatcggatcgctgagctccaggaatcaaattttgaactgagtggctcatcaaaaggtacgcacaaactctgctcaactgactcgtactgttatctttgcaatcttgattaaccgtaatcaatgtagtgcaagctgccaagatatctcagttggggaagcagattcaaattctggaaaatgacaaggcagaactggcaagacaaagagacctggctttaaaggaagttgaaggtatcaacaatcaatacctcaaaagccattatcctccatatgctgacttattaatgtggatctgttgatgcagaccgcaagatcaaatctcaagctcaattcgacgtcctggttggcaagatcaaaaaacttgaaggagcccgggatgaggttgctaacgctgctgccccaattgttcaagcgatgttcttcaataacaacggcctgagtgcacttgatgcttctaaaattttcgacaagctgagagttgctctggatacatatttcaagagcatcaaagaagctggaagtatgagagcaagtctggcgttggcgatgaccaaatctctttatccgagggttgacgttgatgccattgatggctttgcagacgggacgagcgaaggagctgctcttgacctcatcagcgatgcacaaaaatctgctgataagatagcagctgatgtagttgagagatttcaggacaccgatcttcgaccgactggtcctgataattctgatgatgaaaagactgatactgattaatgtaccaatgatgttgataattaatgatgatggaggcacaatttgtacaatactgatgaatttatgctgtgcttgatatcttaacttagttcctgatttcttaaaagtttttgtcaaaccttgttgagcctaaaacccgcaaaagttgttaaaaaactttcagtcctcattgactaagccaagaaatcaaacagggcaatgatacatcaagtaagcaaattggattgataaaaatcacactccattattattatagtagccccctgactgaaaacttcaaggaaaaacttgaagttagcagtcaaagaggaaagatacaaacgaaatgcctaagcgtaaaatcgacgaaggtgttcaatattctaagaattgttgatgagagtaccgtcttcgcgcttgagtcgataagaacccggccgagtgacttcagcaattatgaatggtccttcccataagggagataatttatgccgatcctgtgttgtttgaattttcatcagaaccaggtcaccgactaaaaaggctcgcgat

SEQ ID NO: 26845 - DNA, 1501 bp, Oryza sativa
catcttcggctttggcatactcgttggctttttcgaacatctgcttaaccgtcctgggaggtttacgtctaaacttgccgactaggtcctcgtggcgaatgcctttagtgaaggcggcgatgatgacgtcgtcggtgatgtcggagatcttgttgcgttgttcggagaagcgtcggatgtaatctcgaagagattctccagacttctgaacgacgttgtagagatcaaactatgtgccggggcgttcaaaggtgccctggaagttggcgatgaagtgatcacgaagttccgcccatgatccgatcgtgccacggggtaatccgtggagccaggatcgggcggagtccgctaggaccacaggtagatagtttgccatggccttgctgtctcctcctgctgcgcggatagcgagtccgtagacggtgagccaagactccggattagtggtgccgtcatacttctcgattccagtcggcttaaagccggctggccaatccactcgacgcaggtcattagtgaaggcagctactccatccacgtcgtcgtcgtagcgatttggtgaatggcggtgacctcgtgctgcacggcgctggttgatcgtgtcgcgaaggtcgacgggacgctggtgaggtggagagcgaggccgttcgactcggcgctccctgtgacgttcgggaggcgagtgaacagatcgttcgtcgtgacccctgctcctgcgactagatcctatgccgatgatgctgaggcttggctgatgataatcatgagattggagctgagggactcggctaccagtcggggtgtgggtgcttgcagagttggctggaaccgaggcagcgatcatggtcttcgtctggttcaagatgttgacaacatgatcagcttggttgagtacgtcttccttgacgagggtgtcgaggagagtgatagctgcaaccgcgttctactggggggtgcgaaagaccgctgttccatcgacgtcttgttgcccaatgagctctctcactcagcgtccagattccaaggcgcgttgccgtcgatcttcagcctcctttgcaatccgttcgcgatcttgttgctcacgctgtagtcgttctcgctcctgtcgctgtcgctcttcctctagtcggcgacgttcagcttcttgccgtgcgctatcttggtctgcttctcgggcttgacgctgttcctccgtttcgttgtcagccatgaatacgttgaagaagaggggcgtgtagttatcctcatagctgtcgtcaaagttgtcgaggtcaccgtggtcgtagtggtagccgaaattgtcatagtcgaggatctcggttggtcgagaactgaagccgggggagctaaggtaaccatccaactcttccgttgagactgtcccaagaggttggagtataacgccaacctctctggatctagattagatcggggccgaagccggagctcgcctagatcttcgggtggcagatgtcttggcagtgaagacaacggccaaatc

SEQ ID NO: 26846 - DNA, 1501 bp, Oryza sativa
caatgaaaatactaattatataaaatttcatattttgggacggatggagtattacataattatgcctattagcttaacagaacagtagcaaatgcaaacaacatcatattggttccgtgaagcaggatgctcatcaacatgtttccaatcaagctaataaaagaattacagatcgttctcaaaggacataaactatattagctcacacaagttattcatttaccaacatccagatatcttaacaaaaacccagtttagggagatcttaaacagctatggttttgattctatattagaattcccttggaacaagtatacaatggacgcaacgaactacattgcacacaacagttcatgtctggactttggacatcataaaccaaacccattcagatcaaacacgaactcataggccctactgcacatcctgagcactacatattataataatcgatcttcaaacatatgcaatgtaatattggttgctgataaagccaccgaacaaccacttatttgcagattttctaagaattgtcacatccaacgcagtggctttccattcaattaacctagtatatcagaaacaaaatgcttcgtcccagagcatttcccttccctagaaacccaagaaatcccgaaggcgaggcaaaatttcagtagaaggcaattgtctcacccatgtgtctaggtcattaccgggcgcatcgagagacgacggcgttggccttgggggagaggccggagacggaggcctgcttgccggaggaggacgagctgtcggggtcatcgccgtcgcccaccggcgaagccccgcggcgggggaggccccaggtgaaggagccctcccgcacgaggccctcgaacccctccatcagcagatcccgcgtccggttcatcatcgccatcctcacctcaccttacctcaacagggggcggttggcgcacagatctccttgtacccttccttccttccttccttccctgtcgatgatttacccagtgcccatgcttaaagaggcctgtatgcatgcatgcagttagatgattttagtgaggtgatgcattaataccgtgcatgcaacaagaataaatggaggtattaagataaaatagttggcttccttggtctatgagccccaaaactatatgccgtagaattttctagtgagggagcatccttttacatgctcaaagttgtacctgctaatacagggaccagggtgtaatatttatggtaccatactatgtaaacaattttggagaatgaataaatgcactatggtgcataccattatataggcatggacatagattgcacaatcaagttcaatggttcaatagcaagcaggttatctgattattgaatatctttacatccttgttcatatagtgatactattatatttccatcagttaatatacataacctactagtttgtactctgaatttagaatcagtgtctgaagtaggataacaattgggattcctccaaaacattaa

SEQ ID NO: 26847 - DNA, 1501 bp, Oryza sativa
tgaaggctgcaaagaagaaggcggtcgtggcacccctgtaagcgcccctactactgagatgtcatcgagcataacatccatgacgtctccaaccctgatgttcaagtctcagttgccactatgtcaagctgcttcctactgtctagtttcctgtgttgtattgggctgtccctattttgtacctctcttgctgtgtttctctcatcgtcgttgggagtgtttctgcgagagtagagttgctgtgcccttttggtcctatgtcacaagacaatgtttacctgtttaactggaatgtgagaggtttgaatgccaaagtaaagcaagactctgttagagtttgcatctagcaatataaaccgacgattgtctgtttacaggagacgaaactttctgctatctccaatcaaattattctcaacactttgggtcaccagtttgtacagcaacatgcttttctgccggcagatggtactaggggcggcatacttctagcatgtgatgaaaatttcttttcaatctccgaagtggttcttggtcagtactccctctctgctacggtgtccatgcgagaagaaggactaaattggtctatcactgtggtgtatggaccacaacttgatgctgacaaaataaacttcttagctgaacttgaaaatattcaagtctctttgaaacctgcttggttaattattggggatttcaatcttatttacaaagcctgtgataaaaacaatagccgccttaacagagcgatgatgcaacatttccgcagactcttagacaagatccaggtaaaagaattacctcttccaggccggcgtttcacttgggcaggtgagggatcaaatcctgcacaaacaaagattgaccgtgctttcgcttctgtggattgggacttgatgtttgagagctccattatgcaccctctgtcctctgcatgctctgatcacacacctctctttttactgggtaatgaaaagaggagcaaatcttccaacttcatatttgaatcctactggcttgaagttccaggttttctagaagtggtccaacactcttggcaaaagccgattttgtcatctaaccgactagccatctttcgcctaaagcttcggcgtttagcccgtgaccttaagagatggagccgctgcaatgtgggagacatcaaattgcaattagctgttgcagctgaagtaattttccagctttagctagctcgagaatccaggtcactatctgatcaagagaacctactcctctccaatctcaaatcaagatttctaggtctctcaacccttaataaaattaaaattaggcagcgctcgaggctcacttggctcaaagagggggatgttgattcaaaacttttccatatcaaagcaaactctaggagaagaaaaaattacatccaatcacttcaaactccctcaggagtggcaatatcggcacaagacaaggaagacgagctgttccgttttttcaaatccagacctgggacaaa

SEQ ID NO: 26848 - DNA, 1501 bp, Oryza sativa
cttgcttttgttccatgcttcgcatgggattgggtaacctgtctatatttgatatatgaatcctccaaatatatcttgcaatgtcctatgttggaatgttcgtggcctaaattctccagttcgctgccaagccgtgaagcagaaaattgatgagagttcttgttcgatctactgtttaaaggaaactaaaaaaagatcactttgaccatagtttcattagatccttggctctaagacgctttgataattatttgttttctccttcggttggagcttctgggggtattattgcaacagactcaacttgccctagaggttcaatttatttttaaaataaatggggaggaataggttttggtaaatgtctatggcccatcccatggtcctgagagagatgagttcattgattggcttcatgatctccagattgataatgactattggatgatccttggggactttaatttttatagatcggttttgaacagaaataagacaggaggaaacatgaatgatatctttattttcaatgaattcatcatttttctcagtttgcttgagatccctcttcaaggccgtgcttttacttggagtaacatgcagggtgatccccttttagagcaacttgattgggtcttcaccttctccaattggatttctagataccccaacactcaggctttggtgttagccaaaaatgtgtttgatcatgccccaattaaaattcagattgctacaatgatcccaaaatccaatatttttcgttttaaaaatttttggatttcctagcttggtttcaaggagcaggtctctaatgcttgggtggatattgggtatattcaggatcagaccaaactaatctatgccaagttcaagaagctcagaaggtttcttaaaaaaaatggagttcttctttcttctggctctctaaggctattgagaattgtaataaagtaattctttcgtttgatcgtttggaagaacttcgtgaactggcaagagcaatattggaggcagagatataaacaaatggttcttcttggtagagaaaacacaaaattctttcatgctatggctactgagaggtttagaattaacgcaatctcttctctcattgattctgttggaaaccaagtttctgatcatgaggggaaagctgccattctttggaatgcttttagggaaagaatgggtgtttctatgaaacctaaaatggtttttgatctgagtgaacttattgaggataaatgtgaccttatgtcccattgtttacaaatcactaccaaagaaatagatgaagtggtgaaaaggatccctggtgatgaagctcctagaccagatggctttaatggatgcttttacaagtccagttggggactaattgctcaagatttctatcggctttgtgcagacttttgtgggaactcagctgatctttctgcaatcaactattcctatatcacatgggttccaaagaaaatggctcctcagcctcctaatg

SEQ ID NO: 26849 - DNA, 1501 bp, Oryza sativa
gtgatggatgctgctgatcctgatccgtgatggactgtggtgtggcggtgctcatggcggagatgccgacttcgccgaggcaggcgctgttgcaggagaggtggcagatgatggcccaaccttggcacccggcgaggcactcgtcgcggcagtttccgcgcgccgccgtcgccagcagcgcccagcacaccatcaccaccaccatcaccggctgcctttgctgccgctgcctcaccatcaccaccatcttcttcttcttttcttcttgtttgcccctctctctctctctctatatatataatatattccagtttccagatcgataaaagagagcaccaatcaatcaatcaatcaattcattcgtcgtttatatatgaaggcgcagcagctaattttgggatggacgcatcaatcgacggcggagctcttgtgatctattctaggcgactccctccctaattagaattattagaattagaattacaaggcgtgatttattcgctaactaataaatagcaactcctactactaattatatgccgattgagagtgttgtagcgtcagttcgttaggtaattgatgcccactggtcgatgatgatgagacgtatcacctcacccattccagcgagcgaaattagatgcacatctcgacagctcatatggaatggaaactatggaaggcagtattattatggttctaatactactagtagacagtactcactccagtatgtatgtatgtatgtatgtatgtatgatccccctgcccggacccggaggctcaccctcacctgcctgaagaagaaacaacaaccgcctaccgcctctcctctctctctctctctctctctcatctaccacatgcaatgcaactaactacgcaaccacctcatcatcatcattataatcaagatcattaccacatcattaagtcatccataactgaatcggatacttcatgccaatacacatatgttggagatagcgtagtttctccatttctcattttttttctataatttttttcgttattctaaaaaaaagaagtttcttcgtttctcgttattcttaaaaacattttcttcatttctcatctcattattatagagaaagtttcttcatttctaatccaacaaccaccatctccgataataaaagccaatccttgtgtctctctgtctgcaccactctcctctctcttggttccatgcctcgccgtttatctatctaatttactagcagtatttatttttctttcctgcccttgatattatttattatctctgtttctattgtcgttgttcccttcttctactggtaacaaggaatccaatcaatcccagtactgggagggagggagtctgtctcaacctgcatttgctctgttccaaaattctctcctttctttgttctttcctccgctggtccatagcatctgatgatccaatcatactccaagatctgaagagaaggagggattgggaagaatcgctctgcaa

SEQ ID NO: 26850 - DNA, 1501 bp, Oryza sativa
gaaggtccagtcgccgtcttgtcggaggcaaaacgtgtggtcggcctcggcgatgccggcggggcgctcggcgtgggcgcggcggaagctcgggtcggagacgagggagcgccagcccttgcacacggcgaggcagcgggtggcgctgcgcggcggcaggcggagcaggatgtcccggagcaggtcgtccggcagatgctgctccgcggcggcggcggcggtgatcatctcgacgtgtgcatgtcgcgtacttcttcggttgtttccttccatggctgcgctttatgtatcgttcgtctcgtagtagttcaagggacgataccaaccagagtcctcgatgagtaaaatgtgccgtgccgagatcaaacaggattcgtcgtccgcacgcgcgcgtcacccacgaacgcgccggaagcacaacgactcattcttttttttttttcctttcttctgcttagttcacagagaaagaataagaaaagaaaaaaaataaaatacgagaagaaaagaagaaaaaggaaaagaaaaaatattaaatggatcttatttatcagtcaaaataatgtcacgtcagctggcagcagacgtacggcgacatcgccgcgcactcggccatgtcggctctggacatgctgcagtgcagcctgatgaagatgatcaccagcgcgggcgctggtgacctgttcgacgcgttgtcttccgcgcccgcgcccacccgcatgacaaggaggtcggcgacgacgaaactgatgaggtgatgatgacgaagacattgatggtgatgtcatgcatcgaggtacagtgacgacggcggcgccgaaaaggaggaggctgccgtcgggagcatcaacgacgacattgatcgatgaccattattcaaattaaactgtgccatgaagaattgccggtctcaatgtgtcatcctcaccccacgcatcacatgtgcaacaaatactcctacgatgtctccacttcttcgttgttgtgaactacaggcatactaggggtgtgtttggttgcaagccacactttgccacagtttgccatgtctaaggttaggcaaatttgacaggtggtattgaatgtgacatatttgtgttatgaactattacaacgtaatactccattcgtccctaaatatttgacaccgtagacttttttaaacatgtttgaccgtttgtcttatttaaaaaatttaagtaattattaattatttttctatcatttgatttattattaaatatacttttatgtatacatatagttttacatgttttacaaaagtttttgaataagaagaacggtcaaacatgtttaaaaaaaatcaacggtgtcaaatatttagggacggagggagtaacaatttatatatgtaaagtattcccctccgttttatattataagttgtttgtctcttttcctaatcaaacttatttcagtttgtccaagtttatagaaaaaatataatagtattttcaatagaaaacaaacatattattaa

SEQ ID NO: 26851 - DNA, 1501 bp, Oryza sativa
cttaatgataaatcaagctacaataaaaaaaacatatttactttatttttttaataaaacaaatggtcaaacatgaataaaaatcaacaacatcatatattaaaaaattaaggtacaatatatactctcatttaatttgttttcgacagtacaacaaacttgcatagttgcatgagacatgaatagttgaatactccatccgtttcatattataaattatttgactttttttctagtcaaccaaatttatagaaaaacttagcaacatgtaaaatatgaaattagtttcattaaatctaatattgaatatatattttaataatatgtttgttttctattgaaaatactattatattttttctataaacttggacaaactgaaataagtttgattaggaaaagagacaaacaacttataatataaaacggaggggaatactttacatatataaattgttactccctccgtccctaaatatttgacaccgttgattttttttaaacatgtttgaccgttcttcttattcaaaaacttttgtaaaacatgtaaaactatatgtatacataaaagtatatttaataataaatcaaatgatagaaaaataattaataattacttaaattttttaaataagacaaacggtcaaacatgtttaaaaaagtctacggtgtcaaatatttagggacgaatggagtattacgttgtaatagttcataacacaaatatgtcacattcaataccacctgtcaaatttgcctaaccttagacatggcaaactgtggcaaagtgtggcttgcaaccaaacacacccctagtatgcctgtagttcacaacaacgaagaagtggagacatcgtaggagtatttgttgcacatgtgatgcgtggggtgaggatgacacattgagaccggcaattcttcatggcacagtttaatttgaataatggtcatcgatcaatgtcgtcgttgatgctcccgacggcagcctcctccttttcggcgccgccgtcgtcactgtacctcgatgcatgacatcaccatcaatgtcttcgtcatcatcacctcatcagtttcgtcgtcgccgacctccttgtcatgcgggtgggcgcgggcgcggaagacaacgcgtcgaacaggtcaccagcgcccgcgctggtgatcatcttcatcaggctgcactgcagcatgtccagagccgacatggccgagtgcgcggcgatgtcgccgtacgtctgctgccagctgacgtgacattattttgactgataaataagatccatttaatattttttcttttcctttttcttcttttcttctcgtattttattttttttcttttcttattctttctctgtgaactaagcagaagaaaggaaaaaaaaaaaagaatgagtcgttgtgcttccggcgcgttcgtgggtgacgcgcgcgtgcggacgacgaatcctgtttgatctcggcacggcacattttactcatcgaggactctggttggtatcgt

SEQ ID NO: 26852 - DNA, 1501 bp, Oryza sativa
aaccaaccatgcaaatgaccaccacctgacaatggcatgagctatcagcaaatacgatccaaccgaagcacagcaccaacctctccacggtgccccttgtaaaccatggtgcatcaatctctgggtctacctcaagtgtgatggagtaccctccctttgcaatctgttgttgggcaaccttgagatgtgcaacgaacgggttcagcaaaccagaggctatcttctccttccgtccatttgctatcacaactaaatcacacctacaaaggaggaggcgaaacaaaaaaaaattgactatgaagtgatgcggtcactgctggagctacagccacgaaggcagaagagtcactgtgcatagcagcaagcaagcagtaacagtagaggttgagtattaataagaatgatactgctccaaattaattagatctacaacagcagttgttttggcccaggtttgtcactcgggcatttgacatcagacgctatcttcccaggtggaaggaagatgtcaactttaccatgtccggcaatcaatattcccaatggaaggaccgaacttgtaatcgcgcaaagatgaaacctggattggatcagaccacggcaccaccaccagaagaagaagaagaagatccggactgctcaccttgtgcgggtgggggtgagctggaacaccgctgaatcaagccgcgtctccggcctcattgcagagcgattcttcccaatccctccttctcttcagatcttggagtatgattggatcatcagatgctatggaccagcggaggaaagaacaaagaaaggagagaattttggaacagagcaaatgcaggttgagacagactccctccctcccagtactgggattgattggattccttgttaccagtagaagaagggaacaacgacaatagaaacagagataataaataatatcaagggcaggaaagaaaaataaatactgctagtaaattagatagataaacggcgaggcatggaaccaagagagaggagagtggtgcagacagagagacacaaggattggcttttattatcggagatggtggttgttggattagaaatgaagaaactttctctataataatgagatgagaaatgaagaaaatgtttttaagaataacgagaaacgaagaaacttcttttttttagaataacgaaaaaaattatagaaaaaaaatgagaaatggagaaactacgctatctccaacatatgtgtattggcatgaagtatccgattcagttatggatgacttaatgatgtggtaatgatcttgattataatgatgatgatgaggtggttgcgtagttagttgcattgcatgtggtagatgagagagagagagagagagagaggagaggcggtaggcggttgttgtttcttcttcaggcaggtgagggtgagcctccgggtccgggcagggggatcatacatacatacatacatacatacatactggagtgagtactgtctactagtagtatt

SEQ ID NO: 26853 - DNA, 1501 bp, Oryza sativa
taaaaaaaactaacctaggatttggatttggattatacatgtcgaattcgttgtattagattatcatccatccaaattctagtttaggttttttagtcgggagggtggggggtacggcagcagtcatcggcttaattaattgccattcaccgtgcaccacaatacatgttttattgtgcatgtcgcgctgctgacggtagcagcttataagccagttataaacatattttgaggaggtaaaaaaggagagaaaagagtagagggctacagatttatagccaactttagcatggactctaagatgcatgtgtgtatgacaggtgagacttattaattgtacagtatatgtttataggtaactattgtatgaattgcctataaaattgactacaaatgatttggagccggttgttagatatactattaaacttgctcttagtactacctctgtcccaaaataagtgcagccgttggtatctgtgtccaacgtttgaccgttcatcttatttgaaaaattagaaaaagtagtcacgcataaagtaccattcatgttttattatctaataacaataaaaatattaattataaaagattatcaaataaaacaaatagtcaaacatatataaatatgaacaatgtaaaattatatttattttaggacggagggagtgctgtactgtcctagtagatttgatttatacgggacgaatggagtacgtgcagctttgcttgttctgtccaattacatcgtgaattattacgcaggaggactcgttgattgcgaactcacggcacatccggcggtcgccacagtgccgtacggctgggttggccgaccaccgaaaggtgcgggaaggagagctgtctgcgttctactccggtactcacccgacaaaaaccaaacttagtattaaatgagatattttctgctataatgaatttagatatgagtctatccacatttattttactaagaagaatcttatacaattactagattgatttttcatgggacagataaagtattccttatttattttactaagaagaatcttatacaattactagattgatttttcatgggacagataaagtattccttatgtcgagatgtatgactgtctgcatcacacatgaatcttttattctcatcaggagctatcaatttttcagttcttatctctagattggtcagcatagattaagaacgtgaaaaataaatattaatacatgttattgaataagatttttcagcataaatgcagaatgagaaaaaaaatattaataagagatagttggtttggttggaagtcgaaaggtgattggacataaggtagaaaaaataaattagacgtgattaacgagacaaatagtacgcactcctaatagtgctagaggtgtttatatctagtactaattttaaatgttagaagcatttatatttcaaaatggagataataggttatatcggtaagcaagatttgttggcaataaatttaaa

SEQ ID NO: 26854 - DNA, 1501 bp, Oryza sativa
tactatagctgaagtggtccttcatgtttatatggggcccccaaaaaacgagggccctgtgcgggtgcctatttggcacatgcccatcgacggccttgtggacagacaatcgagcgacaattaagagcactaatcaattaattaattaagtttctcatggtattaagctacgagactgcggcagggcccgcgatgtggcactacggccaccgacatacgtattgctctcttgtcattcgaaaacgtccggagagggctacccgtcggacgtccgatgctttaggaaaaaatcggacgctgacgtcagcgccgatttacgtgcaaaactacttttaaactgatttttatcttaaattacttatccaaatcatgatccgattacaccattaaattcgttgcaattaaatcttcaaaacatggatatattccgatgaaaaaaaaagcttattattgaattatttttaaatgttgcacggtgtttcaccaggtatatcggaattgtttcactaagtagatcgaaaatgtttcactcgtttaaatctggtgttgtttcactttatataaaaacaatgtttcagcaaatagcgaaagaatgtttcagtttactgcaacattagatgtatacatagtgaaacattataagtacactaggtggaacatttttcggtgaaacaaaaaatgaaacaaattttcttaataggaggtttccaaaatatgtgggttttttgttgtaatgaaatatttcagttcactgcaacattagatctatacatagtggaacattgtgagtgcactaggtgaaacattttttgtggaacaaaaaaacaaaccaaattctcttaatagagggtttccaaaatatgtgggtgatttattgcaacggcgcgttccactgcaacatttgatccgtacacatttgatccgtacacagtgaaacatcatgagtacactagctgaaacattgtaaaactactggttgaaacatcaaaagagaccacatgcaacattaaaaaaatcaataaaaaaattaaaatatttttttgttgaaatataatcatgtgtggtcttgttgtaaagatttaattgtaacgaattcagtggtgcaatcagatcgtagattagataaatagtttacgataaaaaaatcttttgaagaaagaagaaaagaaaagattctttgcatgcaacatgctgcagtggcagacatcgtccgatttttctccaccccgccggtcatctaagtgtgagcatttttgaaaacgtcccagtcgtcacttggtcttacgatttcgtcacaagttcgcgctgccgaactgcgatgtccaccactttgctttactccaccatgttaccgtcaaaatcgtcgctgctctcctgcgcgacaacggtcgctttactccactgtaataccgcctaagtatagtcgtcgcttctctcctgcgtgacgatcaggcctatttgtgtagaaccgttcgtatctcatatatttctgagaaaaaaa

SEQ ID NO: 26855 - DNA, 1032 bp, Oryza sativa
taaacacctaattcccgtgacttgctgagtacgaaagtactcaccctttctctatataaatatatatatagttcctccgtcgtgaagtgaagatgatgtgaagtgaagattagggtttcgtcctggttcccagccgtcgcctgtggtgttgggtgttagtccgttggttccgctgctgctgctgctgttggtgttttcctcgtccgcgtcgtcggttgcattctcgggctgttctgagctacaacctaagttaaggtaaataagtcatttatttattttaaggattgcaatgattcatatttgtcaccgtgggtaccagcactatgtcctgggactggtactgtaatcgcggtttcgtaggaagcggttcacgccgtttttcctacgacacgctcctgtcaggtgccgttgtacggcggtgccggatcggggtgtgacagagatggtatcagagcattagttggccctaggatcgaaacccctgaataggatggcattaattgagtacaaaaactatttgtgaaagctaaggtgtcgttgtcccctttagctctagttttgcgaaaaatgtttttgtgtccaaaagtagaagctagtcgtttgttttgacatgttatcctagagtaaacctgtcttcacgcccagttgaagaaaggtgtgctcaagcctctaggcgtcttagttaagcccttgttggtaggcaaccctagctccgtcacccgctcggtaggagttgtggtgaactagtgcgtgtgtgagttttgtttggtagcccgtgttcaggtgttagaccagttgggttaccggctggaatacaccacctatgtcttctgcgatttcgaaaaacgttttgatctagtgtttttgttttcctccttttcttatcccatttctggttcggtcagatctcagtcgctttgaagtagatggctcgtcgttctacccgtcaaacccgtgctcctaatcgctttggttttgaagaagagccagttcagtcagagattcccgatcaaccagttaaccaagcagatg

SEQ ID NO: 26856 - DNA, 1501 bp, Oryza sativa
agcccaccactcaccgacgagctccagccgccgctcctcgccgctccagccactgccaagccgcgccccgccaccgtcggcttcgctgcatcgcgtggtaccccggccgctcttccaccttcgttggagaccgccgaatcaccgccgtcgtcttcgccccgtggagtgctgccgcctccctctgctcgagccccatcagcggcctccttcgccgccatgcccctcggtgggctccgccgcctccctcttcgcctcctccactcgttttcgccgctccccggccgccccctcgctcgtcgggccgacgccgccatcaccattgtcgtcgtcgtccttcccgcgtcggtgagcatctccctcctcctcccctccctttctttttctctctttgcccgccggccgccgcatgcgtgtcgccgtcgcgccgcgccgcgccgccgccggtgtcgccgccggtggccgttcggcccgtctggtcgggttggtcggcgagccaacccacccctccgtcttgcacctctaccgtggactcggtccacagtgggctagatccttttgcccgctgacgcgtggggcccgctcatttggtggacccggtccaagcccgcacctcctttacccgctgacgtgttggcccgcctgtcggcgccggcgccccttgctgacgtcagcgaatgccatttcctttgagaaaatatttaataattgcgcaataaatcgagtttaattatagaaatcaatttaaatggctcaaaacttctaaaattcatatctaattcattctaactccgaattgggccattcaacttgcaaaattcatctaaaattgagctctacatgtttgtttacttttcatgtactgtttttttggtttttattagagtttttcctcattttgcgtgctagcgtgtagaatccgtcgtttcggaagatcgcggtcgcaaggataagagtttggaagattgtttgaagaagcaaggcaagtcacacatttccccttgagcatgttgatcccaaattataaatgttttagtatttgcaactaaatatgcatcgttttgctaattacatgggaccagggtttacctatctgcttgcttgtgccatattatttgatatatgtccttcgtcaaccgtgggtgataattcgactagcttgtgtcacttatgttgatctagctagaactttatgcttagccatgcttaattaccactatctcagttgatgggataattgcagtattagacatgttagtatcatgatgagctgcgtgctcgagacatctggccatgtttcatggtcgtaattatccaactaaaatacgactgaatggtgggctgtgggtgaatggttttgctggtcgcacccatggcgattaaggaccggttcgcgggatgcactagaagacatacagcgcttgccacaagcgggaatgggtaactgcctgacttaaagcatagcttttctctggctgacgcatccaggcaagggtgggcgtga

SEQ ID NO: 26857 - DNA, 1501 bp, Oryza sativa
caaactctaattttcacatccctacttcttctaggcatgcaacctaataagagtttttactcatacgtgcttatgattttttttgtgatttttgtgttggaaatttccattatttctttgcacatatgaaaatgttgctgaatttcagtcaggatcgagaccaagaccgaatttgtcggtcctgacatttctgcgttgaaattcgatcttcacttttcaaagaccgaaatgcctgaaagaccgaagaccgagaccgaaaatttcggtcagaccaaatgcccatcccatccctagagatgtaggcttcgaataaacttcgttaataaaaattatgtctttctgtgtcgttatctaatgtgtcttagatgatcaatgactgatatgatcgagaaggttagtcgtcgttccgttatattgattggccttataataatatgtaacacctatacgcagccttactaattagctagccttcaacatcgtccttaactctctattatatgccaaattattattttaagatttaatataatgtgtgaaattggcaggaattgacatatagattggcatgaaaatgcctacatactgctaagaatttcgtaattaattttacacatgtaaaattagaaaaataatgatataggtagagtatttacgccgatatatgttttgccggagatgaggtatattacaaaattgcagatgggtatcagatttatgctaagttggataagagagagaaaaaaacaggccacaaatggctgtattgtgatggtcacacatccaatggcttgcgcccaaccttgccgcacaccagcctccagctattgctatccagtcccgctccgctaggccacctgtggccctgtgccgagcattgttgcttgagcaagcgcgcgcgagagagagaaagattgaggggaagacaaagaagggaaacgaaaggagtggagagagaagaagaaatagatatgtgggtctcacgtgtatgggtattttggtctatatgatgacagaagacgtgatggtgatggcatggttctaattttaaaaaattctaatggcacccaaccaatatcgcggataataaagatttttctaatatagtaaatttgtagtaaatggatggatcaaatttaccctagattagttgcttcattgtattgtctatatatagttgattataagccataacacttattagaaatgaaaataatttatcgataaacattttatatatgtattgatagtaaattaaaagtcaatactggaaaaataaacttaaaaggaaaatcaaaatcaacgctaaagttgatttctaaaatttagattttggtttgacagataagcaaaacacaaaacgatggagctctaagcatatgcttgacatagatatttggctgcggcttattagaagctttggcatgaggcagtagagattctccgggaaaaagaaaaatcaatgcagcattttgagctagctagctagctgaggtggggc

SEQ ID NO: 26858 - DNA, 482 bp, Oryza sativa
agctgtatatgctttccgatgtttgtttatctgtgtgtgtgtgcgcgcttctttccttgtgcagaagagcataggaattgagtgatttgtaacagtcttaattagtcgtagatgctgatcaaatcaagaaatgggttgcatattactttcaaattagcaaattgtacattcatgaaagtggtagaactaaagaagcatacataagctcaaagagaaattctcgacctcactaaaatcctattgaaaacccaccaggatttcaatcctattaaaggaaaatgagcaattctaaggcacaaatctaatgaaccaatggtagcatcttgtccctgattgcaagaaatcatggacaagctcaaaatcgcggcgaacatggttagcacttagtagctagtacgaaacacctagaaaaactttgaaagaaatacaatcttggctaaccgaatgcacacttttggagaaggtgaggagccatacctaca

SEQ ID NO: 26859 - DNA, 1501 bp, Oryza sativa
ttattctaatggatgcagaggtgagaaactccctgttcaaagaaccagtcctgcatgacaccaataaggttggtgtgaactttaggaagcaaaagctattgcaaatggcagaataaaataatgccccaggagagccagaagtggtgatagttgaagatgctgaagtggtgattgagcctgtgccaaaaaagaagtgcactggcaacaagggattcactatccctccaggagttgaagtcattcatataccctccacccctcaggcataattataatacgataaattgtccacatctcaataattttaggatattgcccctaatgaatgtgcaccaatatcataactagtgtgagtggccacttccatttcaataatttattgtgctatgtatcttcttcctttgagatatcaatctaattttcttccatttcaaatctacttttcagcctaacttgcaatgattactgtaattcataactaagagatcaacgcattgagctgtctttgcttcatgtagatgaaagatgtttgatgatttgtattttttccagggatgatggcttgtactagtagtgactgatacagactttactagctaaatatgttttcatcctcaaccttaaagtttaatgtgttgtgataatgatttttgacaagcaagcttgggatgcgttcgattcccctgattgggaactcattccctccacatggaaaacagagcggtccattagtacgtgattaattaagtattagctatttttttaaaaaaaaatagatcaatctgattttttaaaataactttcgtatataaactttttattaaaaaacacatcgtttagtagtttgaaaagcagccttggtagttttcttgataacttttgttgctacctgtacctgtggtgaccactgaccagccttcgtgaggaactcccaagtatttaagctgttaatggaaaaaaaaggcattattgaaaatctataagtttctttgatataactaattgtcactctacttagttccgctggttatttgtgagtaacaattgatagtgcaatgcatatgagtaaatcatgtgtacatgtatttctttgtgacctatatttgcttccatatcataggcatagtatgatatgcgcacgaggcataaattaccattcatagatgagagttgtgtgcgtggtttagcttaggcatgttccggtggttgtgttttgcttgcatacttgaaatttactaactaacgtaacttaaacaaattttgattgattatgtattttctttaataatgttgacgtgccttacacgtgcatgctcactagtgaaaataaatatacgagttttctttttttaaaaaaaagacagcagaattatagcaacagggactctgtaccgcacggcagtattgctcatcgatctgcatcaactccggactcggactgtgtcacaattgccgttagatcatttgtctcggaagtcgtaactccgggcctccgggcata

SEQ ID NO: 26860 - DNA, 1501 bp, Oryza sativa
tgcaatgcaaacaaactggctagctcgttatttttcacgacctctcttaatatattatatataatacatagatactttgtttcttcaaactctaattacgctgaataattttatatatggaaaacaagagtctaatgaggcaaattaaattgtcggctgcgttagctctatacatttgcgcctgatgcttgcatttgtctacaaataaacataatgggttctgggggttgaaatataagagaattcgcaacattaattttgtccttgatatttattcgaatgggatttaactaatcctataaaaatatagggggattaattgttaaagttaattaccgtttcaatttttttaaagcagtgatctctttgtggcatggcttggggtgaggtaaaatcgaactaatcagctgttatacatacccttgaacatgcatgatcgaggatacatgaacgcagctggctggcctgttattgtaacatcccggcctagagtttaataggattaatagaatactcatatcaacaagttgcaacttcttttccagaagtcaatctccaaagaactccagggttaagcgtgcttggcctggagcaatttgggagggttaagcgtgcttggcctggagcaatttgggatgggtgaccgaccgggaaattcttcccgggtgcacacgagtgaggacaaagtgtgcagaaaagacatgtgttgccctgtgaggagtctatgacctatgaaaactatcagatgtaagcgggcccggcctgggggaaggcgggacatgtgttgccctgtgaggagtctatgacctatgaaagctatcagatgtaagcgggcccggcctgggagaaggcgggacgttacaaaatggtatcagagccgactctcgcggtttcacgggcgcgtgtgtcgcagttgcgcaggcatggtgcgcatggctggtgtagattggtctgtgagggcagtcttatgacctatgaaagctatcagatgtaagcgggctcggcctaggggaaggcgggacgttacaaaatagtatcagagccgactctcgcgctttcatgggcgcgtgtgagtctatgacctatgaaagctatcagatgtaagcgggctcggcctgggggaaggcgggctcggcctgggggaaggcgggacgttacaaaatggtatcagagccgactctcgcgctttcacgggcgcgtgtgtcgcagttgcgcagacatggtgcgcatggctggtgtaaaccgggagtggttacacagcatggcacatgcgctgggggaaggcgggacgttacaaaatggtattagagccgactctcgcggtttcacgggcgcgtgtgtcacagttgcgcaggcatagtgcgcatggctgatgtagaccgggagtggttacacagcatggcacatacgctggcactggacacatggacgtggccaagagaggacgttcctggcctggggttgatcgacgggggcgtcgatcactcttaagggggtgagg

SEQ ID NO: 26861 - DNA, 294 bp, Oryza sativa
ccggcccacctaccattttttgatgtacagattgcttgttgatttgatataaaaagaaaagaagaagaagaagaagaagaggatagaatagaaggggaggaggagagacgagaggagtggttgtggccatggccatggcggccgccgtccaccgcttccttggcgtatttcccgccccgtcgacgcccacgcctccgcctcgacaactatcgcctcgcccccatcacattcctccttccctcgtccgatgttgttcctcgtcccccgtatgcgccgccacagttgcagttgcac

SEQ ID NO: 26862 - DNA, 860 bp, Oryza sativa
  unsure (1)..(860): unsure at all n locations
gagcccattggattcactggacctttanaacctgacataccctggnaaagncgaattgcagaagaggaagcaacagaggtgaatgaggcaaggagtcaggtagttccgatagttggaaatcatgttgatgatgataatgaaatggcagatggatcaatggggggaggtggagaaaagcgtacaacggatgctcaattagcatccttggtgcggttctgttttcgagacaaaatatatactcggagggagtgtgaggagactttgttgatgaatggattgagtgttgatttgttgcaccaacattcaaaggagtatgatgacacacatgaagaggagggatatgaagtttagtatgccgtaaactcagatgacgatcatctagtagccaaaatgtctcaagaagaaagggaggtgtttgagaaattagttggaccccattcagacgttgttcacttcgaggatgttagcgattatgagctaccagctgttgatggaggagttacatacaatggcatcatcgatgcaatgggtgaagacccaaaaaatggtttggaatttaaatctcttgagctattacagatattgctgcagagttactcgatcagggtgcatccgtccattccatgtgaagcactccaacgcttctaaaaagtacacggtggcttgcatcgaagaatcatgcgaatggcaggttcgtgcatggaagactaatgatgggaggtggagagttaccggtgtaggcaaagagcacacatgttgtagtgctgaggcttctggcaatcacttgcaactaacttctaagttcatcggtaataggttgcaaccatttgtccgagctgagccgacattgactcatgttg

SEQ ID NO: 26863 - DNA, 188 bp, Oryza sativa
gggggatccaaggggtgtgggtggcgctcgtgtgacctttcgaaatgcggtgcgggcttatttgtagtggggtgggtgagaggcctccgtggctaggtgcacccgagggggagaacggattttttttttcaactctgagcatgagcaggaccctatcccgtcgaagtcacgtgactttgtcactgaca

SEQ ID NO: 26864 - DNA, 553 bp, Oryza sativa
cccccagttgagcgcctgtgaagatggagccgtaggcccgctagtccgctgctgtttatttttattgtcaggcctgaggcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacagcatgcggcagcggcgcaagacggcggccgacggcgaccgaccggcggcggagagcggcggcgtcgcggcgaagcggcagctacgcggctaagcggcggcgcgacggctaaacagtgcgggagagagagagaaagaggaggagagacctcaccgacaacgatcgacgacggcgagcgacggagaacgatggcgacggtgggacgagctccggaacctcctaacgaacaaaaggagaggggttagagggagagaggagagtgcgagagggcgagggcgccggcgcacgacggggatggggctccggcggcgaacattgacggaggaggggtgga

SEQ ID NO: 26865 - DNA, 321 bp, Oryza sativa
atcaacatgttcaagtgacaagcatgacttgccttgctctgctgctggaggaaccttgacgactatttcgaagtacaccggagcgtcggaggaaccggaatctagcgacatacaaggcaaacattgcaaaaaggctataagactactgaaacagagaacaaaaccatttttaatggattctacacatttttctagatttactgagacttgaatgggcttaaacggagctcggatgaattagttatgaattttagaagattcactgtgtttattactatacaagaaaaaccttaaatcatttattgcgcaatatattccagg

SEQ ID NO: 26866 - DNA, 1501 bp, Oryza sativa
cccggcggcctccgcctcagccgagaagaaaagaaaagagtgagagagagagaaaggaggggaagagagagggtgatgacgtagcgacgctaacatgtgggactcacgtgggtcccacgctgactcagccgccacataggacaaaaccaggtttaaaaccaccgagggacctaaaatgaatggttttataagttgagggatgctatatatctggttttgtggttaggggatgattctgtaactcgatgacaagttgagggacctgcggtgtactttttccttttttttctgcacaaattgtgacgggctttttgtttctttaaagaaaagaggatgtgggcagtggcctaaaaaaacagaaatgggctgtggcctaaaaaaaagaaaaaaaaatcatgctactttctttctgcgcgcatggatcgtccgtgcgccgatcgcacggccagcggaaaaaaaaacggttgacaaaacaaaaattttaagccgcatgtcacatagacagtccaaaaaaaatacccctcatatccaacgtttgacggttcatcttgtttaaaattctttttatgattagtatttttgttgttattagatgataaaacatgagcaagtactttgtgtgtgactaattctttttaattttttcataaaattttcaaataagacgaacggtcaaacgtttgatatggatacccacggatacacattttggggcagaggtagtagcatacgatttttccgcttttgaccaaaagcacagcacaggccactgatttttcttgatacgtaacacttccatcccattttaagcaaacgacatcggattagattagagtagataaattattctcggactaattcgcctaatgtttctgggtggtgacggcgccctgtacatttgggtggtgacggcgccctgtacatttgagaaggaggccgctgccactttcccacttctttctgccctgatcaccaccaaatccggtgttgttgagcctacactacctagtagttgataggagcgtgtatatttttgtgtatgttttttcttgcacacacaacgggatatgagatagcatgctcgacatcaacaccttcatcaccaaaaagatatgacggtttctctgtatgaagcgtatgagctaccttattataatcttgctcaaatcgaatttattatgccattctacaagcccatagacccaatataggtgacacaacatcttttttctatgattgtagccaactaagatgcaatttggagatgaggctgtatatatccgattggaaagcgcactccgagagctttccatcaagtactcatggactcaaaatggagctcgtatacatatttggcggctgtttgaagtcaacactgttgtaggtggccgagttggattacagaacttctgcggctttatctcgatatcttatggttgatttatgattcgaataatggttgtatctatggtagttatagccacatcaagatttccttgtt

SEQ ID NO: 26867 - DNA, 275 bp, Oryza sativa
tgctgattgtataacatgttaaataaactagaaaggtagcccgcgcattcgcgcggggatgtattgtacacagggttaaacttttcggtttagcccatttgattgggcatcagtgcatctcccaaatacagaaatttctgaaattttgtaaacatagtttagttgaatttgaccaaatattaccacaattcataaaaagttaaaaaaattcggccaaaataatatcacatctgaggggtccaaaatgatagatatttctataatttccaaccttt

SEQ ID NO: 26868 - DNA, 1501 bp, Oryza sativa
aagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggccggtgtcctgctgctgggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggtagcacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtctttaaatgctgtttactgcaaccctaaccctttatgttataattcccttgtactcccttgcatttattctgcattcgtgggtgtgtcttgttgagtacggtggttgtactcagtcttgcttaattttcccaagcccagatgaggagttcctggaagatgaaggctttggtgtctagctcgtgcctgccgtcaagcgcctgtggtcgtcgccctagtcttccgctgtttttcgttgtctttgagtgtgctgggccttcgttgcccatgtaataattttatttacgcttccgcttgttaaactctgaattgtatcaacttttggtgtaccttgcctcctgggacaaggaataatacacgcacgtcaggaacgcctgttgggtgatttccggtcgtgacaggatatacgataccaaatatagatagaatatctttatgaggactcgggttagattctaaacttgtatgccaggaaaatacccgggatcctagtcggttacgattgtattttatctgtaatcccatattccgttaggatatggactgtactttgtattacggatcccttcccctatataaggaggggtccgggttcctctcggggcgattctttttctcccaatcatacaatcgataacacactcggcggaatcatccccggacaggagtagggtattacttcttgaataagaaggcctgaacctgtataaaattccttgtctccaaacccatccactttcctagcttgatagccacctccttttattattgccgaaatcttgtttcgacagttggcgcgccaggtaggggtagcgtcaagttctcgccgactaagtgcga

SEQ ID NO: 26869 - DNA, 1501 bp, Oryza sativa
aggtcaagagcagctccttcgctcgtcccgtctgcaaagccatcaatggcatcaacgtcaaccctcggataaagagatttggtcatcgccaacgccagacttgctctcatacttccagcttctttgatgctcttgaaatatgtatccagagcaactctcagcttgtcgaaaattttagaagcatcaagtgcactcaggccgttgttattgaagaacatcgcttgaacaattggggcagcagcgttagcaacctcatcccgggctccttcaagttttttgatcttgccaaccaggacgtcgaattgagcttgagatttgatcttgcggtctgcatcaacagatccacattaataagtcagcatatggaggataatggcttttgaggtattgattgttgataccttcaacttcctttaaagccaggtctctttgtcttgccagttctgccttgtcattttccagaatttgaatctgcttccccaactgagatatcttggcagcttgcactacattgattacggttaatcaagattgcaaagataacagtacgagtcagttgagcagagtttgtgcgtaccttttgatgagccactcagttcaaaatttgattcctggagctcagcgatccgatctttcagataatgttcattcttcctggcaagttctttcgcttcgtgcagttgattcctggtggcttcgagggttccgagatgagggactaacctttctaaggttaccgttttggcttcgttcctaagatgaatcctctgcaagacagtttaattagcgcatgaattaaatggcaaacaagatggttgagatcatgtaccagagggcttacatttacaatgcgggttgcctgaccaagtgccttcttcagtaggcataactcttcgtcctctttttgcttatttatcacgatcccttgaggctgcatgttgtcatcccaccacttgaccagaatcggagggcatgaatcctcagctgcttgtatccggaggatttcttattcatcaccaattattggccctagtgtatccatgaatgaagatgaagcagccaaataaagtctgttggatcaagatgatttcagatagcgtgtctacctgtgatgattcccggtcggggatgagtggactttggtgtcttcacaggagatttggtttctgattcactgtcagcatccttcccgagaggactgttcgtttgagcttcaacctcaggaatcttttggtttggccctgcatccgactggtttccagtcgggggctcctggttagcaccgacttcagattcggccgactggttcccagtcgggggctcgttgctgggttctacattgtcggttgtcggttgtttgtcactcggacaatcctctgcagttggcccggtttcttttgaagggtttgcctttatgtcagccggctcggggtctttttcagaaggatctatgtcagacggcttcctacgagtttgagttatgctgttagtattatttcaa

SEQ ID NO: 26870 - DNA, 1501 bp, Oryza sativa
tggtggtccgcgagtggttcgatgacgtctgtcagagggagagcctgcataacgtgaagtcacaacgcgatctcgaggagaaggatgcaaaggagtcatcgagtacacttacattaattgcggcggcacgttcggccggacccttctcgcaaagggggatcgggatgtcgcccgccactgagggggcgctgatcatcacctggctgacgcggtgtcccacggtgtcactttccagacctgtaaatcaaggacaagaactcggtaagtcaggagaaacagacgcactcggagtaaaattcgaaatacaagaaaaaataccccgaggagaaactcggatcgcgtcctctggcacagagtagtcaaaggctggatgggcgcaggcctggagcggttggatccgcctacctacaaagtcggcaacgacttcgtaccctggcaacccctgtgttcagaggtcatcgatgatgtcgatgaaagaccggagagagggagtcagggcgggtttggcagtccactctgggattttgtctagttgttcttcagggacaacaaggacgggatccgagttttctatctgaagatagaaccatctcgcccgccatttgctgcaagaagaggggcactggaaggggatgtaacgcgacttcaggcaatcccgaagtcggaatccgacacatccagatacactgttgggttccatccgacgcaagtcatagtaaaagcggaagagatcaaggaagggctctaccccaatgtaggccttgcagatataagaaaagattctaaggaatgcaatggagttggggttcaaatgaagcaaagaaaggccatagaagttcaagacgagaagaagaaattcggaaggcggaggaagaaaaccgcaagaaatataatcttcgaccacaaccatatggcccaagatgggttcgggttcaatacctcctgtctccctctgcatggtcccgcgaccagggagggcgccgtcgtcctacaatttcttcaaagacgcggtggttgaggtggacttgtcaagatccatcgccgccggaggatcgccagagaacaaagcaagagaaatgggctagggttttctgtgcggagagcggagaagacgaggagcgctagaaggcaggagaagttttctggcaaacggacttttaatggattcccaaaatccctttaaataagcgcactaccgacggtgcgtattccaaggaaaggagagagattgccgccgggaaattctgggtccgttgcacgcagtagttttcaagacttcaatttaaattcactcatgaccgttgaacttcatgcggcgttgtcgatgactctttgtctctacggttctcatgccaagatcgaccagatgagaacgacaacgatttcgacatcagaagtcgtgattgattacatgagttcatttaagcagaagtcgggggctactatcagggttacggataaggtataccctttatccttggataaacgatgagtactgata

SEQ ID NO: 26871 - DNA, 1501 bp, Oryza sativa
ggaatggccatggcgggcaccagagggctgtgagccaacccgacacgcacggcttcaagcctgcacctgccccgaccggtctgcagacgccgccgttgcgcccgccggcacctcagaatgcgccggcgcatgtccctgttcccgcaccacgtcctcagcaccatggtgatttatcggcctgttcccttatgttggattacaaattagaacaatgtgaaaaaggcgtcttttgatgtattggttttggtgatcgcatgcatttcttgaatgagcagatccgtctggagcgcgagcacccaccctaccaccttccagcgagaacacggccaatgcgccaccactgaaaggtattcctcatgccgctccaagggcaccatcaaggatttcaagcacgtccacttcacaaggagcaccaaaaggtttggtcctcgtaggggggttgtttgcaccttgtaattgatatccatggtatactactttgttaactgcctgctgccactcttctttacaggtggagcatataatcttcagtttggcagtttcccaatgaatggtggaactggtggtagcacaatggtacgctcttcaaccctgttcttgcagcttgcagttcttatttcaatttggtctagtttctggttctttttttcaccttttttctaatttccaaatacttttgcatagcaattccctgccaggacaagctcagctcctcctaatttggatgagcaaaaacgcatgcaggtattttctccttcccttggcctttaccattattgtttctctgctttatgttagtttaatttggtggtattggctatgatttttagtgcgcttttgttagatatatcgataacagtatgttgtcaacaaatgcaccaaataatttatgctcctatgtataatatgctttcaggagatttgagcaagtcatgcctttttttgcttctattgttgatattgtattgataggtgttattaattttcaatattctaaaagaatgtattattgtgttatctttctttggtgtttaggccctccctgaaggtcataaggttgtaccttctgggcttgttccacaagctccaaaacatcagcagcaacagcagccgttgcagcagcagaagcaacagccgcagtcacagccaccactgcagcaaacaagaaaggatgttgttagttctaatcattcatcgaaacctatcaaccctcacattccttcccaagttaagagctctgtgcatgtctcaccatccgtgcccaatgttgcaccaccaagaccccctgttcagcagatacctgggatgcccatgtcaatgccatttcaccaccaggcacccttgcagtttggcggtcacaacccacaaattccaccacagggagttgtgcccagttcactacaaatgtctatgggattgcatggcgccaacgcaccccaggttgcacagcaaatgtacatccctaccattcagcaccatcatcaactgcaaccgccaacaa

SEQ ID NO: 26872 - DNA, 1501 bp, Oryza sativa
agacattttgaaatcactaagtgatttatttctttctaagtttgggccgaaaagagacttgcgtctcgattcgactttaagagatgtttttcaacagctcatttggtaatgtaccgacctcccaggtcagatcattacttctcggctcccagagcctttttcattttctcggactcccagagtctagctacccagcagcacaacaatccgcttccactcgggaagcctagtctatgatgcccgcagacatcccgaatcacacagattcgtttcttgaccactcaggtcatccatctgccacataggctgattctggttacgattcccacaccacaacaacttttcacaaagcacaggcaaacaaatctacgcaacgggaaccacctcacatccgcccatgaccgtgggcacggctgtttgaacagttagttaacctctgcagaggggtacactttacccacaagacacgaacttactccagacactggccggtgtcagaggttcgcgacaaagcctttcccaagccgacccagggatacctcatgccacatcgaaggatcaaatcctcacataaacataggccattttaggcgttcacaaatcaaactccaaccaccttgatcggtaagtgagcaagcttctcgtccttgccttaccaggaacccggtttgtctgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgctacataggcacaacccccgcatcgcgagtttttacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacagaaattagtgcgactactgggtagatccgtcggtttggcacgcaaaccgaggccaagcaagttaagtgtgtgattctaataatgcaagttgcaaacaaaataataatgacttttcaattataggggcgattgatcaaagggtgacttgccttgctcaaggtcttctcgaagcttcacgaatcttcgagaaaacccgcgatcgacgaaaatccgataaccgcaactatacacaaacaatcgaaaacctaaacaagagaccaaaagaaagatcctatttagacctattagtagtgccattaaatagatctcaattttacggaattactggaagtggaacggaggcgatcggagctacggatcgagggatatgaattttggaggtctaaatggattttctggacaaggaaaaggaattattaattcccttggaaaagaaaaggaaggaggga

SEQ ID NO: 26873 - DNA, 217 bp, Oryza sativa
attaaggctgagttcggcaccgagtgttcccaactccgcttcctcattttccgcgcgcacgttttttaaacaggtaaacggtatatttttttaaaaaaaaattctatagaaaagttgctttaaaaaaaatcatatcgatgcattttcaagttttttttttgactaatactaattaattaatcatatgctaatgaactgctcttttttcggtgctaga

SEQ ID NO: 26874 - DNA, 821 bp, Oryza sativa
gaatatagggtaaaatccgaaagttgaatcctccaaagatcttttgcaagccctccattttaatgggacccttaatgtttaactgtataaaagaatgtgaaaaattcagagatctggttagtcctgcatatatagctcctagcattaacgtgtgtttctctaaacaagttatgaacttctatatattgcacattcctattgaattaagcacccatatatgacatcacggaagttgcgtcgaaaaatagtcaactttgttgtgatcttacttattactgcaagttgctttatgttaatctgtaaatgatgatcgatactgccatcaaagatgattcaccaatgctgtaatgcaagctagtgtaaaaattttcaaccaaatagaaacgatgttgataatgaccaatgatgcaactggcgagatgttctctgtggactagtgggctgtgagggtatggtgttgattttattttattttattttattactttttaatggaatgagggtattgtatttgctttcatttatcaaatatctagtatatgtcagtatgtcacttgaccattgatgagtcgaaagggcagttaattgcctaaatacaagggtcgcaaatcttgtcatgcacattttagttattgtagcttgcagggccagattcaatcagttcagtatatgtgagcacaaccacaagcttaaaatatactagcagagggtagtgaaaagaacattttgctgattaaaattatcagcattcaagatatgttatgtaagagacatattccctcagtctaaaaaaaaatcaactagacctatgttatatccaa

SEQ ID NO: 26875 - DNA, 218 bp, Oryza sativa
attggattatatatttacatccaaaatgctgtcactatagtttcatactttattctttgttactttttgtttgttcacaaatatttctcttccagaattgaaagtgcatttatccccctagtggtttttggtgattaatgatgaagtggttaagggatcaatgtgtttatatatcaatttgaaacatctttggggatacaataactgacccacgctca

SEQ ID NO: 26876 - DNA, 197 bp, Oryza sativa
ttcaatcatatcccctcccttctctctctaactggtgactgtagcatcacaatgggtcttatcatgcaactcattatcagcagtattacacattgtaaactaatatgttaatgtggacatgcaaaatcacctccatattgtagtatttgcagaaatatatcttttgttcacacatttatcttttgatatgtggcaga

SEQ ID NO: 26877 - DNA, 390 bp, Oryza sativa
tgaggattcttttggaagatgctgatatgggattatgtgtataattgtttgctggcaaaggagacctagggtctcatttcagaggaactatgttccaacctcgagttaataaccaacctgttgatggaaaagaaaaccaattaaaactgtgttgggttaaaaagccaatgagacagtagttggggataggagtttggatacgccttttacagatcaagataaggattgttggatgaaacccataagggtacccgccatgcctctacattgataagttcggatatacctgcaaacagttaagaagatccaggagacatcaatatttgagaacatagtagtcgatggttggtaattagtctatcaggtatcagaaaagggtcaaaggtgata

SEQ ID NO: 26878 - DNA, 1501 bp, Oryza sativa
ggcaaggggcaagtttttgaaaccatgttaaccctcacggtaaccgcacggttaccgtgataaccgtcttacggtggggtagcgataaccccacctaaaattgtttggtgaatcctggtgactagtcacatatgccaaacaaattgagttttgaatcctaactcacttgcttaggtactactccctccgtactcataaaggaagtcgtttaggataatgtttaagtcaaaccttgggaatataaatcatgaataactctcgagttgtgagtttgaaaatataaaaattatacgaatagatttgtcttgaaaaatactttcataaaagtatacatatatcacttttcaataaatatttttatagaaaaaagaagtcaaatttatgttttggagaccgtgtcgctgtcctaaacgacttcctttacgagtacggatggagtattatttaaccagagggggcaaaagcacataagaaccaatagaaaatctatcatagatcaatctagcttatgtttgttctattcctagtgtcatgcacccatcgaggcttgaacacataacgttcctccacctctagttaggtacttaggtgtcacaattgcaacttctcgtcatctgacctgatcttctcaagcaaatttttgatcaatgagtcatgtatcttccttatcataactcgtggtgtgttttttatgactggaaaaaactgaaaaaggaagctactttagggcacgtacaatagagacactcgtactagtaatctcaacctgccatataggataatactacacaaaaacctacctacaataaaaaccacttcttactttcttagtatattttatatttcagaactgataatctacgtgtcggctcttatgatatttaatttatattatgatatcaattggagtttgtattatggatcctataataacaaaaaaaaagtacatatatacccttaaaagttaaaatatagcgaacccacctatcaactgagtacccacgtaaattttcaccccaaggttaaagtgaaaaaaataagtaaaaaggagaacgcgatctctcctcatccgccgccgccgcgccccaatcctcctgtgtcgctgcgatggttaactaccactccgatgtggagagcgagcgacgcggttagattctaagcctatccggtccgcgaaaatagaaaaaagaggagggaaagggagaatgaatctgttgcttctctctctctcttttccaccagaccagctgagctgagccaccacctcctcgatatattccccgcaagcccacaccttcctctcaatttctcccattctccactccacacccgtcccgtctgcatctacccgccacttcctcctcctcctccgcctctcagcttctgctcttccttgttctttggcccgcgagctgatatctgcagtttgcaaccgagaagagaaaaaaaacgaaccgggtttttttttaggtaagcgaatcgcgctcaggtttcgtctggt

SEQ ID NO: 26879 - DNA, 1501 bp, Oryza sativa
gcacagctctactatccccaagatttaagatgcacaaatctgttccatgtagaagcacaaccagaacacaagacccaactgatactaaatctggtctatcgtccatctcttgttcaaccatgcataaaaagtcattttcagcttgctcaacagcagtagtgaggcacttaagcacaccagctcgaaatgtttcagaaaatttcacatcttcattttctgcaaatctcatggccagtgttaactcacttttaacaccattaagagagccctctggtgaaccatatagaccattttcttgtttaatccggcactctaacaaatataggtaatatactatattatcatataaagttactgccaaaaagtcagctgcatctcgtccattaaatccatcatatattccacaaatcaaccatccattcttctcagagcacacagcttggactctatcctctccagcagctccaccagccatttttatctctgtacttgtcagaaaattggatgagacagtagttggggcactggacctccagatatttttactgatttcaaatatagagctctcagtcgatacagggctgccttgtgaggtggataacaagtccaatcttgacattgatggggatgaaacaatttttctgaaagaattaggagagtctagttctggtaaaatttcttccccgataagacccttgcaaatgtttgtattggccagcgtgaaattggcactaatcgcagcaccagacaaacaagtgaaggatccattttgtgatgtcatcatggtattagtttcaagcctcttgttgggagagatgtcatactcatcagtgtctagagaaaaacactgataagaattacaatggtatccaaagctgacgttgagattgctataactcctgacaagcatgtcttcttcctcagaactgatgctgtgatcattggagctcttatcaaacagttcctcatccaccatctttttcaacagaagtataacaccgattgtagtgtatattgctgtcaaactatgctttgaaggtttaaatgctacttaaagcccatgccaaatacaggtccttttatacttaaatggaaacgcaaaccagacctgcaattttaacacaaagcattatttatataagtacggtctgagcatggttgaactgtagagaataaagacggcaaagcgttgccaaacaaagaaatatttcatcaaaatttatagtttctttagagtaccctataatggatatgagccatccattacttttgatctaatggatcagattcaattatacaggggtaaagttagaattggtcgaatgacttcctccataatgtattctagctttctagtccaacgtgatagagttgtgtacaggaggtgtaattgataggtatgtgaacaagattgcttctcgaatctttgatgaataacatggtttccgtcaactgcccctgagcataatactattagtccttagtttgactatccttccat

SEQ ID NO: 26880 - DNA, 182 bp, Oryza sativa
agcagtggctactctcgtgtcttctgttaggatcgagcataccgtattcgggagtggtgttgattaggagcttttatagaattctcatttattgattgtccaatcatggttgccaaaagagaaagagcgcacattcggttagtgtgttctaaactgtctaattttcattggtattttgcagg

SEQ ID NO: 26881 - DNA, 1501 bp, Oryza sativa
ggcatcgacctcaccaatgcatcacggcacaaggacagtgcattgcacctgcccggccagttgctagtgcgcgcttgcagaaaaccctttaattttcatcctagattgcagtcgcgtttccttttctgatcgaagaggaatatatatatatatatatcgaataatttggctgcagccatattgacattgacagggacactagcctagctagatataggtttaacgaccgatatatacatatcgccgtcgctttcgcggcctagttagttaataattaattaatctctcgtatacagtatatgcgtacgtaggatgaaccttctcaattcgtgcgtatgcgttggatctgcatcgatcgatcggtgatgcattattgggtgacatatttaatggcatattaattttatatatgtgtacgtttgtatatagatataaaacaaaaatgaacacgaaagagagagggggggagaactggagaaccttgtgcggctgcgccgcggctacccgacttgccaaaggtcaacgaattctattttgcgtcgctcgcgaggaagaagacaaccgcggcggcgacgacgtcacagagagagagagagagagagagagagagagagagagagagagagagagagacggcaatcggagctgcagatttgattaattaaccagccggcgaattgaaatgagaagaatcaaaaattggggcggcacaaacaaaagatatgggacttgtggcccgtagaatccgtgtgaaatttgcaaggatctaagggcccctttgatttgtaggaaaaatgtaggaattttggaggatttcaatcctatggaaaaaaatcctatgaaggcctttgagacaaaggattgaatcctatccaatcctttaaaattcctatggaatgggtaatcctatgcacattttggaggaaagttagcaagaggtctaacctcttggaacatttcctctgagtctatctctctcatctgattcctgcgtttttcctgtggtccaatcaaacggctattcctgtatttttcctatgttttgcaatcctctgttttacaattgtattcatgttagaatcctgtgtttttcctattcctctgttttttcattcctacgattcaaaggggccctaaacggaggaatggtggtggggagctagggatcttgtggatctggacaacatgtgttgcacagcagtacacgttgtctgtacgaacttcacaggaatttcagtattgccgttcttttctttttatttatttttggaagctactctgatcatggtgctggtagggtgtttcttttctttcttttttggaggatggttgtgtttttttttccatgttgaacctaccgtcataatgtgtactgttacatggtactcactccgttctaaattaagtttgaacttatttttgggatagatgtagtatgtgagcttatcatttgaaatgtgtaatagaaaaaaaaacacacacacacaaattaaaggtactc

SEQ ID NO: 26882 - DNA, 368 bp, Oryza sativa
ctcagggcatgacgtcaccccctcgggctctctcacggcttcgccccgaggccctcacccggccgccacgcggcagagggagagagcaaaaggggagtgcaggctgaacagccataaatgtgcaacgccccaactgtccctcaccgcatttaatgcggtcagggcagacgtgcggcgcgcctagctaacccctgtccatcggatgtgaccggtctgtgatcggcccgtctccgtcacatccgatggatagggcagtcgtgtcctcacgtcgcccttgtccccggcggagtgggggtgggtatgacccgtcacatccgggcgtcacttgaggaagggctgttgcatgtcaccgttcatttatgagggaa

SEQ ID NO: 26883 - DNA, 1501 bp, Oryza sativa
agacgctacatcgctggtcgaggaccagacagtagtcgtaactcgaccacttaaagtggaagtagtgggacatcgctagtcgaggaccaggcagtagtcgtaactcgaccacttaaagtgaggcgagaaagatcactacgttttactggttcgagaaccaggagtaggagtctcttaatcacctataggggcgctaaagttggtttattacatgtgcatatcatgtggccagcatgactcatatacccaacttatagcatatccggatgtccgctcgcaatcatatcgggtgatcaagccgacggcgtttgcgaggaattatccgttaacaaccttttctcgagttgtccagtgatggccggtgctatgagataggtcgtcggtcttccttagtaggttgggtgcgataactccgcatttgtcgagaatgttctcgataatggagtgtactcgaccacaacctactcgagtgctcagttgttcctgaaaattattttctagaaggcaagacatatagcagaggatatcgagtatgtactcaaaaactgcatggatcttctagtatcatcaggatataacgagcaaatgtaaatgtcagggattatgtaaaccgtaagcaagcatgatttatacggaagaaaatagagcgagcccccagcattaaattgtagtcgatttaacatcggggacactcgcgcaacagatattgtataaaaaacatgctctaggtaaacgtaataaattatagatctgacaatattgtatagactggaaaaataggtacggtaaattgcatataaattattgcatacctgtgtagatatatgccggatatatctacggaattagtagatcaatttaaaaaatcaatccactaattacctgtgttaatgttgtgacgacctcgtgtggtcaaagcatatgcaacagcactgtacgtaccaatatatatgcacacgcgtacatgcatgtccgggtagacatgtatgtgtattgtatgcataggtgttaggctctgtacagggacatctgatacgcctcctgacgtcaggacgtcgaccggttggtgacgtggcaacgcacgagtgggcaggaaatttggccatagcttcctgttatctcgtctgtcgtcatggtcggttgcgatctgctgcttctacccaggataaccgagtctgatatgagtcaacaaagaccctgatatcggactcgatgccgtcgtcggcgaatatccactcgaggtagtcgatctggccgaggcttcatgatggataacatcaaaatgccgttctccgcgtcggtgacgtcttcaaagcttggtcgatctcgagagatcgaattattgatgacgatggttccgatctcgtcggaagatgtacttggataggttggatctccccacagccgaagtcgtcgagtagcttgttgtcggagagtccatctcttaaacccaactcgtcgaaatcctgaagcaccaaaatccccctacctggcgcgccac

SEQ ID NO: 26884 - DNA, 314 bp, Oryza sativa
  unsure (1)..(314): unsure at all n locations
tggggacttgaaacccnttgagtaaccnnctgaaancccntttnannnncgntnnnnntnnnnnnnnannnnccaccannannnncagtaggcgacttcagaacggccttttatgtttgtttttatctttcacgactaacacaactgccctcatctaatcaacaatcttgacaggtgaccacagcataccttgatatgtgcaataatttggactcatggagcttgaagatgggctctgaaaattgcagaaactaagttagagaaattaatcaagtcagaaccaccagtgattcacccctgctctgaaaaaaaga

SEQ ID NO: 26885 - DNA, 444 bp, Oryza sativa
ctgcattatttttctagcattgagtggtttcaattattaatacgaactagaaatgccgggacaccttgttaaattttgctttaattttaattgtaaatgcttatgttagaataaatttgttgaaatattccctgacttcattttaaacatgttttgcttaagaactgatttggacatgggttatgatttttttctaattaccttgaaacgtataaactctatactaaaagtaaaattacttgaaaccatataaccttaaattgatgagaaaaattgtgtcggttcatatctatttgtattatgtatgattattttttggaacatttagcacagggccggacccagggggtgtgccgggtatgcaccggcacacccaaaaaaacgaaaaacttatagtatatagcatgtattagtttggggcaaaagttgatgagtatgaacgca

SEQ ID NO: 26886 - DNA, 799 bp, Oryza sativa
gggactcagccattcccaaatgtttttgtactcttagaaatgctgcattatcactacgaactagtgctgtaccatttcagaaaccagtttccttgctcaagttggacattgcagcatagcactgggaaaatgggaccttaaaagtcgtctagtgcttcgtaagtgtgatcatcgtgtccacatattccccacctgaaagtgtttgtttccttacattcatagcttactagaattttcacacaacctccacaaaaaccagaggagtctctatgacctcccactcaggatagcttcctttcttggcaggatatgactgagatatagtgaaaactgcagtcaaatgccacttgcagtgcatgaaaagctcttgatatttcagacttttcaccgcacaaactacactacagtacgtccctgaaggtctgaagaagatatatatgcacaccagaacagtaagaaaaagaaccctggaatatccaatgcaatgcaagcaagctagttctttggaataaggattgttcctctcaatcagtgacctccaaaaagcgaagctcctacttgtgtgccataatgcaattgcaatctatccatccatccgtccgtagcagaggacatggacattgtcattccagccatagtcaaaggaggcatctatctggtttagtcagccactcgctcgggcgcctccaagctaaaaggagagcgcctgatgcttccctgtcaagttagcatccggcaaatgcgagattcctctcgagttgcatctccagccgcttttgcccgtgcctcgctttgcagc

SEQ ID NO: 26887 - DNA, 1501 bp, Oryza sativa
cgcggaaaacgagggagatgggttgagaaaattgggtgccgaacacacccctagtataatgccttgtctgctattgtaaatctcaagttcgtaaatggtttcgaattgtctaaagattaaccaatataaggttcaaactcaactcacacagtgagattaaaaaacaaattcagcatataaatagtagttgtactattcatacccggttttttttcctcctaatgtatatgttgaatttgagatttttgatggagtggtagatattactatattcgtatacaatcaatttttttcaaactatcttaactatttacattaaacatagaaaaaaaagtacacgaagtgacatctacgaaagacgtaccgtcacattaatttatatgctaccacaattgtgacacttacacatcgatcacacatgttcaagagatatagtccaagataattaatatccatgacgttgtgcatataaaatctttccaaaatgttcttgcatatacaccctcaattatgaacaatatatagcatttgaatactacccctctattccatattataatagtctcagacttcaacttttactaagtttattggaaaacgcagcaatatgtacaacaccaaccataagtttcattgaaatcaactattaaatatatttttatagtgtgcttgtttcgtatatcaaaatactgctaattttttacaaacttggtttcaaactttaaaaggtttaacaaaacccatatgatttactacctcagttcctaaatacaaccacctagaactagacgaaatacatcgtagtactgtgaatttagacatgatcaatttggatagaatatatctagatttgcatactaggatatgtcttctaatttactacatacgttccaaaatatagcaacttaaaatcgaacaaaacagatcctaatactgtgaatctggatatactcaatttggacagagcctatccagattcatagtaatttaatgtgtctcacgtccgatcatatatgttattcagatttgtagtactaggaggtgtctcgtctagtcttaggtgttgtccggattcgttgtattaggatgtatctcatttaattctaggttgctatattttgagacgaattgagtagtacttcctccgttttataatgtaagtcattctagtattttctacatttatattgatgttaatgaacatcaatatgaatgtgaaaatgttaaaatgacttacattattaaatggagcgagtagtaaacataaaacggagggagtagtagtacatagatcaattcaccacaaagatgcttctccgagcagtgtgtgaactcttatttcgatcaatatatagatctggccatttattttatctccccacagttctgtgagatcaatttggattccagtagtatatacaaccggcatcaccagatctctatgagtaaaaaaaaaaaatcaacacacaacatgcaacacattgatgtataaactaactta

SEQ ID NO: 26888 - DNA, 1501 bp, Oryza sativa
ttgcacgtgtgctgcacgtgaggaatgggagggccgagtgaagaggatgggccgagcaagagagaaacggcccaacgaccaagagggacgcaaaatagacttttccaaaagatttgatttggaggtattggattcggatttggatttagaattgaattcaaatgtgatgttcgaactcacggacggagaggtaaaggaaaggatccaaggagaaagtcatcattcaaaaacggaacgatgggagatgacgatagagcaatagatagatggatggatagggcgatagataggtcgatcgatagacatggatggatttaaggtagggatttaatattttcttgtaatcggggacaagtatttggcgaggattcaaaggaatagattgaatgtcggagttgtctttggaatgggaatttcgaggagacaatttttgatttcgacgagagggatcaaggagatttaaactgagatccacgacatgacttagactcgcccacaaagaatgaaaattttcgcaattaggattttattaattaggttttttaacgtctcgcgaaaaatgaggcgttacacttttcaaactggtattaatccattaacactaactgtggacccatagaatttactaggaataaattgggcctaacccatttagttctaacaataatccccacctaatttcagagctcacagaaatgttctcagtatttcggcgtagactgtgaagttgaactttcacctagaaaaaggagttacacctgaccacaactgaacaatggactattccttgaattgtcggtcttgtgcagttaggctttactcaatttcttaattgatactagactgtcattagcatctcctttgtgtggtgtgtataagttgtactccaggccttttcatgagtatctagagatcacctaaatctcatagactttggctagcagtcggactcatataggtgtgttccttctaagatgttctgtaggctaacatatcttgtttaagaaaagccactcaggtcacataagggaatgcaccaacccaccatacaaataaggagataagtacatcatagaaatgagctttgggtctctcctcctagctaccaaatagcttgtttcaccatcctaattcacaggatctctaatcataaaggacggattatcactattgtgtaactcaagtggatccaagcccatctcactcgatgcactgtctatcacattacgcgatagacccttagtgaactgatttgccagatttttagtagtctgaacatagtacaatgctatcactccggagtttttcagcttcctgacagactatattagtattctctttatatgtctggatgacttcatgttgtccttctattaacgccaaaatatggtatgtttttttactgcattcaggtaagggaaagagcgaaagggcctgtagcctagtggttacaagagcctcagtagcacccgaggtcctgggttcgactccccatgggagc

SEQ ID NO: 26889 - DNA, 1501 bp, Oryza sativa
tatgattctctcttggcagatctgcagagagtactgattttggtgcatataagttagtttatacatcaatgtgttgcatgttgtgtgttgattttttttttttactcatagagatctggtgatgccggttgtatatactactggaatccaaattgatctcacagaactgtggggagataaaataaatggccagatctatatattgatcgaaataagagttcacacactgctcggagaagcatctttgtggtgaattgatctatgtactactactccctccgttttatgtttactactcgctccatttaataatgtaagtcattttaacattttcacattcatattgatgttcattaacatcaatataaatgtagaaaatactagaatgacttacattataaaacggaggaagtactactcaattcgtctcaaaatatagcaacctagaattaaatgagatacatcctaatacaacgaatccggacaacacctaagactagacgagacacctcctagtactacaaatctgaataacatatatgatcggacgtgagacacattaaattactatgaatctggataggctctgtccaaattgagtatatccagattcacagtattaggatctgttttgttcgattttaagttgctatattttggaacgtatgtagtaaattagaagacatatcctagtatgcaaatctagatatattctatccaaattgatcatgtctaaattcacagtactacgatgtatttcgtctagttctaggtggttgtatttaggaactgaggtagtaaatcatatgggttttgttaaaccttttaaagtttgaaaccaagtttgtaaaaaattagcagtattttgatatacgaaacaagcacactataaaaatatatttaatagttgatttcaatgaaacttatggttggtgttgtacatattgctgcgttttccaataaacttagtaaaagttgaagtctgagactattataatatggaatagaggggtagtattcaaatgctatatattgttcataattgagggtgtatatgcaagaacattttggaaagattttatatgcacaacgtcatggatattaattatcttggactatatctcttgaacatgtgtgatcgatgtgtaagtgtcacaattgtggtagcatataaattaatgtgacggtacgtctttcgtagatgtcacttcgtgtacttttttttctatgtttaatgtaaatagttaagatagtttgaaaaaaattgattgtatacgaatatagtaatatctaccactccatcaaaaatctcaaattcaacatatacattaggaggaaaaaaaaccgggtatgaatagtacaactactatttatatgctgaatttgttttttaatctcactgtgtgagttgagtttgaaccttatattggttaatctttagacaattcgaaaccatttacgaacttgagatttacaatagcagacaaggcattatactagg

SEQ ID NO: 26890 - DNA, 1501 bp, Oryza sativa; identical to SEQ ID NO: 26889

SEQ ID NO: 26891 - DNA, 1501 bp, Oryza sativa; identical to SEQ ID NO: 26887

SEQ ID NO: 26892 - DNA, 1501 bp, Oryza sativa
acttctccactacagttactaacggtgacgtttttattttgcccttcgaggtacaataataagatttaagcatatgcaataaaaacctctagaatatttttttcaaacaataaaatcagcgtatccaaccctaagggcattttgagtgaaaaaagatagaaacaatctcaggggactaaaacttccggtctcaagtaactgaggttcaagactgctttctctgtctgaaaacaacgaaagtggacctgaagttcccgtgcttacgacttgtaatttcagtagatttgacttcgatgctaatgatttcaagtaacgcctattcatccttctctatgcgatattaagctcctttcaagagcgagtataacgtattgtcacaggcacagatatccagattgcgagacagtaattaacgagcttccactagtaatggtgtagtgtgatcatctcgagattgaagtcgagctctcacacctcgagcactatcttgaggtggctttatgaggacgatggccttgtggggttgtgcaccatttgtggcggccactgtggccgccatatcaagaacattattagcaatgagcgcagggacgccattgaaggagtgcaaacaaagacgagaaatacaggtgtggatagcactcaaagacaccatgcggtagatagagatagaggcagaagaagataggaggataaatgtctgacatgtgggcccaaatagatttatttcaatctattatgcaatattgatgattggatgtacacacggctaaaatgacttaagatgacataggacaaaatcacatactatgtttcatccggaggcaattcgctcggttttaggggtgtttggatatggggctaaaattttttagtccctgtcacatcggatgtgtaggacactaatttggagtattaaacatagactaagaaaaactaactaatttcataaatgagtgctaatccgcgagatgatttttttaagcttaattaatacataattagcaaatgttaactgtagcatcacatatgctaatcataaattaattagactcaatatattcatcttgtcaattagtccaaggttatggaatgagttttataattaatctatgtttaatactctaaattaacatctaaacatctaatgtgatagggactaaaatttagtccctatgaaccaaacagggccttagaagtttagtggtatcaaatatcttatagtattaggggctgatcggtttagctgggctatggttgcacagccgcaacgctgcagcccttctagcctaatttcgcttgctgactcctgcagagctgctactgcctgtttcgaacgaacccttagagttaagagaggtaaggctgcgttcgtttatgttagataagttgaggaaacaactcgtttttcgcgcgcacgcttcccaaactactaaatgatgtgttttttgtaaaaaattttctataggaaagttgcttaaaaaatcatattaatccattt

SEQ ID NO: 26893 - DNA, 699 bp, Oryza sativa
agaggcggccctcctcgtcatcctcgcggccgccggcgacgggagaggcgagcggcggcagcgagagggaaaggcgaggatggtggcgaagaaaaagagaagagggggtgggagagagagagattaggggtagggtagtaaaaataaatatggggctttgtgtattggaatacctattatgggttggagtgtctctattaagttacttcagattttgaggagcccatctaggggtatcctacattgcgagctgagtttccctacgagtgtcttcagctagtgaggacattttaggagtagcttaaacatggcctaaaaatattgtgactcttttatatttcttagcagatatattatctttgccgaatatttcagagaaagaaaggcatgtagaaacattgctgcctgcatgttcagacttttcgttgaatgctgcagcatgcaagcaaagtatcatcccaaagcatccatattcatagtaaaaaaaagatgtttttttaacagggggaattagtatttcttacgaaattatagcaaagttcctaaagtaacttgatgctgcataataacgcaaacctaatgggtctaatcagcttgttacagctccatttcaacctatgttaacgctgtgacatgtacttatgttttaactgtgaatctgtcgttgttgatgccttcgtcattttgcaataatttaga

SEQ ID NO: 26894 - DNA, 1501 bp, Oryza sativa
cgtggtcgtccaagaacaaagaacccgccgccgtcgcaccctccagagccctgcacaggccacaccaatatcagaccacgccatcgatcaaaaccaaccgaggtgtcgatcgatcgaacgaagcgtttacctgaggccatagaggtcgtgggggaaggaggcgtgggagaggtactgcgcctgcacggccatggaagagagagggagcggtggaaggagggaaggaatggcgatggtgagttgggtggggggaggagtggaaatggaaaacggatggagtcgtggaggcagatgggttagggggagggagggttatatttatacggcggtgaggcgtggatggaagacacgttgggaggtggggtggcctgcgaggggacaaaagctgtctgcctcgttttattttggacgtgggggaggcaagcagcagcaagcaacccaacggatggatggctatggcccccactctggcctatcgctttctctctctcttttttcctcggcttcaataatggtcatcgtttacggtggaaatcttttggctcttttccctttctttttccctgttcggtttttgttgcctggtgcgggggtggtgattgattcgtccggtgtgacgtgagatgtggagagtggggctgctgctgctcgctgccttgtggtggtggtggtggtccctctcggtggagtactattaaaggtggcccactcgcctctgggaggttgacgctactctattttccgcttttctttatttatgctcgctatcttcagcgcctaggctgttgggggaggtaatttatgaaccacccaagtcctaaccgatcgatttatatccggttcaacgtgtattgtggggataaactagacgtcctaggaagaaatcatgccatcccagaaagatctagtctaccactgcatttataaatttttatattgtttggtgtttacctgaaccaattattaatgcaagattgtctacttgagcagtggactaaagcataggaaccgtatattactctcttttctccagattcgatgcagtttcagcggcccaagccaaggagatgccgagaggcacagcacagcagacgtccccacgcacacacaacctaacctaacccatctcatccatcgtgggcagaccattgattgccgggccgcatcgtccatgcttgctcggcgcccgggtttgaatacgtctcccgaaacgccaagtgcgtgatcacgatggccccccggacccggatctggactagtttggccgcaccaacgtgacatcaactcattactccccgaagcaaagggcgttggctcacaaatgatactccttttatcaatgtacggttacacgctactttatcgtcgtacggttacgctacagccctcaagggggccttttgattccgtttcaaccgggcggtttgtttactggagaggctttctttttaagatccgcgagtcgtacggacgtttaaatattgttactactacaaccacc

SEQ ID NO: 26895 - DNA, 1501 bp, Oryza sativa
aagaacaaacatatatacaaacctattttttatgagatggagagggtactctttctgttccaaaataattcaacttaagataaaatatgatctatcctaaaacaacaaatttgtattatcttagaatatgttattttgggatggaggaaatagttatccttgcgatctactccctccatctaaaaagggcaacctgcaaaaagatgtgaaacaatatagtacgatgaatctggatatagaggttcagagttattatactatattgtgtcatatcctctcatagtcctttttttagatggatggagcatattatagtgatatagtcatcccagttggctataattggaagtgattaatctggtcaaatcaaataaaagagaatatcccgtcttaaaaataacaagtcattttgaacttctcgagacccattttagaattttgactacctagttcagtataatcattatcataaaaaagttatttagtttgttcttattttttgcataagtgtaatattatgaaagctcttgttaggataaagttgaatatatcattttcatatacccaaaaagatattttgaatggtttttatggttaaaattaactctttttgaatgttcgtatttcaagcaacttgtttttgagagcgggggtatgttacttatttatttgtcatatcggatctagcccaaggaaaactttccttttatattggatcaatcacaaaaaaagcgaaacgtcgaactgaacgcaaatagtgtttctcctttcccttttcttcggtttgactacaggagtgataaaagcatatcggtccaaaatatctttcctacaatcatatttgtctcgcacaacagccaaaacatagcaaaattctaattttcattaccatgttcatatagaaaggcaatgtcgaaagcttcagataccaacgatacatttgaaaagtttaaaagttggattgaaacactcaatttttattttggtacaaagtgacagagcgagagacaaaaattactcgcacatctgaaatgtgaccaattcgatagattgctgcaccattttcatataaaattcgaactaaagcagtttgcacgcaccaaacacatgactagttgactactagcaatcactgcccactcatacataatcccggcaatggcggccgaggcgaccaacccctccacctcgcctcaccaacctcctccacgactccggggaactcgaatcccgccccggatagtcgccgccgagatcgatccatggcggccgaggaagcccaccgcctcgccgacgccagcgccaccgcgccgcccaagaacgccgccgccgtcgatggcgtcgccgtggcggcgccggcggccggcggcgggcatgggagggcgccggggaacaagctgtcgctggtgccgctgatattcttgatcttcttcgaggtcgccggcgggccgtacggcgcggagccggcggtgcagtcggcggggcccctgttcgcgctgct

SEQ ID NO: 26896 - DNA, 986 bp, Oryza sativa
ggcacggcaagctcggcgccctgaccccgctcgacgtcaagggcgccatcctgatccagcccttctttggcggcgagacccgcaccgcctccgagaagacgatgccccagccaccaggctcggcgctgacgctctcgacctcggacacctactggcgcatgtcgctccccgccggcgccacacgcgaccacccgtggtgcaaccccgtcaccgggcgtggcgcgccgcggctcgactccctgccgctcccggacttcctcgtgtgcatctccgagcaggacatcctccgcgaccgcaacctggagctctgcagcgcgctgcgcagggccgaccatagcgtggagcaggccacgtacggcggcgtcgggcacgcgttccaggtgctcaacaactaccacctctcgcagccgcggacgcaggagatgctcgcccacatcaaggctttcgtcagagccagatagccccagccagtggctaagcttagctgacactcgccgtgtcacgctaattaatccatcctaatccatccaaccatccaaccagtttctgctgcagcagatgatgagtaggtgtcgtgtaagctgtaaattaattacttttgtagtacgtgtcactcaagacaagcgttgtccatcccaatacccaacttggatcgtcgtagcggtgtcggaaagcaaaagcgtagcacataaaaacgacactgccgctatgccacgatgttgttgctccgtgtatcattcatgttcatcaatatacttaaaaagcaagttgtggatactgttttcaaatcgggttgccgtcctcgacgacactgatggtgttgcatcaaggaaaccggaaaagtttccaagagcaaataattgtctgattgtctgctgctttctgggctttgcatcaggcatcatcaagtgaatagaagaactgatagtcgtagtagtatcctctatctcagaatatagcaacctaaaatcagatggaacgtattc

SEQ ID NO: 26897 - DNA, 246 bp, Oryza sativa
accatttttcccttatttcgtccatagttgcaaaatttgggtgtaaacacgtgccccccgccttttttgtgatcatatgtgacccttaaacgcatagaatatgttgtctcagggtgataatccaatttccgggccatagaacttcctaatcatcttgtcaaatgctcgggaagtatttcttcaagtatttcccattaattgatctctgaaaacaccgtcttgaagtgtcttcatctcgttcaaagt

SEQ ID NO: 26898 - DNA, 385 bp, Oryza sativa
ccccaaaagtgtagtacacgtgcctaattcgaagctgaatatctaatgtgtgctataatcaggaagctgctctcaaacaccctatcgaaaaatggaaaagaaactctgaagattcatcagaaaaagttcagaatggcttcagaaaacttgtccaagaattgaacaaatttgtttcagagaacttatatataagcatgaaaaaaaaattacaactgtggttttctcattgtgtgaatcattgtacaaatgaacaaaaggtgagctaagaaatggtttcctttttctttttacagattttttttttctgacgagtagtagtatcatacagcgctatggcagaggcttgatttccattgagattgtctcgtctccaaccatgccaaga

SEQ ID NO: 26899 - DNA, 1501 bp, Oryza sativa
catatcttattttagaataacccatatttatagcaataaaataccacaacctacctatatgatataacgatacactcagagccgtatagatgcaaactacaactaaactatgttattttcgtcatgtatatctcgatatacctcaagttgggcaactcgtagggattttctaattttataaaattaaagcactcatgctcatgctccggggcctccccctgccacgttgccatcacgttaagcagaaaaaggacggcattaatcaccagtatacagtatcaagacgcgaataatcacagacggaaaagtatacttccacatcaacatggggagatatatatatatatatatatatatatatatatatatatgacaggtactcgatcccctaacgctactaatgaaatcaatgaatatatagctcgtcgttccaccacctttgattgcatatcaaccatgttgacgtgtgatcgacaagctccgacaggcacacgaatggaccaccttttgcacgtccacccgggattggacgcgttccggtttctctgcaccgcacacggtggattttgcgtggttttcgcagctttccatcgtgtgtttaaagactttgggagcacgcaccaagtcattagctggagtactcctctagctcggtcatctcgatcaaaggctgaagggtgacgtgcctagtcaatcacacttaatcaagtcattcacacctacggataaatgcatgcttatgtgtcttattactagtactatagtagctttttggtttggttgataagagaggtttagtaggtgtagctgagttgtagtttgtcagacccgtcaacattagtatgcgggaagggatcgattggtgaaagtgaaaacagtataattgtcgtatcgttttcgggcttaactggctgctagtgcaagtcgctgtatttcgtttttattgtggtagctgtcataattgtagctgaaagggcttgttgatcaataaaaaaaggtgtacataggcatgccacgggtattttttccattgtgcttccttttcttgcggtcatagtgttgcgaattcaacaatgactgtgaaatgtattgccgtatcgtgatattataaggtgtacaaatgcaagaaagagaatgatggtgaaagtaaaaaaaaatcattcttttaggaggacaggaaacatgtaaatcatgtccacatgttttgtagaatagttcacccaatagcggaatatatattttaaaagagcattatttcatttttttttgtctagaaacctatcttgtaaagaaagtgaaacgcgacaaggatttgatcaaatttgaggtgtctcgggatttgttactcatccatataatatatcaaactaaaacatgaagttgcgaatcgtagagcacaagagcaccacaataaggaacgacgaatccttaaattttctatatatattttttaatgaaaatttgagtaattgttataatgaacctttttagtatattttta

SEQ ID NO: 26900 - DNA, 240 bp, Oryza sativa
gtggcccttttgtatttcgactcggtacccctaacgacgtcaggatgcatagttaagagggtttgagggagttctgtgctttgagattgtgacgggacacgtgttgcacaagggattaagtcttttgcaggagcgtaagacttcagtcttaccaaattttcttcccagtctgtgacacacaaaagctttccaacgccaagcttgccaaggcacttgcattttgtttgttctatgtgtaga

SEQ ID NO: 26901 - DNA, 1501 bp, Oryza sativa
tggttataccttatattttggaattgagggagtaattaattgggactgtgttttggagctactcctagccaccattccaggtcaaaagtccaatgatatatggcctacatttcccgcatctatggtgcatataggacggataaatgacgcgcatacgacgagtatgataatcggtgctactactcctaatttatgtggttaaattacgagaaatgctatatgatggtatttcattcggatgtataggatgatactatctggtaggtatgctgatattccgttcgaacgtacgggtaatgcctctgagatatcgtttgatagtcatctaatttattatcccgtccaaacaggatatcgtcgtgtaacattttcctaaattattcatgacaatatagtgtccgggtgtactgttgatggttgaaagcttgaggctaggagtgtctctaccctcttgcgagagggacaactaatctttttatgatttttaaggattgtcgagagatgaatgcagtgcttgaagcaaaagccagaacgaatttatgcttgtttcttaattaatttaaacaagtgatctggatgctgatccaactcagaatttacaattcatctctgtttatgcatccatagttgttctagctagtagtggcatctcgtatatgccaatattgaatatcacacgatagctggtcaaaacatggattggaatttattttataaacatataggagtaatataaacaagcatgccgttggtttgtcatagtactgtccaaatattgtactacacagtacaaatttaagacacctgctaaagggaatcaatcatttcatccattcaacactgtcaccagatctgagatctcttctttcgcatggcacctcaatgcaaatcaaaatcaatatccttgtctccatatggtggcaggagaacaggtatagcttgtgtactcagccttcctcttttgtccaggcttaattcaatcattatatgtacatatctttgtccacactattttccaatgaatgaatgaaacgatccaaacaaattaattgacccaacaattcatgtcagtgtcactgaccatcttagctagcaggaccgtgcgttttgctatgcgcctatgccatgatataaaaataaaactttaaatgattcaatcgacactttttagataaaagagatttcaccaagcaaataaaaatattaggtttctacaacaaagtgtaccactacttaaaaaaaaaggaacgtacatgtcggcactatagatgccagaagtgctaaaaccgacacttataaaccttttcccacctgcacgggttgaaataaccaaaaaccgagagaaaataagtatcagttctaaagaaaaaccacctataatttattataggtgccagtttataaaaccggcacccatcttaagcggagccgagccgagccgagccacacctaccacacttaaatttgccttatctatctactgagcggccgagcccatctc

SEQ ID NO: 26902 - DNA, 849 bp, Oryza sativa
  unsure (1)..(849): unsure at all n locations
cgcgaacttgannccctttgatatcgaccctgatatggcgaattcgagctcggtaccccttctctctcatccccatttgatgcaaataatcattttttattcaggcttacccctattaaatgttcatgacacaccagtgaaacccccattgtgactggccttaggctgagtttttcgcacgcaccttaaggtgaggttgttattgcaactcgttaaaggtgtatgatattattggttacgacagctgatctgatacagataagttttttacattattgatcattcatgaatgactagacccttcactatcacaaatgacggtttaagtacgacatagatgacatgttccgcaccagcatgatattgaattagcatgttataatatttcaaaaattcaaaaacatggattttatcatcgtttccttagtaggaatattccaaatatatatttttctgttttttctgacttttctatatatgacaaatatgaagcatttggaatcctctcactggccccatctacaatactccctccgtttcgaaatgtttgatactgttgactttttagcacatgtttgaccgttcgtcttattcaaaaacttttgtaaaatatgtaaaattatatgcctacataaaaatatatttaacaatgaatcaaatgataggaaaagaattaataattacttaaattttttgaataagacgaacggttaaacatatactaaaaagtcaatggcgtcaaacattttgaaacggatggagtattttactaaattcgcattttacttcttatcaagatctccctgccatcgatgggaatcatactacagcaggcgcttgacctcacta

SEQ ID NO: 26903 - DNA, 1501 bp, Oryza sativa
ccgcatccggcggcgccgtcggccgtcgtcgtcgtcgccgccgcgcgccgctcctccttcttgtacctgatcccgcacgcgttgcacagcgactgcagagaaacgtacgacggcggcaatgtcagcgacacgacgtacgtcggcgaaaccgcgaagtgaactgcagagatagagaacagcgacggcgagagcgagcgtcgccggcgacgaaccttgggtccgcgagggccgttcctccagagcggcgtggacgcggtgccgcagttggcgcagcggcggtcgaggagcgcgtcgtgcccggcgccggcggcgcacttggcggcgccggtggccggcctcccctgctggccacaatagtacgactcggcagtcgcgtcccaggacacggtcgccgctgacagcgacggataatgcgccggcacgggcgcccatggtttgccgctggcgccgccgccgcgacgggctcggcgcggcgagacgacggcgtgccgagcgagagcgtgcagtcgacggagccggtggaggacgacgaaggcgaggaaggagaggtggtgacggtgctgtggtcgtcgtaggccgcggactcctccaccgtcgacggcggccaacactgcccattggacatcgggaagaagagcgagaaggtggaggaagccatgtcgccggggctaccagctgcagcgacgtcctgatgatggccggcgccgccgctgtagtaatggtgaagcatggctcctatcaactgatgaactgaactggctattcacaacactctaccagttggactagaagagcagctagcataggttatataggatatggctgagataatctgaggcgatcccgcccgtaatttttcaccctatcatatcaaacgtttaaacacatatataaagtattaaatataggctaaaaacatctattacacatataacgactaaatttacgagacaaaatttttaatcctaattactccatgatttaataatttatgagtaacagattaattagacttaataaatttgtttcgtggtttattaatcaattctgtaattaattttttattagtatctgaacataatatccgatatccaatgcactgtaacacgttaaaatttcaagctcctgaatcaaaacacctcctgagattgcaacgagatgctggttaagctaggctatgatgatggaacgaatataggggtggaaagggcgtgtgtgcacgagaacagatgcgaaggcatgcaaaggggtggagtacagcgagtagccaatgagtgagcggctggtgcgaagcgctgtgtgtgacagggcggcaggttcaggctgaggctcgactagatggactgactggtcgaggcagaccgctgcgatatcaccccgtctctgccatctgcgacgccgcacttatcccggagctctactatagctagcgcacaccatccacgcccgaagacacggagaaagagagagacgtaggagtgtactcgtactacaacgtacg

SEQ ID NO: 26904 - DNA, 669 bp, Oryza sativa
cagcccgagattacaaccgacgacacggacgagacaacaccaacaacggtagcagcagcggaaacaacggactaacatctaacaccacaggcgacggctgggaactaggacgaaaccctaatctttgcttcaacttcatattcagagctagcagaactatatttatatagagagcaagggtgagtacttacgtattcagcaagccaggggaacttaggtggttaatgcaagcttcaagggtaggctgttatttttcaatcagttttatttgcaagttttcaacaatctaagtgtgtgctttccacaaccagagcgagacaggtctcagctcggtcgggggtgggaagtgaacaatattatttatcaagattgcacaactcccaaagttggcctcaaagctagtttcccaaaccaaaccaattttccaaactttcagagttttggttgtctccaaacaaccagtcacttttagggactccctgtcccgctgtctccctgatagccacttgcctttccaaacatcaggtttcccaaaccacatcactttttcataaaacagggggaaaataaaaactacgctaaggaatcacctcacatccgcccatgaccgtgggcacggccgttcgaacagtttgttaacctctgcagagggggtacactttacccaca

SEQ ID NO: 26905 - DNA, 1297 bp, Oryza sativa
cgcccggcgtcccgctcgcgcgccttcctgcttcacaaattcgccgccgacgcaggagacctccagtctagatggctctcgcctactccttcttccgccaggaggtgagatgattcgatactttgctagttcctcctgcaatttgcgcgtctaatgaggattccgtgatgtagtaatttatgtgaggttattagctcgctttcattgggctggggagggattgtccttgaagccctattttagtattcatccacagtagaaatctctgaattttttgttccagtagggtttccccccggatttgggacatttttcccctagttgttggttaagcaaccaattccccattctttacccagtttatccagcacaattttacaatttttagttttaccagcgactttttagcatactgtgtatggacatgtgattgtgtttaactgaatgaatttctctatcatctctggaggatatacagtgtgcagggccaacagtgtttatttggtgctaatgcattcctttgaggttgtaacaacacgtgcccttttggcagtccaactaaaaaacttggaagttggagagtgtattataaacattttgattttcttcaacttttctaaacatgatgtcttatgcaattcaccttaccctccaatgccctgatccatgttacacttatgtatctgccaatcatttacattctggagcaaaaatagttttactgatccagtaagaattttcatttcacgtctttattcttgctataagaatcaagcatctgttttactgttctttatcttcttgagaaaagacagtggttttaattccatgaaacgaaggtccatgtgtagtccttttttactttctctttgaaaaaaatatggaattaatatctgttcatatagcttcttgttgagttttattatgtcttttgttcacttgcatcaaccaagcatgattggagcatcattgtaggttgaaaacatgcaagtttctcagttttgtttgaatttgtgtcctaaaacctcatggtttgattgaatttgacccgagtatgtgtattggtgctctattacatatatcatctttccatcgtttataccacgttaaatttcttgtacacagaaataaatggtttaaacctatttatttccttctgttcagattacagaggaaactatttctttttgttagctgaaaaatttgctcttgcagatgtatgaagaagcagtcacactttatgctgaacttgcagaggctgcgcttacaagctctttgatctcgaaggagcctccag

SEQ ID NO: 26906 - DNA, 726 bp, Oryza sativa
ttctcaacaatttttgcagtgttccaactagtagtagatgatgctgtgatagaattgtgagtgagaatcattaattgtgctccagttgataacttgatatactagtacgtaccatctatctccagatgaagcaaatcacaaagacacaacctgatcaagcataattgagatggaaaccaaacaaggtagcgcctatagaaactttcgctggttttttggtggaaacactttcaaatgaaatagcaacatttgctgaatcacagctgatcacatccatcaagactgtaaacttcactgaagaaaaccatataaacagcaacaaattcttgatctcgggttgcttcaccaccacatcacagctttggcttttcttgggagggagggaaaaaaaattattttcttgaatgggtcaagtaaccatttccaactttccttggactctagcctacttcagtaaccttttcaacttttggggatatattcccgttgtggttggttccccgggccttccggtccacttctattcgccatttcggtggtacaacccttccaccatattatctgtggccttgtgattggatccaggtggcggggttcgccttttccgcccctataaaacgctcctcgcgttccccctgtctccccacagcgatctcttcgaacgaacacacagggtagcgctcgcgtagtcgcgtactccccggcatgctcctcacacagacgcga

SEQ ID NO: 26907 - DNA, 1501 bp, Oryza sativa
tttgaataaatatttttatagaaacaataagtcaaagttatgttttggagaccgtgtcgctttccaaaatgattttctttacgagcaaggagagagtacttccattagagtaggtacaatagcaggctataagctagctataaccacatatcgagaagaaaagagaagagagagaagaaagcgggctacagatttatagccagctgcagcacggactccaaaacgttatgtgcgtatgagaggtaggactgagtattaatggtgtagtatatttttatagttaactattgtatgaatgagctactccctccgtttctaaatgtttgacaccgttaactttttagcccatgtttgaccattcgttttattcaaaaatttacgaaatatataaaactatatgtatacatgaaagtatatttaacaataaatcaaatgatagaaaaaaaataattacttaatttttttaataagacgaatggtcgaacatgtttaaaaaagtcaacggcgtcaaatatttagaaacggatggagtattagattagctatagatgatttgaagtcagtagttggctatactattaaacttgctcttagatgtcagtttaaagtagatcaaggtaagctaccctgctcaatgaccaccgcctaggtttggtccatcagttgttacattgtacttccttcattctaaaagaaaatcaagctatgaaataatctggattacattcattgtaagggggtcacattccgttattttgtgttttttacggaaggagcagcagcagaggcaagcaccacacggttgatgtatggtgagtttgtctattcgtgtcgtgtactcgtgtggactgcggagccaccggaccatttcattcgtgcgcgcgcgtcctccaacccaaaacccagccattccggaaagagttgggccttttgagagcacgaccatcggcagcccacatcccacagttagagtaagggtaacagtacagctgacctattggctattgttagccttcttttagtctattcatatactctctcagtttcaaaatgtttgacaccgttgacttacatgtttgaccgttcgtcttatttaaaattttttatgaaatatataaaactatatgtgtacatgaaagtatatttaacaatgaatcaaatgatatgaaaagaataaataattacttaaattttttgaataagacgaatggtcaaacacgtactaaaaagtcaacggtgtcaaatattttgaaatgaagggagtaatagttagagcatcaccaatagtccacctatctgattcccaaaactaattttgagatattttagtctaaaaaacagctccaacagatcccttactctcctgccaaagttttggaactcccttctcccgattcctcgctcggcttatgtaggggagagttttctcgcgaatatcgctcccaatctcgcactcccgcctctctcctctcgttcccgcgcgaaggcgaaatgctcccgc

SEQ ID NO: 26908 - DNA, 1501 bp, Oryza sativa
aaaaaaatctgaaaatttcgtttaacagttgcttgcattccatttaatttttcattgttatgtgattttgcaacatccatacaagagtacttagactcaacaccttacagaacggctcacttcaccagtaacttaggctcacaaccatgcacccacagcattaaggatacttgcaacaaaagctcataaaagagacacaaagcattaaaagttcgagtaacagaatggtcaattggtttgcctcaatttttgaaatttcggatttaccagttggtcccagcagaaaatgtctctggcccaaaattgcaagtctatttatttagcgaaaagttgttcagtttgaaaaaaaaaatctgaaaatttgtttttgcggttgcttgcattccgtttatttttttcgttctgaaatgtaaaaaccctggtttactagacatagatgaacgtgatagttactaaccattactccagtatacagtcactaaattattcagataacactattaccatgcattatactagacattctatgagtagctggcaggatcatattcttccacaaggttttgtagaaatgccggtattgggggcaacacgacatctcgagtgccctgcaagatatgaactatctgctgcattgttggtctatgagcctcgttgtcctgaatgcaccaacatgcaaccttgcatgctctctccagctcttgaacattcgtgtcatgcattctatgatcaaatacttcagaaatgtcaccattgcttatcctgactgcagcccagacaggaaagtactttatagttttactctccatcaattctgtgttccttttgcctgaaattatctcaaacaacatcattccatagctgtagacatctgcttttgacgtgatgggaagacctgcgatccattccggtgcaagatatcctattgttcctctcatagttgttagtgcccgactaaaattccgatccataagcttagcaagaccgaaatctgccacttttgggctgaagtccgcatcaacaagtacattttctggttttatatcacaatgtatgatgcattcatggcattcctcatggagataatgtaatccttttgcaacacctagaataacttggaatcttgtgtaccagtccaacaccttcacattattaaaaaggtgacaatctagagaaccatttgttggcaacttttttgacaagtcgacgagcacgatcgcaacacctaaacgccttgcggtgatatggagtcgccaaccacctcgatctagccaaagggccaaattaagatgggtttcggagaaaaacaactaaggccctctttgtttaggcttataagccaacttataagtcgaaaagtctaagccaaaacaaacaagcagctttttcatttggcttttttaagccataagccactctaacactattaagccaaaagctaggttggagaagctttttttggcttatatgagatagatgtatgactctaccattaaactta

SEQ ID NO: 26909 - DNA, 1501 bp, Oryza sativa
ttgcataaaatctgctgtgcatcatgctgtagtttcgatttcagttttacatctttcttaatattgtttttcatgtgattatgcatctgtagtcatcagtcagtacaccggcacaggctagtatttttattgtgattttggaacatcattatttatatttatgaatattttaatttgatatattgagaaaactctatctaaacaacaagaaaattccttgccagcacttttttaaatcttctgagaatacagtacacttatatttttcctctttgccaacgaagttattactttgggtgtggatacttttgtaatttgttgcagcatgatgcttatatttagtatggaagtttagtttttaaactctggaaattaaaacctaataaatcttttttttcatggttacttacagcctaagaacatttttaagacaagattagtatgtaagctagctacatattcctctaggtatgctttagttgtatgccttaattcatactgattgggcagatagtgtaaatcaacttgattagaacatgggaatcgaaaataaatctaattattctgtgtatatttatatgttcagaccttgtatacatagagttactatgaactgaactttgatttgtttttccaggccatgtgcgcccaggaaacagattcatggatgccttctggttcttatcttcatattgtgtgcaatgcatggaacgcatgcttctgagttttgactattactttaaaaactactactactctgatacttattatctattgcatgtagggtgtagatgaaaacattaaatcaaatttgacggtcatggtttccttttttaaagattaatgtgctcatgtttagccatttttttattattgtgtgaatttatttattttagaatttttaagattaatgtgagggcttcttattagtataaacaaagcttcagccgggattcttctactggcctgccaaaaaactattttgtaaatttacaggataacaatggtgtaattactcagatgatggcatttggcccttaagaatttgaaaaatatttaaccagtgcagatgttaaagaaaatatagctactccctccgtcctaaaatataagcattttttgaaccttgacatggtctccgagatactactttgaccaacaatatctataaaaataagatgttttaaataaaaagagttgcatattatgattgtttgtttaataataaatctagtaacatcaattttatatgattgctcttttttaattttttttttgctattagtggtcaaagttaaaaatgtttgacttgtcactgtgctaaaaatgcttatattttgggacggagggagtatttattctcaagtagctcaagattaccaaatttaatctattcagattgttatgtgcaagcagatcataacacctgaattgaagcacatgttgggactctatcaaatgttaacatgtgcagtcaggcctcctcataggttaaacataa

SEQ ID NO: 26910 - DNA, 1501 bp, Oryza sativa
ctactaaccgatgtatttcgcgtgaaaactttttatatagaaattacttttaaaaatcaaatatttttttaatatgtaataattaaaactcaattaaccacgtactcatagctttatttcgttttacatgttctaactttaccgacatcttatattaattagaaacaaacaccaccttatttcagtgacatggttggtggttaccagagtccagactccagaatggatggcgaagtgataggaagctcggacaaagtcatgagaactgacaattaatttaccgttaaaaaaaaatgtcgtcagcttattcagctcgcgggtcaaccgtgccatatctgcaccaatccaagaacaagaagacgcctcaaacattggagctataaaaaaaaatgctaacctcgcgtcacaacttgtgggggtgggttagtacgacgttgtcgtcatctattatctactccggcttagccgccgcgagtcacctcgccaacactgcatccatgcacctgaacctcatcgccaccgtccatgtctccaccaacggccgccgatcttcgccggtctccatgcgccagcgcccctccggtccatgtgcttttcgtcacacgcgacgcctaaaaagaaaatgttatctccgtttttaagagaagaaacatgttttatcattcgtttttatttaaatttttttctacataattattatttataaacatttaaagatggttttatatcttacgtattggtttaaatgttttaaataagacgtataattaaacgtgtgtaaagccagcaacatcatgtattatatgtaaaatggaagagtataaacggagtcgcaactcgcaaggccggcaaggcaagcaaaagctgctgacacagcactcctatctgctcaaccacttgcttggcttcctctgctccggcgaccgggcggccggccggccggcggcgagaggtagcgccaggtgatccatccatccatccatccatctcctccccccttcttgtgatcaaccgttaatcagccgccatggcccatgggtttgagttgatgatcgatggagctagcttcccagattcttgcagacttttgtgttctcgcctctgcctccttaacatagatgatggctgggcagtggtatcaagtagctcaagtttgtgatgaattctgtgtgagatgctgaaatgattatagcaagttctagctatgcagaaattgtattgactctccatatttatgggaaattttttgctgtggcatgcacgttgactttttcgtcatgtactgtactgcatgaacttgatgtccttgcacaaagaaaacgcctctttgaaatatgctagctgggttatgttgattttgttttttaaaaaaattatgcctagttgaattgggatcttgagagatgtattcaccttctgctttcaggggcacagggctgcaattggaacctgaacttgaaagcaagttgtgcaagaggacagaaaagaatcagtctgaata

SEQ ID NO: 26911 - DNA, 1501 bp, Oryza sativa
attagcaactttcgtgttgatctcttacgattcgatatgtgatttctgacaagttaacaactttcgtgttgatctcttcttttacaggcacgattacttctctgatgagaagagtgctactgcgtcgctggaaggatgataggaagaagaagaaattgttgtcatggaatggaacactaatttcattatcagtcgaccagcacagtgttcactgtgaatgtgtccgcttccatgataacaaattaacaatcccatgtgtgtgtatgatcattatgaattgggctatgggtatgaaatgtttttataccctttggtatacagatagtaagcgagtctgaacttaactgaaacggacttggtttgagttcagctcgaagtacactcgaattaaacttaactcgaacggccttaactgaaacgagagagctcccttcctctgtgccatacaatatgtttgcaatttcggtttgaaattcccgaaatttcatttcggacttccggcacgaaactatttcgcctgaaattatattttctttctgaatttggtcaaattttattcaagttcggctaaaatttcttcaaatttcaaaaaaaaaaaactattcaaccgagaaaaaaagctcctggaagaaggaccaacagggagaggcacaaaagcggtgaaccagagcacgtaacttactccacaaatacctaaccaatgttccattcttcctctcatcttgattttataacttttagacctaacaaacattattcattaaccaacgctgcgtgttgctttgccctctgaaactactggaacggcaaatagcagcaattgcctccttcttcttcttttttttccccctcctaacaacacggggaaaatgcaaacgctttgcccggaaaactcatcataactgatagcggagagctgcgaatatatgccatcgcgttagctttttccaccggagttgtttttttctgactcctctcgcggcgaaagacgatgccatctgatttcagtcgctgcaggccttcctgccaagtagtagcttttgttgcgtttttcctatcaaacggcagtaaattaagtaaaaggctggtaattattaattaacgtgaggcggcaagactttgttgtgcaaaagcaaagcggcagaatgttaactttgggtaagtttcgaagtaaaatcgtgggggcatcgatctacagggagctggaataaaagaccatggaaatgatggaaaagttggaaggcagcagcacatgatcagatgatctgtttgaaattgagaagcaggtgttccccgatttccacccatgatctgtgtacagtacgtatgcgcaagttccgttaatttctcacgcatcagttacagcctcatcttttcgcttatacttatatacttatcaaccaaaagttaaattttcaatcttaaatttagacttgattttgagattttttttcatcgaagtttatttttcagcttttacttttatatcgctaagaacacg

SEQ ID NO: 26912 - DNA, 1501 bp, Oryza sativa
cggtcgctgtcaccggctcgtcattgtcgccctgagccgccgtcgccggctcaccgccctcgtcatcgaggccctaagctgtcaccgccgccatcgtggccctgaggagccgccgccgccgtcgccctgcgaggttacgacgccatctcgcgccgccgctccctgccgtcgcctgcccgcgccgccactgcgctgtctcttgcttgggtcgccgctgtcgttgctaatccgtgccgtcatcgctagcctgcgccgccgccgccgccatagggattagaataggagaggggagtggggaataccggaataggagaggggattggaataggttagggtttctattagttgagtatatatatgtccatagttagtgggccaaatgggccaaataaatggatataaggaataagagataggccaaaattaggtcatatatatgtatgagtcgggtatggactatccgcggacaaaaaacaatacccaattattgcccacgatgttctcgggtttcggacgggcgtgcccaccgacaaaatattacacccatgtccataccaatcgggctgggtatccgtggatatctggactcgcgggcaaaattgccatctctaattcaaacaagggcaagatatgtgtgaaccaaatagactttttttttacttggtcagtgactcagtcccatggagcaaaggttagctttgagtcaagagtgtgttcggatgccccttttctcaacccctctgcctcgttttctgcgcgtacatttttcaaaccgctaaacaatgcgtttttggtttttttgcgaaaaaattctatacgaaagttgtttaaaaaaatcaaattaattctttttttaaaaaaattagctaatacttaattaatcacgcgctaataaacctctctatttttcgtgcgttactgttccggttgggatatgagatagcgaacacaaagcctttttactccacaaaccaaaccaaccaccctccctgggactgggatccataagtcctaaaccgaatttcctattgcgcgcgtctgcgccagcgaacgaagtcgcgcgcggttccggcccagcccactacacgattgcgcagtgtcgcagtgcaggaaggtcagtaggtggggacacgcacacgttcacatgcgcagataagattggattagcgtaatcaggttttgactaatcacgatctgaattatggtgaccattctttttttcttttcgcataaaggttgttttctttttattactacaaatttcaaaaacttatacataatatttaaattttcaaataaaatttaaaaccttctaaaaaaagtcatatccaaaatttaaaacttttaacttgaaagttgaaaattttcaacttaaaatttaaatgctttcttctcaaaatttgaaactctccactcaaaattggaaaacttccaacataaaattcaaaattttcatctcaaaatcaaaaactttcatattgaaattcaaaactttcaactc

SEQ ID NO: 26913 - DNA, 1501 bp, Oryza sativa
cgggtgaggcgccgcagaacccgaggagcgacggcggatggagcgcgcgcgcgcggcggaggaaggcccggtcggtgacgacgcggcggaaggaggcgcaggacgcgcaggcgcggccgaggtcggcgagggacgggaggcggatcaggacctccgccaggaggtcgtcggggagggcgtcgagctgacggtgcgccggcggcgaggccatcgcgacgctaaggctagctagtagctacccaccggcggccgggttaattaggtttccgaggaacggcggggattgtggtgtggacgtttgggtccttcactccttccttccgctttattatccccacgaggccacgttctccacgaaaatagtcgaaacgttgcgttgcgttgcgttgcgccttgcgcggcggaggacacgagcgatctccacgaaaatagtcgacgaaacgtttgtgttgctcggtggcggcggcggcggcagcgcacgttcttaagagcgagtataacagtaggctataaatcggctaaatgatgacgtggagaagagaagagaggagagagaggggaagcgggttgtaaacttacagccagcttggatactagaactaagaaactctgtgagagagacaagtggaacatgtattaattgtaaagagctaagagtatcaccaacagtcctcctataatctccccccaaaaatttgtttttaggtttcctaaactgaaaataggaagtaaaaaaactcctccctccaacagatagcctaaatttaatccccgaaaactaaaagtgggtccttctgttgaactaccaacagaaattttcgtttttcccctcccacgcgcgcacagaaagagatcactatctcagtatctcccacacgcaatagccggccgattctccactgcgcgctccctgccgctacgccgccggccgatctctccacgcgcgccgtgctcatcgccgatccctacaccatccctgccatctccccctcctctatatcccccactggtgctgcccatctctcccttgatctactcgcttggccgcctctccctacacaccctcgtcgtgttaaagaaagagatgagtcctccaggcagtctcgttaagatgctattggatgatgagtcttcgtcggatgacgacgatgaatttatttttgaggcggtcgaaacaattttcgatgataacaatgaagaaccaaagcgaggagggtctgtctttggacatgcagtgattaatcgggagagattggctggtcattggagactatacaatgactatttctcagaagagcctacataccttcatgttcaatttagacgcaggtgggtaatagtgaattgtatttttttttaatcttgatttgaattagtgatgcatgtattaattttaattgctaattatttttcaggtttagaatgaaaaggacgctctttttacgcataatgaatgctgttgaagcgcatgatgattattttgttcagaagagaaatgcgg

SEQ ID NO: 26914 - DNA, 1501 bp, Oryza sativa
tttgatgatatgcatatcatgatatcgaacaccgattggccttcctgttttgttgaacgccgcaagtactatgtattcaaggatctttgttaccaagcttttgcccttggaaatgcgctggtgcttcgttggtttttcactgtggctgcactggagcaagtgttcggacgagctggtaacctattgctccaggtgcacagtgcgctacttaagtagcggcagagtataaaatcatactcctacagtttgaagtagaccaagctgcccatatttagtccagtgcgttgcagtttacggcttcatattgtcgcttatgcttatacttatcagctaaaattttaattttcaacattaaatttaaagctaattatagggttttttcattgaagcctattttttagcctttgcttttagattattaagaatacgtatataaaagttttattacaaattacttttcgtttacaaatatgctgtctagcttgttccttgaataagcgaaacaatggagccgttacttgtagtagcgtagtagcagccatacaggagtccaagttcgcccgcgaaccgcggggcagcgggcgaagcggaggcctctggctcccgccgtggcggcgtcccaatgtcccacccacgtagccgtgcatgtggatgactcgtgttgcgccttgtgtggtcacacggttgcaagagtctacattttaacatgttttttttaaaagaattgctgcagtttgaatttgtgaagacatctcataagagcaaggataattggcagagttcttatcctagtttttccaactcacttatctcgttttccgcgcacacgttttttattccgctgtggcggcgtcccaatgtcccacccacgtagccatgcatgtggatgactcgtgttgcgccttgtgcggtcacccggttgcgagagtctacacttgtaacatgtttttttttaaagaattgctgcagtttgtatttgtgaggacatctcataagagcaatgacaattggttgagttcttatcctaggggtgtttagatggggctaaaactttttagcccatgtcacatcggatgtttggatgctaatttggagtattaaatatagactaataaaaaaactaatttcataaatgagagctaatccgcgagacgaattttttaagcctaattaatctataattataaaaagtttactgtagcatcacattgtcaaaatcatgacataattagactcaaaagattcgtcttgtgaattagtccaatgaattagtccaaggatatggaatgtgttttgtaattagtgtatgtttaatactccaaattagtatccaaacatccgatgtgacatggacttggaataagtccctggaaaccaaacaggcccctagtttttccaattcacgtctctcgtttttcgcgcgcacgcttttcaaactgctaaacaattaatatttttgtaaaaatactatatgaaagttgttttaaaaaaatgtattaat

SEQ ID NO: 26915 - DNA, 1501 bp, Oryza sativa
atggtgcaagttatacgcagcaccaaaaacctctgtgtactctctcactttgcaatttcgttctcgcatgtgtttcttgctcaatagttttggttacagctaacaagtattcttgcaaattaaaatcctaaagcaaatcatggccaattaattatcctttttcaatgtcatcgttagattccagaaggtgcgtattgagtctgccttcgatcgcttggcagaagacgtacaatcagtgcatcgatacagcggatatgggtttttatccctaaatagtcacctaactagtaatcttgacatccctcatttctttgtcactaatatttatcctcctctgcaggttggtttacatgttgatcacgctgatgcaaagatggagaatccttttcaaagaagaaaagacaatcttcatttgaatttgctctataacaaatagatgcagaaggccaagcaacttcgtatggtgggaaggctgcctgatgatttgggactgttgtagtggtcgtgctatatgtttcatgttttgttggcgttgttggtgaccagctgtttgtcgttcaggagttttcagctgtcatcccagctagggagcaatctagcttttgggtgcgctctaaagtggcgagttggatgggctgacatgggctaggggagtcgttactgtagcagaattttgtgttgggcttaaagtatactataaaagtccacgtgggttataacgccgttgtgagcatgacgtttacgtcagaccttcgtcaccgcgtcatcttctccttctagcgctctctcgtgatcccatcgcaaggagcagctcaccccattgtccaccggtttttcccctttccacacgtcgcgtaagagtgcatactaccgactggcgattgtcgaggcagaggaggagagcgtcagcgtgccgtgcggagctgaattcgttgctcgttgtcatcagtggcgtgcagccgggcgatgacgcgggtgacatcaatgactcgtgagcagcccctcggagaccgcatcctgtggaaaggggcgtggtgtgcgcagttgccggcagcgattccaacatccattgctgcagcctggcagcgattcctgctgcatttttgcagccttgtgagctgatttgatcgatctctgcactgatctcgtgtagtacagtaggtagaaggcaaattttactacaggacactgctaatgtgtagttttagccctaggacactgcccaaactcacttttgggggaaaacactccataaacgtggtaatttgctagtggacaccgcgccgattaaaataattaatttccggttgaagaggagagagaaatcgcgtgaaatgacaaaaatgcccttggacccacatgtcagctctcttatctccactctctatcccctttccagcgtctacagagcgccagcccgacgccgagacgctgcagctgcgatagaccgcggcggtcactggtgacacgcgcacgagcagcattagcacggcatcgtagg

SEQ ID NO: 26916 - DNA, 1501 bp, Oryza sativa
gagaaaagagagtaatatacggttcctatgctttagtccactgctcaagtagacaatcttgcattaataattggttcaggtaaacaccaaacaatataaaaatttataaatgcagtggtagactagatctttctgggatggcatgatttcttcctaggacgtctagtttatccccacaatacacgttgaaccggatataaatcgatcggttaggacttgggtggttcataaattacctcccccaacagcctaggcgctgaagatagcgagcataaataaagaaaagcggaaaatagagtagcgtcaacctcccagaggcgagtgggccacctttaatagtactccaccgagagggaccaccaccaccaccacaaggcagcgagcagcagcagccccactctccacatctcacgtcacaccggacgaatcaatcaccacccccgcaccaggcaacaaaaaccgaacagggaaaaagaaagggaaaagagccaaaagatttccaccgtaaacgatgaccattattgaagccgaggaaaaaagagagagagaaagcgataggccagagtgggggccatagccatccatccgttgggttgcttgctgctgcttgcctcccccacgtccaaaataaaacgaggcagacagcttttgtcccctcgcaggccaccccacctcccaacgtgtcttccatccacgcctcaccgccgtataaatataaccctccctccccctaacccatctgcctccacgactccatccgttttccatttccactcctccccccacccaactcaccatcgccattccttccctccttccaccgctccctctctcttccatggccgtgcaggcgcagtacctctcccacgcctccttcccccacgacctctatggcctcaggtaaacgcttcgttcgatcgatcgacacctcggttggttttgatcgatggcgtggtctgatattggtgtggcctgtgcagggctctggagggtgcgacggcggcgggttctttgttcttggacgaccacggcgggtgcgcgccggcgactccggcggcggccgcggctgggatagggcacacggtgctgagcgaccttccccggagcgagcttacctgcaacgacaataacggcgcgggatacggattcgtgccgaggaagagggcgcgcctggatgcggatgagtcggccggggcgttgatggcggcggcggcggcgcagcagcagcgcatggttcttccgccccatggccttgtctttcccggggatgtgcagagcagggcggtgggttgcggcgccgcgtccaccagcgggagggctggcaatgccgccggcctctcgcaggggctcctgtctcagctctatcatcagggtgtcgagatcgacgcgctcgtgcgactcgaggtacggccttgttcgagattttgatcgagcgttcgatcggttcgccgtgatgcgcgggtgtctgactcgatcgacgtctatgttggctatgcagagc

SEQ ID NO: 26917 - DNA, 754 bp, Oryza sativa
aatccatttgatatgggattatatggtggaaaacacaggttacaaaggaaagatggaacttgtcgaatccggcgagattaaagtcgagttgattcgactagctcttgacgacgtggcccctcgcaggctccggcttcgtagcctgtgtgggttgtgttggctctgagattcgatcctctatgccctccccggggggtcccttttatatcgcaggtctggtggtctccgagtaggactcgaacacaccagacccagctcaatacgtaggtaacccagttcttatccgagaaggactcttcccgtctattgatttcgtgaaaggtttccttagatcataaaggaaatatccgcgtacgcgtgggtatgccatgttgatacgtaacgtatatcgaagggtagagggtatgcctgacccgtaaccctgacaacgattgagatttagtcatcgacgagtgagagccgcattgtcacaccctgaagttctcctcccaaacctaaattgaatttataaatggtcccaagaaaatatcggtgtaaaagcaagagtaaaccctaataaaccaatgcaaataataatcggaattggcatgtggaatttttcttgagttctacatgtcgaaatttactaacaagatttttagtggaattttcagagccctagaaataattttaaccaattaaaattgagcacatgcaatttttaatcccaggaaaaaccctttcttccttttctttttcttttccctcctttttc

SEQ ID NO: 26918 - DNA, 1501 bp, Oryza sativa
gtgtcttcttaatagcaacttggttctttatagtatattgatctattgctttcctaagctctacaacatctgcaaacattatgctaaccttaaactcaggtgtctccatgtctacattagccctaaaactcttaaaactgaacttgattttttcttcttcttcttcagaaatatctggcatcatcaacctttcatcttcagatgaaacatagtctgaaccctcctctttattatgcgctaactcaattttcccttcaacacaattatcaaacaagtcatcatccccatgatcaatctcataatcactatcaacaaaatttggatcttcagttcttgactcctcttcatcatcaattttagcgtcggtagcacgtttatctacaatcaactccccaccatcactcttagccctaattattttacttggtttcacaacagtacgcaaagaatctgaaccaataattgccacatcatataagtcaatagcgtcaactatgtcttgatgatctgcatacaaaacaaatgatcggaccctaggtacaagagcgaccatactattagtgtctgcatcacacttaacccttctcaacccatcacttaattgtttgccaggaagcaaccaataaattttggtgttatcagatttctcatatcctagttcttcaatgaaatcatcaacccacaacagtgaccaagaatctgactcacaatggtcaaaccagtttactctaccatcaacataagcccggtttacaccatttcccataaaaaagcctccgtggtgcatctcaatgctgaattcttcatcttcgtaatctacatatgttgtgtacagataattattcatcgtcagaacagtttactttaggttcagatgtttaagggtatatccatgtttaagggtatatccaggaagaaagcatagttaacaacagaaactagcagtacattaatgatcaaattgctctccaaaaatacaaatttgtcgtgatcacttctataccataaatgtcaacaaaaattacagcttttgtgtaccatgaactagctcctggcataaattaaaacaactaatagtccttcttgtttgcaatacctaataaatcgacaataagaggaagaaatctctacaaaaattggaattgagaaagacaatctcatttttgacctgataaactaaagtactcactgtatacatgagatcgtgcaccttcacttcgcagccctggcaccatgttgcctcagcgccggcggcaacgtcctgccaccgctgccctaaacgtggccggtgtgttgtctcccagaaaagccctaccgcctggatccaattcgcagccttccaccttgatccaaatatcaatctcctgatttatctccttttgttgctaactcaattggaggtaggctatcgtgaaactgatctctagcatgggcatcatcgtgggctacaacacaaaagaagattcggaggaattgaaagatgtatgaggggttatttgca

SEQ ID NO: 26919 - DNA, 282 bp, Oryza sativa
cggcgtcgataggcagaggcgacttcgggacgttcaagccgagcgatctacaccggtcagaccggcagaataggcgcggtcagaccggccgatcaacttcggtcagaccgatttcatcgattttgagggtaacttttatttgcgctaaaagttttcggtttttgggtatatcaaccattcacccccccctctggttggcttagttcttgtgattcgatcctacaagtggtatcagagccttgttttcttctttggattttaaccgatctagagtttttgcca

SEQ ID NO: 26920 - DNA, 1501 bp, Oryza sativa
caaggtaatgcgatttggttaaaccatactgtattgtacgcttaattactaaggggaactaaagtcatctattatattattaacacagccttgaaaagaggcaccacattcgttgtgggagctagaaattcccacattaatcggagaaaaagaaaaagaaaaaggaaagaaaaatgagagtccaagtagaagtacaatttaaaaatagttgaaattcggaattaaaaataaacaatattaaaagaagtttccatataagaacccaatacgagattaatcaaaattcgaaataaaaataaaataaaatccaaaattagaaaaggaaaggagagtccaagtagaaatacaatttaaaaatagctgaaattcggaattaaaataaggaatattaaaataagtttcaatataagaacccaatacgagattaataaaaaatcgaaataaaaataaaataaaatccaaaattagaaaaggaaatgagagtccaagtaggaatacaatttaaaaatatctgaaattcggaattaaaaataagaaatattaaaagaataatccatatcagaacccaatacgagattaattaaaattcggaataaaaataaataaatctgaaattagcaaaagaaaataaaagaagagttcaagaaagaatacaatttaaaattagcaaaaattcggaattaaaaataagcaatattgaaagaacaattgtcacgccccgaactagccccgaacagaactagcccgtgacgctccaaattaacctgttaaccgataccagtcccaggaaacagtgctggtatcacaggaagacagattatcacagcaacataggtctctttattacagagtaggagtacagtcatgttgagctgcggacagatctcgagctcacaactgcattacaaaagggaacaacggaagccaagacttggaccaatcatcacaggcacgacttgggaactagaccgaaaccctaaaactcatcatagccgacttgctcctggaagaactcctcatcagcggcatccacttcatcttcttcagcaactgggggggagtattatttatatagagcaagggtgagtacaggagtactcagcaagccatgggaattaagtgtttaatgtaggtttcaaaggaaaggctgttgttttttcaattgattttatttaaacttctttttggaacatctaagtgagtgcttctcaaacgacacggataagacagtgcgtctcgtccggtcggagtatgtgtaatgtatcagtctttgaattgatcaaggttggcacccggccaacagctttcaaatggccacccgggcctagctgatcccatcagccacattttccaaacatcgatcccattccacaacagcaatttcacaaagtagtagtcaaacaaaactacgctaggaatcacctcacatctgcccatgaccgtgggcacggctgttcgaacagtttaataacctctgcagagggggtacactttacccaca

SEQ ID NO: 26921 - DNA, 177 bp, Oryza sativa
gaaggagggatgtatattagacttgggccgagcgaagggaatgggctgagcaagcaagaagcggcccatcggctgggagaggatcattagacttttgctgagagttatttgaaggaatttgagaggcacttgaggtgggatttgaattccaatcgtatatctgaactcaaggatata

SEQ ID NO: 26922 - DNA, 426 bp, Oryza sativa
tagtggtaggcccacggcgcccaagactgtcattgcaagatggtctaactactgcgggctgtcggcacgtaagaactttgggatcctccataaagatatcggcacggtcacaaaatcctagaaagagcgagcttggacagctccggagaaatggttcacatttccggctgaagcaaaggataggctcaagtggaaggcattccataagatgggtaaagcttggaagaattagaagtcgaagctcttctccgagtttgtcaacccgcccggcaatcatatgtcgttcgatgaataccctcaaataaccgagtcggtgtgggaggaattttgctctctcaaaaacacccaagagtttagggaatcaagcgagacacatcgccaactgcaacaacgaaatgagcacccacatcggttgggcaccgcagg

SEQ ID NO: 26923 - DNA, 1501 bp, Oryza sativa
caaggagatgatattctctggatcaatttcaagggaatctacgaagtataccagctggatgccctcgacgtctctattatgagttgctggattttgtaagtatatcgttcagttatatttcttaattactacgtctcctttaattaattaggtccttgtatataagtaaactatataaaataaaatactcctttttatcgttgtagaatggagattcaaagggcccgacgacggagggttttcgatactggattcatcgaccctcggagagtaaacgtcgcaatgctcgaccaatatccacaagaaacagaggaaaatctcgtccatctcctgaaggcgcagcattacaagacgttcatactgttgccgtacaacacagagttagtttaattttactgtcttcctacataccaaattttattcccgtacgaacttgctaagtgtttcatatgtaatgcatcccacgcacattgcagattccactgggtgcttttactcttcgacctgtcggcctgcaccgtcaacgtatatgactcaatggataaaaagagtctacgtttgacaaggttttcgaacttatagacaggtactggcataagttcctctgttaattaagaaattattgttatgttaattatttctactacgaatcatatctttaaactccttgtagggcttggtatcggttccgtcatttggtccgcggcaactggagagaaagacttaggcggaggttcaaatttcctgtgagtacacatgctctacatttatatttctccgattcaaattaatacatacaagtgtatattaattagatctcacgccgttaatttgtcatttatttgtagtgcgcaaagcaaaagcagggaactaacttgtgcggctactacgtgtgcgagtattgccactgccttgcagaccaaatcatcaccacaagagagctcgatgtacgtacaaataaattcaaaatttcattacgtaacgatttcttgtttaattactaatcaatttcatacattcatatagtttattcgcatgagggataacctgaccacacacaaggaatttatcgcggcggttcaagaacaactcatgggattcatcaacgaagaaatccttgatcccaagagtgaattctactacgatggaaacacaattcaccggtccttagcttctgagctagcagtgagtactactactacgtcgaaatcgtagctagctaggacatataatggattgtaattaatacatgactacatatgtttctatatgcatgtgtacacattttctataatgtaaatatattttggtcatatatatatatatatatatatatatatatatatatatatatatatatatatatatatatgtatgcatatatatgtattgaaacatatatatgcatggtttatgtatatatataaaccatgcagcaacagggccatgcaaaaaaaaaaggtcagctcaacttttagtcccggttggtgttaccaaccgg

SEQ ID NO: 26924 - DNA, 424 bp, Oryza sativa
catgtatatttttatgaaaatatttttcaagataaatatattcatataatttttacattttcaaacttaacaacttaagagttattcatgatttatactcctaaggtttgacttaaacattgtcctaaacgacttcctttacgagtatgaagagagtacgtagtaggaatatgtagctaggtaggacgaatttctagtggagtaggagtatcaacgtgaggcagctgaaaaatcacctgagctaatcttgaaaatccctgacaaagccatctaaatggttgatttaggaaaaacatacctccggtcgctccttgttgggtggcgacgcaaccctctatgccgttgtcccccactctcgatcccctccccatcccaccacctacgacgatccaaccctatattaacctgcgtctggagggaaaca

SEQ ID NO: 26925 - DNA, 390 bp, Oryza sativa
ctattgtgcttgatgagaaggatcacactattgagattctaaatgctgaaattgatagattaaaatcttcaatttctgatgatgataattgttaatcttgtgaagttttattttctgaaattaatgctttgcgagatgccaattctgttaattgcaaaaaattggaattttagattgaaaaatctaaaacgttggaatcttcttttgcgattggatttgctttacatgctcgtgttgttgatgagttgattttgacaaagaacgttttgaaaaaatacaaagttgctttttgtgcaagttctttggtcaatgcttcatgtgtgaataaagcaaaacaaaacaatggtgttttgatttctcaagattgttcaaagtgtgttttgaatgaga

SEQ ID NO: 26926 - DNA, 376 bp, Oryza sativa
ctccctccgtttcgaaatgtttaacaccattgactttttatcatatgtttgaccgttcgtcttattcaaaaaatttaagtaattattaatttttttcctatcatttgattcattgttaaatatatttctatgtaggcatataattttacatatctcacaaaagtttttgaataagacgaacggtcaaacatgtgctaaaaagtcaacggtgtcaaacatttcgaaacggagggagtaggaagcaaatatgtaaaataaacatttgagaccaccgattgtttatgcgtgcaagtatgtcagtataatagaataacaaaatagagatattgtttctcatgtcatttgatagtttagtcctctttgaatagtgtaacaa

SEQ ID NO: 26927 - DNA, 196 bp, Oryza sativa
atataatgattagtgtgtgacacactataaaagttaataattaggcttttaggcgtataattagagctgaaaaaagtttttaccccttcccatttcgaatacacaagttcaaagtccttggcccgcgcccctggctacatcgtagaccgtgctgaccatgtttgccaataagaagataacatgcatgtccatgaga

SEQ ID NO: 26928 - DNA, 796 bp, Oryza sativa
ttcggcccatcgaccccgggggaggcaaaatagactttgcggaggaatttgatttggaaggatttggattcggaattgaactcgacgatagatcggggatttgagatcttgagatagcacgggcactagacaacaagcaaagaaacaaatttcgcaattagggtttttaagagataattttcccgctaggcgccacgacggaacgggcgctacaatgtatcacttttcaataaatatttttatagaaacaatcaatcaaagttgtgttttgaagaccgtgtcgttatcctaaatgacttcctttatgagtacggagggattattctgtacttacccacgctaccactgcatgtacagtactgtacctgatgaaaatcagagagaaaatagcgcagatgaattactggttgttggtcaaatcatgaaaagacggtgatgaccgcgtcgttatgcctagcataaaacctgggtcgcaaaaccaaataataaatcatgaagaacaagttaatgcagggtcgaactaccgaatcaaattcaatcaaaacaatactgaccgaattaatgaccagcatcgcgccatcgcctccttggctcctcgctgaacgaagccttgaccgttaaggttttttcacctaaaaaaaaaaaaaccctctcctgctgtcatgcatggctgcatatatacaggctcgctgctcttcagctaaacactcccgcgcgcgcagccaaagattcagaaccggcaaaacctgtagcagtagcactgtgcaagtcttccacaacacaaagcctgttccat

SEQ ID NO: 26929 - DNA, 245 bp, Oryza sativa
acgggtatatgggcccatcaggactatgatttcatgatgtgcgctcacaaccgggagtatgaggcctgtaccctatgcgtataccattattgaagttaaggttcttagtactaatgctacataaccactgcgcaggcgacattggattctcctagtcattgtacctaagtggagtagggttacctaccttaactccaataagtccaaagattatgatttcactgaaatcaccaagggcttaaata

SEQ ID NO: 26930 - DNA, 1501 bp, Oryza sativa
aatctttgcaagcaagctgctttaacaaattatgtatacttggattgctagctttaacaagctattttaactacatgttcattacacaacgattcatattcgagagtaacaacatcattttgataaggttttgcatggtttgttgccagtggtagaaaccatgtgtactaattaccaaagttctggagagaaaggaaccagacggcaacagtgcaacagtcaaaatgatctgcaaagaaagtcaatgatgtactgttgctagcaataatcaacaatagaaaaatgatctgcatgttggtgacttgtccaaatcaacaatagctcctagcctttctttattaactaggaatatattatttactactggtgttgacaactaatcaattgcaataagtaacgtgttaggttagtgtggacatagaaaaaaaatacttagttttaaaacacatatcacaattatttatttttgttgatagcattgcatgtggacatactctgctaatatgcttcttgctccatttactttaacaagttttggtgaacttaagtcattgtgccctgcagcctgtcttgtttcaaaatataatattggcaagggggtgacaaaccaggttgtcagggttctcaggccttatcaggaatcatagttgccacacacacacacacagagacatacagaaagtgttgcaacatgtgcctcaacaatttccttgttccagcaatccagggtcgctttacctcccctgcctgaacactctatgctgcaggtcaacgcaagctcactcaaagtgcttcaacacctccagccatctccattttcaggtactggcgttcgatctaaatgtgtttccaggacttgcattggtatctgcaatttataagacctctaaatttgttctgtagatcaggccacaagcatagacgatggggacaattttagtgtgtttgtcatccaaatgtttagaaaagctggttgggatactgcgggaggaatttgtgaagacattatttgtgagaagagatatcaggaggctccgtgaatctctgaagtactttgattctgttcgtgaagatgccgatgctttggccttggaaaatagagtgacaggaacatggtggagtgatgtgaaggatgttatgtatgatgttgacgacattgtagattttttgagagctcactcgtacaagcagcgatgttgtgatcgtgtcctgttctctaggctggcacaacttccacttgattacaggattgccagaagaatcaaatatgtaaatgaaaggcttgtgcaaatcacaatgaacagcaagatgtttgttccactggcaatgaggagtcctcaaactctccaaagaaacggtgttagtaggtatgtggctgctttggttgatgaacttgatgttgtcggaagagaaatcaaggaaactactgatgatatggttcaaatgatcattggatgtggccatcagagcaccatatcagtttacgggatcctagggatgg

SEQ ID NO: 26931 - DNA, 1501 bp, Oryza sativa
tatgctagacgaagaagaaggtgaagtagcaggaccaacagtatggaatgacaacctcggtagccgaagtaggggcggctgaaccactggcctagagtggcaacggtagcagcctggagatgcggcggcgaggctcgaagtaaatgaagaagaccctgagcggctgatgatgaccagtgcggacaacgaggttgtcaatgcgcgaacggtgatgaatatgacaaaagcagcgaagctgtggtccaaagggacaacacagttgcagctcttatgtcgatgcagcagcatgaactccactggcggtgaggccatgctgaggagggcgcctctcagcattccaatagccaatggaggtggaccacgggcgatggcactgcagcctgagggggggatgcagcggcaacctgaagcttgatagcgtagatgcgtgcttgatgacaatcggttgcagaagtcattgtagccgagcacttgaataggtgatcaagccgaacatgcgcggggcaggacgacatagaggaagccagagccgatgccgatgtcggagacgcgtagatatcgacgaggcggtggacgacacaaacccggtctctgatcgggagaaaaaaaaggtatatgcaacagcagtaccacagcaatcaacacggtagcaacctcctcacaatctgcactatagcagcctccccacacagttgatccagccaaccattggttaaaatccccaacttgccaccccttctctctactcgtgccgactgttgaggggtcaaagagaaaagagagcagggaggtggcgtggaggagagcaaaggtgttaacacaaaaatttggtaagccccgaagtcatcatcggcctagagtcagtatcggtttcagagtcctggaatcagccaatgggcactatcagtcgccagtagtcggattcttgatgggttcagttaaggaaattaatcaattaagggaagtttatccagaagagaccgagttcaaggaggatgtggcttggaagtttatctattaattaggaagagtctgttagtttccttttatctttagaaaagtgtgtttagtgtttgataaggactttatgttttccttttaacattaggaaacaaattctcttgtccaataagaactagtatctacccatgtgtataaatatgtacacccggggtcattgtaatttatctctcgatcaataaaaatactcttggcgcatcgccaccctcttttccgaggtttttacttatcaccagcgaaacttggcacctgatgcggggttgcatcagctttcgatctccggtgaagaggtaagtcctacgttccaccggccttggcaattgtatccactacattggtgttgttcaaggctacatcgctttgacctcttggatcgctctggttcggttgatatatttgcctacctacctatcacatattttagttaatctagtttgacagctcaatttacttgtatcggctgggatctgctttagggttt

SEQ ID NO: 26932 - DNA, 1501 bp, Oryza sativa
cgggggctaccacacatgcacatatattccttatattcctttttcctttatttcagcatttcaataaaagaagtttcaatttcctaaaggttgtgtctgtgccgtttttccttctgaagaatcttaacttgaaataaggtcactcgtgctcaaccttgccctcgggggctcggttcggtcagctaaaatcgccaaacggggcccagaaccgagccgtgccccggggcgtggtgaactccgggggggaaccggcaaaaacccacaatcgggtcacccatacccctcggtcaccacgttcccggcctggccagtctcgacatgcggatctccccaggcactagccccgacccgagccattcgaggaccgggacttgggcacgagcccttatttcaagctaaggcgcaaaaggaccacggcacagatcatcctcaactcacatgcatagcaaaataaagttaacatagaaaatttttcatcatttttgattgcagattaagttgatctatacacaaaagaggcatgaaggccttagaagaaagaaaaaaaaaaaaaagttaagattggcgggggcctgggggctcattcaaatgcacccgggtcgctggcctcgtcgccaccgtcgtcctcgccgctggcgtcgccctcctcgtcggagctgggggcgaacgcgagccgaggggccgagccctcgaagctgttgacgatgtggtcggcagcattcccgacccgcgcgcgcgcgttgtcctcggtcccgggagggaactcctccagcgccatccatggagagaagttggggtcccgggcctggtaactcgccagcacgagttcgaccgccccccgggcgaggtccctcgaggatgacttaatggtcttctcaagctcctcggggagtcgttcgagaacccaggccatcctgttgaggtgcggagcgaggccttccagattgctagggcgcgtcctcgtctggcctttccaaaggcccgcttgccgaccggcgcgatccatgcgggagaccgagtcccaaagcatgtcgggccccatctcgcccgccaagcggagggcctcggcctccccgatggaagaatccagcgcgcgctgctcaagtgatgtggcagtcttgaatagaccgcccattatggacaaccaaagttaccaataccaatgtgcatggattgggaccgttggggattttgcccaactatggagaccggtcccacctgtcaccaggctttaggggtggcgttacgccagaccgcttcccttgggaagggaaattgctctggcacaacgccgggggctactgtcggtgatatgggaccgggagtatcatgaccagaggcttgaggcagacgcaatcgcccacgtggcctggcaccttcggggacgtcgggcccgaggatgaggtgtccgccctcctcctgatttcccccgagggggggggtcgggttgcgcttgccccggccccgagggccgaggcaccccgaccccttaaggaaatct

SEQ ID NO: 26933 - DNA, 1501 bp, Oryza sativa
caagagtgcaagaccatgactaattcagacattcagtgactataaactatcgattcaccggttgcttagttgttcttctagctgctgttgctcgccgcctaatctgctagctgctcggctgtcagcgtcggcagtctcgttgcccagtcgcctggtaccttgcgcccttgcctgctctgcctccatatgctgctcgccggctcgccaccgcggcgcccggctgctgttccatgactgcgcccgcctccgcttattcgctatcgccggctcgccgaagcacctcgttgctggcttgctgcttcacccaaccgcccagccacccagccgcgagtccccaaccctaatctatagagagagatgcgtgcgtgaggtcgcggccgcaccaggatcgcacgacgatgacgccctggatggatgagtgggggcaacgtctttcggcgaggcaccgcagtggcgatggggaggagagcacggaggaggcgcgttggatgccgggagtggcggagggagcggcggagagagggatcgagccatcgagggcgagagatcgcggtggttgtgaggaacgaggagaggtcgacgactcggggggtggggaggggatgcatgtgtctgcgcctacagcacccattttgaagcgttggatatctggatccaatgggtacaatggcgcgtggctgtcaccactacaaaattttaaagtagtagagattaccggcaaggatcggtatcgctacttgagtttgcgagaccactcgctctcacgaactgcggtctcgtgtttttattgtgcaagatcgtaatatcaacggtatatctgtgcaaataaaattacaacccgaatatttatgagagaaaaaaataaacggtatatttttaatttttttcctttttttctgtatgcttgtagttgtagctagcaaccctcttggtagtacagatggtttacaaaaccaaacgggtttttttagaaaaccgggagctccattagttggtctaataagccaatgcaaaagttaaaatttaaagttttaaacttgattttgaagttgattttaagatatttttaactaattttcttagctttggattttgaattgcttcgaaaagtatataaaagttttaccaataaattaatttttattccctaataagctaaaaatatgggcaaccgatgaggctcgggacttcctgggtcggctagctctgaaccacaatccgcttggttttccagttaagttcaaaaggaaattcaaactggataattgttgataaagtttcctttatccttgtttgatgaaaacaaaacaacgaacacacagaaaatagggaaaccctgtattttattaatcatgattcattaacatgaatgtttacaaatatatgagggctcccgcaggagttcgccttttgccttcgtgaggaatgcttaatagaaaggtatgctgactggaaattgcgtgtagtccgctgattcccggtgcatagcaatgaggctacc

SEQ ID NO: 26934 - DNA, 1355 bp, Oryza sativa
ggacgagctgggacccaggtcgggttgccagttcggtccaaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacctaacccctattattatccccttgtaccccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacccaaggacatattttataaataaaaattatttgcgaaagttcctttttctccttcccctaatgctatttgcaaaaggtttactccgttcttccttcttcggattttcaactagtactagatggtcaggtcagtgaagaagaggacatcgtcagttgtttgccgaagctccagaagactgcaggatctgctagtgaagtggaggaagcagtgaagccagctgtgaagatcttggagaacctgtcgcagaacctaagccaccctctagggtagagtcgttagtcgtgtgtttccttgtttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaaccaattgcttatagagatactacagcagcatcggatgccaattttgaacccgagtcagatgcaacctcaagtgcagttggaggcagtccaagcactcacaccacaagtcagcgcaccgccaacatcccaga

SEQ ID NO: 26935 - DNA, 1501 bp, Oryza sativa
gaactaaaaatgttttagttaaccaaattattccttttattcaacttaaacaggaagtagcatgttctgaacctatcactcaaaagtcatgaacatataaaacactatatgcctaaaacatgttgtaacttgtaaaatctataagaaaatcattataactccaaaaattgtgaaaccaaatgtgttagtcttagaaaacacaacttcacactcctatgaagtctaatctagtaaaaatcactttacaaaagtatttcataacactacctaagactatactactataaaccgataaaacttctaaaattcataactcccaaatggaataaaataaaataggaattatttcacctaaattcattttagatcagtaccaacccactgtgcataaatcatgcattttagagcattttggattttcagctctttcggtgtttaattgcatatcgtgtcctttatctagataattgcataatcggtgaagaagtggattaggtgctaacaattctctgatcaaggcaagttttctcctcccatcctttgaacacattgaatcccatgatttgaggaatgaaaatatttgtttgcaaagttgcatgtgaacttagactatatcggtatttgaaattgggttaaggtagttatgacttatttgctgcatattccaccttgaataattgatcctcttgctgtttgaacccctagaaatggttagagtacactctttgtgctcaaatgggtttatatatgctctatgtgcaactacttgctcagccatgcttagaaatatgcaaatgctcattccatctataattaaaatgtgaatttttatacatgaacccttgctggaataaaatgaatatgatgggtatttacgaactaaaatgtgtaaaatgtgattttatacttgggcggcaagtggtgtgcatatggtattagttgcataccgataggggaagtgtttgcccaagtccataaggaccgaacttgtgtcacccatttaaagttatccgtacatccacatgtgctagtatgggatggcctaagctgattaatctatttaggactagccttgcattctggtaggccggtgtgtatgagttagtcgataattctgaggaattagtcgatgattcagaggaacttcctatttgccccgacgtggtagtttaggtgactaagtctgtccaatacaacggtattgtgccacgtggtgggttcccgtcgtgtccgccaccacggcgttaagtttaaggcgtgggcccgccacttaacggttctaggtatattccaagtatgcctaggatggaggaacacgtatcgtgctggtgcaaggctagattctaagtagtgtaaaggcttcgttatgacctctagatcacattcaacatgaagagtgtgatggagtcttgcaaactcaaaacaaactagagagttcatatcatgtgggtaaagctgtacaaactctgcagagttctttaaactaatcgattagccgtgc

SEQ ID NO: 26936 - DNA, 1501 bp, Oryza sativa
attccccaccttccgatcactccagctttttagggcacaaccaaccgacttgagcttggagtcaagcctggaaatgggatcgatgatggtacacgattccgaccaagattgctgcaccacatcagagaatccattcaatttgcaccaaaaattttcgaagtgaaatctccccttcgacggatgggccggcaaggttgaaaggagtagagggcaatgatccgagatcaaggaaggcagagccttgaggaagcattgagggaagagtttttcccagtcggcttcaagtcactccagggttgggttctcccacccattcgaccaggtaaaagcacgtccattcaggtggagcttgtggagagctagatcgttgatagtccgacggaaacgactcatcatccgatggttgaggttggcgttgtttttgtccctatcttggtagattagattaaaatcgccaacaactacccatggcccattacgcatacttctgatatcgcacagctcctgaaggaatagcaccttgtccgcatcggactggggaccgtagacgaccgtaatccaacaggaggacccattgtaaaaggatcctccttagttctttgattgctgctgctatctcccaagatctctgcaaggtttctcaataagaaggaatgttttgatatcttgtacctcagtgttatgccaatttccccttcaatgcttgtgagcctctgcagcaccttcaacgatgacattaacagaaccttctgttgtgcttcggaatttaccattgcacttttgaagcttgtgaatccaatgattttggggatcaggtcagttactctgtctatttccacgcagttattttgatcacaaccagcaaggctataaatgattgacatgcctagtgcagggaggagatcattgtctgtcaatggctgctcctttggaatcgaccagtacgccggtatcctctaccaaattctaggtatgtatctttggtcgttgatgtgcattgatcgggttggtgtttccagcaggttattgatgtttctctaaaaaagggttaaataattatatttatcttgaactatatatttttaaagaagccagtgtatttcttaactactttaaaagacaatcattttccttttttcgtcaaaaaccgctccctctcataaaaaaacatcatagaaaaccactcttccttgagaaaacagtccttaaaaaaatctcatgatcccaatataaaatacgtaagtagttttatataaaaatgatcaagtatgtccgtttgaaatgttggagtcttcatccgttactttgcattcccaaatttcaaccggcccaaatatggagtatatttcttttctacggaaaaaaaaaccgatttagcccatctatatctattatccatcacaaaaactacctaacggcatcatgtggtggtgcgacggtcacgggacaaacttaatgtgcccgaaccgttaccatctcacccccatcagctctctcatga

SEQ ID NO: 26937 - DNA, 374 bp, Oryza sativa
ttcctgcagcccattattaaaacaggcgagaactagtgatgcttgcgatgcatatatctgttagaataataatattccacagttttagatatactaaccttttgcagagaatgacaataaagtagaggagaatcgacatcaacacagacgataaatcaatcggacgatgtcgagaaccagacttgtgtatgatgggccaagaacgcagacttgacacgatgaatcaggccaaaattcacaagtctacgaagtgaagcaacagaggaggccgctagccgaaattgggctggattgggccagccccaggttcggccgaacctccctcgcctccgttggatccaggttttggatggacggtggagatgaagccgcaa

SEQ ID NO: 26938 - DNA, 1050 bp, Oryza sativa
tcctgcaccccgatgagttttaggagcagagaagagtttttgagaaaagcatgtttttggttcaattggaaatttctttcttttaaaaagggggagaagttttcttttggatttttgagcatgatgtgtacgtttgtacgaagtgtgttttttaccgcttttgtttttaattttccaaactccaaaacatttttaatgggtttgccaatgtgttcatcaagggggagattgtaagatcaacgtgtgttttgattcttattctgtgatgaacaattggcatatgtgattatcggttttgatatttggagattatcgtcgaagtggttttggagataatcagttttcaggagatgaaaagagtttactggtttgtcgggaccggtcagactgggcggttgttgccggttagaccggtgctatgtgagcggtcagaccggccggcccgtggtctgatcggccgacgctgtgtcggtttcggtttcggattgtttgtttggatattcgtgattgtttcatggttatggcttctagatggatactatacgtatgtaatactgttgtttgctaacaatgagtgaagttggagatagcttggtctcggaatatggtttctttctttgtttcatgtgtaggtgactcgatgcctcgggagagtatttgcggtgatggaccgggagtcggcttagtggtaagacgatgtccgtggtggtcagatatcatgcgggatactaagggtagagttgatgcacgtggttggtgaagattccatatggcatacgatggaggtattgtgtgcgtatgggggatgcggagtcgaatttggaaggagtccaaatttggtacgattggttatgtaaagtttctttcttgtactagagggttttctaaggtgtttaggactcttagtatgagtttggttcgtggctttaggctgcctacctcatgtataaatagaggggaagcgtgaggcttcccagtatcgcttttgagagcaattgagttaagttttaagttagggtttcgagtttagtcaaaatttttgtaaggagt

SEQ ID NO: 26939 - DNA, 215 bp, Oryza sativa
tatgctccctgcaatctaaacactacagattgaaattttctgaccgttagaaatgttcaattgcacatcatgcgagcaactgatttgtttgcaatgtgcatgtgtcgccatttatgaacagactaaattctgacgcggttgttctctttgaccataaatctgttctgtgaacaagaaatatgaattggttgatgagctcattaaatctctgtaga

SEQ ID NO: 26940 - DNA, 873 bp, Oryza sativa
atgcaatatatgttacttcgcgtttatcctaatacatctttttgtatcctgcagaaaagacgttgtcgaagtcgtccctcaagccggagtggtagctagccctcgaaggaattcgcgcaggcaagtgacgtaattatatatatgattgttatatttgtaatgcaattaagactattggatttaatatacgtcacctagacttagcatttatcactatttgagttttagtataagattattagatttgtaattagacttagcatataagattgtgtagggttctaatatacgacagttacacttagcacacatgactatttgagttttagtctaagattatttgagttttaatataagattatcatgcatgtaattagacttagtatataattattgactagctagggtcctataatatacgtcacctatacttagcatttatcactatttgagttttagtataagattattagatttgtaattagacttagcatataagattgtgtagggttctaatatacgacagttacacttagcacacatgactatttgagttttagtctaagattatttgagttttaatataagattattatatttgtaattagacttagtatataattattgactagctagggtcctataatatacgtcacctagacttagcatttatcactatttgagttttagtataagattatttgagttttaatataagattattagatttgtaattagacttactatataatttattgactagctagggtcctataatatacgtcacctagacttagcatatgattgttagcatataagattgttaaaacataaatgtctcatgacttagcagatgtttcctgtatgaacaga

SEQ ID NO: 26941 - DNA, 606 bp, Oryza sativa
gttagaggatcttttttgtagatatatgcttcacatcctcacccttcagtggacacaggtcctggtattgcttgtgcaggtgtgctggctgctagcttcctattttacacaagcctaaaagctaacaatgcagatcaatggtcattgaacactaacgttatccttggcttctccgtagatactaatattagccacttctgtgtgcaaaccaaccagtttttagaacactgcaatttggaaagtgatgaaagatggatcattctggtcctgcaaggaaccaaagaaagtcacctttacaggctgaagccagtgtttcaccataaaccataatgctgccaacatcacggggtaagaaagtttttgactttcaacaaagtgcatttttcaactgtgtcaccccaagggtccaagggtaaatttaatccattagtaaaaacttttgccatttgttatttatgcaaccacaaaacagccattttatggacttccctaaggtggcggtgggggccaaaaacctttggtcagacctccaaaagttcaagatgcttttttccccccaaggcatcagagtttcaggtgcatttctagatagcaaacttacaattc

SEQ ID NO: 26942 - DNA, 1501 bp, Oryza sativa
tataccccacatgccaggatgccatgtcatcaccctctcccttcctcttcctttcccttcctcctctccctctcacttctttgcgcaggctggccagcgggtggggaggaggtcggtggccatcaggaagatgaaatagaaagagcaaatcaaagaaacgagaaaaaggaagagcagcccgcaggctgtcctggccgccgacaagcagcacgccacgccatctcaggcgccgcgctgcgctgccattgcacacggtcgctgccgggtagcccatgccgtaaccgccaccctagacttgcatggccatgctgatgccgccctcctccgtcggaaaatgccgtacgttgcacagccactccaccccgcgccagggtcgccgcaccggctgcaagcgctgatctggcaactccgttggagggaaagaacaaaaaaagaataggagaggaagaagaaaaagaaaaaaaaaaggagcagcaccggatggccgcgccgctggacgagccgccgtcttccaccatgccgttgtgcaccccaggcaccgggttcccctccttgctgtgacaaccgtgggccgctcgtcctgcgcctcgcatgcgctggagaagctgcgcctgtcccttgtccaacattccgccaccatcgccgccgcatcgcccgtcgtcggccgctgacttcctcctcctctccggcctcaccacgccggcttcctccccgcctgtcggccagcctgcgcagagaagtgagagagagagaaagaggaggaggaagggaaaggagggcaaagagagagggtgatgatgtggcatgctgacatgtggggccatgctgactcagccgccatgtcggataaaactgggttcaaaaccaccgaaggatctaaaatgaacggttttgtaagttgagcgatgtcatatatctgattttgctgatggggacgattttgtaactcgatgactagtagagagaccttgggattatttttccaaaaacaaaaaaataaataaggagtggtttcgggcggagaaaagcttggaccaattgaacattgccatatcatagtttttaaggatttatgttaggaaaaggtgttcgaagggaaagggaacgggtctgaatttgatacatctgatttttggatggagctttgcatgcaatgtatggatgagttaatatttttgttggcaccagaatcaaaatgtatgttcaatatccaaaatctgaatttgaagtctcattcaactgtgcttttagcaacggtgtttgatagcaataattcagccatcattgaccctgtgacattaatttgatactgcgcaaagcatgtgcatcccctggtcatgcagtaagttcatgtaacaacaggtggttgtggacaccttccagttttgaactatactgccaagtgcatcacccttcaatttataaaggggtaaatgtaggtacctaaaacctatgtggacgatttattcgtacgtggatgatttgttgtgaacgatgaacc

SEQ ID NO: 26943 - DNA, 342 bp, Oryza sativa
tgtgaatttcatagtttcattagctactaaacatgatttagtttggtacgttttggtttggttttcaacaaacattgtttaggaattttaaattttgtactttctcagtgtttgtcttatttgtctttatctttgttagtttttaaaattttgttcataatctcagtttcgtcaaaatttcagtttgcagtatttttgttcatggcaagaaacacttatgcggtactttttgtcacgaaaccctagcgatgcactcaggcacgagccacttgcccttaaggagatgcggttacaatttctattgtgaaagtttcttctcatgcccttgaggatatgcactca

SEQ ID NO: 26944 - DNA, 673 bp, Oryza sativa
ttgagcaagaatgagtacaaccacagtactcagcaagccacaccggcagatgcatgattaatgcaagggggtacaaggggtaataatataggggttaagttttgcagaaaacagcatttaaaagtcacttagttgcccaaagccattttataaagacgatcctagagttacacagtgttattaatcaagggcgtgaaccctcacgaacctgccttaacccaaggcctacgatgattcagaccgaactggcaacccgaccctgggtcccagctcgtcccaagccaacccaggccaaccattccacattttagttgttaagcaaattttaagaattaaaacactaacttgggtacattgctaggcttgcccataaccgagggcgcggctattcgaataggttatactctgatcagaggtgtacatctttacccacaagacacatcttcctcacgtgtaaccacgtgccacataccaccacggtatacggacggaagacgtgacatagtttccaacccatcctagccataaacaagagtaccgacccaaccccacctacgggcggaaccttcgggacaggcaggcaggattgagcccctagcagcaggacaccagccctgtgccatgacatctcgactaccgggccgcagctcgtgtagccttcatttgtcctaga

SEQ ID NO: 26945 - DNA, 188 bp, Oryza sativa
tggggctaggaaaagtgtacgactcaacgactgaccaaagtcgtgaactgagaaaacattcttcccgattatatccagagtaaaagatttcatcaggatagatttcttttctatttcgcaaaatctttcttaccaactttacacaagtccaaacccatatacattttttctaagatatctatcacagg

SEQ ID NO: 26946 - DNA, 1501 bp, Oryza sativa
ccacatcagagatccagttagaatcactatattcctccagtactgcaggatacccagtatagtgaagccccaattccatagtacctttcagatagcgcattactcgctcaagcgcacgccagtgatcatctcccgggttagaggtaaaccggctcaacttgctcacagcaaaggagatatcaggcctagttgcactagccaggtacataagcgagctaatgatttgggagtattccaattgattcctagcaattctcttgttcttacgaagcaacaagctaggatcataaattgttagctggataaattaatactatcatatcgttaggtttggcaacttgttgatgttcatattgttatttactcgaacccttcgtcttgaaattttgcaactttaacgttcaaattttattataaatatacccacttctccagctgctttcttaattatttctgctatatacaaccatctctcattcaattcctctatttacttcctataatctcgactaatcatagtcctttccatttaatttcatccctcttcttactcgatcccagtgaaaaactcaaaaaatgcttatattttatgatggaagaagtattaattagagaaattacaataagaacttgatgatacggataagagtagaatagaggagagagaccatgctttactctatctattgccatatcatctttaatctatgtagcatatctatataatagttagctacatattcatactacatcaatacttcctctgtcccaaaatataaaagattttagagggatgcgacacatctagaactattttggaccaaaggcgtcacgtcaagcttttacttgaaagcataggagttcgacttcctccaaaatcctctattttataagacggtgggagtagtaattagtcctacagctaactctctccacaaagccttatagagcgttactgttgactacatatttgtaacccgttttctttcgctctccttttctctttcttttaacttagaaaaaatgtgaggtggcaactcctataacccacttacaacatctttttctacctacaatttttatataaacttcaagataaaattaaggagagagagaggaagagtagatggacgaataaattaacactgtggctgtgtattagagttaattactatatagagataacgtattgtatacactacctctaaatgttttagtagataacgtggacaaaattaaagattagcacccacaccggtttcttgcatggactttgaccccggctaatcgcacgtacatgcacctgcatatgcatgcatgtagttttttttttcggggaaaggaagatgtattactcatccacatccaaaacgtgcgggataaaattacagttatcgtccgaccaaaaggcagttaaagactcacacctaccttttatttgctaaaacatgacaaataacttgatcatggtcaagaaattaattatctattataattgaga

SEQ ID NO: 26947 - DNA, 258 bp, Oryza sativa
ccaagacggcgacgaccacgcagtgtgcgggagcagcaaggttggtgggtggtgcacaggcaatgccgaggctggtcagtggcagatccggtggtgggaggcacatgggcagtgggtccagcgataaagaggattgcgggcagcggatctggcggcgggaagggccgaggctggtgaacagcggatccgtctgtgggaggagagtggtgtgggcggtggcgaggttggtgggtagcagatctggctgcaggaggcgca

SEQ ID NO: 26948 - DNA, 480 bp, Oryza sativa
ctcttctgggatctttgcataagtaagccaagggtttattcaagaccgcggctctttggagcacctcacaagagagtaggattcatgtgatccgaacttcgggaaaaaaatcgtctttgtctctcttgtgcatgatctttgtgtgaatctgctgatattctgcaatcttcatcttgttcctctgtgtgcctaaacttctcttgctaggacctgtttttcatctctgttttaatttatctctgctgcccggaagttcctggctcaagaactccggaagttccaggctactcatcctgcccggaagttccggtgttcatcaccaggaggttccgggccctgtcaatttaaccgctacgattgttgagaaaatttcaggaaagcctattcaccccccctctaggctacatctctgatcattcaattggtatcagagcaaggtgctcttgattcaagcttcaccgctttgagtgatccacgatg

SEQ ID NO: 26949 - DNA, 164 bp, Oryza sativa
ccgaagtacgcgacggcgagcaggaagcagaggagaaagaggaggaggccgtggctgataaggccgcggacgaggcgatcgaagaccgtgtcgacacccccggctacactcctaccccaagtcccagtcacaacaagactggggtagagtcgaacagctcccct

SEQ ID NO: 26950 - DNA, 932 bp, Oryza sativa
cgtcctcctcccgtcggccgtgccggcgaggccgccttcggcgcgccctcgcggctgccaagtgggcccggccgtcagccgcccgcgcccggccgcgtgcacccggtccaccgtggaccgtggggctgacgcgtgggccccactcccgtggacccggtccgcgcgccccctccctcggctgacgcaataaatgggtttttaattaaaatttaaatgaagaaattcgtaaatatccatttaaagagcatataaacttcaaatggctttatcttggccatttgaactcggaattggaccgttcaagtctctaatttttccttaagaagtcaagaacccatttttgtgctttgttcctgcttgttgtatggagtttattagagtaaaagccttttcttttccgttggtcgtgtagacgctgcagcttcggaagatccgctcttcgtggaagttgaagccggtgtttgggaaagcgagcaaggcaagtcacatcatccttgaacatattgaatcccagtttgtaaaattatgttgatttaaattattgcattatcgctttatttaaattcccgcgttatcactgttttatttagccatgcctatttacctttgttatgacattattattgctattgttattattaccttgttcaccctagaataaacaaaaccccaactagtggacactctatttatggttccactagtatgaatttaggtagatgcttcgctgattaataggacaacattaggtggttttacaactttagactttgggaattctcatatcatttggacactatggaatggttggcttatgttggaattggacacacacctctcttcctctttcaaaacccctaaaacctgttttcggtggggtttgggtgcatgccagttgtgggaagtagcaccccggccactataaagattaa

SEQ ID NO: 26951 - DNA, 1501 bp, Oryza sativa
ttttttccttcgatgtgctcttctcttttcgctttccaactttcctcttttttccaaactcgttggttattcccatcactaagttgtgcacctctgtccctgttagctctgtcgggggtccggctgtatctctgtgtccattgaaattctttctcatattcctatacgggtgataccttgggagaaatctcctgtgacccatgtagaccgtcttgtgtgaatgcttcaaccatttgcttcttgtttcctccatacactccgaacacgcccatttccctttcacagtttggccagaaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgagcatggcaagcataatgtactttcttttgaaacacaaccagggaggaaggttatagttaacaagcagaactggccatgtactgtgacgactgctcaaatcaccaaaaggattaatgccgtccgtacacattgcgaaacgcatgtttcttgggtcatttgagaattcctggtaaatcctatcgattgtcctccactgcactgaatctgctgggtgcctcagcatagtatcgactttccgttcttcggcatgccagcgcacaagcttagcttgttccttgttcgcaaacattctcttcatgcgctccgcaattgggagataccacaccacctttgctgggcctcccctctttgacttacttccttcaccttcactctttgctcgtttgtatcttgatcccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttaagcttcatcatttccaacatgcatgacaacttgctgtgcttcgacttgcatccatcatacaacggcatctggcaatcttccaccaacttactaaacttctcataatctctgtcgttgtcctttgcgtcttcaatgtcatgcaacattgtagatagacattgagtgtccaaatctatggtctctccacctaaaggagaaggtacgaacatgccttctcgagctgcggcggtgttctctacatcctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacat

SEQ ID NO: 26952 - DNA, 1501 bp, Oryza sativa
cctcatagtcatgagagatcaacataactgatagctcatcctttaagccttccaaaaacttctcctgcctttcctcgtcagtacgcacatcttctggagcatagcgagctagacgattgaactcatgaagatattccgtcacggtacgatccttttgcttaagtgcccggaactcacgcttcttcaaagcaacaacacctgcaggtatgtgtgtcttcttgaatgcttccgtgaactccgcccaagtgattggttgtccttctgctttgttcatccggaaatgatcccaccattctgatgcaggtccttgcaactgatgtgaagcgaaaacaactttctcctgatccgtgcactggagcagttccaacttcttctcaatagtgtgcaaccaatcacctgcttccactgggttggtagtgctagaaaaggtaggtggcctcacacgaagaaaatcagttaacttgttctgcggcggtggagcattgttgttcccttggttgagctggttctgcatctgctgtatcatcatgttcattaactgagtctgttgagccagaacttgagcaagagttgggttcccttcattgttattgtttccacttccattagcacgagtgttcaccatctgttgcagattagagaagataggaggagaggggttacgctaaagttaagaccttaaccaggttaacactgatctgatgtgtgtagaccattatattgttcaagttgattaagcaagcaacctagtatagttacacactcatcattgaaccacaccaatgacgggaatgcaaccatacctacacacaagcaaacaacaaacgttctatcctactaactattcttcaaagacactttggcggcataggttctaaggtaggatccaaacttcattccatcttgaccacttggcccttcagatcgaccatcaccttcttatttatcgatccacttgacttaacctccataagttgaccacattggcgtcttcaagtttcaacaactagtttcagaaccacttaagttgaaagagagaggggagtagacaatgaaacaatttgcaaagaattctagataaggaagaaaggagaaattttcacaaatcatgttttcggaaaattagtccttaaggtttgaccatttggcttatcctacagtcgagatggctctgataccaacttgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaactggggtataagccaaacgtcttctccttcgagatcctttttcttcaactgaggttgattgattattgcaaggtgagcatatgacatactca

SEQ ID NO: 26953 - DNA, 1501 bp, Oryza sativa
acaagccagcgtgggcaacggctttatcttttgtatagcatggttcattgcggggcaccagactgagaagtggcggagataagcccacgggggtcgctggggagtccatgccttgttttataagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagcaatgtttttcgtgattagtcccacacctctcaccataattttagatgttataactggtaataatttgcttagctcctggtttggagttagatctgttcagccgggtatggttgttcagaatggttgggcctgtgcagcatgggtgtgctgttcagtgttggttaaaatttctgattaattactccactgttttacttcccttaaatgttttgctaaatgctgcttttgcaaatgagccgatattatgccatcctttggtatccttgtgcacttgcatatttgctgtgtggcttgctgagtatgtcatatgctcaccttgcaataatcaatcaacctcagttgaagaaaaaggatctcgaaggagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactcccctctctctttcaacttaagtggttctgaaactagttgttgaaacttgaagacgccaatgtggtcaacttatggaggttaagtcaagtggatcgataaataagaaggtgatggtcgatctgaagggccaagtggtcaagatggaatgaagtttggatcctaccttagaacctatgccgccaaagtgtctttgaagaatagttagtaggatagaacgtttgttgtttgcttgtgtgtaggtatggttgcattcccgtcattggtgtggttcaatgatgagtgtgtaactatactaggttgcttgcttaatcaacttgaacaatataatggtctacacacatcagatcagtgttaacctggttaaggtcttaactttagcgtaacccctctcctcctatcttctctaatctgcaacaga

SEQ ID NO: 26954 - DNA, 1501 bp, Oryza sativa
gcgagagagctcaaactctaaatattctctcccctttttctcaatctagctctcccctttttctcaatctagctctccccatccgaatccccctcatcagtgggcaaggtcctccttttatatctcaaggggataccacatgcaccacctctcttttttgtgtggggacttgcctctctttttaccaatttgacttcccttctcttcatgaatcgacggagatttgcatggttgccctccgaatcatcttctgatgggacggcccatatctacctccactttcgtcggaagtaggcgcgtcgtgggatcatggctgtctgctgatgacatgaccagtatcagtccggtcatgtcggtcattcttgtccaccacgcgtcagtttagcaatctgcatgtttgcccttcttcatacaacaccttgcttgtaatgtttgggatgaagcctagcatatgtctgaccgggaccaacgtgccatctccaggaggtaacacgccggctccggctagggacgagtgcttggatgcgctcatcctgacaggacggggcgaggcgtgtgtcagaccgcctgtcgccacctaacccacgatctggtctgcgactgatcacagaccggataaacgagcgcgctgcactgcgttacatgcggcgtgacgcgcttgtcctaatcgcaataaatgcggttaggtgagtcccgctgcgctcacctaacccactcatgcggcgccaaacctgcaaggggtcggggcgcctcagccctcagggccgaaacggaagcggtctgacccctcggggagacaaagagggggggcggccacgtcaccctcggacccgacccccccaagggggtcaggcctcgtgggtgattgctcctgtccaagcctttagtagtgatactcctggtcccatgtcaccgacagtagcccccggcgttatgccagggcgatcgctctcttcgagggaagcggtcaggtgtgacgccacttccaaaagtctggtgacaggtgggaccgatctccacagttgggcagaaatccagcggtctcaaatcacgcactccggcaacggtgacttgactgtgaataatgagcggcctcttcaagactgccacattactcaagtattgcacgaatcgggacgagccggttcgttttgcctggagatatggcgatggcgctttggtcggcgagcgtaattaacgcgcgcacgatatgatctatctcgactgccacaaccgcatatccacctcatgcgccgcaagcgggcgaatgggattagtggaagcgtgggcgcgagaaacgagggagcgaaatagtgggcgcgagaagcgaggagccgggcacagcgttggcaagggtataaagacatcgaggaaaagatttgcttccttcctttcgccattattccccttgtcttcgcctacttgcgccctaactccttctttcctgtgccccaccttcgccacacgcgctcgctctcaatcatttcctcctccggcgtca

SEQ ID NO: 26955 - DNA, 1501 bp, Oryza sativa
taacgtttgcaagcttcctgggagattgccaatggaactaggtaagattccatgaatcctgttgttatccaaatatattgccaccagtttggtagagtttatttttgaggacaaggatgtccagtctacagattcaaataggttggcaccaaggtccaactgggtcaagttttgcaaagcccagaaagaaggaacaacaccagtgaatgtgttatcacggacctctagcacttgaaggttcaaggcattaactaaagaggttggcagtgtgtcggtgacatgggaccgggagtatcactactaaaggcttggacaggagcaatcacccacgaggcctgacccccttgggggggtcgggcccgagggtgacgtggccgccccccctctttgtctccccgaggggtcagaccgcttccgtttcagccctgagggctgaggcgccccgaccccttgcaggtttggcgccgcatgagtgggttaggtgagcgcagcggggctcacctaaccgcatttattgcgattaggacaagcgcgtcacgccgcatgtaacgcagtgcagcgcgctcgtttatccggtctgtgatcagtcgcagaccagatcgtgggttaggtggcgacaggcggtctgacacacgcctcgccccgtcctgtcaggatgagcgcatccaagcactcgtccctagccggagccggcgtgttacctcctggagatggcacgttggtcccggtcagacatatgctaggcttcatcccaaccattacaagcaaggtgttgtatgaagaagggcaaacatgcagattgctaaactgacgcgtggtggacaagaatgaccgacatgaccggactgatactggtcatgtcatcagcagacagccatgatcccacgacgcgcctacttccgacgaaagtggaggtaggtatgggccgtcccatcagaagatgattcggtgggcaaccatgcaaatctccgtcgattcatgaagagaagggaagtcaaattggtaaaaagagaggcaagtccccacacaaaaaagagaggtggtgcatgtggtatccttgagatataaaaggaggaccttgcccactgatgagggggattcggatggggagagctagattgagaaaaaggggagagctagattgagaaaaaggggagagaatatttagagtttgagctctctcgctctcgagctctttgtaagcttcttcatacacagatccaccaaaaacacaggagtagggtattacgcttctcagcggcccgaacctgtatacatcgcccgtgtcttgagtgtttccactctcgcgaaccttccacagaccaagagcttagaacttcacccagggcccccggccgaaccggcaaaggggggcctgcgcggtctcccggtgaggagccccacgctccgtcatctggcgcgtcagatagggggctttgcgtgtgtttttctaagctctcgtattctttcgtgggcgccaagcttttcctgttcagcccaa

SEQ ID NO: 26956 - DNA, 1501 bp, Oryza sativa
accaaagaacttgcacaaaaagcaactttgtatttttttcaaaacgttctttgtcaaaatcaactcatcaacaacacgagcatgtaaagcaaatccaatcgcaaaagaagattccaacgttttagatttttcaatctaaaattccaattttttgcaattaacagaattggcatctcgcaaagcattaatttcagaaaataaaacttcacaagattaacaattatcatcatcagaaatcgaagattttaatctatcaatttcagcatttagaatctcaatagtgtgatccttctcatcaagcacaatagaacatgtctgaagtttcttagcaaatttgtaagcagcatattccaattcatcataactaagcttttcttcactatcagattcatcaacatcagaatttgcattacgagcaataaaagctagatcaataacttgcttacctttgctctcatcttcaccttccgattcatgaaaagctgctatgattacttagattagccactgcatgcaatgcttcttcttctccttctccttcatgttcttcttcttgttcacgtcatcctctttgactctaccatcatcttccttcttgcctctcccaaacttaggacaatgcgagcgaagatgatcaagtgcaccacactcaaagcattgattaggacctcctcttttcttgttcctgacattgttcatagctcgagaaactttgttacataacaaaaccaagtactcctccttgaactgttcgagttgctcatcggacatggtattaaccaaagcaagaatagaaaactttgatgaagaagcaccaatatccaaagaagttgaagacgaaaccaaagcactggacttagaatcacctttacgagaaagaatattcatctgatgtgttttcaattttgtgtaaagtgaatccaaagtcaaagaagacatatcaacagactcctgaatagatgtaactttcatctcccaaatagacatgtcaagaccattcaaaaagtgacgagaaacctcagattgtgaataattagcatcataagaaaaatcagcaaatctaagatcactcaaaattttgttaaacctagagagatagtcatctaaagcttctccaggtttcatctcaaatttaatgtactcctttttgaaaagatcacgacgaagttctataatatttgaagttccttgatgaaagtttttcaaagcgttccaaatctcatgagcagtttcaagatgagaaacacgatcataatctgaacgagaaatcccactcaaaagaatattgcgagctttgcaattgtgttcaaattcaagttttaaagcatcaatattaatttgatcaggaatcacataaggatgagaaaattttctccaaatatcataatcctcagccataatgtaagattgcatcctactgcaccaatgagaaaaatctgttccatcgaaaacatgaggcttagttgaaaatctattagtagccatggcaaaaactctagat

SEQ ID NO: 26957 - DNA, 1501 bp, Oryza sativa
ccaaattcaggataatgctagctttggatgtgattgatggctcacttgcgttggcctgattcttcgtgcattgcattacataattgatacggcctgctgcacattaggcataatttgacaaaaccaatcagtggtagaggtatgtgcttctccctttccatcattttacctcaattgcaactcggcgtatccatggacaactgtcaatgagcttagggatacagagacccgttgtcatacggtagctccctaatagctcaacaaatgtgcactgcagtgtcaagacacgtgtgtctgttttccaatgtcacccattctcgaaatacagcctaacatctagcatgctgtctgtattttgatattttaacgagggttattatgagaacgctcggctatttagcatgtgaccgacgggatatatatttaagtaagtgagaattattagataccacttggaaatggttataagtggccgatggaccatattagtaaccgagaggtttaatactgtagttgggtcatcagcgaggcagtgtgccagaaaccatagttaatcacctcagctccggccgtgaactgtctgagctttatgaaggtgacaggacacagggctcaggcagtcagtacccttctactgcctgatccagttgatggtgggaagaacttgtaagatcaacatgtgttttgattcttattctgtgatgaataattggcatctgtgattattggttttgatattggagtttattgtcagagtggttttggatgattggatttacaggtgctgttattttatgtggtccggtctgaccgggcgatggttgccggtcagaccggtgctatgcgagcggtcagaccggccggcccgcggtctgaccggccgacgctgtgtcggtttcggtttcgggttgtttctttggatatccgtgattgtttcatggttatggcttctagatggacagtatacgtatgtaatactgttgtttgctaacaatgagtcaatttggtgatagcttggtctcggaatatggtttctttgtttgtttcatgtgtaggtgacttgatgcctcgggagagtatttgcagtgatggaccgggagtcggcttagtggtaagacgatgttcgtggtggtcagatatcatgcgggatactaaggctagaattgatgcacgtggttgatagagattccatatggcatacgatggaggtattgtgtgcgtatgggatgcggagtcgaatttggaaggagtctaaatctggtatgattggttatgtagagtttgttccttgtactagagggtttcctaaggtgtttaggactcttagtatgagtttggttcgtggctttaggctgcttatctcatgtataaatagagggggagcgtgaggcttcccggtatctcttttgtatcgcttttgtatagcttttgagagctagtttagttagggtttcgagtttagtcgagatttttgtaaggagtgctgttggtgcactttgta

SEQ ID NO: 26958 - DNA, 1501 bp, Oryza sativa
ctagaagctagactgtatttgagaatgggtgacattggaaaacaaacacatcgtgtcttgacactgcaatgcacatttcttgagctatccctaagctcattggcagttgtgcatggacacgccgagttgcaattgaggtaaaatgatggaaagggagaagcacatacctctaccactgtttggtcgatagaattattcctaatgttcagcaggccgtatcaattatgtaagaatcaggccaacgcaagtgagccatcaatcacatccaaagctagcatttgggcctgtggggatgagaagaaaaccgcatactgttgtaagcttgcatgtaacaattattccacaaagatatctttttatgtattagaatttggtttcaaaaatgtacatgaaagcacttccattaaaaaacagttgcattgatcgcttcctccctttcctaatttgcgatgtgttaagattcgcttgaggtactccatgccttctgtcgtgaggtgatcatcacgggcgcagcatcgatacgccagctgatctctacatcatgcaagcttcagctctggacataccgtgcccattccgctgagtccaccactgtgctacctatagtgccaactaccaagcttagcgttgattcagtgcatgaggcaacaatactacatctttagatttatagctgatatttacgcaagggtgtcctttctgtaagatcaacgtgtgttttgattcttattctgtgatgatcatttggcatatgtgattatcggttttgatatttggagattatcgtcgaagtggttttggagataatcagttttcaggagatgaacagagtttactggtttgtcgggaccggtcagaccgggcggtggttgccggttagaccggtgctatgtgagcggtcagaccagccggcgctgtgtcaatttcggtttcgggttgtttgtttggatattcgtgattgtttcatggttatggcttctagatggatagtatacgtatgtaatactgttgtttgctaacaatgagtcaagttggagatagcttggtctcagaatatggtttctttgtttgtttcatgtgtaggtgactcgatgcctcgggagagtatttgcggtgatggaccgggagtcggcttggtggtaagacgatgtccgtggtggtcagatatcatgcgggatactaagggtagagttgatgcacgtggttggtgaagattccatatggcatacgatggaggtattgtgtgcgtatgggggatgcggagtcgaatttggaaggagtccaaatttggtacgattggttatgtaaagtttctttcttgtactagagggttttctaaggtgtttaggactcttagtatgagtttggttcgtggctttaggctgcctacctcatgtataaatagaggggaagcgtgaggcttcccagtatcgcttttgagagcaattgagttaagttttaagttagggtttcgagtttagtcaaaatttttgtaaggagt

SEQ ID NO: 26959 - DNA, 1501 bp, Oryza sativa
ggtgccgaatccctgaaaacagtcttgacgacagggacgtacccagaatataaaaaagagaaaaatatgagcaaaaaggctcaaggaaagaaaaagtaaaattctcttggttgttttgtgcagaaggctaatttgagaaataatgataaatgcaataggtatatgtgtttagtgtttattcttcaacctatgtgcttgttaagatgttgcattataaattgtatgaaatcatgaattttgattgttgattcaagcttaattgtaaaatctttggttcatggttgtactttaatgcatgcttgttatattatagatgggttcatcttctttttattgcaacacataacatgataggctatatgtatgttaagctcttatacattaatgaacataattcctatgcttgatgaaatcattgtcaaaagtgggagaagagataagttttgggggaagagatgagttttaggagcagagaagagtttttgagaaaagcatgtttttggttcaattggaaatttctttcttttaaaaagggggagaagttttcttttggatttttgagcatgatgtgtacgtttgtacgaagtgtgttttttaccgcttttgtttttaattttccaaactccaaaacatttttaatgggtttgccaatgtgttcatcaagggggagattgtaagatcaacgtgtgttttgattcttattctgtgatgaacaattggcatatgtgattatcggttttgatatttggagattatcgtcgaagtggttttggagataatcagttttcaggagatgaaaagagtttactggtttgtcgggaccggtcagactgggcggttgttgccggttagaccggtgctatgtgagcggtcagaccggccggcccgtggtctgatcggccgacgctgtgtcggtttcggtttcggattgtttgtttggatattcgtgattgtttcatggttatggcttctagatggatactatacgtatgtaatactgttgtttgctaacaatgagtgaagttggagatagcttggtctcggaatatggtttctttctttgtttcatgtgtaggtgactcgatgcctcgggagagtatttgcggtgatggaccgggagtcggcttagtggtaagacgatgtccgtggtggtcagatatcatgcgggatactaaggctacagttgatgcacgcggttggtgaagattccatatggcatacgatggaggtattgtgtgcgtatggatgcggagtcgaatttggaaggagtgcaaatttggtacgattggttatgtaaagtttctttcttgtactagagggtttcctaaggtgtttaagactcttcgtatgagtttggttcatggctttaggctgcctacctcatgtataaatagagggggagcgtgaggcttcccggtatcgcttttgtatcacttttgagagcaattgagttaagttttaagttagggtttcgagtttagtcgaaatttttataaggagt

SEQ ID NO: 26960 - DNA, 156 bp, Oryza sativa
ggaacgctgtcgaccccgtcgacccgagccgagtcgccgccttcctccgctccggctgcctttttcgtcgtcgccgtcgacctagggtgagccatggaccgccgcttcttttcccccttcccttcccctctctcggccgccgctccgccgtgccta

SEQ ID NO: 26961 - DNA, 784 bp, Oryza sativa
gccaataacataagcatggtgggtttcactggttgaatagtagacatagtgccacaccgctgttacctgcaaaataaagggaataaccatttgggcaactttactcactgtcggagtcattttttcccatgcatgtttgttctgtaacagtttaaaactcgaggaagaaatattctcgtccaaaatatttattccctcggtcaaaaatatttaacttggatgaaaatttgatcaaacctctaaaattttgagaataaattatatataaagtaagtttatagtattatgatactagttttcaagacaaatatctgtatataatttatttcgtctttaaaacacacatttgaaaaattattgaaatatatagaattttaaattttttatcaaatcttattgtaaatattcttcttttttgcagagggagtataatataatgctaaaaagcaggaaggctaagctttgttaaatccgcacacatagggtatgtgaaaggcaatagagggttgaaataccaatcaggagaggagagaacacgcaccttcgcccggccggagtgcagagcactgcaacctcttcggcttggctatgcgcggtggtgtgtgtgatctgggctctgggttggatatgcttatctgactcaggccccaggggtttaaaaactattttacagcagccttacctccacacatttgagctgtcacaccttatcttagcttgaccgccgtaacagcggagaccttgattcggagtcgttgagactaatccattgcaacttttcagc

SEQ ID NO: 26962 - DNA, 1501 bp, Oryza sativa
acatataagccaaaaatttggcttaaaagcctaatcccaaataaagatgccctaagtaccaatcagttatcacgttaagttagctaattaatactccagcattttttttattataagacatttttaattttttactagtcaaaacattgtagcatttctaacataaaacaaacttagatttgataaaattattttgatgttgttgatgttgcgattttttctacaaacatagtattttttacgaaataaaataaaataaaaattaaaacgacttataatataaaacataaaacagaacaagtattatgttattagttatccgatccgactttatgctcccaggtaaacaaatgattagctagacaaaacaatccgtacctcctcaatccaacatctccaaacactagtaattgttaccagcagaagtggagggaccataaatatataccgaatgaaaattttcaccagtattaattgtagccacgacgattaattacattttgagaccatattaaaatagcaataagtcactcagatgataaaatagcgtgacccaggggcggatacaggagtagggcagctagggctacagccctactcctgatcctaaatatgcattgaaatttcattttaaaacttcaaaaattagaagataaagacaaaattatataaattcaactaattgagttctatgtttaaaaaaaattctgactccgccattggcgtgaccaaaacatcccaagatcatcaggaatataattgatcatcatctcatctggttcagtaactagagatcgaacaataaagcaaatgcacttacctggagaaattcaagtactcgcagctctcgccagctcagtatggcgcggggcttggtcatgggatggtgctttatacactgacatattcatacgaggccgatcgatgtggatcagcttgataacgaaattccaaacgttagtataacaaaaaggtcaggcgcggctgagctatattatgtaattaatctacttgattaatgagaaattaaactttggctatatcagatcacacgttattggtcgccgagcttccaaaaagcatccaatatctttattagtatcgaacaacgttaattattgatcagctgggtgtctatattatatactagtatataggagagagatgatggttgactacaagtcatctatacaactcgctcggatgatacttttatattgatttatagccagtagcagatccagaaatttagttcgttggtatcacaacgtgtctatcggtgtcatagcatgttaattatatttagaatatagtgttataatatatggataggtggtttaagtatagcttttgccaaaagtcatcggtgtcacctgacaccgatggtattactgtagatccgtccctgtttatagctagtcattagctctactattaaacttgctctgatggtataagtctactctggtcgtacaagtcagagcttatttttggctgtata

SEQ ID NO: 26963 - DNA, 221 bp, Oryza sativa
aacatagatcctacaaacaatagcaattaccatttagcacacattcactaattagtaacaatttataaattgcattctcagttattcacagactaactaatctctaatcacaaattcacaaatcttctaatcacaaattcacaaatctagtcatttagtttaggcatctatttgttacctggctagtgggctgagccacggaaggggaagggacgggcgga

SEQ ID NO: 26964 - DNA, 393 bp, Oryza sativa
gtcaaacgttagacataaatagtgtaaaactgcatttattttgggacggagggagtataacgaatctaaactggagcagatttattatactaaattatgtcatattttattttaggttaggtttttcagtgacggcagagtgccaagagaagaaaatactagcagaggcagagacgatcagacgaatggctggcctctctacccacacccatgccaaggcatgaggatgatgttgtccttgtccacagtgcacagacactggtgcaccgtgatgcacagtcgcacacaggcacacagccttcttcacgaagccatatccctcattcccctctatatataagccagcaagctgcgccatgtcatatcccccgctaaactctccgcccgcgcagc

SEQ ID NO: 26965 - DNA, 1501 bp, Oryza sativa
acgatttggcaccgtaaggtatcggtattttgaggtacttttggttgttatgaagcaaatctctattcgtatgcatgttttttggctgtgttcttccctcaagattcatgacctcatctatctcgttttttgtgcctacgctttctaaactactaaacggtacgttttttttaagtttctatatgaaagttgctgtaaaaatcatattaatctatttctcaatttttttttaaactaacacttaattaattatatgttaattcgtcacttcgttttgtgtgcaaagcagagcatcttgctgccatgtgttcattcatgtagagcaattttggaactttttcatttgtcaaaaacttttggcccacttgctttgcattgcttcatgtctgcgtcattaattttagcagcatgcatgtagatctatgtatttatcataatttaagaattgaagtgattgattattggtctctgaaactattttgattttgggatttctgtgcaggaaacgtgaatgctaatcacgacccgtccaaacaatctggttctgcagtgcaccccctcaatacaccatgcaactacccaggacaagctggttgccctcattgatagttcgtgctactcagaaaaagatgaaattaaataacagattacaacaataagcgccaatacatgagcgtctggttatcgacctcgatgtgtccaattaaaccttgtactcgacctgattttcacctaatgaacgagtgctttccgctacatattttccctattttttatggttgctacaaatgcatggatgcatattacacacatgtcgatcagatcgcgcgaatgatgagaaataatttcgtgcaaaaattaaatacgggaatgcggcaattctcgtcaaaccatgcaagacctatcaaattttgtttgaagaaatcatttgggtgtggaaaatctctctcaaggtgatcctccattctgtgcaaccatacaggtgaaattcgtagtcgatggagagaagaaagacaacaagatcaggccgcgcagacgtacgatcagtgaggaatgatggcagtgcgacggcagccaccattcgttgctctcctcagcagggttagcatgcaatgcattcccgatgcctcacatgtccatctacgaattttttttttaataatggaatgaaacatttcggcctttgctcatcagagctacagctaatgttgatctacgaataaataccgaaaaagatttatcactgttagagtatatcaccatatgtaacaaacgtgtgattaagatcaggttcggccggcaatctagaggatatagctagctgtgtttgttaggataatgccagctgatcttatctaatcatacgtatatatatgtactcccatgcaccgtttgaggtgcttaattaacacgcagccgtcgaccctagcgtgaagggcgacgttcctatccatcgtgttttcccacatggtatcaaagcgctgaagttagatcccatctg

SEQ ID NO: 26966 - DNA, 1501 bp, Oryza sativa
ctgttatgtatggacctttttctatggggaagggtatcttttccacataacatcaagctaccaattaatgcagtaactacatatctatattaaagtaaataattactcctgtacccactggcaattagatgtcctggtgttctctcacgcatgatctagtattaccccttcgttattatagtgtagtaatcccttcgttattatagtgaagtaatttctttgttacaaaaggacagttgcttcataaagtcaaagccatatcaataattggctgtaccagtcacaacaggcagtaatgagatgtagcttaataattggttgtaccgtgcttgatagcaacgatgagcgcggtggtgcttgaacacaaggatgaagagtataatgcacggtttgcggtgctctataagcattttacattggtgttgtgtgggagatcaatcttatcttttgagataagaaagctcgcagtagaagtctcaatgataccatgaagtttccagcccttgctgaatttacacatacaacctctctctattggcttgcaccaaaaggccaatttgtgttgtaggcatgcaaacttggtgggccaaaagatcctgatacctcacaatcctagccgcctctggtataaaccaatgaaaaacattattctccttcaaagtgtttttatcatggaaaatcaaatttgctttactcgaggagtatgtaggtcacccacctagttatgtgcttggagagatagctgtctgttactctgtttcatggtttacctatatcagtcttgaaatgttgcaagtgaataggactgatcagcatccgccgtctgatcaatgatttgtggtgtagattatgcaggagtccttgcctcgtgaattaggggcctggaaatcctcacggcccaataggcttctacttatgcacctcttgtagtcatatggttggagtccggagaaaggagatggtatcattggcaatagatgcagaggcggaggaagaggttaactccagacgatttcacgaggctctgtggctgggatatgcctctgccgatggacacgaaggcaacgtcggatcccagttggtggatgccgtgttggtgccaccgatgcacctgcagataccgtcaaatcctagtatttttcttgcttccattgctacttttctgtggaggacactcggactttatattattgttgctaattgaaatgaacatatcaagttaagtggttcacttactctccccttggccgaatgcaaaagtcatgtggtctcttaggaggcccacctaaaaaaataaacttatttttgtaggcggatctattaaggggccacatgagaaaatgtatttttcttacgacccgtgaaacttccttcgaatataatttttgcaggcacgacctgttacaacctgcctataaccttcgtatagaaaaatcgtttctgtagtagtgtatactgcgtgcttcaggaaaagaaaaacccaccataattgaggcagatc

SEQ ID NO: 26967 - DNA, 1501 bp, Oryza sativa
tttgcaattattaagagcagaaaataaattatcttatctctatgcttttgatttattccgaataatacttagcaccttgcgttactcggtccatccaacgagcccccgggtgctaggaatcggcctaaaggcaactatccattggcaaaccaaacggaaagcataggaagatggaactccataactcgataggcacttttgtactcagaatatgtcgcaagcaatcaagataaatattatgaaaattgtttaaaaaatatgatataacatctgtagcccccgactcactactcaatggaagaccaattggtgtagtgaggcagaggaaaaggcaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgcgtaagcggaaacaccagtcgacggcaacgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgcagacggaaacaccagtcggcaagagtagtgccgcggcgttacatgcaaacagcagaaaataccaagagagattaatctgacatttagagatcaatctaataaacaacaataagttgaaaaggaaaaaacctggcgaagtcggagattaaaaggaaaaaactcgccgagattgatctcttcgactgactccgagacggagcggaggaggcggaggtcgcagtcgcgggcggcgttggtgtccatcagcacgacgcaggacggcaggaaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcggcgtttacccctacctggcgcgccaactgtcgaaacatgaattcggcaataataaaacggggtagcgcacgagacctaaaagtggatggatgtggagacaaaggat

SEQ ID NO: 26968 - DNA, 1501 bp, Oryza sativa
ggtacccataatctccacagtagcccctgagaccttcacagtcgaaaagataatcttctctcgaaccagattactccaaagccgagtacttcaatcatctttgccatggtctcccgagtacttttaccaaatctgaagactgtggagggctgaaaaataaagtcaggtgcatcgactagatgcacctaataggtgtagccctcgactatgcggttaagtgaacaaaccaagcatatagtcaaggaataaataatccaaccaaccgagtggcttcgataattatagttaactaagcgacttgatattaatatgtagcatatgcggtgtaaatccctgaataacatgatccgagtgatataccgactgctttgtaaaatatgatgagtgtaacctaaagttggctacattattgaaaattcacatagcaaaacagctataaaaaagcttgtatgttgtgaataaagaaatttccaaagtattgggcataccccatgcgcacactgctttaacagatgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacatgacaggccacacctgaaaatatgggctgcagacatattaggccttggccaaaaaatatgccttcgataccctttaaaggatgacgcatgtaacatgctcccgggtgatatagaccatgtgatctgagtgattatcccttatgggatactccaaaatagatataaaaattgaatcccgactggcgcaagtattcggttgataacccttacggggaataataaatagtccagtctttgagcatagaaaatagacccatgatcataaattcatgttgcatgtatccggaacaagtccaaattggagacataatacttgtgtttgaactagtaagcccctgagcatatagcttgtccttatgtcgtagtcacaattgtctattgatggtagctgacgcagttggcatagagacaagataaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctc

SEQ ID NO: 26969 - DNA, 855 bp, Oryza sativa
ctagatagagaagcactccaacctagcaatcatatcaacggcctcatcgtttcgcttattcggtaaataagtcaaacaacatatttacaaatgaaaaataatttgtgaataaaatttttatatacatgttcttaacgatctaaaagactaaaaaataaactttgatgaaaaaccccaaaatcaactttaaatttaagattaaatatttaaatttcggctgataagcatgagcgtaagcgaaaagataaggctgcaaagctgttcaataaggtagtgtttggttgctgggataggatgggatgggatgggatgaacccatttttaggggtgtttggttcaaggttgagtgggatgggttggtccctagaaaggaatattcctttcagatccgggaccaattgatccggccaaaccggccggaccaactcatcccccttggaacgagtgaccggcgtgaacgagcgaaccccttggcaggttggcggcctggttggggggttggtcttcaaaagacgccaccgggttagccaacgccgccgccgccgggttcaacaccgccgccgccgccgccgtaaaccgcttcggccacggcggtggcggacggctcgggcgaccgcggcggcggtgggctcgggcgacgtcgacggcggtgggctcggcgacagcggcggcggggggctcggtggcagcggatccggtggtggggaaggcggcggcggcggatccggcgatagggaaggcgacggcggcggatccggcgatggggaaggcggcggcgacggatctggagccggggaactcggcggcgggccgaccgtgcgtcgtcgcgcttctccgcccgcccgaccgcgatga

SEQ ID NO: 26970 - DNA, 1501 bp, Oryza sativa
ggcttactagttcaaacacaagtattatgtctccaatttggacttgttccggatacatgcaacatgaatttatgatcatgggtctattttctatgctcaaagactggactatttattattccccgtaagggttatcaaccgaatacttgcgccagtcgggattcaatttttatatctattttggagtatcccataagggataatcactcagatcacatggtctatatcacccgggagcatgttacatgcgtcatcctttaaagggtatcgaaggcatattttttggccaaggcctaatatgtctgcagcccatattttcaggtgtggcctgtcatgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggggtatgcccaatactttggaaatttctttattcacaacatacaagcttttttatagctgttttgctatgtgaattttcaataatgtagccaactttaggttacactcatcatattttacaaagcagtcggtatatcactcggatcatgttattcagggatttacaccgcatatgctacatattaatatcaagtcgcttagttaactataattatcgaagccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggctttggagtaatctggttcgagagaagattatcttttcgactgtgaaggtctcaggggctactgtggagattatgggtaccctatacccacacggcatggttatccgactagttataggggataacttatatgtatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 26971 - DNA, 1501 bp, Oryza sativa
ctgtcattgcacttgcacttctttaattatgagcaatatagtgtacagcttctgcattgtatggttttgatgggtatgaacagctccagtctttcacatagcaaggaaaatcttatggaatgttactaccacattgggtgcagacgtgcagttagctcttttgaacaactcgaaattcatatatatacatgcgagcttatacaaattaaacaaaaataaaagaaactatagtatgctgcatgttttgactacatattatcactactggagaaaccatctttggtcggtcgcccataatccacaatagtcccggttctattaggaaccttccattaggaaccgggactaaagactatttttagtcctggttaaaaactttttgatgtttagtcccggttggtgttaaccgggactaaagatcatttttagtcctggttcaaaaagttgtcgggtcgagccaggcccaattatctttagtctcgattggtataaacaactgggactaaagtagtcccagttgtttataccaaccggggccaaaattcaccccgagccatgcgcctcatctcggtcagtcggtcgatcttatcccctcccccttcctctctcctccccccattaaattaacagcctcatctctcagctcagcctcatctcttacagcctccacctcccctttcgtctctccttcctcccccttcccctctcctccccctccccgcctcctcctctccaagcggccgagcgacagccaagcccaggcggcggggacggcaccgaacccaggcaccgagggcggcagatggcgggtggaagggagggcggcgggagccggcggccggcggcgccctcccctcttccggcagggaggcaggaggcgacagcggcagcattttgttgttcttttttttttaagaatttgcgatacattggatctgagaatttttagaagttgagattcattagatttgtgatgtataatctgtgatgatttttttaagaatttggtatgttttttcttttgataatttgtgatgtgaatatatgattcattgatttctgatgatactttgattttgatttgggaatatgtagggagcaacttgatttgcgaaggagcaacttgatttgaaaagaaacaatgaaaaaaaatggtgaccaaccgggctggcgctgccatctttagttccggttggtaacatcaaccgggactaaattaagatggatttttagacccgattattttacccgggactaatgatacccatttttagtcccggagtcatactctaggttgcaaaaccgggagtaaaaatgctttctacagtcgtgtatataagttatgctatgcatgtgcttgttgtgcttattttaaataagaaaaaaaattgaaagactgacatgtaatatcacttgtaaagaaaacattcgattaaggcatgagtaaaaaacacaaatgctatctcctttagtttcctttctgcacactgcgaagtataat

SEQ ID NO: 26972 - DNA, 1501 bp, Oryza sativa
ggtgtaaaactaatccgccttaattttcacccatcctgtgatacgaggattaaccaaccggctagaggttttcagtcttgaacgaaaatctagtactaccttttgtcactgtctcaacttgctggtgtcgggtttgagatttgagagaatgagagggaaggcacgtaagggcaagttgttttatagtggaggtagatgtcacatttaatttagaatatgtcatcttctcattaattaagaggtaacacatacttcctccatactcacaaaggaagttgtttatgacaatgtttaagttaaatcttgggaatataaatgaataactctcaagttgttgagttcgaaaatataaaaattatatgaatagatttttcttgaaaaaaatactttcataaaagtatatatgtatcatttttcaataagtatttttatagaaaaaagaagtcaaaagttgtgttttggagaccgtgtcgctgtcctaaacgacttcctttatgagtatggagggagtataatatatcacatctaatatacaaggcaacatatcctatgcacacaggccctcacgtgtacacacgtgcacatcaactaaaaaatgtcaccaaaaattctagaaaaaaatcatacacatactttcaattgtattacacctagggttaaaatcttaacgtcaaattcattatattttagccgtaacaaaaaaaaacaaaaaatctgacagttttaaggttgtaattttgtcagaattttatcttttttgttattctctatgtagaatgaatttgaagatgcgactttgcacgtagatgtaatactattgaaagtacatgtatgaattttcctagaattttttgtgataatttttagttggtgtacacggtgtgtacacgcgagggcatgtgtgcataagatacgctcccaatatacaaactccaatattagctcacactcacatcatcttacacttttttcttggagattgtgtaaaggttgccccttgcatgaggggtggctcaatctcatacacctcatcatctaattatgtatggcaaatttaggggcaatatgtaggggcttccagtacttgccctaacaggatgcttgacactgacacacagtagttgcccgcgcctcacggcgcttccttttgatgtatttcgatttttctttttcagaaagaacaattcacagttgaattgacagagaggacttgacagaatttaagcgaagaagcagaaaactggaaacagaaaaatactactccagttttcaacctcgagaaagagagagagatacagacccggcgcattcatgaccatctcgttttcggccttttctaaaccgcacttgaaggttcagcccaatatttgtacggcgcatattggacccatcagaagcctatcaacaaatttagcccaagatgctcgtcacgcagcccgcaatcccgttctagtctctttgactcgtcaacgaatccgattttcgtccttgaacctcaaaa

SEQ ID NO: 26973 - DNA, 171 bp, Oryza sativa
aaatatgcaggcttggttgtaatcgaattgcaattatattcaggcatcagagaactaaccacaacctgcatgttaactttctataaagaatgttggcattttcctaacaaaaagcaccataaattgcacttgtttgtcaaaacaaaatattcatatggtcatacctgcaga

SEQ ID NO: 26974 - DNA, 865 bp, Oryza sativa
ccaaatacgtgtaatgatgaaagtataagtacacaattggtagttttcgctcacatctcttattttaaataaaataaacaattgaaacgctctagtcactcacatatcttattttaagataaataaacatatcaacatgcactagtcatccgcataccagctcatctgtactccctcccatatttgattttaaatatatgtttgacaattcattttacttaaaaattataaaaatattgcttgttttgttgtgacttttaccattaaaggtgctctaaacatgtcttatgttttatactaaatttttaataaacgaactatggaaacatgcataaaagtaaataatgtcatatatttaaaaatggatgtaatattattttgctgatttcaccaatgtgaaaaaaaaaaactgtccctaagaatcggtcaagttatgtaatttgtgtaacctcccccctccctacaaaagaaactgatggatgttggcagtacttcttttcagctgaaaatttttccaaaaaaaaaaaaaaacttaagcgcgtaattaatctgcataacgcatccgttaacccttttttctttgcaaaagcttcagctctgacctcactcctcactaagccatccccttgcagtttaatttggaggtacaaaacgccggtggacgtaagccggatggcacgcgagaacagacgtcagatatataccaaatcctatgaaaagtaatatgttctttctccgatgcgtcggtgtcgcggcaaacgtcagatgcccgcatgatcatccccggccgttctgttcacgatttcttccacttttttctattccaacggctcgctaatctctctctctctctctcgttgatagc

SEQ ID NO: 26975 - DNA, 1501 bp, Oryza sativa
gttggtttttatggcaattggtatgttagcaacacttaattgcattaggtaactgaggagaagagacaccatatatgttgcacacctggacataccaatatgagagcctaagtacaagtttggcctactgctttgggaaaacctaaattacatgttggaaataaacattaatacttcctctccattgacagcactgtcgtcattggtatatattgctataagtgcttgaaatcttgaatactttttgtgatcaataaatttaccactgacactaatctgaatagggacttgataagtctcctaattgattagtacacaatctatcatcgttatcattagcagtgcaatgacgatgaaataagaaaatcagaaaaaatactgcagtttttcaactgcttccagcattggcattgaaaaaaaaatattcctctttcaaaatcagtgttactgcaaaagtttggaagggatcgagtcgagactcgagagtgatgtatgtggggttttccccacataaatcagtacttcatgaatgacaactgactctttcctcgcaatagtttggaagtcccattgtcccaaatcagtttggactttggaagttagtaacgtcaagcgctactgcttaatagtgtcttccaatcgagggaccaatctcaaaaagaggcaaatgaatgcaacctaaatcttaaggttcattgtttatgcaaatgtaatgttttaatcacaaaggtaacgacctaactaagtttcagctcacttctgtttaatttgtttggaacttaatttgaatcctggctttccctctgtttgctttgcagccagcagagcaatgagaacctacaaaaaggtactcctgcaaggttattcaactcattggatttaaatactagatatcaaatttctctgactttgcatagtgatttagcatatgcatgcagatgtcaaattgacaacaaaatgtaaatttctgcatctggtaattagtacatatggtacttttgcatttttcactgaaactgtggctacaatatactgaccataaagtatttaagcttgaagtttatgatgtattgcccatctctgattttaattttaataaactaacatgacctgccattagcctctaaagtttctgaaatcttctaaatttaatttattttcacatgataaacttaaatatttctgcatattagaaggttaagttttttaaaagtttcaacgtgtctgttcttaaacttcaaatatttcagaaaggagggatgaaatagctatgacaaggacacaaaaaatgattaccctcatcaatgcaaatttctaatttcaaaggagtggatacaagaatgctgaagcaaaataaaaaaaaaacatctgcaatggtgaatcttaatttccctccataattaaatgtttctttcacaaaaaaatatactatgatgaagacatcacttcatcggatacgcacataacttcacatgttccaatgataattccaagtccaagt

SEQ ID NO: 26976 - DNA, 1203 bp, Oryza sativa
  unsure (1)..(1203): unsure at all n locations
atgatcgaagatgatcgatagaggcgcaacacggcatgagaagtgagatcgaagacgtaccaccgttcagggcttgggagttgggaccctgccgcccctgcagcggcgaatgtcgcagccgcagcggcgcagccgttccaccgcctcgtcgatcaaacgctgccgctgtactagctccccgcgcgacaggttgaatagaaaggggagcctcgtcgtcggcgccggcggatcagcgtcctcctctctcgaatgttgggatcccatgtcgtcgtgatccagccaagatctaaagttttacaagaaattctcaaaaaaaatagggaagttttacaagggaggctaaagtanattcggcccatttaagtgttcaggcccatttaagacttttaagtgctcacgtgtgctgcgcgtcgtgacccaatggaacgggctgacttgcaactccctctcctccgcttcctcccgacggcgtcccgtcctggatggcccgaggcggccgttcgccattgacaggacgaggagctacgtgcatggcgtgagtacgtcgatcgttgttttccgaggagattggatcgtcggagcaagtactccttgaatcagcccaatccataggagagatttttttttataccgttgatgtgttcgtgttggacttggaggaaagaaaacgctcgatctcaaggcgcgtagcaacggcgcacgtgcagagcatatcaaactcaaacatgcatgccgttgtcgacagccgacatggcacgggcatgctctgtgcacagccgcatggcgagaagattgcagtcctatttgatgcatccttgagccttcccttcccggatttcagttccagtgagcaagataagccagcttgtcatttgtcaagacggcaacagggagaagaggacgcatatcgtactggacttctggggacgacgaaagttaaacgcctcaacgtctcgtcatttgtcctgtatggctggcttggctgtataacagtatgtcagcataagcggtcaagccacggcacgacaatttgagaaacaaagcatgtggatgtaatgcaatgctacttgggccatgtggccggagtgcctgacacaatcacacacgagaaaagactcatacttgattttgtaaggtaagtttctagtgaaaaaaaaaggggctgctatataacggaatcccgttttcgaacgggatgatccc

SEQ ID NO: 26977 - DNA, 1501 bp, Oryza sativa
aaagatttggccactattctaagttcgcaatgaatgaaagaaattggaatatccggcacacaaacaaacctagatacactcaaagatccaatttttttaatatagggttttaattgttgaatgttggaacaaagtctaacaagcgtggcaaaggcaccccttttcttggagggagcctaagcttagatccatgggggataagatgagaggaagagagtgaggatggttgttcattgaatggaatggggagatcccccctgctcttggagggctccttttattcatatataatagaaaattacagtactatccttaattggttacatcagaggggcattgccctaagggcgttctagtccattactacattagtttatacaacacccaagttatgggaggtcttctccaacaatataccgtggggttattccccaacattattaaaaatagatttttttgacggggcgaaaattggagcattataagttcggaggctgtagtcggtgtcctaaatatgagataccctatacttatggggaaaaatcgctaaaaaggaaatatgaaaaaaaggaaaatataatgataaaaatcagatccatttttgaggcctagcccattttcggcggtatgatcctgttccaatgcgtgggtatattactaggaaaaaaaactgaccctcgtccttctccatccaaaggctaccccatgcagaatttctacacttcaaggctagcctttgggtgaagattgaagggaactgattgtttgacatgtgtgcattatcaggacgggactacctgtatatttgtcgacaaatttttccccaaaaatttaacagatgtaattatagtacaatcgtagtgtaattacactgtaacttgtatataattatactgtaacttgcatgtaactacaatgtaacttatatgtaagtgtcacataattttgaatcgttaaatctattacacgatttgttttggtgaggaagaaaacaaatcatagcacacacatatatgaaagaatttgttcccacgacctccattttaccgaaataatatgttatggagagatttttaaaagttacatataatttacactatagttactgtgtaattacatacaagttacagtgtaattacactacgattgtactgtaattacatctatcaaatttttggggaaaaaatttgtcaacaaatatatagcaaaatcgtatcaggactgggtgcacctgatacttggggacaaaacatacccttttaagttttaagttttaacaaattcgctggagactgatcgcgaaggttattgttgttggcaaggagacaccgcacatgataagtcatactatggcttccattgaaatatggccctccctgtatctctctctctctatatatatgtgatgagaattaggcctcatttcatattcgaaacggcctgatcatctcctctagcagaacaccatctgagttgaaatagatcgacatggccagccaac

SEQ ID NO: 26978 - DNA, 165 bp, Oryza sativa
cctcccccccccccccccccgccgccgtcgatggcgccccctcctctgcccttcctccctgcctaacgcaagaaagagaggaagaagagagaaaaaggaaggactagtgggccccaccatttttattacttcattattatttttggatcaaactgtcacgtcagt

SEQ ID NO: 26979 - DNA, 1199 bp, Oryza sativa
tgtataaactttagatgcataaaaatactatatatagaaaatatttgaattcaaattcaaatttgaatcagatataattcaaattcaaatttgaaacgggtatgtaaacttttgacttataaactttgggtctataaactttaggtgtataaactttagatgtatagaaatactatatataaaaaaaatttgaattcaaattcaaatttgaatcggatatataaacttttgacttataaacttttggtctctaaactttagatgtgtaaacttaaggtgtataaactttaggtgtataaatttactaaaatagaaaagtaatgtggtgccaaaaaagaaaaccaggtagagggaggcggagacccgatccgatcgcccctggcagcccctagcgatcaatcgcccaataggagtttcgagttgaacacacacctggccctatctgggccggttctcctgcactactaagggcccgtttagttccttaaattttttttcccaaaaacatcacatcgaatcttttgacacatgcatgaagcattaaatatagataaaaagaaaaactaattgcacagttatggaggaaatcgtgagacgaatcttttatgcctaattagtccgtgattagccataagtgctacagtacccacatgtgctaatgacggcttaattactctcaagagattcgtctcgcggtttccaggcgagttctgaaattagttttttcattcgtgtccgaaaaccccttccgacatccggtcaaacattcgatgtgacaccaacaaattttcttttctccaactaaacacaccctaacatacaggcctactgccatgtgaactttcccaagtccaataggcatgttcatttcgtgggcctgatttcaggttatgtccggaaaagcccggcactgcaccaatcaattttgacatggtgacaaaagctttgcatcaatcttgagataacaagagatgcatgcggtggcaaagagctaaagagtatgtacggttttaactctgaggtgtcgtgttcaatcctcaatatatttacaagaaaaaaaatgtttggagtgtaatcccactcttcaaatctcgttttttttcacaagcggaagaatcattgtcccagtgaaccatcgtctccacggtatatgaaggcgtattgttgcctgcaataaatctggatgcaggctgtcttga

SEQ ID NO: 26980 - DNA, 1501 bp, Oryza sativa
aggaagagagttccaagtatcttggtacaccggaggaagacaagagtactcgggaagagcaggctcaggattctgaacataaaaccagttcgcatgccaccctttgtttgaggtcttgaagggcatagagaaatacttctggctcagagttcccctcaactgaaatcctgcccctccgactacacatggcttattcttgttcggttggggcttgagaaaaaagattcggcggaacagagcgaaatggggtttaattcccaagaaggcttcacaaacatggacgaaattggcgatatggactatggaatttgggtttaggtgatgcaaactgattccatagaaacttaatatcccgcggaaaaatttcgaggtcggaagagcgaagccgccatagaagaaatgagagaagaccacaatctcgtgtgtatcgggggtcggaaaaatctcaccgcacgctggccgccacccgatgatctccttggcagggagaacgccgtgcgccaccatctccttcaggttctcttctgttacgtcggacggcgcccactggccttcaaagctttctttctcttccgccatcgattttccccgaatgcgctgatttgattcgagggatggcttgggagaggtgaggaattgaggcggtggatcacggggaggattttgatcactttttgaaggtggatttgagtggaatggtgaaccctagtttgccggcgcagttctttactgtagcagggagtggggaaaatggcgagagttccggcggggaagacgaagcgtcgcttggatctcgggatttcttgttaagggtatcggaggtgcaaatgggcctaggcctgaacagtacctcagcccaatacttttaacagcgtggcccattgtgttccttagggacttgggcattttttgctttggcaatttatgcgcacaatagtgttgcccaatgctgataaaatcctttttatgcggtcatataattctttggaattattgcaatgcaaattaaaaggtgcccgacagaaaggcgtcatgctgctttttgtaagcttttttaggctacaaaagctgtctgggttaacttggagtggcttgtttttaccatagtcatttccctggtatgttatatgcctgtttttattatggtaaatagtcatagcctaggctattagacttatttattaccataatttttataatacttggtgggtaatctttagagtttttattcggatgactgtcaagtgtgttcattcgtgaaccttttagagtgtaaaccactcggattccttttattatggctaaaaagcagtcggctaggatgcctctttaggcgccgcgtatgcttttgtcatatgatgcatgattgtgctattattttgttctcaactatatgtttagtttgttaactaatcacatagttgggggctacacctaattaggtgcatctattcgatgcaccgtattctttattgtttcgccctttacagtcttcgtcttc

SEQ ID NO: 26981 - DNA, 1501 bp, Oryza sativa
aagtgaagattagggtttcgtcctggttcccagccgtcgcctgtggtgtcgggtgttagaccgttggttctgctgctgctgctgctgttgttggtgttcgcctcgtccgtgtcgtcggttgcattctcgggctgtctgagctgcaacctaagttaaggtaaataagtcctctatttattttaaggatttgcaatgattcatatttgtcaccgtgggtaccagcactatgtcctgggactggtactgagatcgcggtttcgtaggaagcggttcgcgctgtttttcctacgacacgctcctatcaggtgccgttgtgcggcggtgccggattggggtgtgacagttagtcgtcattccgctatatcgactaacttttataacaagtggtatcagagcccaaggtttggaaccggaataatttccatgggtcatatggttggtaggccagataacaagtcttcggggtcacatgggttgatgtgacgggggagattgttaggcccgaggcccaagtaacaagtcttcggggtcacatgggttgatgtgacgagggagattgttaggcccgatgtatgacgggggagattgttgggtttagtcccacatcggtaattgatggtaggggagcatgacttaaaaggtgggggcggtcctcacccatcagactagtcttttgggttgtgtacgctcaggacctaaagttgtggctccggttgcgcctgtggtggagcaggccggccggcattgagctagcgagcttgttaactactcccgcgcttttaactgtgagcgagtctaccatacatccttctcgtacgtcggcttcctgagctgtggaaaccgacagaccaatcttgctgcggcactgctacagtgcagtagacaacgaccacttgacatttgtgagctgtggatgtggtttaccgcgtccatcttctgtttccatacaccgattgattgtgctattctcaactgggcctacaaacgtcttctctaggcgtcatgctttttgtggagattatggatatcccatatctacacggcgatgatatttgggttgaatataggataccgaatatagatagaatatcttgtgtgtatctcgggtttgtttcttaacttgtacgtaaaggaaataccttgagatctagtcggtcacgactgtattttatctgtatctgcctattccgttagggatatagattatcttttgtaacacggactccttcccatatataaggggggtccgggtgcctctagcggcggatgttgattttctccaaatcatacaatcaataacacactcggcggattcatccccggacaggagtagggtattacttcttttataagaaggcctgaacctgtataaatcctttgtctccaaacccatacacttttccagcttgatagccacccccttttattattgccgaaatctagtttcgacagttggcgcgccaggtaggggtagcgtcaagcttttcgccgatcagtgcaa

SEQ ID NO: 26982 - DNA, 1501 bp, Oryza sativa
catctgtagcccccgactcactactcaatggaagaccaattggtgtagtgaggcagaggaaaaggcaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgcgtaagcggaaacaccagtcgacggcaacgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggccagccgtataggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgcagacggaaacaccagtcggcaagagtagtgccgcggcgttacatgcaaacagcagaaaataccaagagagattaatctgacatttagagatcaatctaataaacaacaataagttgaaaaggaaaaaacctggcgaagtcggagattaaaaggaaaaaactcgccgagattgatctcttcgactgactccgagacggagcggaggaggcggaggtcgcagtcgcgggcggcgttggtgtccatcagcacgacgcaggacggcaggaaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcggcgtttacccctacctggcgcgccaactgtcgaaacatgaattcggcaataataaaacggggtagcgcacgagacctaaaagtggatggatgtggagacaaaggat

SEQ ID NO: 26983 - DNA, 1501 bp, Oryza sativa
caacccaaacaaagccgatactcctatatatgtaccaaaagtgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtgttattgattgtatgatttggagaaaatcaacatccgccgctagaggcacccggaccccccttatatatgggaaggagtccgtgttacaaaagataatctatatccctaacggaataggcagatacagataaaatacagtcgtgaccgactagatctcaaggtatttcctttacgtacaagttaagaaacaaacccgagatacacacaagatattctatctatattcggtatcctatattcaacccaaatatcatcgccgtgtagatatgggatatccataatctccacagtagcccccgagacctttgcagtcaaccattatagccttctcaaagatagtaatccgagtgcttcaaattattcatgccaaggcctgccgagtagcgaagacgaagactgtaaagggcgaaacaataaagaatacggtgcatcgaatagatgcacctaattaggtgtagcccccaactatgtgattagttaacaaactaaacatatagttgagaacaaaataatagcacaatcatgcatcatatgacaaaagcatacgcggcgcctaaagaggcatcctagccgactgctttttagccataataaaaggaatccgagtggtttacactctaaaaggttcacgaatgaacacacttgacagtcatccgaataaaaactctaaagattacccaccaagtattataaaaattatggtaataaataagtctaatagcctaggctatgactatttaccataataaaaacaggcatataacataccagggaaatgactatggtaaaaacaagccactccaagttaacccagacagcttttgtagcctaaaaaagcttacaaaaagcagcatgacgcctttctgtcgggcaccttttaatttgcattgcaataattccaaagaattatatgaccgcataaaaaggattttatcagcattgggcaacactattgtgcgcataaattgccaaagcaaaaaatgcccaagtccctaaggaacacaatgggccacgctgttaaaagtattgggctgaggtactgttcaggcctaggcccatttgcacctccgatacccttaacaagaaatcccgagatccaagcgacgcttcgtcttccccgccggaactctcgccattttccccactccctgctacagtaaagaactgcgccggcaaactagggttcaccattccactcaaatccaccttcaaaaagtgatcaaaatcctccccgtgatccaccgcctcaattcctcacctctcccaagccatccctcgaatcaaatcagcgcattcggggaaaatcga

SEQ ID NO: 26984 - DNA, 1501 bp, Oryza sativa
tggcgatgaagtggtcgcgtaattcggcccaagatccaattgtaccacggggcaatccatggagccaagaccgggcggaatccgctaaagccactggtaaatagttcgccatggccttgctgtctcctcctgctgcgcggattgcgagaccgtagacggtaagccactattctgggttagtggtaccatcgtacttctctattccagtcggcttgaagccggctggccaatccactcgacgcaggtcgtcggtgaaggctgctactccatcaaggtcgtcgtcgtggcggtccggcgagtgaagatagcctcgtgctgctcggcgctgtatgattgtgtcgcgaagatcgacggggcggcgactaggtggtgagcgaggccgttccactcggcgctccctatggtgatcgggaggtgagtgaacagaccgctcgtcgtggcccctgctcctgcgattggatcctgcgccggtgatgctgaggcttggatgacggtagtcatgagatcggaagtgggggactcggctaccagtcggcgtgtggacgctttcggagttaactgggaccgaagccgcaatcatggtcttcgtctggttcaagatgttgacgacgtgatcagattgattgagctcgttttccctgaggagggtgtcgaggagggtgatcgcggcaaccgcattctgttgaggggtgcggaaaaccggtgtcccttcaacatcttgttggccgatgagatcacgcgctcggcgccctgcttccaaagctcgctgccgtcgatcctcagcctccttcgcggtccgctcacggtcctgctgctcacgccgtagccgttcttgttcttgtgcttgatgctcctcctccagtcggcggcgctcagtctcgcgacgcgcttcggtctcccgggcttggcgttgctcctccgtctcgttattggccatgaagacgccaaagtagagaggggtgtagttgtcatctaggcttccgtcgaagtcgtcgagatccgggtcgtggtagcgagaactaaactcgtcgtactccacgatgtcggtggggcgcgagtcgacggtgggagagctgtagtcgccatctagctgatccgtcgaaatcgtgccgagtggttggaggatgacgccaacttccctgaagctaggcgaaatcggtgtcgaagccgacttccgcctaggcctacgggaaggagacgctgtcgtgatggagacggccgtcaaatcgtcggggagcttcatcaggatcggtgggtaagccccatcatcttgatctggtgacattggagaagatgcgatctcagccgagtggtttgaagccgactcggttgagatggtattgaagtaactctcagccgcgtttgggaatccaaacgggactgagatccggctctctcccgactggtccgactccgagtcaaggagagagatcttgccgaagttgttggtgacgaagtcgaggctgccgaaccgaaacgtctgcccgggtggtaagacgag

SEQ ID NO: 26985 - DNA, 1501 bp, Oryza sativa
aaaccctctcactccctctttgttaatccatctattgttgttcgtctatccaaagtgttctacccgactagatctaacctaggtgatcccaaagcaatgctaacaaatggtatcagagcaaccctagcgtttggatcttgttttcggggatggaaatccaaagagaaaagcaaaagaaagaaaagcaaacgatccaacggattgaaaagagaaaccctaaccctaatcttacctcgtcgccggccgtcgttgacgccgacaacggaggggggaggggcaaagaggcaccgccaaggagcccctcgacggctgcgcgcgcacccgcgggtgcacgcgcgcgccggcgagggggcccgcggcggcgccgccatctccttcgtcgccgctactctctctcactcggtggggctggtggcgcgatgggggagaagagaaaagaggcgtcgacgacaccgctcggcgcggccgagcccgcccgagagagaaagcgaagagaaaaggagggggcgccgcggcacagccgctcgacggtagcgcactcacccttgagtgagtgcgcgcaccggcgagggggagtgcgacggcgctgccgtgtcgccgttccgccgccgcgcggtaagccgccgccggggccgtgccgccgccggcgctgtgctagggtttcggcggtcgcatgagagagaagagaagaagctagggtttttggcgcaggcgactgggggtcaggttttgttttgcccgatctctccgcgcggtcgtccgatcgaaaccctagcgatcggacggccggcggcggccgggccgaaaatagcccaagagggcgcgcgcggggggcggctttcctggcccaggcctaggttgcggcctgggggagggggcatggccgcaagcgcctaaaggcgaccgtgggccgaccggcaaaggccaaaaaagtccatattaggtccctcggcgaaggaaaagaagtttaataaatgtccctattcagaatcattttcaatatgtttaatgattgtttttatttctaagcaatttgtaaattgtgaaaattgtttagagaatagataaatgtgagaaatgcttctgaacatgtattttgtatgttttcatgcaaattacaatagaattttgaattgtttttacatgtttttcctctgtttaaatttgaaccaacaggagaatttttacagagagtaaataacatagttttgttactgttcttatggattttaatatagatcttccgctgcaaatagatgatattgatgaaaattagtgtttctaaaattaaatttcgaaccaacgggagaatttaattttaggaacattaattatgtgctatgatgttgtaattttctgacccacgttgatgattgcaatgttatagttatggctttatgtgttatgtctattttctgcccaacggtgatgtagacttaatacataatatttttaatgttaattttgttctcacaatacatgattatctcaggtgactact

SEQ ID NO: 26986 - DNA, 1501 bp, Oryza sativa
ttaagtccacatgttatcactcaagattaactataggtttgtttagtgaagtaattcttttagattatgctcatgggatctattatggaatgcaagaccaaaactccaaatgcacaaagaactcgagcctaggcatgcattatgtacatgtatgcttggtgacatttctagtctaatgttgggaatgaaaagattttattttgttctcaaattttaatcatgcaatggtttaagttggtcatcacctaaattaaaacggaaattttggctctcaaaattggagaagttaacctctaactattttgacaagaaattttaagtcctaaaatttcgggtatgttacataatagagtacaaataaataactatttaatattcgcaaacaaattattacagaggtagatagttcctctcaaagaataaccttctacgcagcggaaaaaaaaataaaactataacaaactacggaacagctatggcgactccactccacaggcatcttaaccagaacaagctcaatccttcagatcatcaccttcgctgaaatactcctcttctgatgattaaatattgcaagaatgagcatatgacatactcaacaagccacacagcaagtatgcaagtgcacaaggataccaagggatggcataatataggctcatttgcaaaaacagcatttagcaaagatttaagagtagtaaaataatagagtaattaatcatcaatattaatcaacactgaacagcacacccatgccactcaggcccaaccaaacctgaacaaccaaccccggtcgtacagatcaaacctccaaaccaggaattatccattccaaaccaggagtcaaattaattatcacattattaacattgatgagtagtgtgaaactaatcacgaaaaacattgctcaactcacccataaccgcgggtacggctattcgaatagttttactctgatcagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcacccccttataaacaaggcatggactccccagcgacccccgtggacttctcgccgcttctcagtctggcgcactataatgaatcatgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaatcaattaacatcacacgattaaccatcgtgagctaccatttaatgtaaccataattaaaacaataaagtaacataatttataattaatccctttagttagctaatgtttctaaacatggctaagcaaacttacatatagcatttagctgaaccaa

SEQ ID NO: 26987 - DNA, 1501 bp, Oryza sativa
tttgtaagtgtaccaatagtgtactaagtgttgaaattgtattgtatgatggtttttaggggcatggctacatcgaaatgcgggacctatatgttttaagccattacatacttcatccattagagaggcattcatgtttatttttaatggtgttatcatattattcggtagatatgatatatttatactaattgtacatatgattgaaaaaagtgatgaacaccgggttatgttgtgtagatgaattttttagtgtattaataatgtatcatttgtttaagtggtgctaatacagattcatttattaaaagtcatctaactcttaaaacaattatagtaagtagtgatgacaaacaaccagtttatatacgaccaggataaagggatttttatttaaatctaagagacattcttatcacattagtagtatattaaaatctaccatctattttatggtaaatatattcctttttttattgtaggatgatctaaattctcttacactatatatatagtgattatatatatagtgatgtatgattccttttagcattctttttttaataacaaataagatgcctgtgcatctatgcaaaattcttttctgatttatattccggaaatgttctacaacttatattccgtcgttatagagtttgaaacacaaactataatacatgcccacgcgaatgcgcgggctacctttctcgttgaaaataaaaagcacttccaaagcatcttcttctaaagggctaatagcgttattccaacggatgtcacttatgacaagtatctaaggtatattggtaccgcagcacctatggtctattagaacttcactatgtcccttaggacaaagatgttaaactagataagacctaatgccaattgtaaaatcttaaaatatcttttctaccttaaaagctaaccaataaggtaagggctttctctcttatacattgtttttttatccttcaacaacaaatgtgggaccgttcaacataatccatcatcaaaattacaacctcaagattgctaatcggattttgggttgggaatagattcctctttatttttcagaaaaaaaatctaaaaattgactgacagtaataaaaagtgtgtccaccctactaccaacaattcaaaaaactagaaacaaatatctcatcctccgtttaaaaaaaaactaatttgcaaagatcaatttggacaaacaaataattatctggactcatattcctacaatttttttaatcgaaaggatatatatctgttgtgctctctctctcctcaattatagattctctctaggaacgtgatgatatagcagaaattgttttttagcctgctggcttgtacttcctgctttaccgacgttgcttctcggaagcacacacccagtcgacgacgacttgacttcatccttatcactaaaaacgccgcctgagtaatacaaagaggcgtaggcctgcctgactataattggctcgatgatcgactg

SEQ ID NO: 26988 - DNA, 711 bp, Oryza sativa
aggtgcggtgtccattgaccaaataccatatttatggagtgttttcctctaaaaatgagttcaggcggtatcccacggctaactccacgaagtcgaagcgtcctgtagcaaaatttacctcgaagtacacacttattatcactaaaaatgcacctggctaccttgcagatcatgcacttttctggtcagtcttttctaaggttgttcggtacaaacatatatatttagtgaatttattttgttgccacagtttatagggataattgaaactattgtttagatgctgtgttgggtactccaagttctcaacactcacctctccttttccacgcgcacgctttttaaactgctaaacagtgtgatttttgcaaaaaaaatttatatacaaaaattgctttaaaaaatcatattatcattttctttaaaaaaatagctaataattaattaatcacgcgctaattgatcacttcgtttttcgtgcgcactgtttgaagttaggaactgcatctgaacacagcctaaacaattctttcaccatctgatcgatgtcatctcgatccgagcatcaccccacagcaacagccactttcatttttttaaagttctattaaaacactatataaataatattatttatctcttcttcaccggtagtaatataccggtaatagatattatcaccagattttaattcttcgccactctcacaga

SEQ ID NO: 26989 - DNA, 1501 bp, Oryza sativa
tacctcgatttctgttagcatgttttttaaattgctaaacggcttttttcatgcgaaagttttataggtaaatgttgctttaaaataccaaataaattcatttttcaagtttaaaacaactaaaacttaattaatcatgatataataactctcattttacatgtatgtacttaatctgcatcttgggctagcttatctggggaattcggtaaggcatgcacagtggagaaaagaaactaccccagctacaaaagttaaatcaaacaataatgctatgcagcacctgtgggcgatgatgattctgaagcctactatttatccatgaacagtatcacggctgccatgttttcttcttttctggtgccacccactcctaaacagcacaaggaagaattaatattggcataacacttgctgtataaaactttgtccaccatatttcacagtggtacatttcactttatgccctgtgggcctctgtttggagctcaatattctgggttagtcgtagtagtaggaagacagaagctaagctgctagctgctaggatgaagcttggattacgatttgatttatgcaattgttgtcaatctgtcagtataaatggaggacaagcttaagcacactgtactagatgacacctcacaggtttctagctaggggaagttataatgtaaaataagcaagattgaacaaatgactctgtatggtaggcacgaatatataaacgcagaacatgcgaccagattgatcgggttaattagctcttcttgatggtgtggcctcgtgcatgggatgagctgataggtagtatatgttagggtttaggtggtagaaaaataaaaaatagttatccaaagaatagaaacaataaataggaagctaaatggccacatcatgccacaggcaaaaagatgaatgaaataaaattgtgcacaatcatcttactacagtttaaactcatgaatgaaataaaattgtgcacaatcatcttactaaaattgtgcacatcatgccttatttattctagttgtctacccatccatttcacaggttattatttattacaaatactataaatgttgttagaactacttctaatattccaagcgtcaaacatgcatcagcctaggcccaccccaccccacgtcccgtcatcccacttctactgttgtcggagtaaacgatttactcctatcgcgcgcctcaaccacccacatttattcgagtaaacgatttaattcaataataaaaacaactcccctgcttccgattccaccccacgtcccgcatcgtgctcctaccattatcggagtcaatgatttacttcgataaaaacaacttctctgcttccggtatatattctattttttctgtacccaaccaaccactctcgcgcccactttattttttttcctttttttcagaacccactttattttttttcctttttttcggatctgaattgatccaccatcccagcccacagatcggcgataca

SEQ ID NO: 26990 - DNA, 1501 bp, Oryza sativa
tctctttgttatgttgtgctaaaggttatttaagaaagagtgataaatgcaataggtatatgtgtttagcgtttatttttcaacctatgtgcttgttaagatgttgcattataaattgtatgaaatcatgaatttttattgttgattcaagcttaattgtaaaatctttgattcatggttatactttaatgcatgcttattatattatagatgggttcatcttcttttattgcaacacatgacatgatatgctatatgtatgttaagcttttatacattaatgaaataattcctatgctttatgaaatcattgtcaaaagggggagaaataatgtgaaaatttttagatcttttggagttgtcaaaagggggagaaataatgtgaaaatttttggatcttttggagaagagttaagttttagaagagaagagtttttaagaagagcatgtttttggttcaattgggaatttctttcttttaaaaaggggagaaggtttcttgtttttggttcaattgggaatttctttcttttaaaaagggggagtagttttcttttggatttttgagcacgatgtgtacgtttgtacgaagtgtgctttttaccgcttttgtttttaatgttccaaactccaaaacatttttaatgggtttgccaatgtgttcatcaagggggaaattgtaagatcaacgtgtgttttgatttttattctgtgatgaacaattggcatctgtgattattggttttgatactggagtttattcacgaagtggttttggagatgattggagttcacaggtgaatctacaggaaatcgctgttatttcatgtgaccggtcagaccgggaaggtgttgccggtcagaccggcggagatcgagcggtcggaccggccggcccgcggtctgaccggccgacgctgtgtcggtttcggtttcgggttgtttctttggatatctgtgattgtttcatggttatggcttctagatagatactatacgtatgtaatactgttgtttgctaacaatgagtcaagttggagatagcttggtctcagaatatggtttctttgtttgtttcatgtctaggtgactcgatgcctcgggagagtatttgcggtgatggaccgggagtcggcttggtggtaagacgatgtccgtggtggtcagatatcaagcgggatactaaggctagagttgatacacgtggttggtgaagattccatatggcatacgatggaggtattgtgtacgtatgggatgcggagtcgaatttgaaaggagtccaaatttggtacgattggttatgtaaagtttctttcttgtactagagggtttcctaaggtgtttaggactcttagtatgagtttggttcatggctttaggctgcctacctcatgtataaatagagggggagcgtgaggcttcccggattcgcttttgagagcaattgagttgagttttaagttagggtttcgagttagtcaaaatttttgtaaggagt

SEQ ID NO: 26991 - DNA, 298 bp, Oryza sativa
ctagaatgacttacattgtgaaacgaaggaagtattcatcaatgagcagcatgtcaagctatgtagaaatgtagactagaaaagatcatattttaaatctatgtagtaatgcaaaatacagaaaaaaaaaaggttttattatgccattacttgaagtctgaaatatccaacatacgtcatagttaatatcaaaaggggaaaaaaagatagaaacatcatacctttatctcatcaacaaatgctaagaagtttctttccatgtctcccaaaatcgagtcccactccactgaatttcaga

SEQ ID NO: 26992 - DNA, 1501 bp, Oryza sativa
tgcatatatacatatatatatatatatatatgcttatatattatgcatatatatattgtgacatatgtgtgtgtgtgtgcacacacacatatatatatatatacatatatatatatatatatatatatacatatatatatatacatatatatatatatgtgtgtgtgtgtgtgtatatatatatatatgtatgtgttatatatgcttatatattatgcatatatatattgtgacatatgtgtgtgtgtgtgcacacacacatatatatatatatatacatatatatatatacatatatatatatatatgtgtgtgtgtgtgtgtgtatatatatatatatgtatgtgtatatatgtatatatatatatatgcatatatatatgtgtgtatatatatatatatatatatatattttgtgtatttgataccatggtgcccgggcaccatggtgccccatatgagtgtcctatatatatatatatatatatatatatatatatatatatatatatatatatatatataatcaaccatgcagcaaacagggccatgcaaataaaaaaaaatagtgcaccaatctttagtcccggtttgtaacacaaaccgggactaaagatggctcggccggccacgtggctgaccgatctttagtcccggttattttacccgggactaaatatagctatctttagtcccagattcatagtcccggttggacaaccgggactaaagggggttaccaatcgggattacaaacggtttctccaccagtggtactatatatatatcatgtgtctaccattcactctgctttttattttactagcaaaaaaaatgcccatgcgttgcaacgggatcttttttatatatgtgtttcagatttttccaggattggtatggatgtttcttattataacccctagatttactttgggcagaacttctttttattttttagaacaaaggtagtattagagggaagtgattgtggattgtaaattggagacaacatgctagcggttcttgttacgactgagtagtgctcaatgcttctaggctaaggctgagttctagagcacgttttacaaagtgctaaacggtacgtttcggacaaaagttttctatatagaaatttctttttaaaaaatcaaatagttcatgtgttaatgactcgtctagtgaaaaaaaaatacttggtatccacgtttaacagttatacaaaattttatcttctacgtgcaaggctcttgcgcgtttgaaaaaaactcccgtgttctacctttgacaactgcttatcaacctttgataaatatattttgacatgagctgtcacgtttgcattgccatcagttgagtatgtagactctcatgcagaaatcccatcagcaggctgcaagcccattcttgttaggcccagccaatggtaccgattactttgctacaggatgacaattaccgcaccagatcgatttcaattaatcttatcgattcattttccagg

SEQ ID NO: 26993 - DNA, 1501 bp, Oryza sativa
catcgttcgccggcggcggcgaggccttcaggttaattgggctgctgtagatccggccccgctgtcgccagatctatgacggcgatgtctggaagcgtgttgcggaggcggtacggccggcggaggccgctgcggcgcgaggcggcgtggtggttgtggctcgtgggatgcatggctggcgcccgcgaggcgtcgctgctcgcgggcgcgaggtggcgtggcggttgcgactcgtgaggtggccggcggtgaccggcgctcgcggcgtgtcgcggcgcgaggtgactcgtgaggcagcaggcggcggcaaccggctccgggtcgacggcatgtcggcctgctgggggtgtgcgctggctggctgcccccagcgcccccccgcgcagcggaccgccgcgggcgccggttccttgctggctacctcctgtgtgttcctcgctatgccccctcgcagaacaaactgttgggggagaccatcctctccccactcccccgcagcgctcccctctctgcactggtggtgaagttgcaggtggtcgccacagccctatgttcagctcttagttcctctccgggccgaccatgcctctttggtgcctccccttcccttggctgtctacttccagatctggccgtggtctctttcggtgcttgaggagtttgttcgtccgtggtattggtcctgtttgtacgtagatagggctcttaggcctcaccggtgcttcacgtgcactgtggctttctgagcttgttgtggtgctgaggttggagcggtgtgcttacctccatggtgcgagagcttttgctcaagccctgcatgctcttccaggatcggcaatatcgacgtctgcgggtgccgattcctccttggaggtgttgccttatggactctctcccacctaggtgaaaacccattctgggcgggcgtcgacaatggcttatgtcgttgttcacattcttgaaagcttcgtcgtgttgatattcttgaaggcttcgtcttagggtcttgcttttccctcagcattctgtggttcgtaattgttttgcctcatgctttttgtgtcttctgtgtaagattttcgtaggtttcacttctgcaaaccgtgcagttatatggtttttaggcccgattttgcttataaataggattaactctatctttctaatatattcggcaataacttttgccacttgcacttgaaaaaaagtaaaaccgtggtgtgccccaaaaataattgatgaaaaaaaaaagagaaaaaaggatgagggtatgttgaggtagtgggctgcttagctcgccttcagcagcaacagaggctttgggcctttgtccaactagtgttgagcaacagtagttgcagctgcatagcagctcggcaaggtagaaagcagtaacacctgtagcggcaataataccacctcgcttagctaactagagtagcaccgattaatcccattttgaagctaggaagagggttagtgcacatgttatttaactaga

SEQ ID NO: 26994 - DNA, 372 bp, Oryza sativa
ggttcctccgccacgtcctcctgcaccatctcctctggctcctctgccacctcctcctgcaccatctcctccggctcctctggctcctccacctccaccatgtccgcctgcacctcccaagacaaggtctcgccaagctccaccgcctgcccgcacaaggacaacgaagaaggcgaaagttgacgccaccaaaaacaaggagccaccgtacgattgcagtcaagaggagcttgatgcttatgtgacaggagaagtgaagaggcaactcaagcctcggagtcataaaaagaagatacctattgacccgagcatgaagaacttcttcaagggaatgtccgcaacaaacaaggaggccttacagatatcggacta

SEQ ID NO: 26995 - DNA, 1501 bp, Oryza sativa
gttggaaataaaatctaacataatatcagttcgaagtatacaaccctaaactataacttgagaacgataaaagtctcattttctaatatattttctgtttctgatttagaaaaacttttactgctaaaccataaattcatactgcaatactatatacttacaattaaatcaatatttcaacatattcagttcatttagttagatgatgtagtcgtattagccatatttttaatagaaaatatcttcaattaatatatcctaaaattcataaaaacatatatagtatacaaaagaaaaattgttactcatagtttagaatgtgcaaaaataagatatgctaaatattaaaaaaaagaagtgcattttgtagaagtgatatatagtttcacatatatatttttcttataaaacctaatttgcatggttttaaataattttagtttagaatttatacaccagcgatggttactagcattcagagaaacaccacacaaattattgaaaaattaaacatgtttaaaatagagtaatcataaacattcctaatcaaatttctagcacagttaaataagatgcccgcgcatacgcgggctatctttctagttttagaaattattcgtaatcaaaattcaaataagtttaacatagtctcgtccaaaataacaactatttttcaacacggagagagtacactgttaaatctttaaggaaaagtctagctaaacttctggcttaacatcgttagctgcagtcttagctattctaattctaatggtagtagcagtttgacacatcaaacctttttatgtagcaacaaactctcgagtgtgacatccccgcaatgctcgaacacattcgagatccatggaaattctgaatcgatcaagcaactccatctcctagctaggcctaccagccaccaaaccgatcgacctccctctccgatcatatcccttttcatggcttttcatgcagctcttttgagtcgatcatatcagtgctctcttgacagcttgcacacagttaagcaccagctgttggcaactgcaccatgcatggatcgatgctaggctcgatcgaaaatccgttttacttttaataggcatccggcgatcgatggagacgagtggtggagaaaatggcggatgacatggacagctgctgagggcctctcctattcctacgacgacgccagggccagccctccaccgtcgcctccgacctcgcgacctggcgagccagagagcccccgtcgccgctgccgccgcggctgccgccatgacctccaccaccaccatcaccaccaccaacaccaccaccaccaccaccaacaacaacaacaaccccgtctccaccaccaccaccaccactgcctcccaccaacgccagagccttcccgtcgccgcccgtcctccgcactccagcggcagcggcagcggcagcggcggctcgcatcgcggcgccagcggcggagggagcggaggaggtggtggtggtggag

SEQ ID NO: 26996 - DNA, 906 bp, Oryza sativa
ggcccacggcaccccgacgccgctgccaccgtgccgtcacgccgctgccgcgccatttccgcgcgcgcccaacattgccgaacatgaacgaacatgattgaaacgtgaccgaacgtgaacgaacgcgaacaaacatgaatgaacgcgaacgaacgtgaacgatacatggatgaccgtgaacgaacgcttaacgaacacgaacgaacttgaacgaaatgttaacaaacgcgaacgagcgtgaacgaatgtgaacgaagcgcttacgaacgtgaatgcacttgtactaaaagtgtgagaacggacgcgtttagactaatacattttcctggtaatacatatatgattatatatatgtaacttggcccgtttagaataatacattttcttggtaatgttgcagagaagacgtcgttgtcgtccctcaagcggaagtggtacttagccatcgaaggaattcgagcacacaagtgacgtaaagaagtgattgttagagatttaatataagattgttagacttagcatatatgattattacaattttaatataagattagtagcgatttaatataagattgttagatattcaatataagattgttagacttagcatatatatatatgattattacaattttaatataagaatagtagtgatttaatatgagattagtagagatttaatataagattagtagcgatttaatataagactgttatacttagcatatatatatatatatatatatatatatatatatatatatatatatatatatatatatatatatgattattacaattttaatatgagattagtagagatttaatataagattagtagagttttaatattacggttagcaaatatgacctatagacctaacaaatattttttgtatgcacaga

SEQ ID NO: 26997 - DNA, 1501 bp, Oryza sativa
tatttggcagtaggataattacaatgccagatatattcacacccgtaccatattattattagcaaaaatacaaaaagaatctaatcctgatatcaaattgttcccttgaacactcgactgaattttcaaaattctctacatcatctccaagaaaattccgaatgcatacctccttcacatatgcatacggacgagacgatgatgacggaacaattagaacgaagaaacacctaatcctagtctgcaatgcgacgactcggccatttgagtcgcatcacctgctatgatcttgccattgtccagctccggcagctcctctttaacaccaatgtcgccgttcacgtccaccaccgtcttgacaacgtcgacgatgtcggcgttcacgtccaccattgtcttgataatgtcgatgttgctgttctcgtccaccattgtcttgacatcgatgtcggcgttcatatccaccatttccttgacctcgatgtccgtgttcacgtccaccgtctgcacttgctcctcctcctgccgaaggtcgaacacatcgacgagtgacggtcccgactttatctcgaaccccttatcatcaatctggttgtgctcatccacccctaccggcatttggtgatcggatgtgagctcaaccttgtgttcagcatcatagttggtgtcgaaatcaaaatgctgcattccatcgacattgatgtcgagatgcggcttgctactgacgtcgtcaccggcggtcgagtcgtagtagaagtaatcgtaaagctgctgtggttgaccgtgatggtgttcacgctgactctcgtcctgattatgatggccgtcggcgtgtaggatcgcagcatcggcttcttgattggcatagagcgcatcaacgacctcatgctccgcactgagtaggagaggctggtttgacgaggtgacatcgagatcggcgcacgcgtcgtccaacacgcctgccggcagcgcagcggcgacgctaccggacgcgccagcggcagccgcctgacgacacatcgccagatggtggagtacggtgttgagttcggccgtgtcgagctcgagctggcgctcgagatcgcagatgacgcggcaacacccgccgacggggtcgtgggcccgcatctcggcctggtagatgagcgtgcgcatggcgtcgtcgcacagctcgggcttgaggtggcggagcgtcttgaggatgttgctgacgccgaagaggcggtgcgcgttgaggaagcggcgctgctggtcggcggggaagtagggcgccatcgggcagtccgggttgcacttgcgccgctggtacttgcacgccgcgcatgcctgattcgtccctccccctccacctccaccaccacctccaccaccaccacctcctccgctccctccgccgctggcgccgcgatgcgagccgccgctgccgctgccgctgccgctggagtgcggaggacgggcggcgacgggaaggctctggcgttggtgggaggcagtggtggtg

SEQ ID NO: 26998 - DNA, 1501 bp, Oryza sativa
atccaaaaacctcataaaaaattagtcatgtaatttaaattcgagctattcaaataaaaatatcattgtttttattcgtatatgcttttacttgtatagcatgtgacatcagcgatccagaagtttcatagggcatgtcttatagtccctccattagttttttaatagataatgttgttgacttttaaatacatgtttgatcatttgtcttattcaaaagttttaaagcatccatgcctagatccagtagcttgaaaactggttggcgtcggatgcagccccaggagtgaaggtttgccggatctggggcatccgtggctagatccggcatcttgtcggctcagttggtgatgatgggtgatgatggacgctccatttatttttggagggtgtcggtggctgcggtgtaggaaagtaggtcaccttgacacactacgttgggctagggcagctgtaaacacacctgtgagcgagcacaactgacagtgggactgctttaacattggcagctcggtggaggctatggtgaaagcctagacggcaatgcctgtgggcgccgttctcttcttggaggtgacatttttgtctcctcgtcatgctgtgtttcgattcttcgaatgaaaacctagctcaaggccagcaatgacgacgtggtttggcatggtgtccttcttgaaggcatcatcgagaaaatccttcatatctttgctagtgtgggagtcttcctttcttctagcttgttgcatggccttgccgtttatgtgttgagcatcgtttgttgactgtccttttccgttgctatgttgtttaggttagttgaagactttgttggagttgtgattttcactcagttttttctaattaactatgtgctgtaaaattcagttccctttttttcttaaaataggatacattcttctttatttaaaacatcgggaatgggttgaccgttcgaaaaagaatttataattgatgatcaggaaggtgcagattgaagacgtatttcattatcccctatcccacaaaagcttgatgaggcacgatcctaaacatgcatatatgttgtcatatccctattatcataaatatatgtttcctttcactagggttatgggcttgtgtcaaagcagaccttaggaagattcaaatacattattgttctcgtctctcccaactaagactcaatacctaacgagatctcattttaattaggttccttttgtagtttcccagagaagttggtatatagaattgttcttgccattcctaatattttacctgattttttattgtaaatttgcgtacagatatattgaaaagtacaattgaatttgatatgcaatttttgctatgtgtaattatattttgttcacacagctatatggctatttgctccattataatcttgatacaccacaatataacggtgcccatatttctattttttaacaaaaaatatttttcttattttacacctctaagctatttcattggagcactt

SEQ ID NO: 26999 - DNA, 1501 bp, Oryza sativa
gcacgcatatatgtctaaattcgttagcatatatataaatttaggcaatgctagaaagttttataatatgaaacggagaaagtattaaattagaaacccgagatgataacatacgattttttaaagtcctaaggcaacattatagctatttaacaaattgtaagtaaaatcgtttgtaaaaaatagataacttcgtataggtgctagccacgcaattgcgcgagcaacccagctagttaattattataagttaaaaataagtttatttgattcttaaaagaaacatctatattaaaaaaagagcaaatttcacgaaactatatgtattttgatcaatctatcataaatagatttaagatattgtataaaaagaaactacaaattaacatcagttttaccacaaaagtacaatttttgttacctcaataatgctatggatataaactctaaaatttgtagttctttaataacttcatcacaaattaaagttgtagacttgtgatacaatgctttagatatgtggttgtatcataaatttgatgataaatttgtagttaaatctatagttttacgatagtttggttaaagttcctatagttttctgaaatttacttaagagaaacattgtttagcattttgggaagcgtgtgtgctaacgaaaatcaagcaagctgccaatacgggaccttagttttggttgggctgaactaaatggatatgcccttataaattgatagttgtttattctctcacagtgccatataattaatggatatctcaattatttcaagtccttaaattaatagctgatctatggtgtattctgttcctcttatctccttaagctacatcataattaatctaaggaacaaaattgaatagaacacgtaaagccaaacccattcaccacgtttaccattttgtcatttaacttaagtcacacgcataggatttcgatctagtgacatattataaccgtgcaatttgagaaaagaaatcgacttgtgcttgtaccagagtcagaagctgccgaggacaaagctcttgtcactaatcatgaagctgccgttcatcttcacctgccaggttcgaaaactctcctgtcactggtcatgaagtagccacatacgccatctaattgtccattattaattattgtacttaattatgcagtaatgcttctgtaactaattccagctgatacttgccagtactatcttccttcaattcgttgtttaatagatatatagcatcgttaatttttaaagttacctccttcattccaagataaattaatctaatataaaatatgacacatcttaatttacgaatttggacacatataatagtaagttaatttattttaagaggaggaagtacatcaaccattaatattattaaaattgtccaaatagaaaagaaatgtgctttaaatatatttaatgataaaccaagttaataaatagtacgtactattttaaatcagacgaacagtagttgt

SEQ ID NO: 27000 - DNA, 1501 bp, Oryza sativa
ttttcaagcattctgaacataacgaatagaagtgcagacattaaggctttggacctttcgtactgaattggttatgcagtcaatttgaatatgatgcaaatacagaagggaagtaaataccttggctttaaactgctactccctccggtttcattttaattgacgctttggacaatgacatgctctacaagatatacctttgaccttatttttctattataatatatacaataaataaatgcatgtttacttttattatagtgttttcaaagacaaatctatatatgtttttctagtttctttaaactaaatatttttaaagttattgatggtcaaagttataaaagtttaacctcaaccttgtcgaaaacgtcaattattatagaaccagagggaagtaacccatatgggcacaaaaatagaaacattaattagagttcaaatgagagtaagaaatgacagataggcatagcatgtccttcttactattgttacatgtaatcaaggggtgatgggcatattcacagtggtttagctgtagttagttggctgatgagtccataaatctaagtagtactcgaagtttgctgcctctgcattgaatagcacttaatggtatgggtgagctctcttgaatgcatgcacacagtggcactcccaatctcacagtgctgcatctgtctacataaacgattggaatgcatttgggcaagactgtgaggcagaacagaaatcagagaactgaggacagaaggcaagtaggaagaatctgagctgtctgaatggaagggaaaaacaactagggggagaaaaggaaaggattatccaagctttcgtgtatcatccgagtgtcccttgtatgcaatgggtttgatcaatagaggggtcttcttcaagatcttggccttcctctgcttcatcagatcatctcaaggtacattcaatctatttcagttcatatgttccttaagcgtcagcatgaatcattttccttcgacttcctttccactaaaacgaattcagtaggattttatgatggtcaaaggctggtttctcagagatgctggaatttgatcactcaaatttcaataagctgcttctatcaaccatagctttcatcatgacattttcatatttttatagcaaaaatggagttcagaattttggctgacactcagaatcataaccatgccatttgcaaccaactcctgtttatattactctctgatttcactatttttcgttggccagaaatcttaggtatagagcgatgcaataagaaatttgcaggaagaggagagggcgaaaaagacataccttataatctcggcctgtagtgaatattcagaagaaacctgatgaatggcaatgcagcatttagcttaaaccgattgagattttcttatgtataaagatataaaaggaagtgataaaaaccgtacctgaaactgggtagcttcagataaaacatgaatacttgtatttgcaggaagaaatcatt

SEQ ID NO: 27001 - DNA, 278 bp, Oryza sativa
gaattcctgcagccccacttaatgggccgaaataaggggattggatagagatctaatatgagtttaattcggatagggatccaaatagtagtcctacgggccttggaggcccgagtgatggatcctatatattcgtgagaggtgtgaccggtggaggtattgcatcatgtgagaaaccctagccgtcacttccctacccgagcaaaaccctagccgcgcgcgggtgctagcacatctgcacgtggcgttccgtccctgtacgtgtggatactggtaga

SEQ ID NO: 27002 - DNA, 1501 bp, Oryza sativa
cccttttagacgtgcaaaagacaagttcatccagaataaggaggagaaagatggcccacctattcatcgatcatcttcagaagtgtatgattgtgttaaatctctccctaaattacatttggtaccaaggcaggaaatcaagagattgagggttttggaaaggagcataattgggtaaaaagatctatcttttgagagttgccttactggcgtgagttgttagtacggcacaaccttgatgtgatgcacattgaaaagaatgtgtttgacaatatatggaatactttgatggatatcccaaagaggactaaagataatgtcaaggctcgatttgattagccaatatatgcaatcacaaagaacttcatatgcaacaaaaatctataggtcgatgggtgaaaccaaaagcttgttatagtctagataaggcacagaagaaattggtactgcaatgggttaagaatcttaaattccctgatggttatgcatcaaatttagcacggggtgttgatattaatcgaggcaagatcataggaatgaagagtcatgattgccatgtcttcatggaaaggttgctacctgtggcatttcgtgatttcctccccaagcacatctggaagtgtttagcagaactgagctacttctttaggcaactatgtgcaaaagaggtggatatagaacaaatgaagcacctacaaaaggaagtgccagtcattgtgtgtaaacttgaacaaatttttcctcctggattttttgattgtatggaacacttggtggtgcatctagcttatgaagctttaattggagggcctgtagcttaccgctggatgtatgtatttgaaaggtatgtttctttggttaagtactaaagtgtgaatttgtatattaatttcataattatgttttctgctcaattcatagggagttacatgaggctcgcaagagggttcgaaacaaagcacgtgtcgaaggttcaattgtagaggggtatagggtacaggaggtctctaattttatttctatgtactttgctgatcatgtgcgaacaaagcacactcgcgtccctagacatgatgatggtggtttcagagcacctactgactggctgtctatattctctatcccatatcgcactcttggaaagagcacatcacgtaacttatcaagagaagaatggcaggctgctagggtatatgcattactcaattgtgcagaagttgacaaatatgtcttgtaagtatatattattctgttttcctattttattacttgggctctatttttgtgaatatgacatattacatttatgttattgcaataaatgtcaggaaatttgatagggagatgaaacaacaaaacaggaacatcactacaactcaattacaagagatgcatgagaaagattttccaacctggcttcgtgagttggtaagaatacatgatgtaatatctgatggattattatttattttaatgcatgattcatgaaaattgattctac

SEQ ID NO: 27003 - DNA, 785 bp, Oryza sativa
aacaactaacaaagttatatctgatttttaattttttgaactattattttataagtagataagtaaataatttatgatccatattacacatatttttactatataaaaaaattaaattgcaccattttaacacacacatatccttctatatggcaaacaaataacatctggttttcaatttgcttgaactattattttatttgtaattaagtaagtaaatcacaaccaaatttcgcaaatcatatattggatttggagttgaagccgaagcggatttggaaggagttcgttgttctcaaaatcagagtacgcatcggctaccgtctgcatcggctgataccgagttggatagggagaagccgattgttgatatttcttaacgacattaccagaaatataattcccagcaatggcggagaaatactcctggtatattatggttacaaagttcatccgcaagcgcacgaatataccattgtaccatttcacctgagagtattccaagggtatcgtatttattttatcccgtgggaagatcatatagagagaacctgactaataatttatatgttacttgtgaaaatcaaagtctaagtaggggttaagataatccaagggtagagtcacacacaagcagtagctacttattctcatactaaatttcctagctaagtggaaagaaaagagaaagagaatctattcttatacttctagtacacatagtatacatacattctagttatatgatatactagctaataccctctattcgatgccctcctagt

SEQ ID NO: 27004 - DNA, 450 bp, Oryza sativa
aggataaaatttgataaacatttaaacaaaatgttaattatttagcatgctatcgatttaatatggatattattatcattgcatatgaaaacatgcttatggaactatttatggctatatgctaagaattgttgacaccgcatatgagcgggtggaacacatgatagagttcatgtgtttggtttcatggacctgtttatggtcataatgggtatatcgatatatttatggttatttcttatttaaaattgatataataattaacccccttgtgtcaagaagaatgacatagtttcgcccatccacacaatcgatttgtcgaacctggccgtatattgctccaattgattaaacttctgcatgcctttcggtgtattggccattagctttcaagtgtgtgaagcaaagtgacatgtttcatgtttatatgatttatatatgtgggctcga

SEQ ID NO: 27005 - DNA, 734 bp, Oryza sativa
catcaagctagctttctttttcttaatttagctatgcatgcttacaaaaaaatgtatgatggtaaaatatgtgttgttaaatcattttataatttttatggcaatttggatgacatgtaaaaggacaatggagtgtgtcccttcgaattttttatgcagtggctaggactattcatatttgggatttttttttctttggtattatatatctaatgtagttttgcatgtttgctaaacaatatatgattggatagcacatcaggggggaggtggagttgaccttatttttatattttttataaatgagttaagtgaaagctgatgtttatatgttgtttttctcagatttgcaagatttttttcctaatttttaatatgtggcttgtcgtggcttaagctttcctctaaaagtaattttaacggttgaaaataatattaataggtcattgatttatgtagaaactgatggttagatgttttgaattttcttttaatttcaataatttttctaatttttaaaatgtcatacgtagtgacttaatggctttgtattttctttaaattttacaatgtagaatgatttaagatgatgtaatatatattaccaattttttaatgttccattgttgttcggtatatgtttgaattacgtattttaaattttatatagtaaaatagagtaattgttgatgcaaaaaacacatactggcataagagattcgctttactctagt

SEQ ID NO: 27006 - DNA, 1501 bp, Oryza sativa
ggttatggttctaagcacgactggggctgatgcagcgcaaagtatgaaaataaacataatatgtagacaatcaagcccttgactgaatttcagggtggtagacaccttagttaatctaatctggtaaagcaatttagccgatatcggcataaaccctaaaacgaatcttagctgatacaaataaattgaactaacaaactagattaactaagatatatgatagataggtacttacattgacaagattagagtgtcgaagccctaaccctgccgatgcaaataaccatgacaagtataaactcgttgaacaatagaaaagtaaaaagggtggtgttgtgccgaaattgtattagattgtccatccgattataatgctatggggttcatatttatgcctgagtacaaacttagtccattatggactcgattcaaattttcctaaaaataagatacaaacaagactacacggtggtctcttgccaaatctctaacaaaactgacttaaatatcctaattattagatacaattaccttattcgagttctatctctaattggcaacgacggttatcttaatctaggtgcaaaccgagcccaagttataccgtatcggctgtattggctatcaaccttatcaactgttatcgacttaagctcagtttgcagccgatacagtgtctagccgatgcggagtccgacttcaaaaccaacttgatcttgcaccaaatccgcttcgatcttgttccttcttctccgagtttgatacaaaattccattgttaacaacactacaacaaattctcatcgtcttattattttttccattattcaaacttgtatattatgtcatactgtcttaattggactatgcgctgcaataaacttgtattgtaataattgaactccagatgacattgccagagaagcgcaatctggtatatatcttgttgtgtagagcataattttattgcaaatgctacaacaaaaatcatgtggatgcaaaccttgcttgcagttaggaattataagtcctcaggcaaccaatatttggtgtgacaatctaggtgctaactacttatcaacaaatccaattttccatgcaaaaaaaaacattgaggttgactatcacttcatcagagaacgggtaagtcataaacttttacaaattgattttgtttcatctagtgatcaagttgcagatggttttactaagccattgtcagttagacttctggataatttgaagaacaacctgaacctagctcagtcacgattaagtgttagataagatcattggtcacacctgataatagcagaacatatagatcattggtcgcctttcctgattttgtggtcctaccgattctatcagcgcatatctctgtaagacacaataggtgttgttcctatctatattaacacaaaggcgatgcgcgggattggtgcgatcgtttccatccagaaaactcacatggtatcagagtgtcgatccatctagggcga

SEQ ID NO: 27007 - DNA, 1246 bp, Oryza sativa
ggttgggcctatacaacagggtatgttgtatagcgttggattaatattgtttatttattacttaactgttttattaaattctgaaatgtttattaaatgctgtttgtgcaaatgaaaccctactatgccatcctttgttatcctgtgcacttgcatatttgctgcgtggcttgctgagtatgtcatatactcaccatgcaatcattcatcagaggaagagttctacaatgatgctgatggtgtggaggattaggtgtagccctggtcaagctgcctgtggagtggagccgtctgcgccgtttatcttattttccgctgcttagatctttattgattgagaggaactatctacctctgtaatgacattttattcgcttattaactagagtaataattgtactctattatcaatttgttattgtgtgcctcggctgattcctggacgagggttcacacacatgtaagcgtttggaattttggatagaaattccgggcgtgacagcatgcacactcacccctatgaacgtacacacgcacattctacgtggaggagtacctcctaataactggattggtatatcttgagattgacgaagtcgcacattctaccagaaggagtacctccgaatgactgggcaagtatatcttgagattgacgaagtcaccacaggtgtctcgctgccaacatgtacgttgcctacccctaaaaaaataattagccgtaaatgtgagcaccatattaaatgtaggatttgaacttgggtggactggctccattacaaagaatctaaccaattgagctacgcttactttaaaaaaaaagatttctttgactggctccattaaaaaacctaatcaattgagttatgctcactttgaaaaactagttatttgtaaatgttagacattactacattttaattatataaaagtgctataaatatgtactgtaataggtattttcatcaaaataacatcgaatcaacagtttagagctctccaagagccctgtcaaatattggtctatttcgtaccgaggcaaaatattgatcttcattttgcctatttcgcaagatcgaaaaataaagtgaaccctctttgtttcaacagtcattcaacctcccactctccaatttcttgggtcccacttgttagtgtcttagtgtttttcttttctcttgtttttcccacccacccgtatgctggcgatcattatctaaaaaaaaaaaaacccgtatgctggcga

SEQ ID NO: 27008 - DNA, 1501 bp, Oryza sativa
ggtataatgtctccccactcttcaaaaatctgaccaaatcaagtcccttggctgtttggatagcggtttcatcctatgtgacgctcatgggatccactgtcagtgataaaaaaataaaaaaaataacgcccccacataacggacttcatatatagttgagaacttgtgagtacaactccccaacagagattggttcaacccgtgcgcacatagctgaaacaacttcattgtatccttcaccaagttgagttacgatatactggattagatcttcttcgtcatgtggacaaccgctagccatcgtcatctcctcggcaagggactccatcttcgcaaagtactctgggactgatagggggttcccttcatggtgttcatgagcgcaattctggtgttgattgatcgtgcccgggtgtaagttgagtacatcacttcaatcacacctgatgctttagtcattatctcacacgtcgcaacttgcatatggacatcccttgatagggacgagagcaagtaacccatgacctattgattggtcttcttctccgtcttgccatcggtggtgacggagacctcaacaatagctaggtttcttgctggcattaatgagatgcccttggagtcaagctccttggacagcagtgatgatctgcaccttctagaacacatgattcgccttcccttatttctttgaaacacagtggccttgaagcggattggtggccattgtgtttgaggatgacgacaccatgaggatcgccctagatggatcgacactctgataccatgtgagttttctggatggaaacgatcgcaccaatcccgcgcatcgcctttgtgttaatatagataggaacaacacctattgtgtcttacagagatatgcgctgatagaatcggtaggaccacaaaatcaggaaaggcgaccaatgatctatatgttctgctattatcaggtgtgaccaatgatcttatctaacacttaatcgtgactgagctaggttcaggttgttcttcaaattatccagaagtctaactgacaatggcttagtaaaaccatctgcaacttgatcactagatgaaacaaaatcaatttgtaaaagtttatgacttacccgttctctgatgaagtgatagtcaacctcaatgtttttttttgcatggaaaattggatttgttgataagtagttagcacctagattgtcacaccaaatattggttgcctgaggacttataattcctaactgcaagcaaggtttgcatccacatgatttttgttgtagcatttgcaataaaattatgctctacacaacaagatatataccagattgcgcttctctggcaatgtcatctggagttcaattattacaatacaagtttattgcagcgcatagtccaattaagacagtatgacataatatacaagtttgaataatggaaaaaataataagacgatgagaatttgttgtagtgttgttaacaatggaattttgtatcaaac

SEQ ID NO: 27009 - DNA, 1501 bp, Oryza sativa
agcacccacgcgcggccgccgcatccagactttccaagaagccaaactctgaggtgccattttttcttagacaacatgaccagcctcatcgttcctctctcctccatgttgaccaagcacatggagccgtcgtcggtgtcgccgacggcgtacgacgggcccaggaggaccccgggcggaggcacgacttcggggaaccccatggtttcggcgtccagggagacaagactgttaggagagccgccgcgtagcctcttccagcagatgcgacctggcgcgtgcatggctgaataacgtttcactttgagaggcagcggcatgtcgatgtcgctggtgttggtccacgggcgagcgctccacgcacccgtggaggagtcgtacacagccagtcgctccatgtccagccgttgatctcctcccgaggcgtatattactgtcgtactacatctctgcatggtgaccacacggaacgacgacgacgacgctgcctgatcgccgacgcggccagggatcaagaagctgccggagttgtgatgaaatgcccgcttgttgccatgccgcggtggggtgagcttcgccaggacacggcgggctacagggtcgaaaacggtgagctctcgttggtgtcgcaattcctcagtaggaggcggccttggtggcagtcttcaacttcaaggcggcccatggacgtgacgggagtgaggaagaaatcgccatgtcggacgaccgcggatagttcggggtcggagaaggtgggctgcgctggttggaacaccggccgcgaagagcattcagtgtagtagtagtggccgaggagaggttgggcttggccggggtggagggcgtggaagcggcggaggaaggcgggggacgaggccacccggcgccaccgcttcacagcgcaggcggcgcgagccagcgacgggactgacggcagccgcacgaggaactccgcgatgacatcgtcgcagaacgagtcgacggttgtgggcgatgcggccggcggtggatcaccggaaaaactggagggtgatgccttgcgcttcatgcctcaatacacggtgcgtagtacggcatgacacaactcggtcgatcagatcgctctgggactcaggaaaacttgacttcatatatactataaatattcttccttgcagagaaagagttcgttctggattggaacagagctctcgtatctatcgaaactactaaaaaatattggagatatatggaaaactcaatttatcccttaagaggatatcccatcatttttcatgtcaactaaaaagtcataaaaaaaatttagtagaatagatcaatatgtgatattgtcacttcacaaatatgcaaattcaaattcaacttatacaagtagaaacaaaaataaaaaatttactatgaaaaaaaaatcagtagaatagatcaatatgtgatatgtcacttcacaaacatacaaattcaaattcaacttatacaagtagaaacaaaaataacaaattta

SEQ ID NO: 27010 - DNA, 1258 bp, Oryza sativa
gtgtgagactaatcacaaaagacattgttagacccgcccataaccgcgggcacggctattcgaatagttttactctgatcagagatgtaccactgtacccacaagacacagccctacatcatgtcaccatgtgcctcaataccaccacggtacctcggaaaggagctgtgacaataccccttgcataacacaatccaccgcagcgcaccattcctggattataaatcacccccttataaacaaggcatggactccccagcgacccccgtgggcttatctccgccacttctcagtctggtactccgcaataaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaggttttaattggctagtaattaattaaccaatcacgattgaccatcgtgaactatcattaagccatcattaattaatagtgaatcataagttatcccaatagtgtgctaatgtttctaagcatggctaagcaatcacatataatatctagctgaaccaatatgtatagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacaggatcaacatgctcaaagggttgtttgggatctgtgtgacttgccttgctggccttagaactcttcaaattcttctcctgcgaaaacggactctccggaaacgtcggaatctaaacagaaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagattaaatcggattaaaacacttatatggattttaattgaattatgacgcaataatgaattatttttgaaaaggaaaagagatttattgcgtcagcggctagggtttgcggtggaccgggtgcacggcagcggttcacgggaacgaacggccgagatcgatccatccaaaacggacggccgagatcgatcgggtctacggcggctcacggagacacgacgacga

SEQ ID NO: 27011 - DNA, 316 bp, Oryza sativa
agaactaagtaaaaaacaggtttagtaaaaccataaagaagagggttcgaaccttggtcactgtaacgccacctttcaaatacctaccactgagctaagccaaacctaattgttgcttttgcttttgcttttatttagccagtataaaggccagcgccgctgtagaacatatattctgatatttatatttatatatatatatttaaaaaacagagagcatcattaatcatttatatgtactaatgtacgcacgtagattgaagatttgaagaaaaaaaaagaacgaacaaggctgccgtgatagggagtcgaacca

SEQ ID NO: 27012 - DNA, 174 bp, Oryza sativa
ttttgtggtatcgtttgtgtctaggctcgcgtctctagtacgttctagcctaggaccagcacggtacttgactttgaaccattattcaactttgcattctctcatttgagcatttgcattctctcatttgagcatttgctatccctttgctacatatttaagcctacccagagc

SEQ ID NO: 27013 - DNA, 180 bp, Oryza sativa
cgttgtggagcacttcccatacgcatatatattcctgaaggagttgtattgtcacccctccgcggatgtcttcgatccaagcatcattggttattgcctcaagaaccgacctgtttttccttttggagtgcttgaagaggtttggggctaagtatttcagcggctggtctcctatccagt

SEQ ID NO: 27014 - DNA, 279 bp, Oryza sativa
aattcggcttactggatccttgaaataaatgaaacaagggtttgttgaaaaatagttctaacttcggaccaatagaaacctgttacctaacttctcatatacaacttatttctccatgctttagttgcttaagagctctgcagaatggtgattccgaggagttccatgtgaagctttctaactccaagatggtatttaatttcatctgtggttcacttccctctgttggatttattgtgaatctagcttctaatacttattattttatccccttttagg

SEQ ID NO: 27015 - DNA, 457 bp, Oryza sativa
  unsure (1)..(457): unsure at all n locations
acacattttgcagctacttgcacattccatgacttatgctatgtgtaccattaccccgactcatcttgcctacctattcctaacccaatttaacgtttattttatccgcatccgttcctntttgtcaaatgtctactccaacatgacagcattaatgttcactcgtaaatttctgcgtggaacttccaataaagaatactgctgagggctgaaaggaggtgctcaggcattctctttcatgcatgcctgctagtaatgctcatacctttggtgttgggatgctcctgattttcatgtactcttgtttatttatgcatcttctcacttgccacttgccagacacccagcagtatgcttcgcgtttaaccagatatgcaaacatccttttcaattgctttgaagtggaatattttacattctgtatgacgataaacaagaggttcattgtctctgcagg

SEQ ID NO: 27016 - DNA, 569 bp, Oryza sativa
aagttcctagactctcctcttctttgatctagcctcagagcctctaaccatgtaatagtgacgcagatggttacatgaggttcctaccctctgttctcatatcatacattcgtacccaacaaattaagtactagtagtactggttttaaatgatcagtccatgtagcctttccagtacacatttagttcttaatcggccttgtctttttaatatttgttgataagtcatcttttaatattagtgtcccgttggggacaaaagagctctatagttctagagaatttgccctgtttcctataaaatccatgtaaaacaaataggactaaagttgcccatagaattgttatcatagctttgaaactgggaatcgctcgaaccagcaagcccactggttcactggtttcgattggtggttcctatataataatattatagtggtttggaaaaataaaacctaaagtaagctgcctttgttgataatattacacatattggtttatatatattgcttatatgttgtgaattatctgtgatccatgaagttcatgtcctgcctttacactccagc

SEQ ID NO: 27017 - DNA, 229 bp, Oryza sativa
ggtaagtaccaaaatggtatccattggtgcataataaaaggtttgtttttgtcgaagggcgaattgttttctaaatggtgaatggctgacaaaacttcattgcaagttatttaatctggtgaattaatgtttccgcggctatttctttgcaagtagacattttcccgtcagataaactttacatatatataagcaaatgaatagatgattgtggttatgtttttgcagg

SEQ ID NO: 27018 - DNA, 604 bp, Oryza sativa
gtatttggatttagatctttatagacataagaattttgagattagctattgttgaagctacacctggtcgtgtggttgatgtcgtcgtagacttgtagttctatggtacttaaggggagtcagtttgatgtatgttctggtactggcagggcaatctagatatgaccctgtgacaggctaaattctaatgttcaatgtttgataacaataccagtttctaggtttcgttaatcattgatatttgtttggagtaaattccccaggcatatactacaagtaacaagtatgtaatgactctctagacctaggcccttgatattataatctgccttcataattgaataataaaactctgtaaattatccaaacatactctgttagccatgaaccaaatatcactgcaagaaatgtatatgtggattaattttttaaaaaaaacattcaaagaatttatgcatagctgatgtattctttaccttttctgatggtgcttgatttcatccctgatttattcttggttttcctgtatatgatatttgcttggttgaattggtgagtcttaagctttactggatctaacatgatttgctttcgtgtacaccag

SEQ ID NO: 27019 - DNA, 154 bp, Oryza sativa
ttttgtgtgagagagttccacccaactctactcccatttaagctgaactctgaaaaaggtggagctgaagttggaactgtaccaaacaggcctgtagtataaactgatcgacatctgtgacaagtcgatacatatacaagggcggaagcaggaa

SEQ ID NO: 27020 - DNA, 1501 bp, Oryza sativa
tgggcctggaggatttctgcccattaacttcgccgtcgccacctatgcggtgatcggggtttttgtttatttcctctcttttttggcagagtgactagtacattttttttagataatggaatgaacatttcggcctttgctcatcaaaactacagccaattattataatgtatcactcaaacgaagagtgtagttcataatgaaattaaacacacccaacaaaataaaagaccaaacagagataaggagtacacatttattcaagtctatttgtaaatctccatccatagtttgcaaaaagttgcataactgtcgtctcaagcctgcgacatgcaaccttcataagctctccatcatcttcatacttttgcagctgtgcctaacaccggagccaatatgttgccctgaaaattacctgcaaatatgagatagatggtgatttgtcaaatattatatcattcctactcaaccacagagtccaacatatggcagatgctcctacaagtatgagtttactcttcttcttgtcaaccctcaaaagccaaccatcaaacatattagatatggttccaggaaggtataaaccaaatgagaactgaactgctctccaaataaattttgcataatgacaatctataaaaagatgttgaatggtctcgtttttcatacagacacaacatcttaaacaattaatcatcatctcatacaattattccagtcgttttaacttttaatagcctggatcgatctgtgctggtacaaaagagagctagcagccgcacttttcataattgtgcaagaaaaacataattacaatgctttctttttcaaattattattgtacttttattggatcccaaaaaaaaaaaagcactccggccgggtcggtcgagggtgacctgaccttataacccatccacctttgtttaggaaaggaacacgcatcattagccaaaaaaaaagtccattttcgatctagaagctcacagtttcttttctaaaatttccccaattcttgaataaaaaactgtgttctaactcagattgagagttcgggaggaaaaggaacagtacgtgggccccggcctaatcctccccgaacttttcggacaagtccatgggctgtgtttttttacagcgggcgaaaatgcgaaacgcatgtacgcatgtgtcacacgtgaggaatcgcgaagattcctagctgtttcgaggcagctgtgaacaacggcaatacgacgttgctcatgtgaccccaaagatccggggagacatgagtactactgctgcaacaaattaacaatgcgatttcgccaactaattgtgatcccatgcaatcgatttttgatttttgcatgatgagaccatagaattagcagaccgcatgcatagatcggaatgatgtggatcagaaaaatgcagaccaagcgcagcaacgtaatctgaatacgcgattcttcctgtgaaagctgacgcgtttggtgaccgggacacacacgaccgt

SEQ ID NO: 27021 - DNA, 1501 bp, Oryza sativa
ccttttgtaatgcagttgtgagctcgggatctgtccgcagcccaacatgactgtacttttactctataataaagagacctctgttgctgtgatattctgtctccctgtgataccagcactgtttcctgggactggtatcgattaacaggttaatttggagcgtcacgggctagttccggtcggcactagttcggggcgtgacatgaggccagccaatagcgcgattaagtgatggtggtggagaagggggtctagcagagggggcggtggagaagtgataatgttgagacagaggaggaaagagagaaagggtttgggttggtgggtaatacacgaattttaaagctatccaatattcttttggtattctcttacatgtcaagtatgaattcagatatttcaactgttcaaaattttatccttttgcatgcaacagagccacagacacaaagggtagatctacaatgtttaggtgtcgccgcgacaccgatcatttttggacaaaaacttatgattaacctgtttatttatatactccctccgtcctctaatataagggattttaacattttgcttgcactgtttgaccattcgtcttattcaaaaaattttaaaattattattattattttacttactttattatccaaagtactttaagcacaactttttattttttatatttgcataaattaattaaataagacgagtggtcaaacaatacaagcaaaatatcaaaatcacttatattatgggacgaagggactaggataacactatatctagctaagcataaatagtatattatgacgccgatatttatattatgttatcatcgaaccaattttctgaatccacacaatgttatatcatattgtagtataaatccatttctcttaaatttgtaataattgattataccctaataattttattgttttccatgagttaacttcattttcatcttagtacagaaactaacaacacctaggcgtcaactcatatgagccccgcgcatggctccccacatcgttcgccgttgacacgtaacctgcaggctctagctacatctgcagatgcagaggccaaaagacagcagctatagctgcccctgctcatctgctgcaaatgacgcatgggctagctacctaggagtaggtcgcatgcatgcatgcatggcgtatactgaatactgatacggtgactggcgcacacataatactggctggtgtacagtgccgcgcgcttttggtcagtgctttacttacattttactcggggaaactattctaaaactctgaaggagatgttcactcgttatttatatgacacttataaaaaagtatattaacatgtgattaaatttgtttttctttttataacatgtaaaagttgaattctaacttatttgttcgtgagatgatatgtcacgtgttaatacatacactttctatttttgtatttattttagcgacatgtaaacaccaaaggaacattcttt

SEQ ID NO: 27022 - DNA, 414 bp, Oryza sativa
tagccagccaaggcgaggcccacgcgcgtgcaaggatattcagaacaagttcagttaactttttatgttttcgtctgaattcagatccgcgcgacggaatcagaatttctcggtcaccccgcatgtgtatcatatggttgggcgacgcgagcacgcagatctaatgacattctctgttgcattatcttattcgttcaaagagacattgcaagactgacactattaaagaaagagagaaaagaataggaggaaatggaaaaggaggaagaggtggagagtaactaaatgttaaccatatatcccctctatgatacgatgtctgtggcatgcaggctaatactataatcaagcgtgattaattaattagtagtattgctcgccttgataatttttggttgttaatctgatcgtctc

SEQ ID NO: 27023 - DNA, 1501 bp, Oryza sativa
taaggtgtttaatgcaggcttcaaagaaaggctggtgtttttgcaattgattttattcgaactcttttctgaaacaactaagtgagtgcttctcaaacgacatggatgagacagtgcgtctcgtccgaacggagtatgtgcaatgtatcagtctttagaattgaaacaaggttggcacccggccaatagcttttcaacggccacccgggccaacaacttttcaaacggccacccgggcctagctgatcccatcagctacagatttttcaaacatcgaacctcttttctcaacagcaatttcacaagcagtagtcaaacaaaactacgctaggaatcacctcacatccgcccatgaccgtgggcacggctgttcgaacagttagttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccatatgtctctcggcatcaaggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaattcatttagttcacaagcaccgacctaggtgtcgggttttccaagtcttttgtaaaacccaagttttacccaagttgtttttcagattttaagtttgaaggcgtccgtcgatactcgcactgggtgcacgaatatcgagacgcaactagatggttgcaagggggcatggtatcacaattaacaaaggaaggatcaaatgcaacaaattaggtagatctgccaatctgccttgcagacgggacaacagattaagtgcgatcctatcaatgcataataattttcaagcaacataattaaatttcaaatataggctcaagatgttcaaaggtggcttgccttgctcgagatctggagcttgatcctcgtaatcctcgcactgcgggtcttcgggctccggaactacacgcgaaacgggacaactcaacaaacggcgaaaataaagacctattaatgacctctaagcgtgccattagatagatctcgagatttgaggaattttggaagttgaacggagtcaaacggacttacggttaggaagatattgaatttctaagattattggatttttggtctaaaggaaaaggatttaattaaatcctttttggaaaagaaaagaaaaggaaggagggagggattatagacttttcctcgggcggctagggcgcggcccaagggaaaaaggagcggaccggccgagctaaa

SEQ ID NO: 27024 - DNA, 205 bp, Oryza sativa
atgggccgagagaaattcggcccatcgaccccgggggaggcaaactagacttttgcggagggatttgatttggaaggatttggattcggaattgaactcgacgatagatcggggattgagatcttgagagggcacggacactagacaacaagcgaagaaacaaattttgcaattagggtttttaagagataatttttccgctagg

SEQ ID NO: 27025 - DNA, 1501 bp, Oryza sativa
cgcgaacgaagacatggatgatcagcgggaacaaaaccatggccatttgcgaaattagtagttcatgcaaaacgaagacatgatcaagtttttttcaacaactcgaaacggtacttgttatccattattagcatgtagtagtatgttttattttaaaaaaaacttatataaaagtattttttgggaaatctttagatttataatagttcatactatataagtaattacttcttttctaatatattagaatctatgattggataggatattttagccctacaaatctaaacagacgcctatccagattcgtagtattagaaaatgttttatccgatttttatatcttacgacggagagagtagtatatgctaatgatttttcctttttcaatccgagaacagctccagcgaaagcccgaaactacacattagaaactgggactaatattaggccatgtttagttcacacacagaaattttacaccctgtcatattgaacgtttgaacacttgcataaagtattaaatatagacttaaaaataattaattacacatattgcgactaatttatgagacaaatcttttaagcctaattactccatgatttgataatatgacgctacagtaaacattgctaattacggattaattaggcttgataaattcttctcgctgtttactgacggattctgtaattggttttttttattaatgtccgaacacctcatacaacgtgacgcgtcaaaactatacacccttatatctaaacacccccttaactcggaagaccctaccacgaatacgacctctcaaatctttttccctattaattcaagctcatcactgatttgataagacattaagatagcactgcagctgcaccagagacagtactaacctcgtcctgtcctgccaaagtcacgaattaataatgatcacgttgccctctgcaaactgcaatttgaagcaaattaaagattgtgaaagttaggccgccgaatcgcttatttcccttcggattgggctgatacagcgatatcgtttgggctgatacacacgcacgcacgcacgcacacgtacacacacaaaccatgatgggctctaactctaaagcccatcagactcaagcagaatgcagatctgaaccgcaaaaacagcaactcccaccgcacgcgcgcgcaactgccccgccgaaccggtctccgtgccggctgttttggcgccagttgctgcccgccaaccacgccaaccaaactcgccaaactgcccaaaccagcctcgcctcgccgcgagctccagcttcgcccgcatcaaaagcgcctctcccctcgccttctcccgatgggcacgcagcgcatcacgaagcccccgcgacgatccatccatcgatcgcgacgccgagggagcgagcagcgccggcggcaactccggtagctcgctcgcttccccggcccggccggaagatatggccgatcacgccgtggtggtggacgacggcggtt

SEQ ID NO: 27026 - DNA, 1501 bp, Oryza sativa
gtttactgtagcgtcatattatcaaatcatggagtaattaggcttaaaagatttgtctcataaattagtcgcaatatgtgtaattaattatttttaagtctatatttaatactttatgcaagtgttcaaacgttcaatatgacagggtgtaaaatttctgtgtgtgaactaaacatggcctaatattagtcccagtttctaatgtgtagtttcgggctttcgctggagctgttctcggattgaaaaaggaaaaatcattagcatatactactctctccgtcgtaagatataaaaatcggataaaacattttctaatactacgaatctggataggcgtctgtttagatttgtagggctaaaatatcctatccaatcatagattctaatatattagaaaagaagtaattacttatatagtatgaactattataaatctaaagatttcccaaaaaatacttttatataagttttttttaaaataaaacatactactacatgctaataatggataacaagtaccgtttcgagttgttgaaaaaaacttgatcatgtcttcgttttgcatgaactactaatttcgcaaatggccatggttttgttcccgctgatcatccatgtcttcgttcgcgcttgttagacattattgtagccttctttagctgcttctaaatgtaacgatgcatttctctcacctatcaattatcagggcaacaactagataatttgctgacaacattctcgatcagaaaatcgatttcaggtagctagcatgcttacatcgatcttgtagacctgtactccagattcctcagccagggaactcgacaagtaaacccggacaaactatctgctcggaaggataagaacattacattagattacagaatcccagcagtgttcgttaaacaataattaagaggagatgctgaccgatctgggtaacaaccagaggagagcctgagaccgcataattaagtaggtcatcactcgccagttccctccgggcaaagaggcaaagtcgttcatcatacctccagttcacgttagtctacatggtacataccgctatcaccttcgacgtttttccaaatgaatccatggaagagatcatcgatcgtcggtggcgatagcgatgacaacgagctgtacacgggccattatagctttcgtttaattctttttctcaatgaaactattagattttcttgatgagcatgcatgtgcgctgcagttttcctgtaggaatgttccaatcgagaagaaaattaagtgctccggccggtcatgaaaacataacgttttagatatgctttttaatataaaaaaacgtcaatcttcaaaaaaaaaaaggatgtatgaaaattgtaggggtagattgacaaaaaaaatttcataatactgtatcattttaaaaatatagaatttgggagatgattttaaagattatgccgatgtctgaaatgttctgaaaagcagtatataggccagactagactagaat

SEQ ID NO: 27027 - DNA, 1501 bp, Oryza sativa
tagtgattacaatcctgacgaacgtacaaggtcataaatctccaaactgcacagtgctgtgcctaggaggactggagtgatggagaggaattcagcgaagagagagaaggggatctcaagttcatgacatattgacatggactgcatcgccgggagtgatcccttcctcgacagcacacgaggagaacaacgaatcaggccagctcgtgagctaaacgggccgccaatatgggccaccttggatgtttcggtacggcccggatttggacgattcgcaacgcggttcacctctatgctagtcaagcacccgcctgccactcgtcgcggttttactcggattttctaatttcatttcgagagatactgcagaacttccaacgaaatagttataatattagcatgatatcatgggtaccggatctgatatttctggtactaaacatgatacaccataggtactagaccagatctgttacctatactgatattatgatttgacattagtgatacccgtttttaaaaggaaaaaaagatgctaagaagaaacttagcatcaattattaagagagaagaaataatgagaaaacccagcgtcgaggggactagaacgtgggccaacgagagcacctggtagctccggatcgagatccggtgcggtcgcagtaacaactgcaactttagcagttgcggttcggtggatggatcaaaaaccaacggctcagatagctgcaaaatactgttcacaaattactgtaggggaatctttactgtagcgattgctgtagcgtcagaggtgcaacagggttgcaagcagatctgagcctttcacttcatcaatccaacgatcaaaacgtacaacgacagctaaagttgcggtagtaatatcaactgcaccggatctcaatccggtagctccctaccaccgggctacaacctcgttctctaatgatacccgtatgtcagttatctcgttggaatgatatatcgttttgtactattatttttttttatgatgtcaatactaaatagttgaattgataaatatgtacagttattgatcggtcgaccatcgttttcgaaaagatgttagcgattccaattgtttccactgtttacaagtccccgtctagataatttcatctgtacccaaaaggtccgaaagtctaaagcattactacctctgtctcaaaatacaataacttttgactatgattctaaacaaaattgttcagatttatagctaaaatgcttacattttgagtgtgagggagtatctatcatcccgccaccgatgggcagtttaagcacacgtgcactaatcaggattcgaagaaatatcacacacgcaaccgcattctcgccacagataaacctgtgctccacgattaattcggagacgaacctaggattcgtcgcactgtccagtagccactgtgtttccaggattcacaagccaacgcatcaaagctcaccgtttgctcagccaaaggcctcatgtcac

SEQ ID NO: 27028 - DNA, 1501 bp, Oryza sativa
acttcctactcctcattttaagtgcaactatgagtttctgtacccaactttgacagtccgtcttattcaaaaaaaatttataattagtatttttattgttatgagatgataaaatataaatagtactttatacgtgacttattttttttatttttttttcaaaaaagacgtgcgttcaaagtttggcacggaaaatcatggttgcacttaaatggaacggagggagtagtaattttcgctgccatatggacgagagagagagagagagcatgtttaatgaacagtgctaaatgatgtgtttcgtaaaaatgtaagaagtactccttccgttttaggttataatacgttttgactttggtcaaagttaaactgttttaaatttaactaagtttatagacaaatatagtactagtttcaaatttataatacgttttgactttggtcaaagtcaaactgttttaaatttataatattaaactagtttcatcaaatcgataattgaatatattttcataataaatttgtcttaggttaaaaatgttactacttttctctacaaatttggtcaaagttaaagtaatttgactttgaccaaagtcaacatgtcttataacctgaaatggaggaagtataaaagttttttttaaaaaaaatctattttttcaagtttacaatagttgatagttaatatatactgtatagtaacccactaactttaaagcttaacatacaaacatgccatatcatcacccactagcaataattatatattcaacctcatacaagcatgcaacatcaggtacaatttatttaattatacgaatcaacgtcatgcaaacatatccaattatcactcccttacatcatttccacaacatttttataaatctatctatcatttttataatatttaaattaaattaacttatcaatatgttccatattaaagcgggttttatttgtttgtttcaagataaatattaataagctctgttatttcatgtattttctttttacccctagcttgattgtaacaagaaaatatatattgaaaattacttagtaatttccgtagtaaagcgcggggaatcatctagttgattactactgtgttaatgacccgtcatgttttcaatgctccaataagctcaagcccaacctcgcaattaaacggtggaaaactgcgctaagcttttgcagagatgttctcaatgataggaaactatcttaatcttttgatggaatgtcccctagcccatttgtttaaataccatctaaatagtttgaaaaaactcaataaattgacaatattcatacgacacagtacgtatatcactttataaaatctaaagtttagacttgacccacacatccagaaatcagagtatgaaacagtacagatagtatttacatctggattatcttttatgtttctttggaatgagtttggtttaactttttttttcgaggtggtttaactttttttaagcgatagatgtcg

SEQ ID NO: 27029 - DNA, 1501 bp, Oryza sativa
cgcgacgccgtgcttcgaccgctcggttatcaagttgccggatggagaggcgttggccaggagcgtcttaaggaagtacacgccgaacttgcctgtggtatgtcgggaaatcattttacggatttgctaaataacatgcgagaaatttgaggatgaaatctcgtagattttagatcgtcggattcatgccaagatttgtaaatggacttctttatttctaatcttggtgagcttttttttgtttttttttttgggtaccggcgacatcccaactctttagacgacatacagataacgggttgggttgtgataagatgaggagagaggagggggatgatgatgaacatctaaccgtgcgtgggtgtacccgtggagtcgtcccctccacacacccttccccacgtcctcctatatacgtgcatgtatgtatacgcatatatatatatatgtacaaagtttatacgtatatatataaactttaaagaaaaaatatttcgtgtgtccggaaactgatcgcccatgcccttccctgtgtggctgatcaccacttagcagtttcagaggggaggaggaagacagggtttacatgcgtttaaaggaattgttgtgggtaacagaagatcgattggaaatatacaggaaaatgaaaaatatagaaagagtggcatggctattccaattctacaggaaataaaaacacataaatttaaaagaggtataggtgtttggctactccataagaaaatcacaagaattaattgtgaagaaaacgtttggctataatagataaataggcatttgccttgggcttaaggggattgtaaataggcatttgccttgggcttaagggaattggaaaacatgatcttttatcaaatgttttcagttttccaaaaaaaaataaataaaggaagtaggaattttggaatccatttcttaccatcaaaaggctccaaagaaaaaaaaatgggatttcaattatttcaaattcgttaaaaaaattctttgccttcaaaggagcctaatctgaacgatcattgcacattagtccgaagattttggaatgtttaaatggcaatatcagttgttaacaatctattgtttcgctgcttatacttattagctaaaatttaattttagatttgtttttcaatcactcaagatacttaaatagttttactaataaattgttttattattctttggttgctatttgctagtaagttataaggataagcataacaaagtataagcgaaccaataaagttgttaaagtctactaataccaattattgcatcccaataagatatgcgaatggggtgctaccgttttctagagatttttttaatcctttttattttctaatttcaaaaataaacccattcaaaacttatttacaagatttggaacttattgaccatgccagccggactaacgtagcaaaataatactgacacactggtctaaatagcgtgaagacattgtcttacattgacatgt

SEQ ID NO: 27030 - DNA, 1501 bp, Oryza sativa
gacgcggcaccgcggcgccatccgcttgccgaggctcagcgtcagcagcacggggttggtgacgatgtgcgtcgcgtcgcacccggcctccgccatcaggaactccaccttccgccgcagcagcgccgcgggcacgaacacgaggcacggcgcgcggcggaacatggcgtcgaactcctcctccgtgcagcccgcggctcccaccacggccgccttcttggcacggaagctgccctcgctgacgttgtgcagcgcgaagaaggcccacatgtacatcccggagcttggcgggacgccgcacgcctcgacgcggccgaccagcttctggaacctggccggcgtctgcgtgatcagcgtcggctgcatccgcaccgtggtggtgatgcggctctgctggacgccgagggatcggagcgtggagaggttgcggaggagggcgtcgacgctgtaccggagcagccacgtcttggcgagccatttcatcagtaacttggcggaccccaggaagtcgatccagaagaggacgcgcgggaggaggttggtgtggatgccgtaggtgagcgccggcgggtagagggcgaagaggcgcgcgacgtcggcgcggccgaggccgagcgcgcggacggcgcggaacttggggtcgagggtggcgtcgacgtcgctgagcagcagctccggcttccacgacacgacctcgcggacctgcgcgcgggtgaggccctgagaccggaggaaggcgagcgcggcgtcgggcctggacgccgagtcgaggtgggcgaaccgcggggcggccttggcggcggccgccggcgagaggccgcacttggagacgaggtactggaccatgaagtgcggtggggtggaagagggggtggagaagcggcggacgaggtggccgcgggattcggaggagaggaacgcgagcggcgggcgcggaggtggaagggattccacacggtggaggaggacgcggccggcgacggcgaaacgccgcagcgccatggattccaggacggacgtccgtggtgaggaatcgatttaagggatctcagatgaacttattcctatccacaaaagtacaagatccacttcaagctgtttggttgggctaactttggcccgcatccaacacccagagtaaatgaatagtgttgtgccaactttgttttaagtgggcctttattaaaagtagttcacgcggccttccaatcggcgttcctcgcatttccccagcctgcgaagtgcgaaccgtgacagtagtttgcccttatattcaccgggaaaaacaggtttactgattactattctttacatttttttaatatatgataccgttgatttttttatacgtttgaccatttatgttattaaaaaaatttatgtaatttcccaaaaaaaaattatgtaattatcttttttttacttgatttatcgtcaaatgttatttaatcatgacttaattttatatttgtaaaaaaattgaataaaacgaatggccaaa

SEQ ID NO: 27031 - DNA, 1501 bp, Oryza sativa
catagatgctgcgtcatcatgctttctgtgcttgggattagatcaccagaatcttagttacaattacagacatcccatggagttcagttcaggttcactggttcaggacttggttgacatcgaaggcacaggattgactatacttcatccgtttcacaatgtaagtcattgtagcatttaccacatttataatgatattaataaatctagaatgatatatatgtctagattcattaacatcaatatgaatatagaaaatgctataatgacttgcactatgaaacagagggaatagcttagtagtagtatatgaggatgatgactgagacagacagccgaccccacaaaaaaagagtgggacccacgaagcaaatctgagtcactgaggagaagcagcagctaccaggtggcaacttgtccgtggagcagcaagggaagcgagcgagtcactctcagcgtcacgcaccgcgcctttgcaaaagctaaagctcgcagcggcagcgccgccaccactcgcactctgctttgcttccttcgtcacactgccggcactgcactgcctgggaggctgggattccagattccaggttccactcgaactcaagcaagcatccagccactcgcgggcaggcacacgcagtccaggctgctagctagtactcagattcttctcgtctctactaggactaggcacaggttcccgcatcatttctaacaatctagctgcaactagcttgaagctggcaactgattcgtactccctccgtcccaaaaaaaaaaactaaacctagaagagaatgtgacattttctagtacaacgaatctggataaatggttgtccagatttattgtactaagaaatattagatgtcacatccttgcctaggttaagtttttttgggatagagggagtattaattatccctctgatcacagcctctttgtagtgagagagactgttactgttactgttgggctgaagatgactgtgctactgatcggacctgggctgttgagttagtgatcattctgacaattagactcgtacacatgataagaattttttttcttccctgatggaagtgcgctcgcaaagtgaacgtcatctcagccttcagatcaagcttgattcatcatcatttgttgcgcatgttgtcaacctctgcatgccactttggcaaagtgctctaatccccagtgaaaatggcgccttttgatcccccaagcttttgtggagatgcatgcggccgcacttggggagagcatatttgcctttgcatacagctagctatctctaacctttgtgctgtgctgagcacattccatttcccagtttaaaagaatcaccttttttttcttcttcctttcctccctagcttgttgcagctgctgctccaagtagtgtgtggcgatccttagttttttgcacttagggagggtgcactctgctgatcctcttttacttggttcagtatcagcagcgcctctcctccggagtaca

SEQ ID NO: 27032 - DNA, 1501 bp, Oryza sativa
atatcataaaagtaatttgtgatttttcatcaaaatataatcatgtgagatcttgtcgtaaagatttaattattacgaacacaacggtgtaatcgaattgtaaatcggatgagtaatttgagagaaaattttatttgaagcatagatgataggaatatttctcctacttacttaatggattagtactatagtaaagtaagattattccagctaacacatatctggattctggataggcgtcgctagttatgactaaatcgagagtgctctcgaattagattttgcgaaagttttggtagggcaaaatatgataccaaatcaagcagacactaacgtagttgagttagtagtataagaatggagtcaggagatatatggtcatataaatttagtgttgaagactcagaattcagttatcagaaatgcagacaatatatggcctgtcagaaattcagaacatcccagtcggccagtctatagcggtctgtatgccttttctgtttgtcttagttctcatagttactttcactttactgaatttgtaaaaaaggtgaaaggtatctaacctgcaagtgtaaaataatacaaagctaagcttataccaaacttcagctaagcacctggtcaaagcacctctaagacacaagagaataatgtgcatccctgcatagtcaaaagcacagagaatctactcgtggactgcgttggtcgtcagccacagctacagccagcctaaagggcttgaacaattgaaggccagccatggtgacgcacttagtgttcctctccacaagttgaggttctcttctctgtcccagcttctgaaaacagcgcctactgatagataatcttgagtgccaagaataaagttgtcgttagcatgcatgttttagtcaattctttgcattataatagcatataggcgttggattccatttgtattgtggctggcctgagtttgttcagagttggtcaagtagttgcagtttttttcggttgtagtggccgagctgggtctggagcgtgggatggcgcgttcggtagttagatccggcaaagctggtgtttgttatgcatgtaacaacctcacaagatgaggagtatgaatagaaagaatcagaaaaagctgcggtggttgttgagcagcgccaaaactctgctttgctgtgtttctgtgttcgtcagtacactgttcatcatcctgcaagcgtcagttaagctaggatagctacgatctcgcgtgtgtacagggtgttttgctgacaattggtatcagagcggtactggaacgatccggcgatgtcatacacaccgcctggccgtcgtggtggcggtggcggcggggggagcggcaacggccgcggtggcgcaagcggcagcggcggggggaatggcgcagacggcgcattacttccgctcgtgtctcaggggagagacgcatcgcacaccgctcgcctcccagtcctctcgaggacgaactacccggattgggcgctcctga

SEQ ID NO: 27033 - DNA, 1501 bp, Oryza sativa
accgctatagactggccgactgggatgttctgaatttctgacaggccatatattgtctgcatttctgataactgaattctgagtcttcaacactaaatttatatgaccatatatctcctgactccattcttatactactaactcaactacgttagtgtctgcttgatttggtatcatattttgccctaccaaaactttcgcaaaatctaattcgagagcactctcgatttagtcataactagcgacgcctatccagaatccagatatgtgttagctggaataatcttactttactatagtactaatccattaagtaagtaggagaaatattcctatcatctatgcttcaaataaaattttctctcaaattactcatccgatttacaattcgattacaccgttgtgttcgtaataattaaatctttacgacaagatctcacatgattatattttgatgaaaaatcacaaattacttttatgatatgtctaaattacttttagatttcactgagttacttcatagacatataaaagtaaatttagtaaagcctaaaagtaatttacatatattatagaagtaacttataacaaaaagaaagtaactttaattaatgtcttttttcattgaacaaattatcatatatataaattacttttatatttgattaaaatacctcctatacattcataatgctctgaggggattacttttattattgtttttagttaattccataatttgtgctgattaatttaatttctagatagagtcatgtttttatctctacaacggatttacttcaaatgacatgccaaagttactttcgttttgttataagttacttctataatatatgtaaattactttttgactttactgaatttacttttatatatctaagaagtaacttagtgaaatctaaaagtaatttagacataatataaaagtaatttatgattttttatcaaaatataatgatgtgagatcttgttgtaaagatttaattgttacgaacacaacgatgtaatcggatcgtagatcggatgagtagtttaagagaaaattgtatttgaagtatatgtgaatggtgtctcttatagatagagtggtagctggtttagacaaaccagctaccactagctgtgtagttacgtcccaaaactttggtagtaccaaaattttaacgagttttggcactaccagatttgatagtatagaatttaaactagcgtgggtaaaagttagtaccaaatcaaacattactttatactaatgaagttgccaacattctggtatggtaaaaattgatctcaatccaacccgcaaagcagatatgcagagagccagaaacatcgtggaattgtgggctgttgggctagcagaatatgcaggccgtcaccaatcaacaagcccagcattgctttttatccatgggccttcagttgcaaaacggcccagtttctcatggaccacgcgccgccgctaatccagccctactat

SEQ ID NO: 27034 - DNA, 1501 bp, Oryza sativa
aggctggttttgcataggagtctgctgaactaagattgcctggggctgctgtgctgttgtggtggtcatttgtggcattggaacaaaagcggcagcattcgcgacacttgggacctgtgaggaatgttcaattttcagcctcttatcctggtgagtttcggatgaatttttggcttcctcagcagcaaacttggaaagtgcagattgcagtatctgctgagagtttgatgatgctgcaatcttgtctgcgaggatagcagcagctgtcttctgctgatccttcgcctgcccattagaaagtggctttcctggttctactgaggataagtgcttggacgaaggaatgactggctcgttcttgagtttccgttgcatgtcggctgcttcttctaccatagcttcagccagctgttaatcaaaacataggaataatatattttacatcaatacatgctacaacatcagtctttaataaaatttgtgatgtttagacaacattacctgtaactgagtacggactttctccagctcagattcctgaaataacattacaagtaagcttttgcaaataccaactcaattgcatacggaaaatggaaatgcattactataaataatcacaacagttgtttctgacctgttcctgcaatgcctccttcagttcagacacaacagttgctctatttgcttcaactactttaagcttttcaatgcattctgtcatgctatcctcctcttcctttagttctgtgcaaagggtttcacgacgaggatcatcacctacagataaggaataacttgagaatatgtactaagacagctaagatggaggattcatgtcaataacaaataatataaagcacctttactacaagcactgctaacatccttctgcatctttccaacacgccgcattgaggttttgcatttctccagatcagagtcttcatctgcttgttcactgagaacagtgtgcagtgcagatacaatcttctcagcggtcccccaacacctagtctctgaaaacaaaatgataagagtttaagagaattttcataacactttccaatgctgaagaacataatttagcagatggggtaggaaaaaaaaagcttacaagttttacagaacgagagtctcttttgacgatctttattgaggaaccgtgagaccgttttttggtcatatctaatacaggcaggggaacagttccaagcatcacatccttgatgccccccgcacgtgaaccaaaaactctcctttcttgccatatttcaacctacagcacatattactgcagtattaaatgattgcagttttcacggttattcgtattagatattggaggattttataaaagaatatattaaatatacagcagtaatcatcaaatagctcttatcaccaatatctccaactagatataataaattcctatcagtagacaaattatactcaccagcctactgaccaccttcttcccgcgctcatcaccgttttc

SEQ ID NO: 27035 - DNA, 1501 bp, Oryza sativa
aaggatggcatagtagggttgcatttgcaaaagcagcatttaacaaacatttgagaatttaataaagcagttaagtattaaacaatattaatccaacgctatacaacataccctattgtataggcccaaccattctgaacaaccatcccggctacacagttctatctccaaaccaggattgtaccattccaaaccaggagctaatcaaattattaccaattatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgtataacacaatccaccgcagcgcaccttcctggatcataatcacccccttaaaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaatcaatcacgattgaccatcgtgaactatcattaagccatcattaaataatagtgagtcatgagttatcccaatagtgagctaatgtttctaagcagggctaagcaattatatctaatacatctagttgaaccaacatatagagctcaactagtcaagttataataacccaaggtatcaaggaataaggtaatcaaaacaaaaaggctataacaaacaataagttaattccacccaatgacattcgaaaataaatgcaatagttgaaaagaaacaatagctttaaacgggatcaacatgctcaaagggttgtttgggatctgtgtgacttgccttgctggccttggaactcttcaaactcttctccggcgaaaacagactctccagaaacgacggaatctaagcagaaaagagcaaaatcaccaaaacagcacataaacaagcatgaacagtacatgtggatatttttaacatgtagatctcaattttagaaaaatttagagacttgaaccaactaaatccgagcaaagatgaattagttatgaatttttgaagattaaatcggattaaaacacttaaattgattttaattgaattatgacgcaataatgaattatttttgaaaaggaaaagaggatttattgcgtcagcgactagggtttcgcggtggaccgggcgcacggcggcggttcacgcgaacggacggccgagatcgatccatccaaaacggacggccgagatcgatcgggtccacggcggctcacgggagagggcgacga

SEQ ID NO: 27036 - DNA, 1501 bp, Oryza sativa
tgtaaaacatttatcgtgccaaccacaagctagcgtgggcaacggctttatcttttgtatagcatgattcattttggagtgccagactgagaagcggcgagaagtccgtgggggtcgctggggagtccatgcctctggttgtagagggggtgattatgatccaggaacggtgcactgttttgagttgtgttgtgcagagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcgatgtttttcgtgattagtctcacactactcatcaatgttaataatgtgataattaatttgactcctggtttggaatggataattcctggtttggaggtttgatctgtacgaccggggttggttgttcaggtttggttaggcctgagcagcatggatgtgctgtttagtgttgattaaaattgatgattaactactctactgttttacttatcttaaatctttgctaaatgctgcttttgcaaatgagcctatattatgccatcctttggaatccatgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgctattttcttttctttgtaagtatgtaacgttattattaagatggatttgtatattaaattgtcagtttgtgtacctcggctgattcctggacgaggattttatgcacaaattagttcggaaattactagtgaattttcgggcgtgacaagttggtatcagagccatctcgactgtaggataagccaaatggtcaaactttaaggacgaatttttccaacaaaaatgatttgtgaaaatttctcctttcttccttatctagaattctttgcaaattgtttcattgtctactctcctctctcgttcaacttgagtagttctgaaactagttgttgaaactagaagatgttgatgaggtcaacttatagaggtcagtaaagtggatcgaggaagaaccgaagtgccaagtggtcaagatggaatgaagtttggatcctaccttagaacctatgccgctaaagtgtctttgaagaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaaactggttaaggtcttgtctttagtgtaacccctctccttctatcttctctaatatgcaacaga

SEQ ID NO: 27037 - DNA, 441 bp, Oryza sativa
cagttttttttttcttttcctttttttccttcccaaggtcaagcaaaaaaagcgctcgcgtccgatatttcgtgaaactaattttagcaaagatccactctagggacgaacaactacaactgtcagagataacagaaaggtcggaactcaaggcatactgacgagacaaacgaacagctacctgtcactctgtcaggtaacagcaggataaaaaaaaaacagaacgagaagaagagagttatcccagttctcacaagagaagaaaagttttcagagtttttcaggcatatgaactctgaacacgacatacgtatggtaaagtgtgttaagagagacaacgggcatgattaactgattgtgcttaccggcaagaacaaagaacaaggaggtaatcctcccagatgtgcaggagtaaggaggtttcaagagagggagagaggg

SEQ ID NO: 27038 - DNA, 572 bp, Oryza sativa
gtgaggtcaacgaggcagaaccactgtttggtgactttgaactctttggtccagatacgttgggaaggcttgttgttggttggactcgttttgacttgactttctgagggcagcaccatgaatagtgtcccatcccatggcagatgaaacattcgactcctgccttataaccacgtctttttgaaggtgtagggcatggttcggagttgcttccttcatggctactactgttgatcattgtggcttgctgaccaggttctgacatagtcgaacgagacgtagaaccggaactagttgaatgagatgctttctgatagtattgtgctggcgagtttgttttttcgacacaaatcttcttttgcttgaatctctagggacattactttgcgtctcttgtattcttgcatctctttcttttcttggatgtcttggcacatgtcgcaggatgcttttgctcttttgtcatcagggaaggttggacgtactgcattaacatttggcgaattcgggcttccttggggatagaagggcatccttgagatgctcatattagcttgtagtagtgcatccat

SEQ ID NO: 27039 - DNA, 567 bp, Oryza sativa
aatgaaaaaggctgtgggggccgattaatcaagtggaatggtctgggagccgagaagtaatgatctgacccgggaggtcggtacattgctaaatgagttgttgaaaagcatctcttaaagtcgaatcgagacgcaagtctcttttcgcccaaacatagaaagaaataaatcacttagtgatttcaaaatgtcttcaaataaaagatttgcaaaacaaccttgcctctcttccaagcttgcattaaacacctaagttcccgtgacttgctgagtgcgaaagtactcacccttgctctatataaatatatacatagttcctccgccctgaagagaagataaggtgaagtgaagattagggtttcgtcctggttcccagccgtcgcctgtggtgttgggtgttagttcgttggttccgctgctgctgctgttgttggtgtttcctcgtccgtgtcgtcggttgcattctcgggttgttctgagctgcaacctaagttaaggtaaataagtcctctatctattttaaggatttgctatgattcatatttgtcaccgtgggtaccagcacta

SEQ ID NO: 27040 - DNA, 393 bp, Oryza sativa
attgatttggagagaaatggagagatttagggtttgggttcgaattcaaatttgatattcaaactcgagggtttagggatgtatcaaggggaattcaaggagaagtcatgggaaagattcaaaaggaatacttgggtatttgttctcgggaacataggggagtcaaggaaggaaacaaaacgggggtttggacattttgggatttggaaatgtgtttggcgaggattcaaaggaagggattgactttcggatttagatttcggagacttgaattgggagaggagatttgaggcggaggattttgatttcgatgagagggaacaacaggatttgaattgagatcttggcacaacttagactcgcacacaaagaacgaaaattttcgcaattagg

SEQ ID NO: 27041 - DNA, 1501 bp, Oryza sativa
aaagtaagtaaattgagcttaacggcaggtttttcacatggaaggaattatgtgcaaggatcaaggaagttgattacatgatggagattggatttgtgcctgaaccagcgtagattaatcgtattgcccccttggtcgctcgtgaacccaacatgcattggctggatggacagataaaatagttagtatgttgatgtgtatgaactgttgcagggagtgcatgagagtagactaattggtaaggttacctgatgaacatctcccatgaagtgtgacaagaatagcagtgcttcagtcatgttatctgcgttacaagcagttacaacaatatgaaagaaaatgaacagtcagacaagagatacatgacaactaaactatattggttgatatgatatactacaactgcgtagttctcacatttgcgatcggcgctgccgtgattatagtgcataagctgagaggtgaagttcgcgatcgcgccagcgacgcacatatcctccgcaccatccgcgccatggcaatcccctgaaaacccaaacgcgacagacagatcaacatatacaccattatcacagcagattcagagtatagcataattcagaaactgatggaggagaagagttgcctaagcgtacttgagtagacgaagctgcaggctttgtcaggggtgtcgatgaagtggagagggctcgtccacctgtacttgtaccagtgcctgacctgatccggccacacgcacagcgccgacaggtcgccgtccgcctcctccgtcagcaggttcctcaccgcgtgcgccgcggctggctccagcagatcctgcatccaacacggcatcataatcatcagtcattcagcctaaatgttcaggaatggttcgattgatagtgatcattcacctgcgcgattcggcatgtgagcatgtgaccctccttgctccacgaatgagccaccggcgccgacgcgaggacgagcactgcagccgctgccgctgctagtagaaacgatgagcacttgtctgatgccattgatcaacgagacgagcttgatcctgatgagagaaaacaccgggacacagcaagtgatatagagcagcatgcagcaagcggagcagtgggaggcaatgatttaagcttagcttagctagccttcgttgagtgcaagcattgtgtggcgtgttaccccgcatgctttgcttcgcaccatcaaccaatcgccgttgggggtggtttcgcctttttgaaagagctactaggttgctgggcctgggccgaagcagattctctcgtaatgggcctcatcagacggccacggcccatttctcgcttcacatggccgcattaggctgggcttaagggaggcgaaacatttcgcggggacgaggataacgtctgcccaagcggagcgaaagggatgacgggcgccgccgccgccgtctccccgctcgtcgcgtggccccgctccgcgcccgcctcgcggggcggcaggcgtgcggcgcgcgcgt

SEQ ID NO: 27042 - DNA, 193 bp, Oryza sativa
ttcctgtgcgccgacatgccaccacgacataccgaaaagaggccgtgacaggacccttcgcataaccctctctaaccgatcgcaccacaccttagggttcacgcccgtccccagcaggcaacgggcagccccccttttgtgccgcggtgaatccggaagccgatcaaccggacaccccggccgacccaactcc

SEQ ID NO: 27043 - DNA, 1501 bp, Oryza sativa
tcttgcgccacgaataaccacaagatctttgtatgaaggcgcatccggtctcaggtctgacagcatttgcaagagcatcccaatcaaggccaccatctgctgcaagctacaactgaagccacatcagtaactcacaaatagcacaatgtaaagcattcctggtgtttgtaaggtgaagaaatcaacaaaccggaacttctcggtatgccactccaaaatccttgagcgatcccacattggccgaccccctgatcccaatcacctcctccaaggtgtcatagggaggaccagcgacagccaggagctacacattttctaaattttcatcagctcccagtttctaagctagcagaagcaatgcgaaaactcagttcatccaggtgttctctaatctcttacctcgtgtccaggcctcagaagagcaaacagagcacaggcaatggcgtgcgtcccggagaagaactggaaccgattaacaaagagctcatcactagtacaagaagctcagtttttcacgaacgcgcaaaaggattgcgcgtcaatatattacggtgtaggtacaagaagctcagtggagctcagcaatggaagcagtggagagagtggagtggaatgtatggagaaatggggggagtcagagagaaatggtagcgcgtgtggacatggaacctgggggcggacaatggcggcctcggcgccgacgatctgggcgaagacggagtcgagcacctccctgccgcccccgtcgtcgtggccgtaccccgtcgagccaccgaaatgctgaaattcgcggatgccgcgtgcgcgtcataccctgaacctgacagcgagccgcatacggcggaggaggagagaagacgagggaggtttacgtgcggcgcgacgtgggcggcgtggaaggcggcggagacgcgggcggagttgagggcgagcgcgcggtccacctcccggaactccgcctgcagcgactccaccgcgcgggacacgtccgggtggaacgccgacgcgcgcgccgcacgcctgccgccccgcgaggcgggcgcggagcggggccacgcgacgagcggggagacggcggcggcggcgcccgtcatccctttcgctccgcttgggcagacgttatcctcgtccccgcgaaatgtttcgcctcccttaagcccagcctaatgcggccatgtgaagcgagaaatgggccgtggccgtctgatgaggcccattacgagagaatctgcttcggcccaggcccagcaacctagtagctctttcaaaaaggcgaaaccacccccaacggcgattggttgatggtgcgaagcaaagcatgcggggtaacacgccacacaatgcttgcactcaacgaaggctagctaagctaagcttaaatcattgcctcccactgctccgcttgctgcatgctgctctatatcacttgctgtgtcccggtgttttctctcatcaggatcaagctcgtctcgttgatcaatggcatcagacaagtgctcat

SEQ ID NO: 27044 - DNA, 1501 bp, Oryza sativa
tctgctttatagcctactagaattttttttaaaaaaaaattgctagtatgccccaaagttgggttgcatactcagttttgctacaaacgtgagtggctttgcagatttcatttgccacagagttctggccgatattctctctttatcgtgattttctgcttgatgccgcgatggtgaattatcccatgggctgcatgcatgggccaaattactcgcgttacagattcttttggaaataataatgatagaggtacgttgcaatttttttaacgcagtcatgacaaatttagacattctttatttctaattttactgaattttgttgtttttgtaaaggaacaatataaataagcccgaaatgctcttgagtcttgacaccataattttggccaggattttttgttatctctagtgaaatgactatccatgatcatcatcagatgaataattaaacagaagacatgtgcatgcaacacacgcgttttccagcgcataaatctgactgttccctatcgagatagtagttcgacactgaccaaaacggggagtttgtttcactaatcacggcgcggttttagaggccccacaccacgcacgcagcagctaggtgctaatctaacgtagtttttttttttttgacgcaaatctaacgtagttttttagcgaagcgaactgctggattccacggtgttcgtctcgccaccttccatttctgtttgatgatttaatcctctgcccagttcttcactgacgaacgaacaagctcgccgccattgccaaaccaccttcttcttcttcttcttcgcctcctcatcatccacgatcaggtccatttgggagatcaatgcgaaattgtgcagttgctgcgtcgttctggggcggaattgattgtgttcttcagtctatctaatccctattaatcgatcgttgagggtttgagatcggatttggcgatggcgattacgaaggttctcggatcgaaacctgccgactgcttccaatttcaagatcctaattcctggtacttcttcacctgtcgctcgtcctatcccctatcgtatctatccccaatcatctccttgttcatgtttgagacgctttgcgtgtgttcatctcctaaacgattcgttaacttctatatatatgtatatatatatttgccttcgttagggttcaatgtgatcctaacatatgacttgttgattgtgtccctgtagcgcacagactgcatggattttcttccatgaaaattcttcatttcaggttttttttttccaaaaaaaatatcgctatctttgatcaggttaagatgacagtaactcgatcataatacacctgtaagatgaacttaactttcagttttgaccgaatgtagcacataacagagaaaataaactgagatgtaaactttgacacattaacagaatagatgagcatatttgagatgaacagtgcagaatcttttgggtctctttcctgcactctgctagtggaattgcat

SEQ ID NO: 27045 - DNA, 441 bp, Oryza sativa
aattcgatagacctacaactaatgctaatggattaataccaccttaaatatccatgtggaaggatctcaacttaaataggctactattggagagcacctgttgagcggttacgggaaaacacctctctgctctcctctcccccacactggttctcctcggcacatcctgtttttgttactttgctacatttttgcatcctcggttgcagtgtttgggacgagcaggcctcagaactccattcgcttgagtacctgcactgctaggcggcgaggacgagcaggcctccgaaactccattcgcttgagtacctgcactggtaggctgcgatcaagtttttcgggagcgctttctagtgtgattgctctgctgcatcagttctgcacaatgttgtcttcttcctctacattgattctactctgtttcatctacttcactaatca

SEQ ID NO: 27046 - DNA, 338 bp, Oryza sativa
tgttgggccttcgctgcccgtgtaataattatatttacgcttccgtttgttaaactctgaattgtatcaacttttggtgtaccttgcctcctgggacaaggaacaatacacgcacgtcaggaacgcctgttgggtgatttccggtcgtgacaagttggtatcagagcctcccttgaccctaggacgagccgtagatcccaagccttagcaatatttttgaaaattaaaaatcttttgttatttgtgaaaacccgctattctctctctgtcttgctgcttcatttatcgccaaaatctgatctctaaaatgctgtttttcttttgtttttgtttgtaga

SEQ ID NO: 27047 - DNA, 577 bp, Oryza sativa
ttaatcttcttgaacacttccgacgcactcgcgaaccttcgcaacgacggaaacgacaagctatcacgcaaaacgaggaaaaagactaataaaaaccaaataaacaatacataaaaagtaaacaaacatgtaggtcataattttagatgaattaggagacttgaacggcctcattctgacttcaaatgaatttattatgaattttacaagattaaatctatttaaagcccatttaaaaagaattaaataaatttcattcaatttatggacaattttaatatgtagatctttattttatacaacttttgcaacttgaaccacattaaactgagttcaaatgtgaatttttaaagattaaatcggattaaaacacttatatggattttaattgaattatgacgcaataatgaattatttttgaaaaggaaaagaaggattattgtgtcagcggctagggtttgcggtggaccgggtgcacggcggcggttcacgggaacggacggccgagatcaaccctatccaaaacggacggccgagatcgaacggtccacgaccggctcacgggagagggcgacga

SEQ ID NO: 27048 - DNA, 1436 bp, Oryza sativa
attcctgcagccccatgtgataatttttaaatttaaatatagttcatatcaaatgtaatcataatattttcactatacacatctaatttagataagtttattagagacggatggatgttgcttgtatgtataaagattcaaattagaaaacagtgcatagtatgtatgtacccggaggatttttttgtacaatccggtggatagtagtacatatttattgtacaagtgaaaatattttttattttttttgggtgaacagcacatacgtacgtttctctcgtagcaattacgtgggactgtcaactgtagcagtgctaatccttctttcttaatcgtaattacgtttttttttcttttttgcggtgagtagcaaagtacggtaggacatatatatgcgtactattcacgggattttttctaccggcgaggttagacgggatgtattttaaataattctaatctaatggtttgaaaatagtaggttcaccgaattaaaatcgaggattggatatttttcttttttctcaaaatttatatgtttttctctaataaatattacagacagcttggtagtgcttctagaagtgatctaatatatatttttttctttattatagataagataaatatgcagtgttttaaatagtcatttaaggattgatcgttgttattccagatagtatgtatgcctgtgtatgtacaattctctttgttgtttttgtcaaataacgaatagtgtactttttttttttgcttttttgggatacttacagatgtttatttcccgggccctttttctgttgggtcaagcatacgtatatacgtgggctgataagctgaggggtggggatagcagggagaaggagatggaaagatttatagagataaatataataataattaaaaatagtgggtccaccgatttatttggtgccacatggcattttaggagtgtttgtaggagtaccacgtaggagcgtttgtaggaagtttaatggacttttagtatataatagatagatagataacatgctacatgcttaaattttttttaaaagtaatacaattttaatggaaaattataaaaatataggtctgacctatactaataagctattatctcagcccatcatggtgaaaaaagtcttggcctataggcttttcaaccccaagcccagacattagcactactgcgtcgcagattctgctttgactatggtggatgaaagaggggcagctggagcgaagcagccgtgggatagaataaggtgggaagggagatgggccgtgggcgagtaacgcagggtgaaatgggccacacgagacttatcactttgcttgtctccggcgttggtcaacaagtatctccggacgattttgctaaacatctcccgcgtgatttttttcctggcatttgacgtttttttttggccaca

SEQ ID NO: 27049 - DNA, 1451 bp, Oryza sativa
cggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttgtatgaggggtattgtcataactcctttccgaggtaccgtggtggtattgaggcacatggtgacatgatgtggggttgtgtcttgtgggtacagtggtacagctctgatcagagtaaaactattcgaatagccgtgcccgcggttatgggcgggtcgaacaatgtctttcgtgattagtttcacacttctcaccttagtaagagatgcttaaattggtaataatttgattagctcctggtttggaatggtatattcctggtttggagatagaactgtgcagccgggatggttgttcagaatggttgggcctatgcaacagggtatgttgtatagcgttggattaatattgtttaattacttaactgttttattaaattctcaaatgtttgctaaatgctgcctttgcaaatgaaaccctattatgccctcctttgttatcctgtgcacttgcatatttgctgcgtggcttgctgagtatgtcatatactctccttgcaatcattcatcagaagaagagttcttcattgaggctgatggagtggaggattaggtgtagccttggtcaagctgcctgtggagtggagccgtctgcgccgtttattttattttctgctgcttagatctttattgattgagaggaactatctacctccgtaatgacattttatacgcttaataattagagtaataactgtactctattatcaatttgttattgtgtgcctcggctgattcctggacgagggttcacacacatgtaagcgtttggaattttggatagaaattccaggcgtgacaagttggtatcagagcccctttgaccctaggttatgccaaatggttacccatagaagccttctaaaaatattggaaaagtagaactgttctcctctctttctcttttaattaaaccaaactaatggcacatgcacttcataatctcttttaatggttctcattcaaaatttattccagtgttattagtactgtacatctattactgtactaatggctcattttccagcaaaagttttacaatgatgtttcatttaatcttactgcaataaaataaatttagcaagttgattttataactttcttttatttcttttgaaacttgttattcaaaagtacaaaacttgtgacctcattttcaactatttcaactcatcttgcaagtttggtttactttatttacttaccttttgctttgattttcaaactttattcaaaattaatccaaaaacttgtgctattaattggataaatgttttaactccctcctttcacttgtctttaga

SEQ ID NO: 27050 - DNA, 896 bp, Oryza sativa
aaatctaggcctgcggtagaggtgttagaggtgacggcggtggcagcggcgcacagccaaaggcaggcggagcggcggcggcagcgagtgagtgcgggtgcggagcaacggcgtcgtcggcagcaagcagtgggcgagcgcgcggtggcgggcgagcggcggctccgggttgccgccatcagagttagtaccgagggagaaggagggcgcgtcaggaacctcgtaacttcaccattgctcctcccagtggtgctcctcatcaccgtcgatgtcgagagagaaggatggtgcatcgagagcctcataacgcttctgctcctcccctccattgccgttgtcggtgaggtgggactcatcaccgtcgccctcaaaatcgattccgagagagaaggatgaagtccatctgctagcaacggcgatggagggatttggtggagaactcagtaggttggcagaggggggaccagcggcgagcgagagcggcagaaggcacaacagcggcgagaaagcatggcagaggggggaccagcggcgggcgagcatggcagcgggaggagtagagtggctggagtaggccgcaaaggggggacggctgcaggcgacatggcaaagggacggagcagcggccgccgcgacacttctcgagcttctcaagctgtagctgccgtcacgcttctcgagctccacctccacgagctccggccctcgatctcctccaccagctgcggtgcctccaccgccctccgcgtctaaccctgctccgcccggcgccgaccccgcaccgggtcgagcacgcggcacacgaatggtggcggcaacacctaatgccgcctccccctcgctttcccgccggccgtttcccgcccctcccgccggccacctgccccactcccaag

SEQ ID NO: 27051 - DNA, 430 bp, Oryza sativa
gccccagcagatcctccgatcatcatcataagtagtgatgaagaagaagaatccaagcgcaaccattccaagattgagtgggtagcaactcaagatgatgaagacgagccgaacgagccttcaatcgaccttcgatgctcggaagaacaagagtagcttgttaagtcgttgtcttagatcgttgtgttagtttgcttcttttaagcttgcttgtgtgtgtgtgggtcttgcatgtgatttacatcagtggtgggatataagtacatgcgtttgtttgctttttgagtgttaggaagttggtgagtttagtggtgtgagagtcttcagtttgtaataatgaaactcagttaagatcaataaaagttaaagtaattctctgtcctaagtagttttcccccggtttctcttcttgtgccctatccatgccaga

SEQ ID NO: 27052 - DNA, 1501 bp, Oryza sativa
ttgagaggggttaggaatagagagagagagagaccacggtggtcgccattgtcggctggaggtggaaaggatggatagctcaccggcatgcgaggagttggagctacggcggtgatttgcggaaaccgagcggtggacggggtagctcgtacgacggcgaagctggcagcggcgagcgcacagcgtggcggtgaccattgcaatggcatcgtgcggctggaggcggcggcaagcggcagtgcgtgcggcgagcgacgcgagtacggtaggacgcacgggagggggcgacgagtgtgggaaacgagagagggagctcgggggagggtttttatgggcgcgggaggggcggacacggccggggattggcctatttggccagcgacgacgtgggggaggtggagagagagagtgggatgattcgaattgaatctcgcccttacgggtgcgcgcgagctggcgggaaggcgagggcgtgggcacaggaggagcggaggaggtgggtgcggcagtttcggcggcggcggttgccggcttgggcggaagcgggcggcgggaggaagggggaaggcccgacaggtggggcccagctgtcggcgcccgagagagaggagtccgggaggacttcgggtggaggagggaaggaatgggccggcctggcaaggagggtggtgcgtgagagaggttgggccgacggcccaagaaaggaagaggagggaaaataaaaagaagaaaaggaaaagggattttcctgggattctttattgcggtttgatgtttttaattggttataattatttccaaggcttctgaatagaacccaagaaaaattccacatgccgattctgattattatttgcatttattgattaaggaattcaactctaggttaatttgaaccaatttcttcaggcgatttattcaatgaatttttaaacaaggaaggggaactttagggtcaggtggagccgacggatgggagggccggggcagctggagcggagtggcagccatggggtaggtaggaggaataagttcaccggaggtcccttaactcaacagcgagattttttgaggtcctttaaccgcaaaatcagaaatatatactccaaaactcactcaaaccgttcaaagaaggtccgatgacaatatttttgcccagttttactgacgtggcatcctagtcagcaaaaaataaaaaaaataaatatgtggggttcatatgtaagtgagaaaaatgtgtggtctcggttttttttctacccaagcttgggagtggggcaggtggccggcgggaggggcgggaaacggccggcgggaaagcgagggggaggcggcattaggtgttgccgccaccattcgtgtgccgcgtgctcgacccggtgcggggtcggcgccgggcggagcagggttagacgcggagggcggtggaggcaccgcagctggtggaggagatcgagggccggagctcgtggaggtggagctcgagaagcgtgacggcagc

SEQ ID NO: 27053 - DNA, 1501 bp, Oryza sativa
atatgcaagtgcacaggataacaaaggatggcataatagggtttcatttgcagaagcagcatttagcaaacatttcagaatttaataaaacagttaagtattagacaatgttaatccaacgctatacaacatacccggttgcataggcccaaccattctgaacaaccatcccggctgcacagttctatctccaaaccaggaatataccattccaaaccaggagctaatcagattattaccaattatagcatcatttactatggtgagaagtgtgagactaatcacgaaggacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgccccgcaatgaaccatgctatacaaaaggtaaagccgttgcccatgctggcttgtggctggcatggttaatgtttcacaaccgaaactcatgaaccggtccttaattgtcatgagcacgaccatcaaaaccatgtgctcacaacccaccattatcaggttttagttggcacattaattaattaaccaatcacgattgaccatcgtgaactattattaagccatcattaagtaatagtgattcataagttatcccaaaagtgagctaatgtttctaagcagggctaagcaattatatctaatatctagttgaaccaatataaataaagctcaactagtcaaattataataacccaaggtatcaaggaataaagtaatcaagaacaaaagggctataacaaacaataggttaattccacccaatgacattcaaaaataaatgcaatagttgaaaagaaacagtagctttaaacgggatcaacatgctcaaagggttgtttgggatctgtttggcttgccttgctggccttggaactcttcaaattcttcttctgcaaaaacggactctccgtaaacgacggaatctaaacagaaagaagcaaaatcaccaaaacagcacataaacaaacatgaacagtacatgtggatatttttagcatgtagatctcaattttagaaaaatttagagacttgaaccaactaaatcggagctaagatgaattacttatgaatttttgaagattttaattgaattatgacgcaataatgaattatttttgaaaaggaaaagaaggattattgcgtcagcgggctagggtttcggtggaccgggcgcacggcggcggttcacgcgaacggacggccgagatcgacttgatctaaaacggacggccgagatcgaacggtccacgaccggctcacagcgaacggccccga

SEQ ID NO: 27054 - DNA, 1485 bp, Oryza sativa
aggtaggataaggtgggaagggagatgggccgtgggctattaacacaggatgaaatgggccgcgcgtgttttatcagttgtgcttgtctccagtgttgggcaacaagtatcaccggaacccggatgcaatcatgcaaaaagtgcgtgacgcgaactgtgccttagctggtcactcttgtcctggagcttcacatgctgcaagagtctgcagaatgcatgcatttggcctgccgacgcgctcgatcggatatttttgccaaccaattcacgcacaccaacaactaattataacaattactcactccgtcctaaaatataaatatttttaacttaatgacaagtcaaatattttaattatcattaagcaaactatcataatatataattaatttttgtttaaaacatcttacttttataaatattggtggtcaaagtagtatctcatagactgtgtcagggtcaaaaatagtaagattttgaaacggagggagtataattaattatcacttgtagcatataactaacagcatgtctccgtggagcatatataactatagttcattaaccttgatcgagacactcttcacgaatagtattatcaacaactaattatagctactgcatttcaagttagtaatatataactagaagcatgtctcagtggatcaagcaagcagacatagtattccctagctagctaacgggagggcgggcggcacgtaagcacccgaagaagagtgatgaagctgcaactcccgccggtggagaaaccaactttggtcggtggctacaacgcgtatatgtgatctttagtcccggttggtaacatcaactggaactaaagatcatctttagtcccggttgtagagatgtcagatgttgtcagggcccccgggatctttagtcccggttgttgttactaacaggggctaaagatccgatctttagccccagttggttggtaacaccaagggaataaagatccccccgttatatatgccttcttcctcctctagcccgagagcaagcttcaaatttctcaaagaaagaggaggtcatgccaaaatttattgtgaaaattttttagtaattatatacaaatcggatatgtctaaaaggttagtaacttcatcctccaatattttttttcttgttatattacttttggagctatgtttcacacatttttttttctacaaaactttgttgtaagttgatgagagagaaaatttatgtggggaagaagaatatatagaaattttattctcatagtttaaaatatgatgaaaattaatcttaaaaaatagaaaacaaactaaattgaaaattaagagaagtacaacattaatattagtttagaacttcaaaaattgttaataagaattgctcgtcgaaagagttttaaattattttatcattactgtttgactgtcattattgtatcaaaatttatttatgtatgatttttttttcatttcatgtaga

SEQ ID NO: 27055 - DNA, 1501 bp, Oryza sativa
atatagaaattttattctcatagtttaaaatatgatgaaaattaatcttaaaaaatagaaaacaaactaaattgaaaattaagagaagtacaacattaatattagtttagaacttcaaaaattgttaataagaattgctcgtcgaaagagttttaaattattttatcattactgtttgactgtcattattgtatcaaaatttatttatgtatgatttttttttcatttcatgtagatggatcggcaatggatgtatgctgaccggcggtccaaagagtttatcgagggcgtgcattattttttgagagtggccgaagctaacaagcgtaacggttttatttgttgtccatgcaataagtgtaagaactagaaggagtattctgcatccaggactattcatttttatttgttgtccatcaataagtgtaagaaccagaaggagtattctgcatcctggactattcattttcacctgtttgagtcagggttcatgccaagctataattgttggacatcccacggtgagcaaggggttgaaatagaagaagatgaagtggaggacgagaacattcccgactgggctcagtacgctggatttgaaggaaatcaaacgggcgaggtggacagggatgctggcgataacaatgctgcggatgatctttgtaacaccccagaaactacaaagacatcgggatgctactaaatagacatacatttaacaaagaaggagaaatttcgacagcaactcctctaaaacataagcattgcggaagcgtcaaatataagtatagcattgcaagtagccatctacaaaaaaaaaggagaaaggaacattcagggatgaaataaactaatttcaactctcagattcatctagtgcaacttaacaagggtacaattcctttattataaaaatcatgacaactttaaaaattagggtggcagtgtggaatgcagctgtgcttctactcccgttttccccaagcgagcatgtcactttaagcacctgaaaacactgtaggggtgtgagaataaatctcagcaagagaattattttatcaagttatttaacctaccaaatcattaaattatatttataagaaaacaaaggaacataacattaaatataaaggcaaacatctagtgttcataggttcaagagtaaggaggataaaccagatctgcaaagacctcaggagaaagaagccctctcatgaactcaatagagtatataacttccataccccaaaatgctaaagtgcaatgcaatgcaaatgcaataatattcctgccttcacacccaacaaggtgtgaagctgcatcgtgttacgacaatacacgatgctgtaccggtacggtcgcgaccataggttcacgacataacttcgaatgaaatgcaatgcaatacaataatagaggaaagatacacagccataaatccttccaatgatatcacatataataattactctcactaaaagcataccacattaaccatagt

SEQ ID NO: 27056 - DNA, 823 bp, Oryza sativa
gcagtaacaagtatatggttagcatgtgacgctttaacccatatatttttgtttcgattcctggtctactacaattttactacgacgttactgctaaaagtgcagtaacgtcctatgtattctacagtaacgtcacgtgttactgtacttttacaacaatgttactactggagcatagtaacatattatgagtttcggtagtgaaagatattagaattgataatcatattactttctcacaaaattcttgaaacaaatggcatcattagatgaattgattacaagaatgtgttttgaactatgaggtcatgggttcaagtcttgaatttggcaatttattttttatttttctagaaaagagaaaaaatgtttcggggagaaaaaaacagaataaagaaagagagagagatcgggaggagggagggggagtgacgggagagtggtcgggaggagggaaagagagagagatcgggagggggaggggaagcgagagagaagggggaacaggaggaagggggggaggggaagcgagagaaagaagggggaacatgaggaagggggtatagaatacgggtgtagaatagtcttaccctatatatatgtatatgtatatatatgtatatgtatatgtatatgtatatgtatatatacatatacatatacatgtatatgtacatatatacatatacgtacatgtatatacatatacatgtacatgtatatgtatatgtatatatatatatatgtatatgcatatatgcatatacatatatatgtatatgcatatatatgtatatgtatatatacatatatgtatatagga

SEQ ID NO: 27057 - DNA, 1501 bp, Oryza sativa
taagtagaacaaaccaaacaagcaacccatcgttttgctcaggcttatgcttataagccaaattctaaattttaaagcttaattttagagttgattttgtgcccttttcatcatagtttatatatttatttttaaattgctaataacatgtacataaaaatttcacctacaaattaattttttagttaataatatgtggtacggataataagcataaaatgatggggccgaaaatcccagccgactcttaaattttttgtttggcaatgatcaattaatgccacaccaaaataattggcagtgggccggggccgaggccgggccaggccctagttctttcaccgtggaacggttctctagccagctggcaaggactccatgaccaagagtccaggagcaaagcaacgagcacgtcatggagtagactaaactcgtggcgtcgacaggtatccatggtggtggtggcagctggctggggctggcatccatggcaaagacagcggaacctccatgagccatggcaaggtaggtggataggtctgctcccgctcccacccttctgggccatacttgtgctggcccagcacgaacagacccatcaaaaagcaagcaacagcttcgactcaacaagcggcgaccatgaccctagaaggcatcgaccttgaagtgcaagccgaagccgagatggggacgatgcgtcagaacatgaacaagttacaagacatgcttcgccaaatgcaactgcagcatcaagcctatgaagcggcaaaacaagtcaagccagccccatcggccccccacccgacttcgacagcgatggtcaccacccaaggtttcggccatgctgcacaaccccatgctccgccggcttcggccatgtacggacaagtctatcaagctccgctgtacgttgccaaagccgctccgaccgttacagtgcaaccggccccttacaccttcacgatgcccgttcagccggcagtgacacaagtacaaccggcgaagcatgtcgaagcacagcacgccgccatagaagcatctttgaccttacaagctcagttccaagctttccttcaacagctcaatcaaccccacacaatttcgaaaccaaccccatcggcgaatgccgttggaagcaagtcaaggtgccccggtctggcagccgtcaattcggtgcaatgcaccaagcgaatcagtcaagccagggggctccgacctggcaaccgataagtcaattcggcgcggcaatcaatcaaccaagtcaagggacaatagcctggtagcaagcactgagcttcgaacagaacaccatgacccaagcatcaacaactgatgtttatgggataatcaccggtttcggctccacacagcaagcgaaccagtcgaatcagggcgtggcctggatccaagcaccacagttcgacctaggcatggtgacacaggtagtttcagccaacatgcaaggagcactgttcagaaccggaccctagccgaaagcgat

SEQ ID NO: 27058 - DNA, 1501 bp, Oryza sativa
gtcgtttcatgcttaacttcatggctcggtccttaattgaccagggacggcactagccttttccggacaccacccaaatcctccagccgccccagtcgaaaacagttgtttaactttattttcctttcacaaatcatgtcatcaatatcatggcaatgtggcgctcatgtctccacataccgcatctcaattaccttcccaaaggtaattgcccaagcatatagcatttgataaatatgagtatgcatgattctagaatagcatttctaagcaattgtcataattgactagagactcatacgtaaacatggttacgaaggaataaggggtaaacaataatcaaggcatggcataattacaagtaggatgttcataattgcatgcaattttatttgtaaacaaaacaacttcgcaattgggatcaacatgttcaaggaatagtgatgacttgccttgctcaaggtcttgcgggtcttggccttcacccggatccgcggctccctcggtctctataattatgtgcgaaagaacaatttgaattcgattagaattcaaacaaaatccaaataaatccaaatgaaagtcgaatgcgaaagttgattcctttattttaactttactattcgcgaactaaggcaaacccaatttcgattcaaactattttgcgggtataaatgttttgttgtcataagtttttaatttaatctacccgagcattatatccatataataggttagagatttttatcgcgagctaaatatcggacgaaatcctagaaatattatatgatttaatttagtctatgactagatgattaaatataatacacggctaaaatccctaggaattaaatccgaatttctaccgtgaattgattacttatagggattacccaaaaaaataatctataataatccataagaattcatctatttgtttagttattaactacatctaaattattatcgcgaattgattccttatagaaattgccaagaataatccataatttatattaaattttgcaattctatgactataattaacctataaaattccaattattttaaattttctaaacttccctaatctccctctaatttccttttttttctctttttcttttcctctctttctttctctctctctgccagcctctcttttcctctccctctttctctcggctctctctcccacccgagcagtggcggcggtggacgcgaggggaacggagggcggctcaccggcggcagcagcggcgacgacggcggcagcgacggtggcgcacggcggcgcgggagtggcggcacggcggcacgagaacggcggcgcggcggcacgggaacgacggcacgggaacggcggcgcggcagcatgaaggcggcggtacggcggcactacggcggcgccgcggtaaaaagggaggtgatggacgggaatgggtgtgggggagaagagaagggctgggggttttatagggtgtgagagagaggagagaga

SEQ ID NO: 27059 - DNA, 1501 bp, Oryza sativa
cagcatttctcagtccaaaaggcatcctaatgtggcagaaggtgctgaatagtgtgatgaaagttgtcttcagtatgtctctgggttcgtaaagatttgatgatacccggagtaggcatccaaaaaactcataagtacacagcccacggtcgaatcaaccaattgatcaatccttgggagtgggaagtcatctttcgaacaagccttgttcagatccgtgaaatcaacacacatccgccacttgccattggacttcttgactaacactgggttcgccaaccactccgggtggttgatctcccgaatcacaccagccttgagcagcttttagacttctgtcttcactgcctgttggcggtctatcgacattttgcgtagcttctacttctttggcttgcatatagctttactactagatggtgtatgatgaggtcgggccaaacgcccacaacctcgtttgatccccagacgaagatgttgatgtttttcttgagcacggccaagatgttattcgtttcttcttcacttatatcgccgcctagggaaaccacctttgttggttcagcctcgtcaacttggaccttgatcaccttgccatgtggggacggcttcggcacgattcttgctcgctcaccatcttcagcttgtacattgtctacttctctacttatcactgttgtttcgctccctagcacggccaaagactgcagccccttgactacgattaccccggccggaccaggcatcttcagcttgaggtagttgtggtgcgcgatagcttcaaacttgttcaacgtggcggtgccgaagatggcgttgtagttgtacgaaatatcaatgacaccgaagagaatcatctgctcgtgtctgttgggacccgcgccgaacgccggagctaagtgaacttggcctaggacttgcaccgcttcgcccccaaagccgtgaagcaaagtgagcgcctgagagagagccaaggtcaggaaccccatcctagtgtatgcttcggcgaagatgacatatgccgaactgccgccatccacaaggattcgacgtactttaaatctagctatctctgccgaaatgatcagcgggtcttggtgtaggaacaagaccccctcggcgtttctctgttgtgcaccgcccgaagctgcgtttttctttgcagcttcacagctgtgagggtggatctgctcttgttatcacttggataacactttgcgggatgtcttgctgttgttcggcctgagggattatgtcctgaacaggttcacagggcacctcttcggccttcacttgctgtggtcttggctcctgttggttgccttgctgccgaatgtttcggcattgctcggtggagtgcaaagagcgcccgtggaacatgcagtagagatccttcttggccttcttgcgaaagggttgctggtgattggtgtcctggtgtgtgtcaagcaccttgtggagggtctacacctcttcgactgccactcacaacctttccacg

SEQ ID NO: 27060 - DNA, 1501 bp, Oryza sativa
acctccggcacgtgaggctcaagcgtgagcgccggaatgactactgacgtatcgggctgcccgcactgctggacatcctcgacttcaacatatctacaatgacaaaggtactcgggatcacatgctaaggaaacaagggaaacaactgtttaaataaaagcagttcgaacccacagaaagttttacaacatgtagataaaggagtacagaggaaaataaaaatcctactcttgaaaaagggggaggacgaactcccccaagtcactgacttcctccatcgtgtccttacgcgcgtcatcggcggccccccgatccaaagcctctttaaggtctaagtcgcgatgcgctagcctcataaacgcaaggacatggcacgccccagtgtaaataccgttagacgtctcctcaccaagcctagccgtgtggctggaggggatctcctccatcgccttagccagttccgtgagcgacgatgtcagcaaccactcgtcgggatgcgctgggatcgaagttgtgacaccgaactccccggcgagttggtgcacgccggtgaacgatgtccgcagcgaacctcggatggctgtcagatggccctcgagctccgacatacggtgctcgagtccacgccgctacgtctcgttgccagctaccagctccttcatcttttggaggtcctcgcgggactccgccagatcacatgccagctgatcggcacaatgatttgccgacgacgccgctgcactggcctcctcgatctcgcggcccacgccgcgggcgcccgcttgaaggatgcactccatcttagcctggagctgcccccaggtgagggtgtcggcggacagaggccggacgggcacgaggcgagcgataggactacatggcgccgcctcctggtccttagtactggccatgacttccgtcgaggtcgccacagggggcgcactagaagcagcatcagccccactgtgcgccgctttcaccagtgccatcctgcgaagattttttctccatgaggctaggtgatcaaaactttgagaataaaaaaacctcaaaaacatttacttacttctcgccgaccgtcaccaacctctgctttcgctgaggcggtggagacgcacccaagtcctgagtaagataatatgatgtgaggttaagtcgttctgactacgtactcaaggacgaaagagaagcttaccgctgggctcatcgccttccggcgggtcccgggtacagaggagaacttcctccccctcttcggaacattgctgccacttgtggtgtgtcacgcccaaaacgaccctaaaatatatcctttaaattacgcctagaataattaaaatccgtgtgaaagcctccaaaaaataaaatgtgcaaagtaaaagtcaaacaaggcttagaggatttttgtatatttcctaaaagcctaaaatgcgtaaataaattttagtggaattttcagagcacaaataataattattaagaaataaacaaagttgaaaaa

SEQ ID NO: 27061 - DNA, 607 bp, Oryza sativa
taagaagtcaagaacccatttttgtgctttgttcctgcttgtcatttggagtttattagagtaaaagccttttcttttctgttggtcgtgtagacgcgcagcttcggaagatccgctcttcgtggaagttgaagccggcgtttgggaaagcgagcaaggcaagtcacatcatctttgaacatattgaatcctattttgtaaaattatgttgatttaaattattgcattatcactttatttaaattcccgcgttatcactgctttatttagccatgcctatttacctttgttatgaccttaatattgttattgttattatttccttgttcaccctagaataaacaaaaccccaactagtggacaccctactcatggtatcactagtatgattttaggtagatgcttcgctatttaattaggtaacattaggtggttttccaactctagactttgggaatcttcatatcatctggacactttggaattgttggattattgtggaattggattcacaccgctccttctattcaaaatccccaagatggttttaggctgggctcggggtgcatggttttgatagtagcacctcggccatataaggatcggt

SEQ ID NO: 27062 - DNA, 299 bp, Oryza sativa
gagggggacctccttaaagggggatgatgccctcctactcacttgaagcgtgtgaggtggagagaagagggggaacacgcacgctcgctcacctggcatggcatggcggcgcgcgcacgacgtgaaaccattgcccggttggtgtcctgatatctctataatactgcaccctcctctgcgccatccctcaggcgtcctgatatctctataacaacgtgctgcaccgggagaaggcagtttgcctcctcctctgcgccgtcgtggagttcggttggcgtcctgatatctctataataaca

SEQ ID NO: 27063 - DNA, 277 bp, Oryza sativa
ccctagaataaacaaaaccccaactagtggacaccctactcatggtatcactagtatgattttaggtagatgcttcgctatttaattaggtaacattaggtggttttccaactctagactttgggaatcttcatatcatctggacactttggaattgttggattattgtggaattggattcacaccgctccttctattcaaaatccccaagatggttttaggctgggctcggggtgcatggttttgatagtagcacctcggccatataaggaccggt

SEQ ID NO: 27064 - DNA, 1501 bp, Oryza sativa
atggaagttgaagccgacgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccttaatattattattgttattatttccttgttcaccctagaataaacaaaactccaactagtggacactctacacatgttaccactagtatgattttaggtagatgcttcgctgtttaattaggtaacattaggtgattttacaactctagactttgggatgttcatatcacctggacactatggaatggtttggttattgtggaattggcttcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgacagttcggtctgaatcatcgtaggccttgggttaaggcaggttcgtgtgggttcacggccttgataaataatattgtatagttctagactcgtgtttactaaatagttttgagcaactaaatatctttaaatgctgtttaccgcaaccctaaccctttatagtataactcctttgtactcccttgcatttattctgcacttgtgggtgtgtcttgttgagtacggtggttgtactcagtcttgctcaatttttcccaaacccagaagaggagcccctggaagatgaaggctttggtgtctagctcgtgcctaccgtcaagcgcctgtggtcgtcgccctagtcttccgctgtttctcgtttgtctttgtgtgtgctgggccttcgctgcccatgtaataaattaactatttacgcttccgcttgttaaactctgaattgtatcaacttttggtgtacc

SEQ ID NO: 27065 - DNA, 473 bp, Oryza sativa
aatcaaggtcgtgaacccacatgaacctgccttaacccaaggcctatgatgattcagaccgaactggcaacccgaccctgggtcccagctcgtcccaagccaacccaggccaaccattccacattttagttgttaagaaggttttaagaattaaaacactaacttgggtacattgctcggctagcccataaccgagggcgcggctattcgaatagattatactctgatcagaggtgtacaactttacccacaagacacatcttcctcacgtgcaaccacgtgccacataccaccacggtatacagacggaagacgtgacatagtttccaacccatcctagccatagacaagagtaccgacccaatcccacctatggccggaacctccgggacaggtaggcaggattgagcccctagcagcaggacaccagccctgtgccgtgacatctcgactaccgggccgcagctcgtgta

SEQ ID NO: 27066 - DNA, 1196 bp, Oryza sativa
ttttttcaatttttagggtgtgacacgcgggcggctgacggccgggccccacatggcagccgcggggcgcgcccgaaagcggcctcgccggcacagtcgacgggaggtggcgcgcccgcgcccctatggtcgctggcggcggccataggcacggcggagcggcggccgagagaggggagggaagggggaaacgaaatgggcggtccacggctcaccccgggtcgacggcgacgacgggaacggcgaccggaacggaggaaggcagcggcgcggcacgggttgacggggacggcggcgttccgacggtcggcgggcgaaacggaggggtggacgaggtcggcgaggttgcggcgaacccgaagaaggcaacgtcgaagcgggagaaggtcccggggcgacgacagcggtggaccggagctcggcggcgatggcggagagagagaatgacggtgcgaactcgattccgacggggagagagagcggcgagtggtggaaacggcagagggaggcacggggagtgtttatatagggttgggagggggagagagcggccggatgtgggggaatcggccgcggaagatccggccgccattgatgcgccggcgaggtttagggggaaacgttttcgaacgaatccgagggagagagagagggaaaagtggggggaaagagggagggaatcacggggaatatttcccccctcttgattgcacacggggcggacgggagcggcgggattcgcagcggcggcggcgctagggcacaggcgaggcggcgggagcggcgggaggaaggggatgacgggtgggccccacccgtcagcgagggtggcgggcgggcccgtccgtcagcggcacgcgcgcgcggggaggaggccggatgggccgcgggggagaggagagagagggagggaggtgggccgagccagcccaagaggggaaagactttttagggtttttctttttataaaatcattttaactttttttatttcttcttaattattatttgtgctctgaaaattccactaaaatttgagggctccttttagaccaaggagaatttaacaaaaattctccgggccacatttgaatttttcttgtacgtattttagtgtttgccaatttcttttcgaattttaattaattctattattccttttagaaaatgatttttatttcgggatgaatttatcag

SEQ ID NO: 27067 - DNA, 1501 bp, Oryza sativa
ctacgtactagtcaatgttaaagctaacatatatagtagattggctataagtttatctttattttcttcatcctctctctttctctcaccatgaatttaatgcatattttttagagtttgtgtgcagttagctcttgcataagagccaacacttcccacttttgtttatctctctcttccacataagcatataacttgcttatagcccactattatccttgctcttagcgatttcggatcattaggaacgatcaatcgcccattagatttttcagtccatggctccatgcatgttaccgaacgaggatatccgcactgcttttgcctcgtacgtacgaacggccggtcggctgcgcctagcgttagaaaaatcgataattttaagagaaaaattgaacgacagaattttagcaagacagagatttcagatttttgtgagatcgatgtactttgtaccaagcagcgtgctgcgtgctgatgacgctacagccaaacgtcacgcgcccacgtgccactggtggagaaaccatctttcgtcggtcggccgatttccacaatagtcccggatgcaataaaaaccggggctaaagatgatctttagtcccggttcaaaagggaaacgggcatatttgatctttagtcccggtttgtgttaccaaccgggactaaagatcatctttagtcccggttcgaatgctgtcaggacctgtcaggcccccccgggatctttagtcccggttggtaacaccaaccgggactaaagatcttaactttagtcccggttgatattaccaatcgggactaaagatcccggtgatctttagccccggttagtgttaccaaccgggactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaattacttcaaaaaagaggggaggtcatgctaaaatttctattgaatttattttggtgattacatacaaatcggaggtgcctaaaaggtttgcaacttcatcctccaatgttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactgtagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtaga

SEQ ID NO: 27068 - DNA, 1501 bp, Oryza sativa
attacatgggcagcgaaggcccagcacacacagagacaaacgagaaacagcggaagactagggcgactaccacaggcgcttgacggcaggcacgagctagacaccaaagccttcatcttctaggggctcctcttctggggttgggaaaaattgagcaagactgagtacaaccaccgtactcaacaagacacacccacaagtgtagaataaatgcaagggagtacaaaggagttatactataaagggttagggtttgcagtaaacagcatttaaaggtacttagttgctcaaagctattttgtaaacacgattctagaactataccatattatttatcaaggccgtgaacccacacgaacctgccttaacccaaggcctcaataccaccacggtacctcggaaaggagttatgacaatacacctcatacaacacaatccactgcagcgcaccttcctggatcataatcacccccttataaacaaggcatggactccccagcgacccccgtgggcttatctccgccacttctcagtctagtgccccgcaatgaaccatgctatacaaaagataaagccgttgcccatgctagcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattaagccatcatgaaataatagtgaatcataagttatcccaatagtgagctaatgtttctaagcagggctaagcaattatatctaatatctagttgaaccaataaataaagctcaactagtcaagttataataacccaaggtatcaaggaataaagtaatcaagaacaaaagggctataacaaacaataggttaaatccacccaatgacattcgaaaataaatgcaatatttgaatagaaacaatagctttaaataggatcaatatgctcaaagggttgtttgggatctgtgtgacttgccttgctggccttggaactcttcaaactcttctccggcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaattggagctaagatgaattagttatgaatttttaaagattaaatcagattaaaacacttaaatcggtttaaattgaattatgacgcaataatgaattatttttgaaaagaaaaaggggatttattgcgtcagcgggctagggtttcggtggaccgggcgcacgggcggcggttcacgcgaacggacggccgagattcgatccaatccaaacggacggccgagatcgatcgggtccacggcggttcacggcggacgaccttga

SEQ ID NO: 27069 - DNA, 369 bp, Oryza sativa
gttgtaccttaattgcagtacacttgtatataatactaaatggtgtcctgcgtgttgctgcaggatatatatgttagatattgtagaaatggtgaaataatttgaattgaaatatagtgaaaatgatttgaaaataatgatttagcatgtgtatgtttaattttagaatgttgagctttgtgtgcttagaggattgatgtggtatgcttgcatgttagattttaagaatgctaataaatattatgattgcatgttgagctttagatatttagtgggtattagctttatagaaagaagggacatatatattagatgaaaaaacagttattagcatgtcgcatttgaaacaaatatatgaatcattacagg

SEQ ID NO: 27070 - DNA, 1501 bp, Oryza sativa
caactaaaatatggaatggttggcctgggttggcttgggacgagctgggacccagggtcgggttgccagttcggtctgaatcatcataggccttgggttaaggcaggttcgtgtgggttcacggccttgattaataacattgtatagttctagaatcgtgcttatcaaatagctttgagcaactaaacgtctttaaatgctgtttaccgcaaccctaaccctttatattataattcccttgtactcccttgcatttattttgcatctgcgggtgtgtcttgttgagtacggtggttgtactcagtcttgctcaatttttcccaagcccagatgaggagttcctggaagatgaaggctttggtgtctagctcgtgcctgccggcaagtgcctgtggtcgtcgccctagtcttccgctgtttctcgtttgtctttgtgtgttgggccttcgctgcccgtgtaataattatatttacgcttccgtttgttaaactctgaattgtatcaacttttggtgtaccttgcctcctgggacaaggaacaatacacgcacgtcaggaacgcctgttgggtgatttccggtcgtgacaagtatacattaaggaaatctatcacgtgataaggatggtatctacggatggaaggagttctactcggacaagactgggtctttaccatattgtgaggggtccgatatctccaagtcctactaagagatcaactgacccgcggtatatcagggaccccctgggcaggacctaaggtcatcgaatatcaccaccaacacacccaccacagcctacggagccggagcgtgcaggagccaagtcgtcgggtgtcgaggagatgatcctctctagcgggagatcgtgagatcccccttttgtgagttcggccgggggaaagggctcgcctctcgagattgcgtatccgccttgaatgctcctaaatcgcatgcgaacgccaagattacacaggttcgggccgctatcgagcgtaataccctactcctgtgtgtgggactagtggttgaatgttacaagggatcctaactccggagagcgttcttgctcttcgctttcctagagttcaggtctactgagtgtcgtcccctttctcggtaggcaaggtcctccttttatagttcaaggggataccacatgcaccgcctctactctactcttccatgggagggcgacccactttaccttgaccgggtcatgacccgtgccttcgcctggaggctaagcagcagtccgtccttgagcaggacacagcgccaccccccacctgacacggggaacagccctgtcattccctcataaatgggtgaagacttgtggtggtcgtcctctcacggagggaactccgaatgacactccgatgggacgggacatacctacctccactccgccggatacagaggcgacgtgggggcacggccacccgtccaatcggacgtgaccggcaataggccggtcacagactggtcccgcctgattg

SEQ ID NO: 27071 - DNA, 1501 bp, Oryza sativa
tacagaaggagtcgtataagaaatctctttaaaaaacttcatgctaacttgagacgatcggacccctaattgcagctcataattttgtaaaaagaatatcaagcgaattcccacagtgaatttcaccgtagctaaaccgtataacaataataagattaaaatagccttcactcgttgcaacgcatgggcatttttctagtttctctaaaattttattttgctccctgtatacttgttcggttagttgaacgtgcgttggctattaatttttcaaagtgactatattattcctctctcatatatatttattgtgctacatcagtgataaaaactcaatcctcaagtaaaaaagaacatttatttctaaaaaaaaagggtctaaattatttgaccacaaattgaaatgaataaaattgaaacttttaaataaattttaaattaattttgacgaaatttgaataaattttcacaaatatttaaaaccaaataataaataaatttggttctcaattgctagccgaaacccttatactaatttaattaaatattcaaattgataaaattcatttatcattttttgttgaaataatcatatccatttgattttattgtaaattgaggagtaaatttcattaaactatatatactttaatctatctatcacaaaactacacttacgtcatcacttcgtgtgaaaggattaacccgggagtgatatggttagaaggaagaggccttataagttggttctactcatggtaaactagcaaggtagtactaaacatgcgcacacagctcacataggccacacaagccttttcctaattggaccatgatgtcacaagtgctatggatataaactctaaaatctgtagttttttgataacttcattactaaatctgtagttttatgatacaatgatttaaatatgtagttttgtgataaatttcgctctagatttgtagttttatgatatacattcttaaatttgtagttttgtgatagtttggtcaaagtatctatggttttatgaaattttctctaaattaaaatttttgacatgagatttatgaagtatgtaacacaaaagtataagaaaggagggacatgtagtcatttttagaaaataaatttatcgattaacttacagttaaaactaacgaaataggcatggagattacgtagaaaataagacaaaattcagacgcataaaaggattaagaaagttcgatgtgtggtgtgtgttgtagcgccgccgggattgtaggaaattttctatacatgctccattgctcctatatataatgcaaggtaggacgctcacaaaggagcattcatacgtagcacacatacaacttgctctcaagagtaaagccctctaataatttctctacacactctccagtgccatgcaactccacatcctcctcctcctccttgctgtcacagtactcctctcgtcgccgacatgggcggcggccggcggtgaagatcaggcgg

SEQ ID NO: 27072 - DNA, 1501 bp, Oryza sativa
cggattcgtccgatttccttcccgaaaccctcgccggcgcaatcaatggcggccggatcctccgcgaccgattcctccctctccggccgctctttcccttccccggcgctatttaaaccctccccgtgctccgctcttccgtttccgccgctcaccgctcgctctcgccgtcggattcgtgctcgcgccgtgctccgccctctccgccatcgccgccgagttccgttccgccgccgtcgccactccgggcttcctcccggctcggcgccacctccctcggcatcgccgcatccccgtcgaccccgtccgccgctccgcttcgcccgccgaccgtcggagcgtcgtcgtcatcgtcatcccgacccgctccgccgctttcctccgctccggccgccgttctcgtcgtcgtcgttgtcccggggtgagccgaggaccgccgttcgccttcccccttccctcctctgtctcgggcgccgctccgccgcgccgatggtcgccggcggtgaccatcggggcgcgggcgcgccgctcccgtcggccgtgccggcgaggccgccttcgggcgcgccctcgcggctgccaggtgggcccggccgtccgccgcccgcgcccgcgggtgcggctgacgcgcgggacccacggcgccgaccgccgccagccgcgtgcgcccggtccaccgtggaccgtggggctgacgcgtgggccccacttcccgtggacccggcccgcgcgcccgctccctcggctgacgcaataaataggattttttttaactaaaaattaaatgaagaaattcgcaaatatccatttaaagagcatataaacttcaaatggccatatcttggccatttgaactcggaattggaccgttcaagtctctaatttttcctcaagatgtaaagaacccatttttgtgctttgtttctgctgttatatggagttatttagtgtttaagccttttcttttccgttggtcgtgtagacgctgcagcttcggaagatccgctcttcgtggaagtcgaagccgacgtttgggaaggcgagcaaggcaagacacatcatcttgatcatattgaatcccagtttataaaattatgttgatttaaattattgcattatcgctttatttaaattcccgcgttatcactgttttatttagccatgcctacttacctttgttatgaccttattattattgtttttgttattaataccttgttcaccctagattaaacaaaactccaactagtggaccctctactcatagtaccactagtataattttaggtagatgcttcgcaatttaattaggtaacattaggtggttttataactttagactttgggaaatattcatatcacctggacactttggaatggttggtttattgtggaattggattcacaccatccccctttattcaaaatccccaaaatggttttaggctgggctcgaggtgcatggttttgatagtagcacctcggccatataaggaccggt

SEQ ID NO: 27073 - DNA, 712 bp, Oryza sativa
cctgggtccacatgtcagcctcactttccattcaaacaaaagtgacgtgggatccggtgatgggtgaggctgacatgtgggttcgaatagtatttgggaataaaaattttggagagtggtatttgagcactgacattttgggaagatagcaaaaactaaattctccccatgcatggttcataggaagctctactaaccaatttatcctatcacactgtgattagggattgttgcttgcttgctttgtatctctgttcaagtttttgtaagaaaaaattagttatgttacactgttggacaaagtcttagcagtaattccaataaaaaaacaaattagttatgctactgtaggatgttactgtagaaatcatatcttattactacgttttcatagtaacattatcacagaacggcagtaatattatatgttaccgtaaaatttgtaggttgttattgcacttttggcagtaacatcataataaaaattgtagaaacagagacttgtaatagtaacagtgatgctatagtactaatgcttgtgtagagctaaaatcttttaaatatcgatctttagagagcaatatctatcacatcatatcacatcatatcatgcttttctaacccgaatgcaccatgacgttcgtaaaaaagttcttaacgaaattagatcatcatgattattttttgacgtcattatggtggaaagcaatca

SEQ ID NO: 27074 - DNA, 1501 bp, Oryza sativa
gaaaaatctagaaaatagaggaacaagcaaagtatttaacaaaattttatctagctcatttttatgttgagatttagcaaattaaaagaaaagatcttctcttttaaacttttaaaatcatttctaataattccttttaaacaacaatttataatttaaggattttaaacaagaaaatcacttaacaattataattagatcattacctgattaatttgatatttaaataattgctgaacttttctttgtatgattaaaattaacaattgagctccgaaaaatccgagaaaattccagagagtataattaatcatggaggacttaataaaaattaaatccatctatgcttttttttatttaggaaattttatttcccacatttaacttcacttgtaaattaaagaacatttaatataaattctattaataatttattaaataatttataaatcctgaaacgaaaatcaggatgtgacagacttgcctcgccaacatggcggtcgaggcatctggaggcacagcagatcacgcctgtcaggaggcagcctacttgatgatggccagactacgggagcgccacaactacatcttccacgacacggcgtaccgctaccaccccagtcgagccaacggtgatggcgtcagctccttccgtccgacagctggcgagaacgacaccaccttcggtcacatgtgtgctgtgatgaggggattggacaggatgcactcggacctgcacaaggcgaccaaggccttgaacgatgggaagctcatgaggatcgtcgctttgaaggacgagatagcgcgcctgaagaaggagaacgctcagctaaagggtcttccagcgccaggaggagtccggatccgcaccacgccccgcaagacgacgacggcacccgtgcgcatccagcttgcacccagaaacccacctccagcagcagctcccgcagcacctccagttccgcccgcagttcctgcagctccagctccagctccagctccagctcccgcgtccgctctctccttcgctccagcgtcagccgccagaggtccagccagtggcaccgggggttggttgtctgctactcccagtggcagccgcgatctcagcagcagcagctccagtggctcgcagtcaggcagcggcgagacgtatctgccaggctccaggagtcgctcagagggacctggtgacgagcaggaggacgctttcgactccaccgaccgcaggagccgttccgagcattatgctcgttttcccactagtttaccgactgtctagcttttgttcgttagtttgtgtgtttaggttgtttgtttgggtcagacgacggtcgatatcatgtgcctatggtatggctgtcttaataaggattggttgcttgctcttttaagtgttttaattcagatcagaacaattgcagtttaaattcctttgtaataaagcttagttcttgagcatctgtttttcttctttaccccggctgctcttccctccaga

SEQ ID NO: 27075 - DNA, 1501 bp, Oryza sativa; identical to SEQ ID NO: 21971

SEQ ID NO: 27076 - DNA, 1501 bp, Oryza sativa
atatcgagataaagccgcagaagttctgtaatccaactcggccacctacaacagtgttgacttcaaacagccgccaaatatgtatacgagctccattttgagtccatgagtacttgatggaaagctctcggagtgcgctttccaatcggatatatacagcctcatctccaaattgcatcttagttggctacaatcatagaaaaaagatgttgtgtcacctatattgggtctatgggcttgtagaatggcataataaattcgatttgagcaagattataataaggtagctcatacgcttcatacagagaaaccgtcatatctttttggtgatgaaggtgttgatgtcgagcatgctatctcatatcccgttgtgtgtgcaagaaaaaacatacacaaaaatatacacgctcctatcaactactaggtagtgtaggctcaacaacaccggatttggtggtgatcagggcagaaagaagtgggaaagtggcagcggcctccttctcaaatgtacagggcgccgtcaccacccaaatgtacagggcgccgtcaccacccagaaacattaggcgaattagtccgagaataatttatctactctaatctaatccgatgtcgtttgcttaaaatgggatggaagtgttacgtatcaagaaaaatcagtggcctgtgctgtgcttttggtcaaaagcggaaaaatcgtatgctactacctctgccccaaaatgtgtatccgtgggtatccatatcaaacgtttgaccgttcgtcttatttgaaaattttatgaaaaaattaaaaagaattagtcacacacaaagtacttgctcatgttttatcatctaataacaacaaaaatactaatcataaaaagaattttaaacaagatgaaccgtcaaacgttggatatgaggggtattttttttggactgtctatgtgacatgcggcttaaaatttttgttttgtcaaccgtttttttttccgctggccgtgcgatcggcgcacggacgatccatgcgcgcagaaagaaagtagcatgatttttttttcttttttttaggccacagcccatttctgtttttttaggccactgcccacatcctcttttctttaaagaaacaaaaagcccgtcacaatttgtgcagaaaaaaaaggaaaaagtacaccgcaggtccctcaacttgtcatcgagttacagaatcatcccctaaccacaaaaccagatatatagcatccctcaacttataaaaccattcattttaggtccctcggtggttttaaacctggttttgtcctatgtggcggctgagtcagcgtgggacccacgtgagtcccacatgttagcgtcgctacgtcatcaccctctctcttcccctcctttctctctctctcactcttttcttttcttctcggctgaggcggaggccgccgggggagaggaggaggcggcaggcgacgaggcggcagcaacgccggagaaggcgagggcggaggccggtcgcgaa

SEQ ID NO: 27077 - DNA, 410 bp, Oryza sativa
aagaaatacttagatttaaattataggtgcaagatgatgaaaggtgacttgccttgctcgagatcttgagcttgatcctcgaaatcctcgcactgcgggtcttcgggctccgaaactacacgcgaaacgggacaactcaacaaacggcgaaaataagccctattattgacctctaagcgtgccattagatagatctcgagatttgaggaattttggaagttgaacggagtcaaacggacttacggttgggtagatattgaatttctaagattattggatttttgatctaaaggaaaaaggatttaattaaacccttttgaaaaagaaaagaaaaaggaaggggaaatagactttcctcgggcggctagggcgtggcccgagagaaaaaggggcggctcggccgagcttaa

SEQ ID NO: 27078 - DNA, 1501 bp, Oryza sativa
taggccatgttgtgctggctcgctcatgcacttgtcgtgttgatacaccaagccaggtagcagcccaagcacggtgtggctggatcggtcgtgccagcaaaacccatagccaaacggatcatgttgttcctgagttgtctaaatgtgtgtccagacagacacagaaagacacaacccatttgacaacctataggcggatttagcaaacttctagctattcttatgtttcttttgatgagatcaattacgacacctcagtcgcacctaattaatttgattggtgtcgaattaaagggaacctttcaaaaaaatttaaagatgttctcttccataatagctgacggagcgtgggggctcctcaccggaagaccgcgcaggcccccctttgccggttcggccgggggcgctatgtgaggttcttcgccctcgatctgaggaatgtcagcgagaaggagcgcacaagacacgggcgacgtagacaggttcgggccgctgagaagcgtaataccctactcctgtgttctggtggatctgtgtgtgaaggaatacagagagctccagagcgagagagagttcagcctctttctccttcctcttttttttctcccctctttcctaggcctgggcctcctttttatctggtccggggtcaccacaagggcctcccgctacctaagaaaggaaacatgctttttacaatgagggctaatctacagccggaaatgacctctgacaagcagtacacacgcctcctgctccgctcgtcagctctcccggtggacgcccgtttcaaccttcattcaatggccagcgactttcttgccatgcttgcgctgaagcctggaatggatctgaccgggactgacataccaactccaggagtcagcacgccagctccggctagagacgagagccaggaagctctcatcattccgacgggacggggcgaggcgtgcgacaggccgcctgttgccacctaacccgcgatctgaccggtctgtgaccggtcacacaccgcgatcagtcacggaccggataagcgcgcgctgcgccgcattaaatgcggcgtggcgcgctcgaccaacctgctataaatgcggttaggtgagcccgctatgctcacctaacccacacacgtggcgccaacaccacggggggtcggggagccccagcccttggggccgaaacgggagcggcccgacccctcggggagacagagggaggggtggccacgtcaccgtcgggcccgacccccccgaggaggtcgggccacgtgagtgatcgcggctacccaagcctctagtcacaatacccccggccccatgtcaccgacagtagcccccggcgttacgccagggcgaccgcccccctcgagggaggcgctcgggcgtgacgccactccttaggcccggtgacaggtggggccggtccccacaggcgggcagaaacccaacggtcgcaaatcgcgcgcatcggcaagggaaaaaccgatcgacaataa

SEQ ID NO: 27079 - DNA, 1501 bp, Oryza sativa
ttttcggtggaacaaaaaataaaacgaattcccttaataggggtttccaaaatatgtaggtttttttgttgcaatgaaagatttcagttcactgcaacattagatctatacatagtgaaacattgtgagtacactcggtgaaacattttttgtggatcaaaaaataaaccaaatttctttaatagatggtttccaaaatatgtggttgatttgttgcaggtgggggcagatattatggtggggcctaacgacatcaccgcgcactgaggcggggcggggggagcgccctatttttgctccccccgcccggtagcccgaagacaagtattctcgatcttataacgcaatataattatgagtggttggacaagaaccagcaggtcatcgacagcttccccggcgccaacacgtggtggaaccagctcaaggacaagcgggaattgaaagcacaagctggtgttcgtgttccacaagcgccaccgtgagctcatgcagagcccctacctgcgcgacataatcctgcgggggcacgagccaggaaccaagagccggctcagctgagagataggtggctcttcaccaactgtggcagtggtggtaatacgatgtggtcctgtggagccacatcccgtggaaacatgcacccagccacgttcgttccacactcgccatggaccccgccaagaaggatgagatcaagcacgtacgttgtttcgggaggggaagaaatagcacttcgacgttggaagcgtggcttcctgctgtacggtccatccggcagaaagtgcagcatgatctcggctgtatcccactccctcggctacgacgtctgtagcatgtttagttctaaaacaaaacattttcacgctgtcatatcgaatatttagacatatgtacagagtattaaatatataaaataaaaaaataattacacagattacgtgtaaattgcgagacgaatcttttaagcataattgcgccatgatttgacaatgtggtgctacggtaaacatttactaataacggattaattaggcttaataaattcgtatcacagtttcctggcggaatctgtaatttattttgttattatactacgtttaatactttaaatgtgtatccgtatatccgatgtgataactaaacccaaaaaattttcccaactaagggggtgttaagatccaagggtgtgtaaagttttgtcgtgccacatcgggtattatataaagtgttgcatagggtgttcgggcacttataaaaaaaaactaattgctgtaggatcacattgtcaaatcatggagcaattaatccgtcattagcaaataaatttattaagcctaattaatccgtcattagcaaatgtttactgtaggaccacattcgcaaattattcgcaaattagtcgcaacctatgcagatagttattttttagcttatatttaatacttcatacaggtgttcaaacaagaaccgggaataaagaggtttttttgtcccagtt

SEQ ID NO: 27080 - DNA, 1501 bp, Oryza sativa
attagctttttgttttgtaatatatatgctcgtttcttgtgcatacggggagttaaaatctgcatgtttctttattctcccccaccatattgtcacgatcgccacagaatttggaacttctagagggatcgtgaggaaatcaggaagcacgagaggaagaagaaggtagttgcgacagaatattgagcaggaagagagaagatttgaattgagtttgagatattttctattacaagtcatctctctccactgccgactttatatagcatatcattattaggtctcactcactgaaattgggcccagccgatagctactggacccacactcctcccacatatcgtgggcatcactagcgtcctgtcagctgatgtatccaccatgacacatatactcacattaaataaaatatatgctagttaagtttttattggtcttgatgaaaaaaaagttactatatcaagagacgaaatggtttgttgagattcgcggcttgcttggaatgctattaattagttctgaacctggtacagcaaaaatacaacaatagactcgaattttccttttctaataattttacgccaagtggtatgtttgaaaaagaatcggaataggtaaactttaaatattacgaaccttcttttccttggaaattaacatgttgcgttggacaatgacgaacggcagcatcactgtaattgctttagagaaaaaaggttttttcaccctatgagtccattgtaactcaacaatcgaaaaggttgtttgcactagaatagggttccggttctaactaaggtaatactatctccgtaataaataaccatgcaagaacgaagaaatctccataaaacaaacccactaagcaaaagggcactcctccaaaggcttagaaatttctcatcctaatcaaacaagaatatacaccggtcaatcatgattgattaaaaatatatgagttgagattaattcgaactcaatacatacgttctaggaactgacgaggtgataataccatatcaagattcagtttttccttttgagaaaattggaactgtatttgggaccaatcctgaagaaacaaaaataggaacactatgatctactccctccatccagtatatcactaataatgattatctaatccatattcatagtaagagccagaggttgtatctgatctaatattatcgaggcacttttgtagcttagtctgtctgtaagaactattatggctttttaatgaaaattgggcgcaagcctttcctccaaaatattatcgaggcaactacaaatcgcactgctagctctgaactgagcctatcactgaccgcgtccactccgtcgtgaagcgggggctgctgatccgcgaccagtcgcacgctgccgcgcgcgcgcgatcagctgccccctctagtctgatctcttacctatataaacgtactatatgccatatatacatacgtataaactttatatacgtatatacaaagtttatacg

SEQ ID NO: 27081 - DNA, 1501 bp, Oryza sativa
cacatactctaatgtttgcttgcaaaatggcaaaaaaataaaaataaaaggtgtacacatatacatcatgtagtgctgcaatttgagacaactgacatgaatacagacttggatcaaatctgtgacgaaattgcagcactcaggatgctcttaacaataaatctcacaagtcacaacaatgcaaaatctcacaagtcataacaatgcatcgttgctttggataaattgcatcttcggggatcagctccacccgcacatgcgccgtaggagacggcgagcggccgaagaccatgggtaatcaggagccatctcgattttgctggccaggaagagcgcagcaatgaagggggcctcgccggggaggcgcaagctgtggcggtggtgatggagtctgcgacggcgcagaggccttcccctctcccccagtttcttcctagcggcgccaccgcgccagtggctgtggctcagaggtggcatcgatggttgtggatgattttgtgtcatactgggtgattcccgcgctttgctgtggtgattccccacgctttgctgtggaaattcctaactaacttttaatattttttaataatcgagctaaaagtaaaaataatattagttattaacaacgggcctgttcggctgcatgtgctgcagcgcagccgcagccactgcaaccagcttacctaacaggcccaacaaataaaaatggtttgtcaaaccatgttcaaagagaagaaatatatttagtagactctgtatgagattgtagatgaaatatgatattcccgtactttgattatatggacgaatatatgttaattattataaaaatgatgtgtttgtgtatgtgtgtgttaaaaatattgtgaaaatattgtgaaggaagatgattggatgttgatttatagaattcaacgaattacagatgatgttgcatgcatgtggatgataaggtggcatgtttgcatgttgagcttagaatataattttatagatgtgctgaggctatccgctgttctagcttgactccgtccgatgccgaatgaagttactagagctatcggatgtcagaggattcccatgcaaacgatactgcatcttttctcagagctattctgcatgagcatctgctttgctctctctctcccttcccttttcttcgtgtaggattttgacgttgacaatattgcatttggctgactcaaccttttgtacttgctctcatagtcataggtcattttctcttgaacttggtgacgcattatcaaacccaaattactccgtgataacaagaaaaaaagtcatactcttgcgtcattaattttcaaatgttgtattgcttgtgggctctttggctgtgatctggaaacttttctatgtgaggtttaatgaagacgaatcattttgtttcaaagaaatgaatttcacgtaggaagattcagataagatcattttttgacttactgtatcttaggatcaggatcctatcaaaagagatgta

SEQ ID NO: 27082 - DNA, 1501 bp, Oryza sativa
tgcactctaggcgtacacggtttctagcagtgagaggagttctggcgcacccaggaagggaagttttacacccatgcaattaagttataactaagttcaactcaacacacgacagtcctaacaatggcgacaccattgtagagcccctgccttacacatgagaaaccactatgcatggatactgcttccgctcggctattaactccgctaggtctatccccattcgagaaatccggggtcgtttcatgcttaacttcatggctcggtccttaattgaccagggacggtactagcctttcccggataccacccaaatccaccatccgccccggtctaaaacataggtttttaattcctttcatgtcaccattatcatggcaatgtggtgctcatgcctccacatgccgcatctcaattaccttcccaaaggtaattgcccaagcatatagcatttgataaatatgaacatgcaagattctagaatagcattttctaagcaagtgtcataattgactagggactcatacgtaattatggttacaaggatttgaaggaaaacaataacaaggcatggcataaccacaagtgggatgttgatcattgcatgcaatcttgtttgtaaacaaaattaatttcgcaattgggatcaacgtgatcaaggaatagtgatgacttgccttgctcgaggtcttgtgggtcttgaccttcgcccggatccgcggctccctcggtctctgtagttacgtgcgtaagaacaatttgaattcgattagaattcaaataaaaatccaagtaaatccaaatggaagtcgaatgcgaaaatcaattctcttatattatctttactattcgcgaattagggcgaaccccattttgatttaaactattttgcgtgtataaatattttgttgtcataagtttttaatttaatcaacccgatcaatataccaatataataggctagaaatttctattgcgagctaaacatcggacgaaatcctagaaatattatacgacttaatttagtctatgattaaatataatacacggctaaaatccctagtaattaaatacgaattgctaccgttaatcgattacttatagagattacccaaaaataatccataataatttacgagaattcatacatttgtttagttattaattacatctaaattactaccgcgaattgatttcttatagagattactaagaataatctataattaaattttgcaattctacgactataactaatctataatcatactctaattattttaaattttctaaacttcccaatctccctctaattccctatttacttctttttttcctttttcttttcttccctttctttttcttttctttttctctttttctctcttctctcttttctttcttttctttttctctctcctttcctttctcctcccggcttccttctctcttcctctcttcttttctctctctctctcggcttcttcctcccgggcggcga

SEQ ID NO: 27083 - DNA, 1501 bp, Oryza sativa
gagcccgtggtgtggcggcgaaagggaaaacgaagattggcgtggcgccgcagcaacgaagggaaggcagagaccgttacggtagtagcgaatgcatggatggaagcggctggcgggctacggtgctagagacggccagcgagattgagcgagggagaaggccgagtggttttaattgcggatggcgaaatctgagtgtaggtggcacgacatcgagggcaatatcaaggggagaaggaagagtgccatcgacgctagccgacagggaaccacgatcgccgtgatgggcaggcgaagggtagggatttcaccattgaggccatgtttagtttccaaaatttttttcccaaaaacatcacatcgaatctttggacacatgtatgaagtattaaatatagattaaaagaaaaactaattgcacagttagggaggaaatcatgagacgaatcttttgagcctaattagtccatgattagccataagtgctacagtaatccacatgtgctaatggcggattaattaggttcaaaagattcgtctcacggtttacaggcgagttatgaaattagttttctcattcatgtccaaaaaccctttccgacatccggtcaaacgtccgatgtgacacccgaaaattttcatttcgcgaactaaacaggccctgatttaacctattgaattggaaggggtaaactgaactactcctttttatactagtatagactagaaaaaatacccgtgcgttgcaacgttttaatattattattgttgtacggtttagctaaggtgaaattcaccgtgggaattcgcttggatattctttttacaaaatcatgagctgcaattagaggtccggtcgtctcaagttaacatgcaagtttttaaagagatttcttatatgacttcttctgtatttctaaaaacaaacaaagttaaaaaccgactcaaacacggatctgtatttccaaaagcgattgaacttaaaaaccgattcaaacacggatgacgtaccaaaagtatcggcaaaaacatcttcaatttttataatagtagagataaaaatagacatatagataatagatatcgtgtgatttgttgtgtttctcctttgggtgtgtttagttcgtgaaaagaaaatttttggatgtcacatcggacgtttgaccggatgtcggaagaggtttacggacacgaatgaaaaaactaatttcataactaggctggaaaccgcgagatgaatttattaagcctaattaatccatcattagcacacgtggggttactgtaacactttatggctaatcatggactaattaggcttaaaagatttgtctcgcgatttccatgcaaactatgcaattagtttttttatatttatatttaatgctctatgcatgtgtcgaaagattcgatgtggaaaaaaaaatccctagcagatcctctatccggtactccattcgaaatatagcgcatgggataagaaattgtccctccaacagat

SEQ ID NO: 27084 - DNA, 1082 bp, Oryza sativa
cctgcagccctatattagaataaggtagagagtgaggggaagctctggaggagtgcccggaagtttggcgctcatccgacttctccctgacgagtgtagcttcctaggaggaatttgagaggagtaccagagctgtcggtacactctgctccgggttcggagaacttcttctataaagtaagcattcgtgtttatttcttatgttatttaattactttgtttaagtaagatatatttccatctttgcgggttcattgtttagtatttatactaagtgctctagtactaggactctggataaagaaggaagttcctgtacaagtattagagtagtaattaataacttagacatggtgtctaggttagaggatacccttgtttgttgtgtatccaccggatttgtcagaggtaggcggcaagtggtgacagccctgaatcccgtcctagtaatcctccatgttcggatacatcatagagctatagccggaaccacgctggcagaccagcaggggtcggtgcccgaagcaacagatagggaattaccttacttagagtagataattaaaacacatagaaagtcctctctagcctagcctacctatgatcagttgttgtccttggatagtcttagccttaggtagattacacacgttccctgagtttgatatccttttggggtcacccgaaggtaaagtgctacagcggtattccgtgcgcttgcggatttatctatggtcgtaagaaatactaacaagcatttctggcaccgttgctggggaacggttgctaatttatccgagtctaggtcatcctcgtatctttatttttatttcttcttcttttattcctttccttgatggaggaacccacaattcaaaacctttctgcttctcgggctgatctttgtgagccatcctgttcttcacaaccaatcctttccgatggctacgaaatcggtcctggctttatagccatgattcgagagcaaaccttctctggtggtattggtgaaaatccataccgccatcttcgggactttgagctagtgtgttcatgtttatccatcgtaggcatgacacatg

SEQ ID NO: 27085 - DNA, 159 bp, Oryza sativa
acagtggatgattaatactgcttaattacttattacaactggttaaatcttgaaatctctgtttataaatgctcgctttatgcaaaggaaccactttagcttttctttgatgattccctgcatcatacctctattccggtatgacttgctgagtacagt

SEQ ID NO: 27086 - DNA, 200 bp, Oryza sativa
actgttttcgcattcaattcctgtttataaatgccagtatttatgcaaatgaacctgcttagctatcccttgttaaatccctgcatcatacctctattccggtatgacttgctgagtacagtgggtagtactcagtcttgctctacttttcccccccaacctcagagctcgagtatgtgtccgatggcgggttctccgag

SEQ ID NO: 27087 - DNA, 1053 bp, Oryza sativa
cagcgagcagcagcacagtgcagcgcggcactgtagctctcgctggtcaaaatctaacatggctaaattcaaaaccgtattgttcttccattcagtgaaattagggactctatggtttcgcttatcgacggaataagcgaaatgatatttttgcaaacgaaaagtaatatgtaaatataatttatatatacgtgttcttagcgatctaaaagagaaaaaaaaaacctaaattcaactctaaatttaaggttgaatattcaaattttggctcataagcataagccaaaacatgttttgagactgtagatccatcaagggaattgacaatattgttcttccattcttaagttgtcccattgctgaaaataatgcatataactaatttatgttggcttaatcaattacatataaaataaacttagggtgtgttcgctactggaggcccaactaggaacagtgcgggcagaaaacggagcggtccattagcgcgtgactaattaagtattagttttttttttcaaaaatggatcaatatgattttttaagcaactttcgtatagaaactttttgcaaaaaaacacaccgtttagcagtttgaaaagcgtgcgcgtgaaaaacgagaggagaaagttgggaaccagcagtgccgaaacacacccttagaattttcattgtcaaaacaccgttgggcagaaaataactaaggaatagaacaacaaatataattgacataaaactataattactttggtcaaaaaataatttcatatcattattcctttgtagctaaacttctctcatggtttcatttaactagaaataatttacttactaatcaaaataatttttagcagtttaaattagctaagagggatataaccaaaattcttgaaatattaaacatttaatcggcgggttaaaataaaaaaaattcaattcagcccattacttctaaaaactggcccaaaaaccgggccggccagtttaagcgcgagccgagtgcggtggcgagcgtggcccagtgatcttctgtggcccatcggtggtggcagc

SEQ ID NO: 27088 - DNA, 1501 bp, Oryza sativa
gaggagcagttgggtggtagtcagctcctcagaacctggaaaagctgggttttccaacttctaacttctagtttatttcctcgattttacaactacagcttctcagagtttaaattaaaagctagactatttggagaagcttctgattctgggagaagctacagcaagtagaagctctccaaacaagcccatactttgtatctaagtctgcttcaacactttatctccatctatttgagattaatcaacaccaagaccaacaaagggagaatctgcatgtgtggataatatataaacaaattctccacaagtacatttgctctaaattctgtctaaattttgtaacatatataaacatcctctccgaattaaattatgtaacatatgctctaagggaccacctatatgtttgtcgataaattttctcctacaaatttgacagatgcaattatagtacaatcgtagtgtaattacactgtaacttgcatgtaagtttcacgtaattttgaattgttagatatattacaagatttgttctaatgaggaagaaaaaaaatcacagaacaaacatatgtgaaatgatttgttcccatgaccttcattttaccgaaataacatgttacagagagatttttaaaagttacacacaagttacagtgtaactacatgtaagttacagtgtaattacactacgattgtactatgattacatctgtcaaatttttgggagaaaatttgtcgttaaatatatagcacaattgggagaatttcgtttctaaaaaagttttagggaataccatgtgtaggcccaggcgcccagcctattaacgacccaactagggcctgttcaatgcgggactttcagcttctcagcctcagtccgagtcgaaggccgtagtagatctttttgctcggtgagagaacccgttaacggtgcgccgctgctttgctgttgctgtgtcgtgtggtcgtgactcgtgtgactcggtgcgtgagcataatccacacttccacagagagagcaagacgaggtgaagcggcgcaagcaacagtgcaacacgccaggcaacacggaagcgactagcgagcgagataattatcatcgtccactctatccgcctccagcttgccccgcctcggtcctcggaggtgtaggagcgaccgaccatggggagcgcgggggcgctgctctcgcactcgcctccggggctcggcggattccctcctcgccaccatcaccaccaccgtctctccgtcctccgttgcgtaccgctcctcccctccccggcgcccgagcccctcagctgtcgccacggccggcaccttcgctgcgccgccgtcgacgggggagccggccgggagacggagcgtccctcgccgcccgcacctcagagggaggagtcgccgtcgggcagcctcggcgcagccctcgaggacccatctcctcaacctggtgtgccccttatccttctccctttatgttgccgatggtacctcaagt

SEQ ID NO: 27089 - DNA, 179 bp, Oryza sativa
ccgaaactccttcatcagtttttggcacttctcattataaactacaacgtatcattcttacactcatattctcatgccaactgactgattactaacaaagaatcccccatgatttcaacagcatcggcttcaacctccttgagcaattgcaaccctttaagtactgcctcatactcagc

SEQ ID NO: 27090 - DNA, 238 bp, Oryza sativa
cataaatttaaatctattgatatggatctatatgaaggtttctagtgcatttcatcatgagctcttttggttctaaatttggtccatttaagatcaattagaacactcagaaagaaaatggattatacagagctaatttcatactcggtggaataggaagagcatcatagagctgaaaaacaaaagcttaaaaaccaacccaacctcgctaatgccaaccataaaggcgaaagaaaga

SEQ ID NO: 27091 - DNA, 1501 bp, Oryza sativa
tggttttacaactttagacttgggaattatttcatatcacctggatactctggaattgttggattattgtggaattggcttcacaccgccccctctattcaaaatcccctaaaatggttttaggctgggctcggggtgcatggttttgatagtagcacctcggccgtttaaggaccggtcttcgggcctctgttgcaaagcactaccgtacttccacatgtctaatgggtaaggcttagtttgtggctcagtctagtcataaacaaaagtacacggattggagatggatgaagtcgggggtcgatggacattctccagggcaaatgaaggctacacgagctgcggcccggtagtcgagatgtcatacggcagagggttggtgccctgctgctaggggctcagtcttgcctgcctgtcccgggggttccggccgtaggcaggattgggtcggtactcttgtctaaggctaggatgggttggaaactatgtcatgtctttcgtctgtataccgtggtggtatgtggcacgtggttgcacgtgagaaagatgtgtcttgtgggtaaagttgtacacctctgatcagagtataatctattcgaatagccgagccctcggttatgggcaagccgagcaatgtacccaagttagtgttttaattcttaaaacttgcttaacaactaaaatgtggaatggttggcctgggttggcttaggacgagctgggacccagggtcgggttgccagttcggtctgaatcatcgtaggccttgggttaaggcaggttcgtgtgggttcacggccttgattaacaactttgcatagttctaagatcgtgtttacaaaatagccctgagcaactaaatgtctttaaatgctgtttactgcaaccctaaccctttatgttataattcccttgtactcccttgcatttattctgcatttgtgggtgtgtcttgttgagtacggtggttgtactcagtcttgctcaatttttcccaagcccagatgaggagttcctggaagatgaaggcttcggtgtctagctcgtgcctgccgtcaagcgcctgtggtcgtcgccctagtcttccgctgttcctcgtttgtcttcgtgtgttgggccttcgctgcccgtgtaataattttatatacgcttccgcttgttaaactctgaattgtatcaacttttggtgtaccttgcctcctgggacaaggattaatgcacgcacgtaaggaatgcccgttgggttatttccggtcgtgacagtgagtaaaccaaatctattcgaatagccgtgctcgcggttattgagcaccgggacatgtattacacttggctagactctgaattcttaacttgtgtgggatgggttatcgcatgatgaatttttatgctgttggagtcacttcctgagatgggggaaagtggacgtcctcagaaaaccataacgactcaatggcgggaagctatccttgggatcacaatggatggtggacataaccgt

SEQ ID NO: 27092 - DNA, 1488 bp, Oryza sativa
tcggctacacatcatcggctataggaatctgattcttaacacgcaattcctgtcttggttttgctttcttcagccgatggttaatttcttgttcaacctcctgaaggcgctccctgttcctcaatctttgaacccttctcttctgattcttcatgaaaatactagaaggacaccattgatttgtcctgactacgtcatcctcctggccacgaccttgattcactgggcccaatctttgacgaacagacactctttcctgcctcagccgattactcctattatatgactgacttgagctctcaatgatatcattgcacccaaggtagttttcgatagacggcaacctcatcccttcattccagcagaatctaaagaactcacaaccccaatgaggatcaaaaccatcatcgtgttcttcataatgcttctcctgctgcttctcatacttcctctgatatttgttgattatcttagccgaattcacttgaaaaccctttgcacggacgctatcggctgattggccagctgtatgtaccatattaacaggaaaaggattaccatcgaccttcattggcctcttcgaatcatcaaacttgatttttcctccctcaatatccgtttggatctgctgcctgaagaccttgcagtcattagtcgtatgagacccagaattatgccacttacaatacctctttttgcccaactcttcagccgatggaattgtatgtccagcaggaagttgaatctgtttttctcgaactagcaaatcaaatatcttatcagccttagttatgtcaaagtcatacctctcctcttttcctgagtttttcacccattggtaaggtataacctttttgctcctaacccactcagctgcagctatttcagaatcatcatcctcaccatccgatccatacatataaggataaacatgattaatcttcctagagttcttcctagcttccgcgaacctttgttcatgcaaacctaccttctgtgtaaggtacgacaagctttcggaatcttcagatgagaatttttccttgatcggagcaatcatcccttaaaaagccaaatcggctaactgggcatcagtcaagctcaagctgtaacacttattcctcatttccctgaacctttgaatatactcatgtaccggctcatcatgcttttgcttgattgacatgagatcagacagtttcatctcgtgaatcctactatagaaataactatgaaactgcttttctaaatcggcccaactgttaatcgacccatgtggcagcgaagaaaaccaagtaaaagccaacccagccaatgacaaccggaataacctaaccctcaaagcatctacagccgatgcctcaccacactgagctaaaaatcggctaatgtgctcataagtcgatgtagtgtcttgtcctgaaaactttgagaaatcaggtactttgaaccagttaggtaaaggaactctttcaaaccattcaggat

SEQ ID NO: 27093 - DNA, 1501 bp, Oryza sativa
ccgtcgcagccggcagcggccccaactgcgctcgccgccgtgcaagcccaagtcaaccctgatcccgaaacacaaaccgaagccgacatggaagccatgcgacagaacatgacacgactccaagacatacttcgccaaatgcaagaacagcagcaggcatacgaggcggcaaggcggtccaaggtcacttcggccccaatcctccagtattcggcaggctatgtcccaccccaagtttatccacaagtaccgacccaaccctttccgccacaagttgtgcaagcgccaatgtacttcgctgggcagccatcgaccgcagcagcgcatccggcccctcacgtgcaactgcaagctcaaccggtcgctgcccaagtacaccctcaactgcctggccaagtgccacaaacaatggcagaaggggcttcggctctgcaggcacagctccaagctttccttcagcagctcagccaaccccacaacatttcaggtacagccccttcggctcacccggaggggaatacaagtcaaggtgcgcctagttggttgccgtcgaatcagctaggtctgggggcttcaccgtggagtcaaagaccgcagttcgacttcatcaatgctgcttaggcaccaaccgtttggccgcaagcaccaacgccaggcttcggagcaaaccgagcaccaaaccaggtcgctatgacatggtcagagccaactttcgacccatccatgacagctcagcaagcatcaccaatcggagccgggcaaccgaatgccatggcccaacctcacgcgcaagccgtgatttcgcccttcgcctcgccgtaaccgcagcaaggtgccgtgaatagggcagggggcgaaaaggggctaccgctaagtgggggaatcaagacccgtccaatcccaccccagttcaagttcccacccgtcccacgctactcaggcgaaactgacccaaaggaattcctctccatttatgagtccgcgatcgaagcggctcatggcgacgaaaataccaaagcaaaggtaatacatctcgctctagacggcatcgcccgttcttggtatttcaatttgccagccaatagcatttactcatgccagccaataccaaagccaatagcattgtccttaactttcgaggcacctatgaggagccgaagacgcagcagcatctactcagcattcgccagaggccgggggagtcgataagggagtacatgcgtcgcttctcgcaagcccggtgccaagttcaagacataaccgaggcgtctgtcataaacgccgcttcggccggtctacttgagggcgaactcacaagaaaaatcgccaacaaggaaccacagacgcttgagcacctacttcgcatcattgacgggtacgcaaggggcgaagaggattccaagcgacggcaagcaatacaagctgagtatgataaggctttcgtcgccgctgcccaagcccaagcacaagttcaagttgccgaaccacctcctctcgctgt

SEQ ID NO: 27094 - DNA, 1501 bp, Oryza sativa
tggacttgcctgttccggacggaccgtatagcaggtatcctcgcttccacgccttgccgaccttggagtggtactcctttcccttctggaacatcttgagatcttctatgagctcatccttcttgccggggtccatggcgagcgtgtcgaacgtcgccgggtgcttccacgggacgtgggtccacgtgctcatatggttctcgtggtgggtgtacagtcgcctctgcctgttcttggcggtgagcgcgcgcccttgctggaggatttcagggagatatgagtcttgcacgagctgacggtggcgcttgtgaaataccagcatgtagttgcgccgttggatcttacgtccatacaaggaatagtcatcggaagccttggacagtttccaccacatgcgggtgccgcggaagctgtcgacgacctcctgcttctcgtccaaactgaactgggtgtcgccgttgtcgccgagcttggcattgagcttgtgggccccttccatgcatttgctgcccaggtacagctcgttccgacccaacttcgtctcgttgtcgtcgatataatcggagatggtgttctgctcgtagggattgaagtaggcaacactggtggagaaaccatctttcgtcggtcggccgatttccacaataatcccggatgcaataaaaactggggctaaagatgatctttagtcccggttcaaaagggtaacgggcatatttgatctttagtcccggtttgtgttaccaaccgggactaaagatcatctttagtcccggttcgaatgctgtcaggtcatgtcaggccccaccgggatctttagtcccggttggtataccaaccgtaactttagtcccggttggtataccaaccggggctaaagatcccggtgatctttagccccggttggtgctaccaaccgggactaaagtcccacccctatatatatgtcttcttcctcctccagctgcccgagcaagcttcaaaatttcttcaaaaaagaggggaggttatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattataagaataattatttgtgtacggtttttttgactcatgtagatggatcggcaatggatgta

SEQ ID NO: 27095 - DNA, 1501 bp, Oryza sativa
ttggaagaaacgcagcagctccttgatcagaggaagtaagacaaccattcggtgaaccaagctctggatatttatttatttggtactgaccagcgtttaacctgacagggatttgatcacaaagtacagaagctccgttgaagacctgctcaagggggatacaagaagatagtaacatggtgactgtatggtagagttggaatgttaaagaggagctcgttgctacatgtgatcgttttctaatcagcatcggctacttttgtaatcgaggtagccttgaagttggtctggcttaggaacatactttcagtttgtgctatctcatattgttggtgggtaatgggttcatgggtttctgagacgagcatgctgcccagcttatattgaaggtttactgaggaccagtcattttgtttaatgggtaaatttgatccatgccattgcaaactcattgtattggaaaattgccattagtatttatctatttggaatttcacgcttattcgatatatgccgctacttaccccttcaagatacattctaaaaattttggactgaattgtccgttttcttcattcatcccctcctctcctgttcggagatattagaatcttatgaatatgagagatcctatcaggtatcttagtaacttgcaatcttatgatcttgctaggctgaaacgatatcgatcttattaaggtatagtttcatagtattctaatattatgcgagagatctatatgattccatgagattggtaggatatatgtttcgattggtggtattatttaaattaaggcggatttgaaagtaatgtgtataggctttaatttttataatgtattacatctcttttgataggatcctgatcctaagatacagtaagtcaaaaaatgatcttatctgaatcttcctacgtgaaattcatttctttgaaacaaaatgattcgtcttcattaaacctcacatagaaaagtttccagatcacagccaaagagcccacaagcaatacaacatttgaaaattaatgacgcaagagtatgactttttttcttgttatcacggagtaatttgggtttgataatgcgtcaccaagttcaagagaaaatgacctatgactatgagagcaagtacaaaaggttgagtcagccaaatgcaatattgtcaacgtcaaaatcctacacgaagaaaagggaagggagagagagagcaaagcagatgctcatgcagaatagctctgagaaaagatgcagtatcgtttgcatgggaatcctctgacatccgatagctctagtaacttcattcggcatcggacggagtcaagctagaacagcggatagcctcagcacatctataaaattatattctaagctcaacatgcaaacatgccaccttatcatccacatgcatgcaacatcatctgtaattcgttgaattctataaatcaacatccaatcatcttccttcacaatattttcacaatatttttaacacacacata

SEQ ID NO: 27096 - DNA, 816 bp, Oryza sativa
ccgcttgccagaacgccgctctcctcgccatcggcactcttcaccagcgctacccggacgagttgcagcactcgccctaccgctaccaccctcgtcgcggaggagcccgcgactacgccaccttccgagacgccagctcggaggatgacgctaccgtcgtgcatctggcacgcatggtggaggcgtacgacgcggctcgtatcgacttccatcagatggtgcgccgtggcatggtggagaacaacctgaagatcctggagctgcgtcaggagaacctgcagctcaagaaggacctcgacgcgttggaggcgcagctgcaccagctcaagatcgcccagggagagatcagccgtcccaagcgtcgccgcgtctgccgcagccagaagatcaccgcccgcaagagcacctccaggcccgagcttgttcgtcagtccctggcgtggacttgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgtttttcctcgtttgtctttttgagttgtgtggggcatggttacaccggtgtgtggtgtatctatgtcggagcctgtcttattttatttgcctaagcaacttgaacattaatgaaccaatttaatagcagtgataaatttaagaataatggtagtcgtgggtggttagttttaatcgtcagctccttctctgtttgctggttccgtgtggggttttc

SEQ ID NO: 27097 - DNA, 1501 bp, Oryza sativa
tatctctactcagattcttttctctgcttgaacatactagtactatctctgctcagtattctctactcttctctactactactactactattttctcatagctagtgagggcaacggcgggcgagcgggggcggtggggcggtggcaggcgggcgggcaagaggagcagatgggcggggaggaggcagactgcgacgggcggacgggcgaggcgtgggcaaggcgccgtcgggcggggaagcagcagcagtggccggtgggcgcggaaccgcgcaggcgaggcggtggatgcttacacgggcgggtggcgtaggcggccggcgggcggggaagcggcggcggtggtcggtgggagcgaagccacgcaagcgagtggcgtaggcggccggtggttgcggtgccgcgcaggcgacggcggcggttgctaaggtgggcaggtggcgcaggtgggggcgggatcaggagcggcagcagctgctgcaggcgggcgcagaagcggcgtcggcggccggcgagcaacgacgacgacggagggtacgttgatccggaaatcccgatgagggcgggagcaagaacgttgaggtatggcgtgaggagagtgaattgctatatttggccgaactctctccgatttggtgcaacgtctattttttggaggcctcgatgccgtatctgttggagggacaatttcttatcccatgcgctatatttcgaatggagtaccggatagaggatctgctagggatttttttttccacatcgaatctttcgacacatgcatagagcattaaatataaatataaaaaaactaattgcatagtttgcatggaaatcgcgagacaaatcttttaagcctaattagtccatgattagccataaagtgttacagtaaccccacgtgtgctaatgatggattaattaggcttaataaattcatctcgcggtttccagcctagttatgaaattagttttttcattcgtgtccgtaaacctcttccgacatccggtcaaacgtccgatgtgacatccaaaaattttcttttcacgaactaaacacacccaaaggagaaacacaacaaatcacacgatatctattatctatatgtctatttttatctctactattataaaaattgaagatgtttttgccgatacttttggtacgtcatccgtgtttgaatcggtttttaagttcaatcgcttttggaaatacagatccgtgtttgagtcggtttttaactttgtttgtttttagaaatacagaagaagtcatataagaaatctctttaaaaacttgcatgttaacttgagacgaccggacctctaattgcagctcatgattttgtaaaaagaatatccaagcgaattcccacggtgaatttcaccttagctaaaccgtacaacaataataatattaaaacgttgcaacgcacgggtattttttctagtctatactagtataaaaaggagtagttcagtttaccccttccaattcaatagg

SEQ ID NO: 27098 - DNA, 542 bp, Oryza sativa
attggttagtgccctaattgcaagtgttctattcaagggaatgtcctgagtattacttgagaaattctgaagttgcgatcgattgcaactgttcataatgaccacattcttaagttaatacatcatgagcttgttatatttctttccacattctctgtatatttctttccacattctctgtatctgaatatgcatttttgcaattatctgacaaatatataaagaatataatattttctgaggagatatttttttctgaatatcgctccctcatcctatttgttctgttgggtggatgttatcactttgatgggtctatcaacgggttgttccattatcatttgaatgcacccataataagaactaacaattgagaaacaacaattttccttaaaaactaaggaatgttgtttcaagcttttgctgttgtgccactagcccaccaggacaatctggcttaacttatgtctcttgctcttgatctccttctatcagtcagtctaggtccaactaatttgtgttcacctcctgacatttctagg

SEQ ID NO: 27099 - DNA, 1501 bp, Oryza sativa
aagtaaagccgatacttagataaactaaagtaccgagagtatataaagaataatattccattaattccgaaagtcttacaaaagaataaagaaaagctactagagccatacatgaattccttcgaagactccgaggattccgagagctattctattctactccacttagcactagaatactacactaaactatagagagaaatgttgagcttgctagagtgtgttttgaagtgtagatgagctcctccttaaataggcaggtatgacggttgtagcctatgcgaaatgtccaatatgccctgcaaccgtcattggggagcgatcaagagcatccacgtgtaaggccagccggagccggcgtcacaagggtttggcggttcggccgaatctgggccggcccagcaggactccaaacttctctggggcactgacaagtgggtccctacgacggttgtggcagttatggtggtttccgggacggttacacctgacatgtaacccaagaaacaacaacgacatgtaacccatgccagatcagtcaaaccagtgacctcgtcgatgggatgaagcggcaatacttcagtttgctcttcctcgaagggccgaaacaaagaatggcttttttcctccaatcctagtccttctcttcctttctttataggagaggtgtatcaatctctaagacacaacataaatgttttcgacaattagttatttgaccgtattatgaaacctaactatcaatttgaccctacttttttatgttttttcatttgaccctgcttttcaaaaccaaagttttggtctgccctgtttccactctaccgtcaggacttcattcaggaaaataaaaaaaaaatactaacccaaagtgaccaaaatacacctgattactaatcaaccatatctcaatcccatccccaatccgtcccaagcggagggagtagcggttgattcaagggtttcgttgccaacggtggagggagctgcgaccaaccacggtggagggatcagcaacggagggaacaacggtgactattgttgtgcacaagggagcgttggtagctttcatgaccggaattaacccaacaggcattccatacgtgcgtgtaatattccttgtcccaggaggcaaggtacaccaaaagttgatacaattcagagtttaacaagcggaagcgtaaatagttaatttattacatgggcaacgaaggcctagcacacatgaagataaacgaaaaacagcggaagactaaggtaacgaccacatgcacatgacggcaggcacatgtggttcagcaagttttaagaattaaaccactaacttgggtacattgctaggcttgcccataaccgagggcgcggctattcgaatagattatactctgatcagaggtgtacatctttacccacaagacacgtcttcctcacgtgtaaccacgtgccacataccaccacggcatacggacggaggacataacatagttcccaacccatccca

SEQ ID NO: 27100 - DNA, 1501 bp, Oryza sativa
caaattgataatagagtacaattattactctaattaataagcgaataaaatgtcattacagaggtagatagtttctctcaaacaataaagatctaagcagcggaaaaaaaagataaacggcgcagacggctccactccacaggcagcttgaccaaggctacacctaatcctccacaccatcagcctcattgaagaactcctcctctgatgaatgattgcaaggtgagtatatgacatactcagcaagccacgcagcaaatatgcaagtgcacaggataacaaaggatggcatagtagggtttcatttgcaaaagcagcatttagcaaacatttcagaatttaataaaacagttaagtattaaacaatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgacaagtgtgaaactaatcacgaaagacattgttagacccgctcataaccgcgggcacggctattcgaatagttttactctgatcagaggtgtaccactgtacccacaagacacaaccccacatcatgtcaccatgtgcctcaatacaaccacggtatctcggaaaggagttgtgacaataccccttatacaacacaatccactgcagcgcaccttcctggatcataatcacccccttataaacaaggcatggctaaaagggcatataaacttttcccaaatatccatttaaagagcatataaacttcaaatggccataacttgtccatttgaactcggaattggaccgttcaagtctctaatttttccttaagaagtcaagaacccatttttgtgctttgtttctgcttgttatatggagtttattagagtaaaagcctttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattaccgctttatttaaattcccgcgttatcactgttttatctagccatgcctatttacctttgttatgaccttattattgttattgttattattaccttgttcaccctagaataaacaaaacctcaactagtggacactttactcatggtaccactagtatgaatttaggtagatgcttcgctggttagttaggcaacattaggtggttttacaactctagactatgggaatattctcatcacctggacactacggaatggttggattattgtggaattggattcatacctccccctctattcaatatcctcaaaatggttttaggctgggcttggggtccctggttttgatagtagcacctcggccatataaggatcagt

SEQ ID NO: 27101 - DNA, 295 bp, Oryza sativa
atttccttgttcaccctataataaacaaaaccccaactagtgggtactctattgatggttccactagtatgaacttaggtagatgcttcgctggttaattaggcaacattaggtggttttataactttagactttgggaagtctcatatcattcggacactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 27102 - DNA, 304 bp, Oryza sativa
acgaggggcgcggctattcgaatagattatactctgatcagaggtggtacatctttacccacaagacacatcttcctcacgtgtaaccacgtgccacataccaccacggtatacggacggaagacgtgacatagtttccaacccatcctagccatagacaagagtaccgacccaatcccacctacggccggaacctccgggacaggcaggcaggactgagcccctagcagcagggcaccaaccctgtgccatgacatctcgactaccgggccgcagctcgtgtagccttcatttgccctggaga

SEQ ID NO: 27103 - DNA, 210 bp, Oryza sativa
caatttgtaactgaggatgtacatataaactcagattctttgctttacttgtggatggagtcaaagatgcagtggtgagaggaagctggaggcaggtagcgagcaaagaactgatgcttaagcaatgtgtggtctgatactctgatgtgttgttcggtaaaaaaatagaatgtaaacagtcaattatacctcactatgtttcttttcaga

SEQ ID NO: 27104 - DNA, 206 bp, Oryza sativa
tctgacagcgtgacggcgctcgcccattggctgcagggatctggcagtgcggccaccggctgaaggtgtggcgcggcgacgtcaaccggcggagaggtgggtctgccggctagaggtgcgacggcatcggcggccgacagatccatccctcccactccctccctatttgtgattttatttgatctagatgtgttgtttttctaagg

SEQ ID NO: 27105 - DNA, 432 bp, Oryza sativa
tttcaccttttcatataaagcatattgcagactgaggtgtatcagatcacccttctgcgacattgattagaagaattgtcttcaattcattcaattcattaacatacaatggagttatgtaggttgctggagttttaccaagaaaattttgaaattggagttgaaattgttttttttttaattcagttgagttatgtatttgcagtgaaattgactgatgcataatttatattgatcttggttgataagtttatagctatgtaaattttctacccttatcttttgaagtgaataatatgtttatgaattccaaatgatcttgttctgttctcgataaaacttctatgttgcaacctttaggtttattttgatgtttgttgtcattgaactttggaaaaaaaatgaatatgtaactggcttgcataatttaga

SEQ ID NO: 27106 - DNA, 455 bp, Oryza sativa
ttttaccattgttacaactatttaatcctcctgatgggcaactctatctcaatacttctgtgtccaacactaaatgatgaagtccctaacattcttttcatgaagtccctaacattacgtgtccaacactaaatgatcaaagaagttacctagttggatcaagtaggaactaattagttctgtataaatccctagcatttttttgatgaagtccctaacatttttttttatttatgaaatccctaacaactttacaaaacataatattgtggtttaactaatgtttgggcgaccctccaagaaacatcaaacttgataaataggtgtgattgtagattagtcattagtgactgtctgctgatactctgaaagataactttgatatataagaaaattttcatgcactagggcatatcttgaaatttgctcatatgcttacttccttttctaatagt

SEQ ID NO: 27107 - DNA, 310 bp, Oryza sativa
ttgggccacaactcagcccattcggctatatgttaaaatacatacaattcatttcatgaccagttctataaatttatgaaaatatacttatagccattatatattatatagtttagaactatgcgaaactatacatacatatcatttattaggcttgatattgtatttttttatcccttcatatttcgaaggaaaaagtccactttgactcccttaaatattggccgaatctaattcgtaccccttaaccagaaaaccggataagatggctccccgaactattgaaactgatgcaatttgactccctagg

SEQ ID NO: 27108 - DNA, 337 bp, Oryza sativa
caacaaagttgtacaactcatcaatatatacaacttttggtttggtcattttactatatgactctgtttcaataatttaaatttaaaattcaaattatgacaacttcaaacaacattttcaaatactaaagttttcaatacctgaccttgatggtaaccctagcgcgatgtcttgctacaaagtgtggagtcattcagaaaaactcctaatgttccgcctccctcatctgcttagaaaacatgtctcaacaggagctatggagccaacggtatttcacgtggctcaaccttgatggtaactagcaagacatttgctagttaaccacactaccacagt

SEQ ID NO: 27109 - DNA, 364 bp, Oryza sativa
cccaaaagaaaaggggaaaaaaagaagaagggacacatcagtgatagcgaagggcggcatccttttgagagcaaataattgcactccactggagtacccgtagtacgatccatcatcgacgagtccatgtcgtgtgccaccaacttgggtttaatataacggtgctcaatttacacagaaaataccttgcaaaatcccttgaaatatgcctctctgcctttgcagacgaccataaacatcaaggaaggcagcaaactgcaaacccccatcctgtccctctccccctcccttaccttccactcttgatggacacagccgacaagctccactctcccaccactccccttctcgcccacgcccacca

SEQ ID NO: 27110 - DNA, 830 bp, Oryza sativa
gtcgtttagtttgaaactttttaaattttggtcatgtttttgtgagagattttctagaacttccaaattctaataaggtagatatggtaagaatgtgtttattttgctatcctaccaaaattggtaatataaaaaaatagcagggttaaaaatgataatgaagtgaacttaagctgttgtttgcactgatgaagtgatgagcattatacccctccttttattttattttttttgaggacgacccctttttttctgtcatcataaaattgacgaagatactgataatttcacatatctgctgctaatcttgatggacatcggtgccataaataaccatcttaattatccaaaaactgccatttgttcttccacctttgaccacataaaacaggagcaggcattcccacatgcaacagccgcacggctgcctgaagactgatatgattagtgcctgatcgaatgcacacaaatctttttcatcagctaccatagcattagcgtggtcctgatctatgctactaactttttaatgtgttcttgaacacagtagtacagcacagacaagaagaaaataaacctcctaggttgctgaattccagtcatctcaaaatataataacttttagctattaatttgaacacatagttgtctagattcataactaaaaatgcttatattttgggatggagggagtaacaaaaactgcaataccactcgttacaatctgaaatccccattcttgtcaagccttaatttcaattttttttcccttcaacacatacacagcttctggcattattcttccctgcctcttcacaacctgatcgagc

SEQ ID NO: 27111 - DNA, 1501 bp, Oryza sativa
tcttgttatgactcttgggaatttgttttcaaaataaaattgttttaaaagctcaatcctccaattgacttcatcttatacctaccaaggccatatgcaagtatatcattgatgaaccttgttatacatatgactgcttgacattatattgagctttgtcgaatttatgtgactcgtgttagatatctttcatactctcatgatcaaggggtcattgtcatttccacttcccatttccacatatataattgggctaagcttgtacactggaagatgactttccacaaaaattccattcaaataaactcctacttcagactatgctttcttctcctagaaaagttcttggttaaaaaaaagaaaatgagaaaagggaaggcaaggcatggctatgtatgaaaaaagggagaaagaaagaaggaaataaagcttgctcccaaaacattgagcaaagttgaaaaaaaaataatatagccatgcctcttccatatgcatgccaagaaaacaaaaaggaggatagagtatagaaaaaaaggagattcatttctttattccatcattccacaaaatattttacgttttcattttccatccacaaataaagacccttgatctaggagtatgactgatgatcttcttgagtccatatttttggctttgcaatatatatgatgcaggtatgtcccgatttatccctaccaagctccacatatcagctttagaatagggatgaattatggcacattttgccttggtgaggatccaaaaagaaagtatacatctttgagagacgagagaaagtcaatatgaggaaaagagctggtttgcgaaaattcataaaaatcccatgaatctgagagagaagcaagaaggactggaatcgagatcattccatttgtcaattacttaagatggtaagatagccactgataaagttcacaggtgcagatatggttgtgaatgatttataagcttgattcatatcttgaagaaattcattctgcactaacctttactcagggacgagcaaaggactaagtgtggcggggttttgttggcggctgttaaatgccgattctataccgccaacacctgcatcaagttcagataataaaacatccaacatagtgataggtgcttaatctcacatattccacagtgttggtgtatatttgtatgcaggtgataaaccccgatgttgggaggaaatctagactaaagtgaggagaaatatgtatccatacaaggatgggttgtgaacttcgtagaaacatcagagaatcagcccaaacaccgaagaatggatagaggaggatcagatgaggagccagaccaaagtccaggctaggggggcccagcccaagttcggctgaacccccaggttcagccaaaccctggtgatcaccgttgatcccaggtttttggcatggacgtcccagatcactcctgatggcggttgcggggcacttcggacatttccccttcgccaactgtcatacct

SEQ ID NO: 27112 - DNA, 568 bp, Oryza sativa
gtaaacagcatttaaagacatttagttgctcagggctattttgtaaacacgatcttagaactatgcaaagttattaatcaaggccgtgaacccacacgaacctgccttaacccaaggcctacgatgattcagaccgaactggcaacccgaccctgggtcccagctcgtcccaagccaacccaggccaaccattccacattttagttgttaagcaaattttaagaattagaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcccacctacggccggaacctccgggacaggcaggcaggactgagcccctagcagcagggcaccaaccctgtgccatgacatctcgactaccgggccgcagctcgtgtagccttcatttgccctggaga

SEQ ID NO: 27113 - DNA, 748 bp, Oryza sativa
tctcccgaggagagaaatagaaacatccttggtcgaatggcgtctggactgacgccctttatagtgtacgtgcaacagatctccggaaactgctgcagatgagcgttggcatcctcgttaggcttgccgcagaacgggctagcctgtgccatagtgatgaggctggacttcaagtcgaaatccacgtctcccatgttgatctgcggcccaatggccacattttcagcagatggagcggcaaactcgcgaagggtcttgtcagccatagtcttgaaagtcggtggcactggtacggctggtttctctatcggtagagttttctgcggaggaatgactcgcggcctgacgctccggaagaaagcttctggattttctttgaagttttccggcaagttgaaaccaataatgcactaccctgttttcacaacaaaagtgaaaacaaccaaggttagcctgcaaagagcagtgattatacagaggtaaatattaagtattagttcaggtaatctctattatgaatcttccccggtaacaacgctagaaatgctagttggtatttcttaacgacattactagaaatataatttcttgcaaaggcgcagaaatacttctgttatattatggttacagagttcatccgcaagcgcacggatataccattgtagcatctcacccaagagtattccaagggtatcgtatttattttatcccgagggaagatcatgtagagagaacttgactaataatt

SEQ ID NO: 27114 - DNA, 277 bp, Oryza sativa
gaattcgagctcggtaccctagtgggtactctatttatggttccactagtatgaacttaggtagatgcttcgctggttaattaggcaacattaggtggttttataactttagactttgggaagtctcatatcattcggacactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 27115 - DNA, 1501 bp, Oryza sativa
ggtttaagctcaagcggaggtcgaggtggcgggtccatgattggcaggtcgagagtctcaccaggatccacttactctttgatgaaataggggacctcatcttccagaagggcctcgggagactcgtgagggggaactgcaataacctcttccgctgactcaatttctgggagagggtcggtcaaggcgatccttgcccgtgagaatggaattgaaaattcagtctctcccagtgttattttgaggctatctaatcggggtgtgttgatgagaagttgctcaattggcagcccgattaggatgtcaaaatcttggatttcaaaggcatggaaatccaagatcgcctccctatcttcaaagcagacaagcacatcttgcacaatcccaaatccttcgatgatatttccgcttggatgtttgaagaatttgtttgtcggggtcactgtcttatcgcttaaataagcgaatgcaaaagactctgaaacgagattggccccgacagttagactgtagagaataccgacgtcattcccttccagatggcaaggaatgattcggggagcggtatttattcgaattacttcggatgaaagctctgcctcccttaaccattcatcactcattatgaatgttaactcccggacagtttctcgtaggaacccgagttccataggacctggaggtgacaaagaaacgggtggtttcctcttgctaaaatagttcaagttattgccgtagtcttcatcaaagccgtccctgaacaggattgcggcacgatccagagtctgaatttcatcattctcgacggacagctgctcaggaaccttctcatcaaccgagctaacagaagtggatggttcagcaagtagctcgatcgttagaggttcctctatcttggacacggatacctccggctggggttcattggagtgcgtcatgaaggaagtattttctagaatgcgatccaaaattgttcttccttctgacggcgttttgtgcaggaacgatcctctagcggttatgtccagatagaatgcagactccttatccaaacctgatgaggacatcccttccaacgatacaaccacgcctattgcacagcaaggaccaatgactagagctcgagctcgtgaacttaattatcaggaatatgggagaggaaccaaatcgcaagcagcactagcagcgctgatttgatgaagtcaatgctcttcactccggagggcaaacggggcaaatgagtacttgttggaaagatctcgtcgtctactttcagctatgtgtggcctcaccatcaactttgacccaggctgctcagaatgacgaaaatagttctttacatcagaaacttgggcttgggccttgtatcattacagccatcattacagcccattaggggtccacaaaacctagggtttgctcccacctcctctcctggtcattcctccacctatataaactcctagcagccaccattttgcactttgggttttgttttgat

SEQ ID NO: 27116 - DNA, 1501 bp, Oryza sativa
cctagggtttgctcccacctcctctcctggtcattcctccacctatataaactcctagcagccaccattttgcactttgggttttgttttgatgtaagtttagctgcagctacttccttgtactcgcgtgtgtcggctagaccacccggatacttgtattccgaaccccattttggtttgtttaagtttcatcatttgacaagtgccgtgagctgtttccttgtcaacttgttcttgcttgttcttcgattgcttgcaggttcaaggttgttcttggcacggcaagaacagcaacaacgtggagtcggtgtaccggttgctaaggcgcagcacccctgtggtagttgtagtcggaccgccaacgtcgtatccttccccaaatcgaagtttatcctcctctcatcgaaagatcgggaacccccgttgctgcatcaagtggtatcagagctcaagttgctcggtgagagattttatcacttctttgtttttacctacagcccaaaagaaaaaccactaaaataggtcagacccgaaatcaccaaaacatgttgagcctttgctgttctacttagtctttgcttgctgagttttcgattgcatcgattggttgagttgctggttctagtagtttagtcctttagagtttcgagttctgctcacgaattcatcaccgcaaacacttccaccatcacttcatttatcttcatcccgctgccactatcaccaccatattcaccacgaaatccacctccaaccccaccaaatttcgtccaccacaaccagcagcaccctcatcaccacatcagccacccccaaatgcatttattgctgcctccaccaacagccaacccttttgcaactttttgaagtgaatcagcccttcccaagaaagcatttaagtgctctcacttttgacttgttggctgaatcatgtaactagccaaccaacccatcattacttcttgttttgacttgttagctgaagctttgagcttgctgtacaaaaaaaaagaaagaaaacaaaaaaaaagaaagaaaaaaaaatcagaagtgaagagaaggaaaaaaaaaggaagggaagagaggaagttgttgttgttgttgttttgtttgtgttattttcgtgctattttgagtggctacgcttgtgactaggctcgcgtctctaaagggttttgcctaggaccagtacaataccatcgttgaatgattattcaacttgctttgattaatgtggttctagctgtaccttgatattacttgcagccacctatagctccacaaatttttatctactatatcacaggatcgtgcttgttgtcagctccggtactactaaccattgttgctgttcttactatttgccaacgccttttacataacaaagtaagaacatgtaagaactcgtttgcacaagtttggtagaagtgtagatggacaacacctagctccaatagttgataggacatatttcttgtgaattgtttcttcccattaacca

SEQ ID NO: 27117 - DNA, 1501 bp, Oryza sativa
atcatcgtcgtctccgatcgttctcgtcgtcgacgtcccgtcggtcgcccggctcgtcgtctcgcggcgccgcctccgtcatcgtcatcgcagcggcgtgttccacgtcgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagtgagccgccgcagccccgtcatcgtcttcgtcctcggctccgcatcgtcaagcctcgtgccggccgcgtctcgccttcgtccaaggatcgccgccgaagtcgttccctcgcctcgccgcgtagtggtaaggacctctccctcgctgccccgtcctcgtcctttcggtgtcgccccgtacccgttgtgcggtcgtcgaccccggtacccgtgtaccggtgtcggtagtcgttcacgtgtgcgggtggtgaccgtgtagtgtccgtgttagtgtgttcgctcggtagccgcgtggtttccacgtgtgcagcccgcgtggtgtctagtggagtccgtttgtcggctactcgcctcggttgacacacggggtccgcttccgttgacccgtggaccgtctctgtgtacccggtctaccgcggtcctttaggttgacatgtggggtccgcatgtcaacagcgcagccttcctgtctcttccaggctagcgcttacacctgttttataattgcaaagcttaattataataatccgcaaatctccatataacagcattaaacctcggatgatcatatcttggtcatacgaactctgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggttcccgaagcgtggttcgtggtcgtcgccgaaggttcggaaggccgttctctctgagtaaggcaagtcacgtcatccttgaacatattgaatcccagtttataaaattatgttgctttaaattattgcattatcgctttatttaaattcccgcgttatcactgttttatctagccatgcctatttacctttgttatgaccttattattgttgttgttattatttccttgttcaccctagaataaacaaaaccccaactagtgggtactctatttatggttccactagtatgaacttaggtagatgcttcgctggttaattaggcaacattaggtggttttataactttagactttgggaagtctcatatcattcggacactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 27118 - DNA, 1501 bp, Oryza sativa
agtttctgtctgctggctggcctgacaagttttaacaatgctataggtcaattgtagttactcctgccttagatcgatacgatattggagttgccaatactcccagttgtttaccaaacaagcagtgtaatcttcacgcagaggtgcaaccagagagttgatcaagcatattgacaaagcacacttcagtgaacggaaaccctgtgaatttactgcaaattcagtcaacagcttaaacctctctctctaaaaaaagttttaaagctctgaaagtctgaattactgatcacgtgatcatgtgagatcatgtgaaaatatatttgtttcagaaatgaaggttgaaaaaccaactctcttttccgtgcctgtacaaaaacattttcagatttcaggaccctctcttcctcctttgttaaagcatgtattgtttatgtagttacaccatttatcttggaagtgatgtttacagcggccaaatatattccagttttgcatatgcttagattttaaagattcaaattgaaggaattattctcacaattgtgtcgattatatgttgatctcgggcaagtgaatactagtgtgatctccttatcagtcaattcgcctcctttttcaagaaaggtaagaacagattcttctcgtgcaagttgtgctgttgctttggttccaatacttgtatagctatgaccagtattcataccttttcgtacttgatacgtcctgctgatgaaacaccggtgtcactctatcagaacagtattcaggttatagaatttttttgatgtgtccaattgtccatcatgaatctaaagctccattcaaaacagactattggacggatcgttgctatgaattatctactcaattataagaataaattaaataatttaaaacatgtggtctaaataatatagttaaaggaatatattttttagaaaatgtgtttttcaaattatggagcaataatttgtttcaacaatcagatggataatctgaaaataagatgcatatgtacttaggggtgtgtttcccatttcctacttctcgtttttttacgcccatatgtttcccaactgataaatggtgtgtgcttttttaaaaaaaaatctataggaaagttgttttaaaaattatattaatctattttaaggttttttttctaatatttaattaatatgcgtaaatacatgtttcgttttgtgtacctgaaaggaggatttccaacccttactctcaaacacagccttaaaagcctacaaatgtatgagcatattggcactaaaatttgtttcgatcactttgcttactgctatagctctagctcttcagttgtcaccttttgttttctccttgtctttctctgcgatgtcgtggttgctccactctcttctcctcttctccttgcctgtctgatcgatcgcctcgccaccgccgccgccaccgccgccgtcgtcgtcgtcgtcgtcgtatcggcatggaggtgtcccacatggccaac

SEQ ID NO: 27119 - DNA, 1501 bp, Oryza sativa
gcgagggacggcacaatacggagggaggacaaccggagaagaaggcgcgggttgggcgggatgggaaggcggcgcgtcggtggggtgaggaggcggcgcgctgaggaggaaggatggggggctggggagtgcgatgcgaaattacggatcggagagagagggagcgtgatgcggatcagggagatgagaagtggtgcgatgggtggatcgtgggagaaaatctcatccgctgatgcctgtgagaggatcctccgatgaatgttaaccatttgatcgtttaggactcaccaccaccactacaaattttttaagtagtaaagatataaacatttctaatgatcagtatgaaaaattaaaaataggtggcatctcaaatggcacatttttcagtgacactgggtgtttaaatctaggggtgtaaagttttggcgtgtcacattagatattatatagggtatcgcacgaggtgttcgggcactaataaaaaactaattacagtatccgtcagtaaaccgcgagacaaatttattaagcctcattagcacatgtttactgtaaaaccacattgtcaaatcatggagcaattaggcttaaaagattcgtcttgcaaagtagtcgcaatatgtgcaattacttatttttagcctatatttaatacttaatgcatgtgttcaaatattcgatgtgacaaggtgtaaaattttagggtgggatctaaacagtcccataacatgaaatttttgccagaaaaacagcgaaaattctttaaatcgggcgcctgatgcgggcacacatgcatcagacgccccgtcctcccgcgctcctgcgcctccgcgccgtcctcacccgtcaccacacaccccaattcatgcacagttacggaaacgctttattaagggaatccgtttcgtttttttttccaccaacaatgtttcagcaagtgtactcgtaatgtttcattatatacggatcatatgttgcagcgaattgaaacattctttcgctatttgctaaaacaatgtttttatatagggtgaaacatcgtctgatttttttgaaaactgtttgtttcatacgctatagcaaaatgttccataagctgatttggttgacatttacaatgtacccggtgaaacaatttcgatcaactgcctgctaaaatcggacgcttcatgcgcctccgaaaaacagatacgatgtgtcggcagtttgacaactctggtcaaacaagtctgcaagtgcccgagtgacgtgtactatgatcgagtaggataggagtatttctttggagttgtctcgtccagatacaccgcgtcttccaacttcctagcagcaggttcatctgcctgcctccagcttcaactgcggcgtcgccgcgtcgccgtcgcagtcgccgtcgcggcgactctccggctctcccccgaccgcccccgctataagcctgagctgctcaggcgacggcacgcaaccccagccaggcagccagcctagggagagggaa

SEQ ID NO: 27120 - DNA, 566 bp, Oryza sativa
cattagcaatcccaactagcccggtccttgctccctgcaaactccatcatctcttaagctccgcctgacgaaagagggaaaaagaagaaaacgacctagcgattcaactagaccattcatcattttctgttactcatactccctccgtttcgaaatgttacaccgttgactttttagtacgtgtttaatcattcgtcttattcaaaaaatttaagtaattatttattcttttcatatcatttgattcattgttaaatatactttcatgtacacatatagttttacatatttcacaatttttttaaaataagacgaatggtcaaacatgtgctaaaaagtcaacggtgtcaaacatttttaaacggagggagtactattttttttccttttccttaattgaaaatacatgcactgggccatcattcatcatcgctggcttgatgctaacatgactgacgagacgtgcaagcgcgcgcgcgggaagaggtctatctagccagcgtcgcccttgttcagacaaagatgttctctgcatttgactcgtcctctcctggctggtcgttagg

SEQ ID NO: 27121 - DNA, 569 bp, Oryza sativa
gatcccgggggggcctgtcatgacctgacagcattcgaaccgggattacggttggtaacacaaaccgggactaaagatcaaatatgcccgttacccttttgaaccgggactaaaaatcatctttagccccggtttttattgcatccgggactattgtggaaatcggccgaccgacgaaagatggtttctccaccagtggttggtgggtggtgccgtggtctagcccaccggttcagctcgggtcattaatagttaaacccaacgcggtgatatagtcccttctcgtggtttctttgagccccttgcaatttctactactacttacttttcctgtggagtaagccaaatcgcatcatcgcgcttggttcgacgaaacttcgacgaggcgcgttgtcacctttttcctgttccacgatgaaacggcagggatcatttgcgcgccacaatcgccaattatataagccgaggccacaccgccacagaagcaacggtaagcaagcccatccacaacggcaaccattgaagggagctacagtgtaagtagctagatacgcttaattaggcgacta

SEQ ID NO: 27122 - DNA, 588 bp, Oryza sativa
aaatacactttactcataaaaaaaagttggctcgatcagttctcattagccgtagcagtgatggagctaactatgtacgttattgggtcttaggcaatgaggagctcaggttattgatcaatatttttttgtcgattattcatggtgcacaagacaattcggtttgccgcctcaccagcttggtagcatatgctccttttctttttagagaaaaggcagacgcccagcttttcataaagcataacagagagtacagaatgctagggtttccagctttacaagaagcaacacagttcaaaataaaaggaggactaatgctgctggcacagccaaacaagccagagataaagcaaagaaaacaagtccatagaggaagcagctttaagatcaggacgccaaatcttctatttttgcctaagcctagctgatcaaattgtgctgtctccatttactccccatagtctttgttgtagccatccttcacagatgcaaaatgctggggtttccagctttacaaaaataacatagaaacaaaacaaacgatgagcccttgctattgacacagccaaacaagccaataagacctca

SEQ ID NO: 27123 - DNA, 1501 bp, Oryza sativa
gcgccgccacgccgccgccgcgcaacgccaccgcgtaatgcctccacgccgccgccacgtcgccgccgcgccgccccgccgccgctccgttgccgccacaccgccgctccgctgccgccacgacatcgaacgaattaacgtgaacgtgaacgaacgtgaacgagcgaacgaatgtgaacgagcgaacgaacatgaacgagaacgagcgaacgaacgtgaacaagaacgtgaacgagcggacgaacgtgaacgagaattgaatgtgaaagaacgaacgaacgtgaatgaacgagtgtgaacgaacgtcaacaaacgtgaacgtgaacgaacgtgaactaacgaacgtgaacgtgaacgaacgtgaacgtgaaatgcaatatatgcaggtgaatgaacgtgaacgaacgaatgtaggtgaatgaaacgtgaccttaacgagaacgctaacgtgaacgatcgtgaacgaaacgtgaacgtcaaatgcaatatatgttacttcgcgtttatcctaatacatctttttgtatgttgcagaaaagacgttgtcggagtcgtccctcaagccggagtggtagctagccctcgaaggaattcgcgcaggcaagtgacgtaattatatatatgattgttatatttgtaatgcaattaagactattagatttaatatacgacacttagacttagttttaatataagattattatagttttaatataagattattagatttgtaactagacttagcatataagattgtgtagggttctaatatacgacagttagactacgcatatatgactatttgagttttagtataagattatttgagttttaatataagattattagatttgtaattagacttagtatataattattgactagctagggtcctataatatacgtcacctagacttagcatatatcactatttgagttttagtataagattattagatttgtaattagacttagcatataagattgtgtagggttctaatatacgatagttacacttagcatatatgactatttgagttttagtataagattatttgagttttaatataagattattatacttgtaattaaacttagtatataattattgactagctagggtcctataatatacgtcacctagacttagcatatatcactatttgagttttagtataagattattagatttgtaattagacttagcatataagattgtgtagggttctaatatacgacagttacacttagcatatatgactatttgagttttagtataagattatttaagttttaatatacgattattagatttgtaattagacttagcatatacgatagttagacttagcatatacgacagttagactaagcatatatgacttcgcatacacgacagttagacgtagtatatatgacttagcatatatgattgttagcctataagattgttaaaacataaatgtctcatgacttagcagttgtttcctatatgaacaga

SEQ ID NO: 27124 - DNA, 1092 bp, Oryza sativa
acgctgagaatcatggtggcgagggccagtaccaactaggagacccgtgtgtcgatcctgaacacaacaagagtcagaatcaaaaataacacgacaaccatgatcagcaagctgtccagcagacatgagctgtatggtcaaatttggaacataggaaacagaacgaccactaaaagaagaaaatgaaagagttccacgaccaacaacagaaagaggggtaccatcggcaatttgaacagtaataaggactaaaggatgatatatagatgaaagacaagacttatcaggggtcatatggaaagaaacacaagaatcaagaatccacggaaaagtaccagaagcagatgaggatccctcattggaagtctgagaaccaggaacaatagaaccagtttgtgtagagggcaaagcaactgaaccagctgaacgtgtcgaagcagaagcagtgaggcgacgcaataatataaggatctcctgtgtattagaattgctagtactcttcttcttagaagagaaccacaagtatgcaatggccagcaatcttagaagccaattcctcggtaattttattttttttaaaaaaacttaatgtagataacatatctcaggttttgctcttactataattttcaactacgatgtcatcatcttccatgaatattacgttactgataaaattattatattgactatgtatatattaaggtctgagtacgtgttgatagtatgaataacagtaacccatgttaatagtatgaataacagtaacccatgcaacacatgttgatagtatgaataacaataaccgacgcatggagtgatgaggccgtagacatggattgcaatttcggatgaaaaatttcggttttgctagtggggtccggcaaaagtcaatgccggtcaaaaatttggacaaaaaatttttaaaaaaatttgctaataaggccctcactacccccacaaccctaaccctaacccattttttccccgacagcgccgctgagagacgaaaaccttaacctccggcgccaaatcctcttacgtgacgctgccacctccacacctcaatcacggtggcgctcgtcctacagg

SEQ ID NO: 27125 - DNA, 722 bp, Oryza sativa
taaagagctaatgttgttgtgagaatagtcccctatgtaacaccccttaacacttgcacaaaactaaaccttcttctttgttaatgaaaggagactgtccttctaccctcttattcaaaagaaaaaaaaaacagactttttcaaaagtaacagttcttggtacaaagagcggacttttcttccctaaaaacttttaggccccgtttagttcacgagacgaaaagtttcaaagagtcagatcggatatacaaacacacattcaaagtattaaacgtagactaataacagaacaatttacagattccgtctgtaaactgcgagatgaatttattaagcctaattaatccgtcattagcaaatctttactgtagcaccacattatcaaatcatggagcaattaggcttaaaatatttgtctcgtaatttacacacaatctgtgtaattagttttttttctatacttaatactctatacatatgtcaaacattagatgtgacagggtgaaattttttttatttacgaactaaacaggtctttacatagtttgaacacgggtagggctgtatttagttcacaccgagattggaatttttgttgaaattggaacgatgtgatgaaaaagttggaagtttatgtgtgtatgaaagttttgatataatataaaagttggaagtttaaaaaaatattttgaaactaaccacggcgtaggtcgaggtcgata

SEQ ID NO: 27126 - DNA, 1501 bp, Oryza sativa
cctcacatgaatcccatacattaggtcatttcccttcttcgtctccccgttatctccccagtagctcacaacattgtttacacttttggaaaacctctgaaaattgggtgatttcggtggtgaccaaaaaatcatgatttttggacctttttcaccaaattattgaaaattttaacaaattttgaacactattttgactacatttcccaaaaattgaaaaaatctaacaatttcggtcgagatagttacattgccgaggggtctgaaatttcaatcctaacaacatgacatcccctgtgaatgtcatcgatctgtcaaagtgcaccaacttcccacccaccgcaccactaaactcacctctatcacatcgaacccttgcctcacccacccaccatcacaccaccagcctagattaagccaaacaagagaagaaagagtcgcgttgcccgtctgccaacgacgtagggagagggtatccttgatgtacttgatgccaagccattttctggagcgggtgaagggtttggtgtcatctcagtagcgaaggaagccgtatgagttgaagaggctatacttgatgacctacaggccttgtagtctacctgactaatagagacgccgccatcagttgcgtggacatggtggtgggtagtgatggtggcaaacgatgcgaggaggaacacatagtgcttgttgctatggtgaggagcatgtgtagagggagttgtcgttttctgaggagcaagagaacatgagtgtgaggcggcagagcattgtgggaccggtgagcaatagggagaggaagagaagatgccacttgagtaagtgggctccataatagagtgccacactagcatgttacgatataggcgaaagcgtaaaagattaggaagtctgatctccagagaaaaaacataagacgaaactaatagtgccatttaaaataaataatagtgccccttgaaaaggtgacagtttggttagtgacaaatagttacattctcgttgggccaccgcggtttgcttcccacaagcctacaggggtgagggggcctggccttccacaacaagtccggctcaatacagccgcaccgcacaaaacctgggcccccaacgtcgacgctgcggcgctgcctgctacgctcgctttctcctcgtctccgctccgcttcgccggttgacggtgcgacgcacgaagcgacatactctgatactcgcgcacgctgcagctgcacgcaccgccgaggcgccaacacgacgctgtgccgtggcgcgccgacaatcatcgcgcatcaccgtggcccgtgagaactgaggtaagtacgtacgtctccttccagcttgccctggcacagcgtggtctccctatactcaattgctggcttcgccccctgcctgcagtggcccacgcctcggattcgaggatgcgctgcctccgccgcccggcaacccacctgctctgctccgctcggagcgcccacgccgggaacgcccccagggt

SEQ ID NO: 27127 - DNA, 547 bp, Oryza sativa
agatgtgccgaaacatataagctaaaatattagcatccatcccaaaatataaaagttaatatttactgctccatccgtcctaaaatataataatttagaactggatgggacatcctggatgggacatccggttctaagtttttatattttgggacggaattatcttgtggcattaaaattttagtgtaaaatttagttatctaaagttacttttgtaaaaacagtttaaaatttttcataagctaaattttgcagtgctcatgtacgactgtcattgttgtatcttcgcaccggaaaggccaaaacagaattatctcgttaggcaagtaggatgagacgatgccacaagtagcatgagatgagactacatagtggcatgtgacacctttacatactacagctcacatagattagagatccatgcgtacgcagtcctaaaatataaaaataaaggaatgaaagcaacatattctattactgtgaatctaagccgattcatagtacaaatatacatctcattttgttatataggtttttataatttagg

SEQ ID NO: 27128 - DNA, 330 bp, Oryza sativa
agtcaaaacaaatatttgaaggacctatgtggacaaaatgaaacgtgaagaaccaaattgagccttagctgaaactggagggactaaattagctattcacccataagaatttcagtgtggttggtgtttttgaaatccatttcatgaaacaatagagatgcaagtgggtagtctcactacctgtataaaaactcgcttgctagtttatttctcacacaataatataaaatttaaaagaaaaaataaattaaaaatgagataagcgggctaaaaaaaacctacatgcccgtccggcttgcatgcctacgaaacaatcccatgtgtggcagc

SEQ ID NO: 27129 - DNA, 549 bp, Oryza sativa
actctagaggatccccagccccatcatatatatccgagttatgaggctcctggcccagattggggtgagtctagtacgcgactggtcgtgtggagcaaacgcgtggacgctacctatttcttccgtgcgtatctgaacctgctcacaaaactctactccagcccacaacatagtccacgtatatgcaaaattttcatgggcccactagcatatcccagccttttcctttctcatttagactaaaatccaacataaacaattctatttcatacatgtaactttatctgtataaactttacatatactagctttatgcatagtagttttatgtcttgttatatataaactttgcatatgcaaactttcaacatagattttttttcaaaaaagtatgagtgaattttaaacaataaaaaaaataagtccagcgaaaaaatatttaataaaacttctattgtacttaaatgggccaaagtagaataataatctttctacctataactttattaataaataatatactttccacatgataagtttatataagat

SEQ ID NO: 27130 - DNA, 794 bp, Oryza sativa
ccctgttttggactttgtaaagggcatgttggtttagctcaacttatcccaaatcatgctaatttcaaccaaacaaagcccctactatattctaagccaaaaatgtcagaacaaaataatcacaacaaaagctcacatataaccaagcattaacttactacaattacgaaagcagttacgctatagtagaccgtaacattggcttccccaacacggtgatatcatgtactctctctgtcctaaaataactgcaaccatagtttttcgcgctcaactttaatcattcgtcttatttaaaaaattttaaaaaaaattaaaaaaattagtcacgagtaaagtactattcaggttttatcatcttataacaacaaaaatgctaattataaaaaaattttaaataagacggacgattaaagttgggcacggaaacttatggctgtacttaatttgggacggaggtagtaatactagtactaccaaaaagttcagaattcgaaaacccggtcagagagattttcttcgaaccatctgagaagaagtcaaaaacgggaaagttcatatggcgaaatttgcctctcccagctaaacgcacagataacaatttcgagcatttgactaatccataatttacaaataacctcctaaaaaatgcaaaataattccactttgccccctgcgctttaacttttttttccctctccgtttatataatccgcctcgccccattctccatcgtttcgtctcctctctctcttccaccaaatattcccacctcgcgcggctactctctctct

SEQ ID NO: 27131 - DNA, 1095 bp, Oryza sativa
aagcagtgtcgatctcaaacacggaagttaaaaccaatcaaatgcgaactttgttttgttattactactcctagtacctgaatctttgcctaacttcagctcgttcatcatcatcatcatcaccaagattcatcatcattcattgcatcgaaagttgaaattgaaaattatagaaacgaaaaaaaaagcatacagtactaagagcaagtataataatagtaggctataaaccagctaaatgccgaggcaaatgatagaagagatgagagagagaaaagaagcggactgtaaacttacaaccggcttggacacaagaaccaaaaaaattctataagagagacaagtggaccctatagagaaggctaaaaaaaaacttataaacaacatatcgattgtattattagccttgctctaacacacaccagcttgtatgcggaaatgctaaggggcgatcgatcgcccctgggcgctcccctttcctccatatggtttcattttttggcaccacattactttcttattttagtaaatttacgcacctaaagtttgtacaccttaagtttacacatctaaagtttagagacctaaagtttatacatctgattcaaatttgaatttgaattcaaatattttttatatataatatttctatacatctaaagtttatacacctaaaatttatagacccaaaatttataagtcaaaagtttacatacccaattcaaatttgaatttgaattatatccaattcaaatttgaatttgaattcaaatattttttatatatagtattttgtacatctaaagtttatagacccaaagtttatgtcaaaagtttatatacccgattaaaatttgaatttaaattcaaatattagtttatagacccaaagtttataagtcaaaagtttacatacctgttttaaatttaaatttaaatttaatttttttatatatagtatttctatatataatttttttcaagcttatgttttttattttttaaaaatttatggtgtagtaggaagagaagaagatgaggagaaagaaaggatggggggtgttagccgcccccgcttgtatgtgtctaacgcga

SEQ ID NO: 27132 - DNA, 1501 bp, Oryza sativa
ctattaatcattggattacttttgtctatttatttcagttgtgctgtctatataaccatcctaaaacaaagaagaaacacaagccacagcttcatacaaagcaatcacacaaatgggcaagcagatgccgaactgtagccgaggacttctgcttctgttgttggcccttctaggctgttttagcattcctggccatctgtatggtaatctactatctaatattgaatctcaatggtgaatccaaggtttatttcgatttcacaattattcaattattctgtggtaatcacgatgtattatagaaacatatctttcagagtaaaatttgtgtttccatttttcttctagacatccatcttcacatatccatgtattgcatatggtttttctttatctttcatgctttcctagtaaaatattttttatttttcaggtaaaaatctagattacaccaggagtgcatccatgaatgaaggacgcaacaatgtcaatataaatggtttggtacccgtaccatgcaacattttctccccatcgaaggtctgctgtagaaatgtacgctaccctagcttgcaagcctgtgaggcaaattgcaagccaattgtttgatcggcttatcaagcctgtaatagtaaagaaatgataataatattatccgttgttcaccaagcaagagaataatcaatctcctcagagatgaatatggattgtctgtttgtctaggggaaaagtataattgtcttattgatacataactggagaaggctacaggagaatcataagaataagctgcaagaaatagtatcgtgtagtccatatggcatgtatgcaggtttgatcgtagcactcgtttacagaaaaaagtaggcactctttttggaagtgctgtccaccagattaaatttagttttgaggccagatcgaatataccattgcatggcacccaaacgaaaccttgaatcaatgggcatccttttcaacttgggtccgtgtggcaggccaaattggaaccttctgtactgtatcatcattttttacattgtgcatctccttcgttttttttaccaaggtgtgcatctccttcgttcttaagcacaacaatattatcacaagcaatcttccgccgtgaattatcacatgatttatttagttgtactcctttcaagaaatatcccgtgttctagagtatgattgggcgaattcgagggcgaattcgatcgaaggggggaagaatgtaataccccgagttttaaattaatatatctcgcggaatattagagcaaacgcgcaaaagttcaacttttaaaccattgttcgtataggcgatcgggaaccgtggatgcgtagagctcgccgagtagtgcaaaatagactataaatttatagtaatcggagtccgaacgaagtcccgaggattgaatagatgtgagccgttagatcttatctagtctctttatataaccaaccaaaaaaaaaacaaacgaaaaaaaaagaaacagga

SEQ ID NO: 27133 - DNA, 268 bp, Oryza sativa
tgtggatttcttgctctgtcctgcaaaaggaccacatttatttcctccttcaatctatagcatcagttgcttgcttgcttggccaatgaaatgaggtgggttggtgatggggacattgagttttgttagtgcaatgtattatggggacatcagattggtgttgcaaagtagccctatcattcaaaaactaatatcgtatctgtagattgtttcttgttgtttctctagcgcataaaaaaataatctaacacatggtattgtactatca

SEQ ID NO: 27134 - DNA, 696 bp, Oryza sativa
tgagctacctgttcacccctcctaccaaatatcactcatcagccactaataatcaattcaacaacagagccaaaggattaatatttcacaatccgtctccatccctagctaaaaaaaaaattgctcgcttaccaagttaccatgattaacatttcttttatatatagtaccagtagctgccaagcaaagtcacattatgggcatgtttggattcttcaggctattaaatatccttacagaatcttgctatttagtagtattaaacgtaaattactaacaaaactcattccataacctctaggttattttgcgagacgaatctaacgaggtatattaatccataattagtggatgattactgtagcatcattgtagcaaatcatggattaatatacctcgttagattcgtcttacaaaatagcctaggacttataaaataggttttgttagtaatctacgtttaatactcctcaataacaagattccaaagagtccatcgaatagctcaacgaccagcttgctttctggtatcttagcacaaacaatcatgtcagtctactaataagtgaggaaaatatcttatacacataggttttcccaacacacttcgtgcacatttttctaatagccgtaacaaaatggataaaattctgacatatcattactcttaaaattgtaagaatttttttctataga

SEQ ID NO: 27135 - DNA, 299 bp, Oryza sativa
atgaatttagatgaatttaggatcaagtttcattcaaatcggagttaaaatgaataagttatgctagtgtaaggattcaaattcgaataattgcgaaacagtactgttcacatccgatttattttaatccgaaacctatctacagctcagagtcactgacgggtggggtcaggggtcttattatcttttctaccgaattatttttgttagagaaaaatggggagtgggcccggcttgtcagtggctcggctgctctctttctctctctcgttcttttcctatcgtcttctacctccaga

SEQ ID NO: 27136 - DNA, 1365 bp, Oryza sativa
acgcgagtgatgattaattaattgtatagcttttgatgatggcaatatggcatggagctgtgcactatttatagcctaggcaacgtagaattaatccatacatgatactacatgtaagtaccgcagctggtgtgccttgtttgtggtgttgaattgaagctagcatacacgtacgtgctgcattttcgcctgtacttttgctagaccgccatacttcttctgaagctagcggagccgtgcatacgatagattatatatgtggagcaattaatatcactcaggttgatcgcctttgacaagtactgtactgtgcgtgaaccaagacttctacggcccgtataaatcccctagcaaaattatacatcctgtcacatcgaatatttggacacatgcatggagtatcaaatataaaaaaaaactaattacacagattgcgtgtaaattgagaaacaaatcttttaagcctaattgtgccatgatttgacaataatgtggtactacagtaaacatttgctaatgacggattaattaggcttaataaattcgtctcgcgatttacagacggattctgtaatttgttttgttattagactacgttttaatacttcatatgtgtgtccgtatattcgacgtgacacacaaaaaatttacacccctgaatctaaacacaacctacgtcgtccacgccaatagactttggctcttttagatcccatcctaaaatttttcaccctgccacactgaagtttgaacacttacatgaagtattaaatataggctaaaaaaattatgcacatattatgactaatttgcgatacgaattttttaagcctaattgctatatgatttgacaatgtggtgctataataaatatttgctaataatggattaattaggcttaataaattcgtctcgcggtttactaatggattctttaattagttttttttattagtgcccaaacaccccatatgataccctatataatatccgatatgacacgccaaaactttaagctcctagatctgaacacccctttgttagcttagctacagctagtagctgcacccctatgaacaacatgctgctcaatcgtgtgggaaaaaaaaaccccgtagtgtcgctgccgcctgggcgctccagtgggaaggttggaaatatatcttgaaaaattgagcacatgtgaacggtaatcatgggctagtaaaaatgggggcaccgtgacatcctgaccgaattaatttgaatttagtttgtatggacaataaatactgtgtacgcatatttagtatcacatgccatttaaataagagcgaaatcaacttataaggacttttctctccaaccatattaagtagtgtagta

SEQ ID NO: 27137 - DNA, 1501 bp, Oryza sativa
agcaatatgagtaaattgcagatggtaagattagataagattatccaccatacttttcatttcactaatatataacaaaactgtcacgaccggaaataacccaacgggcgttccttacgtgcgtgtattattccttgtcccaggaggcaagttacaccaaaagttgatacaattcagaggctaacaagcggaagcgtaaatagttaatttattacatgggccgcgaaggcccagcacacacaaagacaaacgggaaacagcggaagactagggcgacgaccacaggcgcttgacggcaggcccttcatcatccaggagctcctcttctgggtttgggaaaaattgagcaagactgagtacaaccaccgtactcaacaagacacacccacaagtgcagcataaatgcaaaggagtacaatggagttatagtataggggttaggttttgcaataagcagcatttaaaagactcttagttgctcaaagccaaatttaaaacacgatcctagaactatgtaatattattaaacaaggccgtgaacccacatgaacctgccttaacccaaggcctacgatgattcagaccgaactggcaacccgaccctaggtcccagctcgtcccaagccaacccaggccaaccattccacattttagttattaagcaggttttaagaattaaaaacactaacttgggtacattgctaggcttgcccataaccgagggcgcggctattcgaataggttttactctgatcagaggtgtacatctttacccacaagacacgtcttcctcacgtgcaaccacgtgccacataccaccacggcatatggaaggaagacatgacatagtttccaaccaatcctagacatagacaagagtaccgacccaaccccacctacggccggaatctccgggataggtaggcaggactgagcccctagcagcaggacaccggccctgtgccaggacatctcgactaccggccgcagatcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggtccgaagaccggtccttatatggccgaggtgctactatcaaaaccatgcaccccaagcccagcctaaaaccattttgagagttttgaaaagagggagaggtgtgcatccaattccacaatagttcaaccattccataaagtccaagggatatgaatattcccaaagtctaaagttataaaaccacctaatgttgtcttattaatcagcgaagcatctacctaaattcatactaggggaaccatgagtagagtgcccactagttggggttttgtttattctagggtgaacaaggtaataataacaataacaataataaggtcataacaaaggtaaataggcatggctaaataaaacagtga

SEQ ID NO: 27138 - DNA, 1501 bp, Oryza sativa
ctgattcgtgtcggttctgttggatctggatgtgcgcaggacgtcggagaagatgatgggcggattcctctcccgggtcctcctgtaagcatttccctccccttccccctgaatcttgaaatgtgctcttgcgaagttgatattttgggtatggaagttgtcaaaggcattgggtctccggttttggtttcagtttcttgagatgaggatgcatgtgtgtccattcggagggcagagtctcctttactattttgtctctctgttctttcacccccccccccccctaatagtatatgctattttgtttgaaaacaacaaatcgcgagatgcgtttcttcgtgtcgatttgttcacctgattcttcggcttgaaatcgggaggtgagagcccgctacgcattcgaaaaatatatgatgtttattgttcacgaggaggatgggaccaaattttcaatgcattgcacaacggtcaaaggctttcgtttattcttaacagattgattctttttttcaagattcctgtcgcatgatcttgtctatcggaatctaagaatggataatgattctgacgttctgtactattagctgaagctcagtttttaggctccgatttgaacaaataaacccgaaattcagaagctttgttcttttggcatgcttcatctgcagttgttctataatgtaagcctgatcatgtctcgtagatcaagatgcgtattgtgagttctcctctttaatgcaagtgcgttgaaaatttagcctcttcaatgatgctcagatgctcaattcaacgcaccctcgaaatggtcaactgctcttctatggattagtttggagcgcaacaaaaaaaaaacaagaaaaaaaaagagcaatcgttttcctctaaatcattttactcggaaagaatgtacatacattttgtttatggtctggataacaaatagagcatggatatgtcatttatgatctggcttatgcctattgcatgtaggttggcctttggctacgcctatccagcatatgagtgctacaagactgtcgaactgaataaaccagagattgagcagctcatattttggtgtcagtattggtaagatgattctttcatctttgatcatgacattatccttcattagtatttgcgagacatttagcttttatttgctgtgcctgtgtctaggattctagtagctctgatgacggttatggagagatttggagattttacaatatcatggtaagactgccaacgtttgcatttttcatctctttttaacagtctctaacattagttgcaccatgcatatgatcgtgttgaaggctaccattttactcggaagcaaagctgatgttctttatatacttgtggtaccctaagacaaaggtactcgatttgtcacctatagcttctatttttagatgttttttctgtacattggattgacatttgccttcattgtagggaactacctacatttatgggactttctttaggccatata

SEQ ID NO: 27139 - DNA, 842 bp, Oryza sativa
gccggaaggaaggaaggaaggaaggaagcggaggggagggagctagagggaaatgcgagagagagttgagggaatgagtggtggggagaggataagatggaagaggagaacataagataggacttagtttttttttgtaggcatgagtttttgtaggcggaccacataatattcctcctgcaaaaatcatatttttttcaggtggaccacttaagaggtccgcctgcgaaataacggtattttcgcaggcagacctcttaagtggtccgcctagaaaaattgattttcgtaggaggatgatgaaaatccacctcggtttacattttcataagcggatattgttagatttaattgggtaattgatccatttaaatcaattaaatcaaattaattttaaggctcattatgctaggaattcatgtgtattcattctcttatgggatatcaatgggatgaagagttttgagaattaatccatttgataagtgaattggtaacttatatcaattactcctaattgatggatggtaaatggttgtgtggtgaaggatggttcatggctaattgttagttgatgacaattagctgctctattcctcttcctatttcgttggtaacctacatcaattactcctaattgatggttggttgataattgtgtagtagaggatggttgatgggtaattgatgagaattagttactctattcctcttcctattctattactcttcatctttcattcctcctataaaatgagaatggatttgatctctctaaggagaagtgagacacactttcatccatttccaaggctattgctgctacgataatcccatcccga

SEQ ID NO: 27140 - DNA, 860 bp, Oryza sativa
tattaaaaaaattattgctagttttagtaagctcatgccccgtactcctatcatcctcactgaagtaaacgtggcgaaatagaataattgttaaactactccatgcccgtctccttggcaatttgcaaattttctcaagaaaccgcggggaaagcaagcaaccaaaactaaccaccgcgtagccgaagctccattgaccgttgacttgtagtcatcctctactcagcccactgattttccactgagtgagtaaacgtcagtccaaatactccgtcacagtgtcttgtcttatgcaacactatacttgatcacgggtcatagctttctcatcatttggagacggtcctgcatcgcacggcaaaatgcaaatacacgaagagagtcttgaggtaccagtcatcgaaaacaatttcgtaccgtaccgtgaggtatcgataccttcagatatattttattggactagaacaaatctcttatataaaagtgttaatggtaaacgaaaaattacctactatcccaaccccaattctggcgggggcttttaactatttgccactcttacggatgttgcttaacgatttgccactaggtccacatgtcatagacatacgagggcccacatgtcattgacagggtgtggcaaatcgttaattgccatgtcataagagtggcgaatagttaaatttcccattctggcgttagcgttgtgccgtcgtagcaccaactccgtgtggcccagccgtcaatggcaacatgacaataagttgagcgctactcgtcttccacctcttgcaagaacacccaacaacattagcgaaaccaagcagcaggtgatcgttgatcagcaagtcatcaagaga

SEQ ID NO: 27141 - DNA, 1501 bp, Oryza sativa
tttcttgttttttttttgttgcgctccaaactaatccatagaagagcagttgaccatttcgagggtgcgttgaattgagcatctgagcatcattgaagaggctaaattttcaacgcacttgcattaaagaggagaactcacaatacgcatcttgatctacgagacatgatcaggcttacattatagaacaactgcagatgaagcatgccaaaagaacaaagcttctgaatttcgggtttatttgttcaaatcggagcctaaaaactgagcttcagctaatagtacagaacgtcagaatcattatccattcttagattccgatagacaagatcatgcgacaggaatcttgaaaaaaagaatcaatctgttaagaataaacgaaagcctttgaccgttgtgcaatgcattgaaaatttggtcccatcctcctcgtgaacaataaacatcatatatttttcgaatgcgtagcgggctctcacctcccgatttcaagccgaagaatcaggtgaacaaatcgacacgaagaaacgcatctcgcgatttgttgttttcaaacaaaatagcatatactattaggggggggggggggtgaaagaacagagagacaaaatagtaaaggagactctgccctccgaatggacacacatgcatcctcatctcaagaaactgaaaccaaaaccggagacccaatgcctttgacaacttccatacccaaaatatcaacttcgcaagagcacatttcaagattcagggggaaggggagggaaatgcttacaggaggacccgggagaggaatccgcccatcatcttctccgacgtcctgcgcacatccagatccaacagaaccgacacgaatcagaacacaccatcagcagcaacgaatttccaagagaggacgcaaaagaatctgcaaaagaaacctcttttggagatggatccggcgaggagcggcgaaacggagagggcggagagagatggtcaggagctcgccaccctcccctgttccctctccctctacgctatccctccctcctctatcgcggcttaactaaatataccggcaatgcggtggtggttttgccgagatgaggaggaggagaagagagagagagccggagaagaggcgagcacgtccgccgtcagctcgagctccaaccaaccggaccccttcctgtttctttttgtatcaccgggttataaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctga

SEQ ID NO: 27142 - DNA, 666 bp, Oryza sativa
ttacaggcaaggtgttacacgaagaagggcaaacatgcacgttgttaaaccgacgcgtggtggacaagaatgaccggtctgacactggtcgcatcagcaacgggcagccacgatcccacgttgcgcctgtctccgccgggagtggaagcaggtatgggctgtcccatcaaagtgtcatttggacggcaaccataccgatctccgtccataaagagaagaaaagtccagtttggaaagggaagggtgcatgtggtatccccttgaagtataaaaggaggaccttgcccatagagagggggttggttgattctttcccggattgagagcttagaacgggggagaagtcagctcacactttgtaactcattcatacacagatccaccaaaacacaggagtagggtattacgcttcgcagcggcccgaacctgtatacatcgctgtgtctcgtgtgtcttgcgggcagacaatctttccacatacagagagaaagagagcttgagatctcaccctaagcccccggccgaactggcaaaggggggcctgcgcggtctcccggtgaggagccaggagctccgtcatctggcgcgccaggtagggggctcagcgtgtgctttctgagctctcagactcttccgtgtgccccaagcttttcttgttcaacctaa

SEQ ID NO: 27143 - DNA, 1501 bp, Oryza sativa
gaatttattttgaaaatgcatgagtcaaccaagctcaacattgaaaagatgactgaaaagtatagaattgctgatagtaaaggtaggcaagaggttaagcttgaaccgggtggtttagtttggttgcacttgagaaaggatagatttccggaattgagaaagtctaagttgatgcctcgtgctgatggtccttttaaaattgttgagaagatgaatgataatgcatataaacttgagttgcctcccgagtttggggttagtcccacgtttaacatttcagatttgaagccatacttgggagaagaggatgagcttgagtcgaggatgacttcaattcaagagggggaggatgatgcgaacatcactacctcggatacacacatcaatcctccaacggtcattcaaggaccgataacaagtgctcgtgtgcgacaattaaatttagaggtgagctcgttcctatgttcttctttgtatgaattcgagaatagattgctacctaatgattatattgtgattaggaacaatggaggggacaaggtgtcgcaactgagaaaattaccttttcccgaacgctagtgtattaatccccgtcccaggaaaagccggggtacaccacacaaacatgatacaaaaggcacatctttattatatcgataatatttacattattacaaaggcacttcaggcctgacatataaaaataaatagcagcggactagcgggcctacggctccatcttcacaggcgctcaactggggtataagccagaactccacctaggacttcttctccaaagcttctcttactgaaggggggggggaaagatagagcaagaatgagtacaaccacagtactcagcaagccacaccggtagatgcatgattaatgcaagggggtacaaggggtaataatataggggttaaattttgcagtaaacagcatttaaaagacacgtagttgctcaaagctactttgtacacacgatcctagagctacacaatatttattaaacaaggccgtgaacccacacgaacccgccttaacccaaggcctacaatgattcagaccgaactggcaacccgaccctgggtcccagctcgtcccaagccaacccaggccaaccattccacattttagttgttaagcaggttttaagaattaaaacactaacttgggtacattgctaggcttgcccatatccgagggcgcggctattcgaatagatttactctgatcagaggtgtacatctttacccacaagacacatcttcctcacgtgtaaccacgtgccacataccaccacggcatacggacgaaagacgtgacatagttcccaacccatcctagccataaacaagagtatcgacccaaccccgcctacggccagaacccccgggataggtaggtaggattgagcccctagcagcaggacaccagccctgtgccatgacatctcgactaccgggacgcagctcgtgtagccttcatctatcctaga

SEQ ID NO: 27144 - DNA, 464 bp, Oryza sativa
ccggatcggctccgtgagaaacgcagccgccaaacggccacaagcgcacgttctctcttcacgtgagaaccaagtcttcagtgattgactcgatcagcagaggttgttgtatgcaagcatcttttcatcaacacatgctgatcgtgcggctaagcattaggcatttaaattgatgaaatgatcaatgtctccaagcatgttatttccatcacaacctgctgagtcagcacgcagggcccatatgtcagtgacttctctctttctcctcccctctctcctccctcaattctctctccacctcatctcctcctgcagttcccctcttttccatgacatggcggcagccgagtaggccacggggcggtgagctttggggtaggaccgtaggagagaggggaaccaagcagcaaggccgataaatttctgctactgatgcttcgtcggtgcctcttctctcttctaga

SEQ ID NO: 27145 - DNA, 1501 bp, Oryza sativa
tggcgtcacacctgaccgcttcccttgggaagggaaattgctctggcataacgccgggggctactgtcggtgatatgggaccgggagtatcataaccagaggcttgaggcagacataatcgcccacgtggcctggcaccttcggggacgtcgggcccgagggtgaggtgtccgccctcctcctgatttcccccgagggggggtcggggtgcgcttgccccgaccccgagggccgaggtgccccgaccccctgaggggtttgcactatgtacgtaggttgggtgagcacagcagggctcacctaaccacatttattgcacatcggctaagcgtgtcacgccgcacggagtgcagtgcagtgcactcgattatccggtctgtgaccagtcacagaccggtcaaatcgcgagttaggtggcggcaggcggtctgacgcacgccttgccccatcccgtcaaggtgtgagcttctaagcactcgtccccagctggagctagcgtgttacatcccaaagatggcacgttaaccccgatcgatatataccaggcttcatcctaaccattacaggcaaggtgttacacgaagaagggcaaacatgcacgttgttaaaccgacgcgtggtggacaagaatgaccggtctgacactggtcgcatcagcaacgggcagccacgatcccacgttgcgcctgtctccgccgggagtggaagcaggtatgggctgtcccatcaaagtgtcatttggacggcaaccataccgatctccgtccataaagagaagaaaagtccagtttggaaagggaagggtgcatgtggtatccccttgaagtataaaaggaggaccttgcccatagagagggggttggttgattctttcccggattgagagcttagaacgggggagaagtcagctcacactttgtaactcattcatacacagatccaccaaaacacaggagtagggtattacgcttcgcagcggcccgaacctgtatacatcgctgtgtctcgtgtgtcttgcgggcagacaatctttccacatacagagagaaagagagcttgagatctcaccctaagcccccggccgaactggcaaaggggggcctgcgcggtctcccggtgaggagccaggagctccgtcacccgcgttatcactgttttatttagccatgcctatttacctttgttatgaccttattattgttattgttattattaccttgttcaccctagaataaacaaaaccccaactagtgggcactctactcatggttcccctagtatgaatttaggtagatgcttcgctgattaataagacaacattaggtggttttataactttagactttgggaatattcatatcccttggactttatggaatggttgaactattgtggaattggatgcacacctctccctcttttcaaaactctcaaaatggttttaggctgggcttggggtgcatggttttgatagtagcacctcggccatataaggaccggt

SEQ ID NO: 27146 - DNA, 151 bp, Oryza sativa
attctttggtgctgaaattagtgggtagctgactgaaatggagccggagaaagtagctcccggcagcggcgacgatgaacttgtagcttgaggatgcattgaagatccgggcattcttgtacaaatctccatatgtctctttcccatcaga

SEQ ID NO: 27147 - DNA, 1501 bp, Oryza sativa
actagctagatttatgtgaaaaaatgtatttaattagtctttatgaatgaactatggaagtgtactttatgtgtaatgcatttcaatatttactattattatggattctattttatgctttctattataggctcgatgacttgaggacaagaaacttttaaaatcatatgctcaccccatgttggaggtaaaaaacaatcacgtttatatttttgcacttatgaattcttagatattctagacctaggaatttttcagttacgatatatatgtaaatgtttaaagcatttgagatgttatagagctctagcgatttagtcaagtctcctgggatgtgtaacacatccggtcgctgccttcgtgtggtttgacgggcacgtctcaggctaaagttgactggcacgctgagtcccagcaatatctcttttgctctttactcgaggatatgaatgtaaattatatggaaatgtctagaatttacacttatacttttctggactgatgaattttagacttttgaatttctgacctaaggatatatgtgcaaattaatgttcacaatttagacttagaattttttggacttaaaaattttagacttacaatcttttgacttaggaattttaaactaggtatattttgagttaggttatatatgcaaatgtttaggatttaaagataggaaattttggactttcgaattttgacttaggcttgtaggtttttatatgttgtgattaatggctcgtaggtttttatttgtgttgatgaatgtgaatgtgaatgaatgtgctgtatggatgtggggctgtggggataaatttgggtttatatggaattggggttgtgtggatgaatttactataatttttttgacccaataaataggtgccagtttttaggcttgaaccgacgcctattaggaccgtattggtgccggttttaaactaaaaaccggcacctatttaacagttacgttgcaatctggcttagaactggcacctatttaaaccatataggtaccggtttttaggtcaaaacgcctccttaatgccggttcggaaaaccggcacttattagctagggtttcgaccggcaccttttaccctttctgtagtagtgaaagcttggtcattgctaaatgatgcttatacctctccagaccattttttaaaaaataatatccctccacatttatcctaccactaactagggtggtaatataaatagagcacagtagtggggagtatgtgggcgggcttatttcatagtttacccaaaatgctgctatctatccaaatctcaaagcgaagtaggcaatgacacaactgattagaaacataaatggatgtagaagatacaataacttgcaggaatcacaacaataaaaaattatgctcgtattaatccaagcatttattaactaagtccagcagttcttcgcctgatcctgctggtagagcaggactaatactactcttagttaccaattttacttgag

SEQ ID NO: 27148 - DNA, 629 bp, Oryza sativa
ctgtttatcactttcttgctatttcatgatttttattgaatttggttcttcgtctttcttagtagagtctattatcttttggatggcaacctgtggtgtttcgaggatcggataatcaggttgcctatctcagatttgtttgcgttggagcaaggcaagttattattcctcccatttgagcataataatcctatattctatatctccagtatcttgtgcattggccatacatgattttgaatgcataacctgaatatatagcaaaccagatatatgctagcttttgcttagccctgcctagttagaatgcataaaatataatgaacttagattgggacagtacggtagaaatggttgatttccgggtggctagtactgttccaaccgatataagactgccaagtacatgtgaagaacatatgagtacgaccgcaattctcgtatgggcatagacctagctgattaagttatctagcaaaagtggtacctctgtatagtggttcttcttaagtcctcgtgcaggaggcaaatttatgccgcgaagggcaattgtgatatttaccgaggcgcaggtaaatatatgaaatgaattgtgcacaaattgtttgtgaaccctgattgcgatgaca

SEQ ID NO: 27149 - DNA, 203 bp, Oryza sativa
agttccttcctcaattctccatacccatctcaccaaaattcccatgtctcccaatcaaacaaaacaattaataacctcatccctctaaactccaaatccctcctaaaaactccctccaaccaaacgggctgtgagagttcacacagaatccagaatccagctaaggctgtgtttagatccaaacttccaactttttccatcac

SEQ ID NO: 27150 - DNA, 1501 bp, Oryza sativa
tatgaatattctctagggcttctagcctagatccggtaccctaggaggtatctacctcgaatggtgatagtgagaaactaggggcggatccaacctgatgcatgggattgaacagcaccttcatcacagcacatcagttaaattaaattaattactctagctagtatttatgtaatatcaaagagtctgtcattaggattagaatgaaagttggggataaggataaagaaattgaaggtattttaacttcaacatatttaatcttgaattctgatcttatttcacaatatatatacaccctatatattcctatttctaactattcttgccacacataatatatatccaagttccgataagagctaaaacagttcctagaaaatatataatacaaaatttgaagtgaaattcctactataccttctagaaactgacccatgctgcaacttgcaataatttgtaactaacgataacattaatatgttgtacgattgtactttatctccccaatagctggtaaattgttatagatttttatcttgattttgttgcacccttgcttcgctactagctataacagacaagctcgccgttacccaggagcttaggggggaagttttggtgggataagaaatagtaatattaactacttacggcttttgatgaaagagataaataccaataactatgctaggtaaggagcaactaattagcaaagtgctaactccatcccattttaaacgcagtcctgagtttccgtattatttgtactttttctagaattttttacgatatttcttagttggtgtgcattaatcatgtgcaaggaaatttatgtgtataggatgtgtgaacttaggccgcgttcgatagcgagagatcgaggggatttggtgaattgtgcactgttcagcactgtatatgtctgaataatttactgcatattaaatggcgttggtgactaaacgtggcacctgtacaaacggcacagacggcatttggatggatcgattcgtcggcccatccgtccccaacccaccaccagcgcaagcagccatgctcgctctctctctctcccatcgatccccttcttccttcgccaaattttctcggtcgtcgacggctccacgcgcagtcgtcgtggctggaatcgttgtgccctactgctgagcctcgtccggtggtcgtcgtggtcagcctggggctgttaggcacacggagaaatcgaccactcgtcacgggagctgctgaaaaggcgaatcgaggccggagaaaggggattctctggcggagctgccatcaagccaggcggaagtcggggagcgctgccggtgttgtctgcgtcacctagctgctcatcaggctctgcagctttggccgcatgcggctgtactcggtggagtgctctcgggtgtcacagtgtcgtcaagattcggcagagttggaagctttcttctcgcctccggcctcctatttgaggcctccttctccgggtggacaa

SEQ ID NO: 27151 - DNA, 1501 bp, Oryza sativa
gaatccagaatccagctaaggctgtgtttagatccaaacttccaactttttccatcacatcaacctgtcatacacacacaattttcagtcacatcgtaccaattttaacccaaacttccaactttggaaggaataaacacagcctaatctgcataagctcctacttactgtatctgcataagctgcaccgtacacctctgtacttgtctactgtaacctgacacacttctaacagtagtaacatggatcgatctctgtccatactcctgcaaattatcctaacaccataatctaatcaatcacccacgaccctgtgtccccccatcagatcagatcatactaattctctgaaagtttctcccattatgcatgcacattgcactgacagtgagtgacgaatgctactacagcattcatggctcgctagtacagtacagctgctgagctgcatctgcaggtgcatctcccctaaaaagaaaaatcatctgctactaataataatcagattcagacgccgactgaaatcccactgttcgcgctagcgtccattcggtgcagagacaccggcatgtgctccccaagaatccgctccattttcttttcctctcttttctctggaactcagctgattgttttattctgaattctgatcagaaaaagggccagagcatcgtgtgatgattgagctgtaaatgagatcaagctggatcgtattcagacagcagattggcgactctgatctgatcacgcttgctatagctagcttgtgatgattgatgattgatgattgattgattgattgcccggtcccagagcctgcatttgcatcagccagctttctttgctcgtcatggacagtggcagcagcagctgcagcagacagcccacgcctgggtgctcatgtgggaggtcgctgcatatctagcagaatcgcaatccacatttcctcctgcggatatctctccctgtctccctccctccccctcccaaatccaatcagtcagctcctgcatcacattgctgaatttattattaatgcttgcttgcttgcagcactagcattctactggtatttgttcttcagttcttcatgtctctctgaacttctgaagctgaagtgagactgtgcagccatttcttgtgccaaactgtcactcttcagtttcttcttcgctggtctcctcttgtatttatgggtttggaggtttcttggttttggctcggctgctgcgcgtgaatcgattggtgagttggagccaagaacctgaaatcttcccatttctccattcttcgcttcgatttcagtatttgttttcacctgtcatattcttccctgttcttaatctgttccattgcctttcccctctcgtgattaacgactccgggttcatcgccgctcgcagttcggatttctacacatcaaggagaaacaaatctttggtgattcagctagggtttaatagtcctcccaagaattgcggcgctggaggttatcgaggat

SEQ ID NO: 27152 - DNA, 271 bp, Oryza sativa
acatttaaataacttaaggaaatccaaataaaatattaaaatagcaaatttggtatcaaaatgtagattttgaatttagatgaatttaagtccaaatttgactgtaatcggatctacggtttaggagatatgggcttctaaataataggttttgaattaaatagagaaaataagaagagacactatgcaggggacccacctgtcagtcttttctttttctttttctttctcttcttcttcttcccgcttcttccttcttcttctcttcagt

SEQ ID NO: 27153 - DNA, 1501 bp, Oryza sativa
caaagcagagagagcgtcttgggccaagaaagaaaaataagctcttcacccaaaggaatatatatgttttttttttgttccacaattgaatcatgatcttgcaagatggttggaagactgtgttccaatcctgcaagatggttgaaagattgtgctccagtcctaaagatgagagtgagaccaaacagaccgatataggcattttgtgatccgatggagccatttggatcatgaggctacacattatctgatcatactctatgcagtacaaaagtgcaaccccatctggatagtacatatctgctgctagcaacatcagtttgaggttaatttaactccttgacagattgctcaagatacgctagttttctctgcttttgtttggacgcaagctagaaagttatccaatgtcatcagctcacttgtctcctcctgaatgtcttgtactcttataggctgtagctgtggtgccatggaaatcagccatttggcaggagaagaggccatcaaggggttgagatcaatccaaaaacaatggtaacaacgaccagagattatatgtattcttgcagctgcatataatacggattaagtcctcttgagtcttgataataatggaaggcaggtcttctgggaagaggaattttgtccgtcaccgatggcagtgggtgttggacaatgtggcgtaagaaaagtaaactagcgttgaagtgctgaactaatctgcatgccgtttctgacagcaaaatactatgccatttggagcacaaatggtttgagtttttttgtgagtagagctggagcatatgcatgctagactgcagcacagtttcgacatgtcactgatgcaaatcatgcaactcttcggacatacaaaaggcaaaaccaaccagcattgaatttgtcacctgttgcaagtttcagaaaaagaaagtcaaagatcatgtattgtttcagatgaaaattaacaacacttagatataaactcgaacttgccagtttaacatgtaaaaattgatgtcagtttttacccaagcacaagaatgcagttgtaaatgcaaatatacccaaaagtgctctcaagattcaggatttgataccataattgagagtatgctaacccactgccgtcggtaacatcagccggagaaacgccgatcagtaacatcctgtagcaaaacgacaaccacaaatcgagattagaagcctgtgacgtccggcgtagacatgtaaattaacccggccgtctcgccattggacgagcgtgtggacagccgcccttcaattgcagcattaatatttcctatatcatcttcttcttccctgtccctttctcctcgacgaagcgcacacacacaatgatgcaatgtgttggtgcacctaacgcgtacatatatataaccataaggttgcactcacctagttgcagacttgtaggtgacagcaagagaaatccttctccattgtcactgtgtcagtttgtttgtttagcactagctgc

SEQ ID NO: 27154 - DNA, 320 bp, Oryza sativa
ttgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagatttagcttacatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 27155 - DNA, 166 bp, Oryza sativa
gttatggtgtaaagaacttggttatcaagctgaaatgtttgtatggcatttctttcacataatgatgataattgaagagtataatatcacaggaaatatatttcagcaaatgaatcaccgagcatagatagcatttacttacctgattacttcttcacacaacagc

SEQ ID NO: 27156 - DNA, 1501 bp, Oryza sativa; identical to SEQ ID NO: 19937

SEQ ID NO: 27157 - DNA, 188 bp, Oryza sativa
attcgagcctgtaagaaagaaagttcctgagatcatttcaagagttgatcaaatcattttgaataccataaatgcacctacagctttcagcactaatcaggtacttgaggaaaggggcagattgactggtagaattgattcactatactatgcaaaccagaatcttcgaggtttgcttgcagaaaaga

SEQ ID NO: 27158 - DNA, 1501 bp, Oryza sativa
gctgaaaaaggatggattgatagattggcaatagtgtttctagctaggtagggtagctagctagaaatagtttattaagctagctagttaagggttatcaaaccatcacaaaatacaaaatgcatggggaattttggtggtttggtcagtgtagtccacggacggaaccgacctacacaccaaaattttcaatgcattttgttttctataattctttgataattaaggacctttattaggtgtagggtttgaaatctagttacaagggaagaattgatagattggccgcagatttaatgtagttccgaggttatcaaaccatcacagaatacaaaatgcatggggaattttggtggataggccagtgtagtccatggacggaaccgacctagacaccaaaattctccatgcattttgttttctgtcataatttgatgattaaggaactttgcagattatctaaacttgttgatttatataccctttttgtctatgaataggtcaattgtatgaattgttgtttatatacatgatttatatacccatgctgctgctgccacaatgattgtgggctgttttattatctagacttgcttgaattgaatggatgaattgctgtttacatgaagttagtagtactgtctccttttttatctacacccctgctactgctgttattgtgggctacttgttaatacaccttttccttgttttatgttgttgctgcccctgtggagtatctttgcccctgcttctgctgcccaatgtgttccttgttaaatggccagtgatgaattgctcaataagaacagattatctacacttgttcatttttttatctattcttctttttgcccctgttgtggctcaataagtgatgaattgctcaataagtgaatcttgaatgtggatttaagtgcaactgctgctgtctatgtttgcccttgctgtctatgtttgcccatgctgctgcctatggttgcaactgttagttaagtgcaacttgaatgtggatttaagtgccatttggacatataaccattcatggagtgtgtactgctatatatgttgctagacctattgaattttgtggatcatgtttatatttagctgaaccgacggaaccgacctagacaccaaagttctccatgcattttgttttctgtcattctttgatgatttatatacccttgctgctgctgcccaatgtgttccttattaaatggccagtgatgaattgctcaataagaacagattatctacacttgtttatttttttgcccctacacttgttcacttgttccttattaaatggccagtgtagagtggttatatacctctacacttgttctttttttatgcattagaacagattttgtgcacttgctctttttttatgcataagaacagattttctgcacttgctcttttcttctggattgataagaggagtatatctagacatgttgttttagttaatttgcccctgctgttgctaccc

SEQ ID NO: 27159 - DNA, 1501 bp, Oryza sativa
ttccttatccttggtaacctttgcaagggcccttaatctagactgaaccaagtcttccctttcattggccatgaggttataatactcatcggctgttaaatcattttgcaactccgttctccttgagccaattctaacttcccatggcaaaatagcctcatgtccataaacaagcttataaggagggacttggatcgatccatgacaagccatccgataagaccacaatgcttcggctaatcgagtatgccatagccaaggataatcagaaatctttctcttaatcaatttgatcaaactcttattagatgcctcggcttgcccattagcttgtgtataatatggtgaagaattcaacaatttgatacccatgctataggcaaactgaacaaactcatcggacacgaaaattgaaccttgaccggttgtaatggtttgatgtggggacacccgataaagtcatggtgcacccacgaatacgtaaccgcccaggatgttcagttacgcatgaaatgatataaaagcataaagttcgattatacaatacttaagtcacttagttcacaacacaacataaatacaaatcattacatatatggcctataaagccttatttctataaacagataaactactagactccatcacaggaactgcctgagcgtaggatgacgtaaaaaccatagttgtcccactctaatagattgttgtcgaaacgacaactgcatacgtcgaaagacgtggttactcaacagtggttggaaaaatgaagtgtactaaattttgaattttacatgggatccccccattacatggccctaggggactatttatagccccattacaggtccttactaccagggtttaggttgtacaggggaatttacatgattacccttaaagaaggggcatttacaggggtacataatgttataggggctcatgggcccctgatgggccgtttggcgatcgccggcctgatgggccggaaaggcttcctcggccctcgcgggggcgaacttgtcaaggcgaagtcatcctccttcggcagacagtcttcgccttgcacccttcgtctgagacgcctctggcctagcgctactcttcgccttgcgctgctctcgctccatagccttcgccatgggtttcggcaggtttcgtcgaagggcctgatgccatccgccaacaagcccctcacgggcaagggtgagactggagcttcggccaagaccgtgcaaaccatgtggtatggtatgcggcgccccctttcgaccgatgctcctaccgaaaccaacattatacctgcgaatgaagattattatttgtgcggctggtattattttgccgcgcttcgcctcgtgcgattgatggttatatatattcttttttcctgggccgaacgaaacagtattgggccttcctttcttgggctttttactgtgctgctcggtcgacaggaatttaccgtttcgcctacccttgcgacacgtggcgctttatt

SEQ ID NO: 27160 - DNA, 1501 bp, Oryza sativa
gtttatagaaaaatagtaataataaatttattataaaaatatatttaattattaatttaataaaactaatttggatcagagcatgttgcgatgcaggcggcctagctagcttgtatgacgattgcgtgggtctgaaactagtactacttcggctagcacagctcgatcgtcgggtcttgtcagagcgcgcgcgcccggctcatacttatccatggataacaacccgcttttctaaaaaaactagccgagaagttttaaggtgcgtacaacttggaacctgaaaaatgaaaatagaagttttaattagaattgggttgctataatatagaagcaaataagtattcatcttgtagtgctcttcctcaaatcactgtcaagatcaccattttcttattcactactctctccgtttcaggatatatataagacattttaattttggtcaaagtcaaaccactttaaatttgactaattttgtagaaaaaaatagtaatatttacaacacaaatatagcttcactaaatctataattaaataaatgttcataatatttttgttttgggttaaaaatattactccctccatccacaaaagttacacatatttcacatttgagcttttccaaataagttgttcatatttgtagtatttatgcattcaagagttaaatgaagagataaattaaatgtttgattagaatctaaggagtaatctaaatactcattgattgcatgcttacattcactccttgattttgtaacatccaagataatttaatttttccttgatcttgatgacaaagtaataggtgcaacttttgtggatagagggagtactttttttttataaaattagtcaaacttagattagtttgactttgaccaaagttaaaatgtcttgtaacaacggagagagtatcattcattttaagatgtaaacattatcccttgatgatttaatccaaatgaacctgctgctactccccacatagagtttcactcattcattcaagccttccaataaacaagtggcatgaacatggatttcaataattttctctcaagatatgtatgaatggaaagcataaatcaatagtaattaagaatggcatgacgacattagcaatataagctaaattaaactattatatcagtcgataacctcaaccgcaagatccagtatgatccggtacaatattgcaaacaaaagccaatagatgtttactgaccattcagctaggtggtgactagtgactagtgagagggacaagtcatgttggctctgcaaccaaattgtgcttgttctccatggccctgcagaccaaaaacatacttacagcttattaacggacatgcacctagaagccaatcaggatgaatatactcaagcataatgtgctaccaagaacatgctcatttgaatttcaaagattaaatttccaatcatgaaacaaattaattaacatggtataaatcacaaatgattgatacatccaggactc

SEQ ID NO: 27161 - DNA, 1501 bp, Oryza sativa
caatttcaatgcttgtcctacttgttcttgcttgttcttcgattgcttgcaggacgagtgccctcgtggccgggttgacgcgcaccacaagttcgcggcgaccattggagacggtgtatcggttgctaaggcccagcgtctttggacagttgtagtcgggtcgtgaacgtcgtcttcatctaattgagttatcccttacctctcatcgaaagatcgggccacaaaccctagcgggttcgcatcaggtggtatcagagcgtggttcatcggtgagagaatttacccttcccttcgtcattaattttttttcctatagtccagaaaagtccaaaaaaaatagtagattagttttcccgtgatcctatagacaattgtgcctttttactagtactgcttagttaagtcttgttgagttttcgattgcatcggttgtgttaatttgctggtcttagtgttaggcgattagagtttccagttcttgccaccaccgcacatcgccaccttcatcaattttgcgtcatcaccaccgtcaccaccatcgcagtcacccaccaaatcactttctatttgtgtttgatctgttgccgatagcttttgtgagttgccatgtatcctgccgccactagaaaggaaatagaaccctgattcgagtgaccttccttaaaacagtcatatctttttcatacggactcgaaattaggcttataatatatccacggacatctacaaaaaaagttacatccgattctccccgctacgtcgggttcggcaaatttaaaatcgccaaattcctcttgcaaaattctgtttttgtggcgagaagcttcgggacctattcgcatacaactttgaaaaaattctacaagcttcatactttgtccgtttgagataagattttctgtggttggttctagtgtgctcctggttgtgaaaaaaatatcaaaataataataaaaaaaaagttgtgtctctctcctcagcactagagagagcaagcaaaaaaaaaaagaggatccagtgagcacaccccaccattccccctttgtcaccaccttccaccaccggttcttgttttcgttgctgtttgggtttgtgttttgtggcgtcctttgtggttaggctcgcgtctctacttcgactagcctaggaccagcactgtacactatacccttgagcgattattcaatttgctttggctaacgtggtttctagttttctcttgagcattgctttcagcccacaaacagctccaccacaaacccgactacagcttgactggtcttgttgctacagcaccgatacacctcgttccacggttgctaacttgtgggttgctgtccccctcctgtgggcaaggtaagaactggtaagagcttgtgagacaagctgcgagtgaagtgagagtgagcgtcttgcaaaagctacatcccaatagttgtgtagggcttacattacatcctccattgttttgttgtccttcatttctaaaccatggcaggtc

SEQ ID NO: 27162 - DNA, 254 bp, Oryza sativa
acccttcccaagcatgggcattgccagttttttccaaccaaagccatcaaatgcgcatagctcaactcttatattccaaattgtggattctcaaaccaccgtacataagggaccaacaaacctgctcccaagcaaccaaacaatttgccaccgttagccttttcatgacctgcccaaagaaagcctcttcgtatcttgtcaatagccttgattactgttagggttggaattgtgttccaccgaagggggaagga

SEQ ID NO: 27163 - DNA, 1501 bp, Oryza sativa
ttttaaaagttgaattttaaaatatgtatacggagtgggaacggagcaatattatatacttcctctgtcccataatataagggattttaagtttttacatgcaacgtttgaccactcgtcttatttaaaaaattttgagattattatttattttatttgtaacttactttattatccacagtactttaaacacaactttttgttttttatatttgtaaaaaaaaattaaataagacgagtgatcaaacgatacgagcgaaaacttaaaatcgctgagacagagggagtaagtcatagctgaattgtattcgtggacattccatccagctactccgatgcgagtatttacagtagcaaacattaattgcgctgcttgccgatgggattgatcaaattaaatgcacctggtatatgcagggagcgattgcgagtcaaaattatattttgattgaaaatgaaacgatatgatggaaaagttgaaagtttatatgtgttgaaaagttttgatgtgataaaaatgttaaaagtttgaagtaaatttttggaactaaacacggtgtacattgaacggagtatggttcttggcgtgcgtgaagtgagcatatctactgctatagataaaccgtacatatccgagtacatacagtctgcatgcaatggacggaccgggtacgtactactgttacactccaccatttctgtgcagaaccaatggaggaagtcgccctcctgctcctgctctgtgtgtactgtacgtgtgggtgtggccaccaacaactcaccctggcctcgccggtctggaggcagtcgagactctggagtgtggactgtctcgctatgcatgcggctgttcagacaaaagttctggtgtcacatcaaatatacgacacactattattaaacatagtttaataataaaaataaattagagataaatttattaagcctaattgatttttattagcaaatatttactgtagcaccatattatcaaatcataatgtaattaggctaaactattataatcctcccgaacacatgcccacttagtaaaagctgtaaaaaaaaaagacattcaaggaagctcaattttcacacctttacactgcaaaatttgtaaaaatatcactaatttgtgaaaacataaaatttgccatttttagtacagtgacagaagtgctatggcacaccttaaacatagaaaatttccattttctatgattaataaacacagcaaaaataatacacaatgcatgacaaccaattcaacaactgcgcacattaacaatcaatatttttctctataattaaaatgaacagaaaaggcagaataccagattccacataaaggtccatttcttgaacttctaaagaatgaattaaatgctatagaaatgtaacaattctattatatcagtattgtgataacgttttctgctattttcagaaaaaacaaacaggtaaattgattttggtttttatctgatctttctctaatagg

SEQ ID NO: 27164 - DNA, 1106 bp, Oryza sativa
aaaagtatacgcgaggaaaaagagagaggtgagataggaaaggaggaacaacataaccttaggagagcgggggcctctgtcaaacagtacaactaggtaggccatgcggtacatggccatggacatcaacctcctcacttgcaagttgcaactaggtaggccacgagacaagttgcagagcatgagttgttgcagcaatcaatcttttatagtatatatatactccctccgtccaaaaaaagacaaaccctggtttccgtgtccaatgtttgaccgtccgtcttatttgaaaaaattatgaaaaaaattaaaaagataagtcacgcataaagtattcatcatgttttatcatctaacaataatgaaaatactaattataaaaaaattacatataagacggacagtcaaacgttggcacgcaaacccgtggtttgccttttttttgacggagggagtatgtgtgcaacacccttacaagtaggaggtaatgtcgatgatgggggcatgatgtttacaggagacctgttttgctatcaagagagaatcaagtggatggaggttttacacgataagaaatggaagtgcattcatggtactacacctgtactacgtactccctcggtcccaaaatatttgcttcatccttaataccacaatggtaggtcaaatttgggatgatgggagtatagaagatagagcacgccgagcgagccggcattacttttagccgatcgacttttattattttcttccttttagattagttttatccgataatgctattattagtagcctgaatatatcaaaacatggcagcaatgattgctcaaaaaatatgacaatatttaataatttagttcttgagattaacaaatggcacaacccgtattctataatggatattcagacccaacaagagtgttcagcacctagctaaagattagatgtctaagttatcccaagaatcaggtcttttcacgacatgtagaaaattgtttgggcactatcaaatgtttcaacttacttgataaaatgctttagagaaatgtaacatttaaaaaatagtgattgcaacaccaacagccacgtgaaacatcgagtcccaa

SEQ ID NO: 27165 - DNA, 1501 bp, Oryza sativa
catataatagcagcaataagagcagtagcagggccatataacagcagtaggggtatatatgccacaggggcagcaacagcagggggagattcacataaacagcaacagcagggtggaaattcacataaacagcaacagcagagggaaatttacatagacagcaagggtatataaatcaacaagtgtagataatctgttcttatccataaagaaaagaacaggtatagatagaatgttattaagcaattcatccttggccatttaacaagaagtacaggggcaacaacagcagtggtatataaatcatgcatatattattgtagataaaaaaatgaacaagtgcagaaaatctgttcttatgcataaaaaaagagcaagtgcacaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtagcaacagcaggggcaaattaactaaaacaacatgtctagatatactcctcttatcaatccagaagaaaagagcaagtgcagaaaatctgttcttatgcataaaaaaagagcaagtgcacaaaatctgttctaatgcataaaaaaagaacaagtgtagaggtatataaccactctacactggccatttaataaggaacaagtgaacaagtgtaggggcaaaaaaataaacaagtgtagataatctgttcttattgagcaattcatcactggccatttaataaggaacacattgggcagcagcagcaagggtatataaatcatcaaagaatgacagaaaacaaaatgcatggagaactttggtgtctaggtcggttccgtcggttcagctaaatataaacatgatccacaaaattcaataggtctagcaacatatatagcagtacacactccatgaatggttatatgtccaaatggcacttaaatccacattcaagttgcacttaactaacagttgcaaccataggcagcagcatgggcaaacatagacagcaagggcaaacatagacagcagcagttgcacttaaatccacattcaagattcacttattgagcaattcatcacttattgagccacaacaggggcaaaaagaagaatagataaaaaaatgaacaagtgtagataatctgttcttattgagcaattcatcactggccatttaacaaggaacacattgggcagcagaagcaggggcaaagatactccacaggggcagcaacaacataaaacaaggaaaaggtgtattaacaagtagcccacaataacagcagtagcaggggtgtagataaaaaaggagacagtactactaacttcatgtaaacagcaattcatccattcaattcaagcaagtctagataataaaacagcccacaatcattgtggcagcagcagcatgggtatataaat

SEQ ID NO: 27166 - DNA, 1501 bp, Oryza sativa; identical to SEQ ID NO: 19938

SEQ ID NO: 27167 - DNA, 529 bp, Oryza sativa
agctaagcacaggagtaggatattatgcttctcaacggcccaaacctgtataaacccctttatctcattgttcttgaggggcccaacaccctctacaccacacttctcaccgagtcctcgaatctcacccgctgtccccggccaaaccaacaaagggggcctcactgtcccccgcttgcggagttcaccctccgacagtcagccttctcatctccatgcctccttccttacttttcttataagcccttgactatgcaaatctaaaggatagggggttgttcacaatgccaccctctggttccccatcctctgctggtaaagagaggaaggggattcaccctgccaatagatctagtagtttggttagatttttctctaaataaagttttaattttttgttttgcctcatcgacgtcaatggcggtggcgatgccacaatggtggatcttctagtgttggtccctatccatcttgtctcggtggtctattttatggggtgtgattggctatgggcttcgtttcacctagc

SEQ ID NO: 27168 - DNA, 1501 bp, Oryza sativa
tgtgcaaaggagaattgtattaaaattggcagcaacacaaattaatacacttcgctaatataccagtatcaagttattttaaatgcttaccattatacaattgacttttttcaacagaaaaaactatgtggagtgtacagtgttttctcattttaatttcagatatgaaaactaagaaagactatcactcattgtcaaccgcagttcattaataacagaaaattgagcacgtgaccagttagaatctgtaatcttgtacccaaattaaaacactgctaaacagctaaagtagctccaagtgtcccaatcagttgagactgcaaaacttttagtaaaatacaggtgcataataaacataactgccttttctgtcctctataatttctaaccggaaaatacagtgtaagccaccatcgcacttagctaaacggtttataggtgaacttaacagcaatttcaacataaatgcccatgtgaaacatctaatggagctcagctggtcatcaatagaaatttcagacattacacagtaaaatattttaagcacctaaatccgcgaaaattaggcaaatgtccttctatttcagttttttatcctgaactttatttccggagaatttgacaatgaggcaaacttcgttcttttaacctcgttccgatgcaaatgaaggtacaaaatcattcatttgttgaattgcagactgcagtgctcactttgcatcaatattatgcaaagaatatcttactaacagaaatgctatcgtgaactattccaaaacatgcataaaactaacatagctataagccacctccgttaccaaacaaagaagacaatattaagcagaacattcattttagtgcagaaaaaataaggtagaaaattgtacctctcatgcctcaaagatcatcttgttgtgaggcatcatcatatttcttgagcacctggtatgcaatggcactttctgtcttctcgttgtcacatctcattttgctcaatttttgtcaagaacttggaaaatatgataatgatgacaccatgcatggtatagccccttaggcataacaaaagccagtatctgatcgaactggaagatgttgatcaaaaaccttttgggacagcagtagaatgcaattccatcattgatctgctctatttctgttgctgaaagtaagccaaatatgcccaggtctacacaaacaaaaattcacaatgtaactgcttatataaccaagaatataaactgcaaattagtaaagaacgacatgttgcgtcaaaaaaaaaaaagaacgacatgaattttattcagatgacgaccattattacagatcacagaaatctccattagaaatttgctgacatgaaagtgcctcattgaagaaacaatttgtattttatatgcacaatgccatgtaaaaataatccagatgaaagatagtagtaacacagataccactcaattcattttttttttggcaaccctccattcaattttccaaaagt

SEQ ID NO: 27169 - DNA, 1501 bp, Oryza sativa
aaatatactgtcatcgctatatgagagtgcgagatcgataagacacgctgaaccattgcgtgagaatgacgatgtgggtggtctcgcggggtgggagcgtgagaccgcgcggtctcacacaaccacaacgcgagtctgagctgagaccatgcgatctcgcatgcaaaaaagcgacagcgcttcaaaaaatagttaattagtgattaattatcctaattaatgttaattgattattaataatgctaattacaataatattaattaattaatttctaattatgctagttaatttattaatcacagagtatggatgggaagtcggtctcacgccctcgcagagcgagaccgtggtgactcttgcgatctcgccggaccgccctgcgacagtggtatacttctgcaaatttcttcagtacatgtatatttatgtaaaaccaatgaaaaaagatatattttcattttttttgaaatatcttacattgtcaaaagggcaaggactatctagcactttgcgagttacttgaactaaacgacgtgcatcacacccttccaccatcccacaacactagcatcccaaggtcatgtttccccttcccatcctcttcacacttctcccattgtaactctcttcaactatcgtgttcatatcttatactatgtatctgaccaactctttctgccaaaaccactccagtaatttttggatcttgctgcactggatagaaattgaccgagggaagaggccgttcattttcccttcagcttcccctttacctgcgataagcataggaggagcaaatggtgaggaagaaaccatgaggtggaagggagcatgccagagaagacggttggctacaccgcccagagactggagacttccattgtcctaccccgcacatacctggcttcgaatctgccacctccatagatcaccggtagccaatcttttctaaattggagctctcagcattgttgggacaacttgggaggagcatccttaatggcaacgccactctccctctccgcctgattaggctgagggcatttgcctccacatcaagctatcctcctcaacccatcaacgacgaagacctatcctcgtctcctccgctgtggccaccaccgccacgtgccaacaactgcacaatcctaggcatgcttaggctgccttcttccactgagggtcccaacaataatcccccgatgtcattgagatttctgcacttggacgcttccccaatggcaatgtgacgccggcgacctcgttccctgccccatgacttgagctaccgatctcatccacaatgccatcagttcaaagggcggtgataaggactagatgatgattgcaaatccagacctagcgatgcaatgatggctagccgacagcagcagatctaactagcaaagtttgcgcccggaggcaggaaaggtatttggtggcggtggtgccatagtcttcgagcggagagtaggagaaatgccattaccataactctcc

SEQ ID NO: 27170 - DNA, 1501 bp, Oryza sativa
ccctaactagtgggtaccctattcatggttccactagtatgaatttagctagctgcttcgctgattaattaggcaacattaggtggttttataaccttagtctttgggaatgctcatatcatttggacattatggaatggttggattattggaaatagacacacacacctgggtttagcctgggctcgaggtgcatggttttgatagtagcacctcggccactacaaggaccagtcttcgggcctctgttacaaagcactaccgtacttccacatgtctagtgggtaaggcttagtttgtggctctgtctggtcatgggcaaaagtacacggatagagatggacatctctagggcaaatgagggctacacgagctgcggctcggtagtcgagatgtcatgccacagggccggtgtcctgctgctaggggctcaaccttggttacctttctcgggaatcccggccgtagccagggttgggtcggtactcttgtttatggctaggatgggttgggaactatgtcacgtcttgcgtccgtatgccgtggtggtatgtggcacatggttacacgtgaggaagatgtgtcttgtgggtaaagatatacacctctgatcagagtataatctattcgaatagccgcgccctcggttatgggcaagcctagcaatgtacccaagttagtgttttaattcttaaaacctgcttaacaactaaaatgttgaatggttggcctgggttggcttgggacgagctgggacctgggtctggttgccagttcggtctgaatcatcgtaggccttgggttaaggcaggttcgtgcgggttcacggccttgattaataacattgtgtagctctagaatcgtctttacaaaatagcttcgggcatctaagtgacttttaaatgctgtttactgcaaaccctaacccctttattataactcccttgtactcctttgcatttattctgcattcgtgggtgtgtcttgttgagtacgatggttgtactcaatcttgctcaatttttccccaacccagaagaggagttcctggaggatgaaggctttggtgtctagctcgtgcctgtcgtcaagtgcctatggtcgtcaccctagtcttccgctgttttccgtttatcttcgtgtgtgctgggccttcatcgcccatgtaataaattaactatttatgcttccgcttgttaaactctgaattgtatcaacttttgatgtaccttgcctcctgggacaaggaacaatacacgcacgtatggaatgcccgttgggttaattccggtcgtgacaacctatcaaaccaggggttaggccacaccaacaacctcctagaagatgcaaagccgatatgcttgaacctgtcaaggctgagattaaacggttatatgatgctggttttattcgtccttgccgatatgcctagtgggtttctagtatagttcctgttatcaagaagaacagcaaggtgagggtgtgcattgacttcagagat

SEQ ID NO: 27171 - DNA, 1501 bp, Oryza sativa
cagtatgctttttcagtgccagttcaccccaattatgcctgagcaagcccatggtgttgagatcatacttggagaccattctcaatgctttctgcttcaccagctcgggaattgtgatgtcccacaaataacaaccggtgtcccactcgtcaccataccctagcttcttaatgagcctaccgaattgcttgttggttgggttgacctgcgtggcacggaagtagagcaaattgaactgtcctatggtgcccgaccagtttcttgatccaccgagaaggcctcccgtcaaggctgcgacgcgcttgcgaacagccaggactgcccgtcggagctggtaccatcttccgacacatagagcgacatgttgaagccaactccacctcctggcgcacaagaaggaaagcgtccagcttgaccccagagcgctgaggagggacgttgtttccatcaagagggcaccgcctaacaggacataggtaacagcggtgtcgactccattctggccatccttgacctcgctgccgcagaaatagaacagcagaaaggaggtggcaatagcaaagggtgacaaggctcggatgcagtagccaatccaagtgtggactacggctgccttggtatagagaatatcgtacatcagggacagttccatctccattaccttatacatccgctggggctcttcactaagattgttgattatttccttggtggtttccgcctcagcattctcagtatcctcattgatcacggagtctactatcccacgcttacatatgtgaaacagggagtgagcacgttgcagaaggaattcattgttagtgttgttatgatcctcattgtgtaggtacccttggtaccaatggagttggttaccctgtaactcctcgagagagctcccgatgctgctaaaattgctgcgatagagcgcccatgttctctcacaatacttgacaacgcccacggcggagatcaatccggtggccactctaaggattgtggcctccctgcgaacgataatatgcttgtagaccacatagcaagctccgattacctggaaaataagattcagtgcgtggcgcaaccagagtttgttgtcctctagtgcataggccgtgatgttgtctgggccaccgaggtgcagcaacaagaatggtgcccaaaatgctgccagacggtgctcttcaattgccacgctgccgaaggagaggttcccaagggcgtatatcgccgtcgagtcggccagctggtaagctatccacaggatgatctttggcacgagtactttacgccggcgagtaccagccaggaggaggagaatgacctgcagcgcgaggctgaggagtacaaagaattgtatcccccatgtcgaaacatgaattcggcaataataaaacggggtaacgcacgagacctaaaagtggatggatgtggagacaaaggatttagacaggttcaggccctctcaatgagaggtaataccctactcctgtttggggat

SEQ ID NO: 27172 - DNA, 1501 bp, Oryza sativa
gcgcaaggcgaagagtagcgccaggccagaggcgtctcaggcgaagggtgcaaggcgaagactgtctgccgaaggaggatgacttcgccttgacaagttcgcccccgcgagggccgaggaaacctttccggcccatcaggccggcgatcgccagacggcccatcaggggcccatgagcccctataacattatgtacccctgtaaatgccccttctgtaagggtaatcatgtaaattcccctgtacaacctaaaccctggtagtaaggacctgtaatggggctataaatagtctcctagggccatgtaatggggggatcccaagtaaaattcaaaatttagtacacttcatttttccaaccactgttgagtaaccacgtctttcgacgtatgcagttttcgtttcgacaacagctggcgccgaccgtggggactccgagcgaaaccactgagagcgaatgccaccgaagagggtcgtgaaggagaaggttgccaggcggaaggagagcgacgccggaccagacatggccgccgaggaaggagcagagccttcggcgcccgtggccgaagctggaggagcacaagcgccatcacaaccgccttcggcccctgcaacctcggtgcacgtgccgaacgaggccgacgtggcaaaggcggctgcggcggcaagggcactccagaccagggcggagatcctttcgacaagccaaccggtggtgccccaggcagctccatcacagccggcagctaccacaaccgcgctcaccgttgtacagtcccaaaccagccttgaccccgaagcacaagccgaagccgacatggaagccatgcggcagaacatgacacggctccaagacatgcttcgccaaatgcaagaacaacaacaagcatacgaggcggcaaggcgggtcaaggccacgtcggctccaatccttcagtattcggcaggctatgtcccacatcaagtccatccgcaagtgacgacccagccctttccgccacaagccgcacaggcgccggtgtagttcgccgggcagcatcaaccaactggccaagtgccacaaacagtggcggaagggacttcggctctgcaggcgcaactccaagctttccttcagcaactcaaccaaccccactacatttcaagtacaaccccatcggttcacccggtggggaatacaagtcaaggtgcgcctacttggttgccatcgattcagtcaggctcgggagcttcgccgtggaatcagggactgtagttcgactgcgccaacgttgctcaggcgccaaccgttcggcagcaagctccgaccccaggcttcggaacaaaccaagcaccaatccaagctgctatgacgtggtcgcagccaatttttgacccatccatggcggctcagcaagtgcctccagttggagccgggcagccgaacgccatggcccaacctcacgcacaagctgcgatttcgcccttcaccagaccgtacccgcagcaaggtgcggtaaaca

SEQ ID NO: 27173 - DNA, 657 bp, Oryza sativa
ggtcactgagacccttctactgaagtatgaaccccatgtaaattaaaatgcagatatatatgtacaaacacaggtgcaatgaaaaaaggaagttgaattcctgccggtttatagtcaaatgaactccaacattaggcaaccgaccagatcgtatgtctgacagagagtaaacacatgaagcaacagtgcatgtatccctgttcttgaatcatccgtgcaaccccaagccccagctaggattctttggcctgcatagatgggatgtgttgcgtacatggaagcaatgtagcatgtcccaaccctccatctagaatggtgtctatagcattaactacattgccatgtaaaacttttagcttatgtggcactatattaattaagtgagagagtgaagagaggaagaaactgggtctcatgcaagacacagcttcaacacgagaacctatacactagacactatcaagttttgtattgggagagaataatgtcttcataatagatgaagaataaatatgattggtagagaagagagatgatgtatttattaatggcccactttaagaaaccatgggttgaagtgtagtttctatcgtgatgtcttattaagatggcttcatacacactacttatggatactataggttgggactgccctca

SEQ ID NO: 27174 - DNA, 1501 bp, Oryza sativa
tctcgcactctcatatagcgatgacagtatatttgtgccaaaagaattacagcccgaatatttcttagaaaaaatgaacagtatatactctaagaaggataactacgtagatctccactgacgtggatttaatgaaatccgttataatgggtcctatgcctagaaggatgtatagatttattcactatttctggactaacatgaatgtttctcgggactgtccaacaattctacaatctacatatatatagacagacatatatacgcatatattgatagattggttggtacgctaacaaccgcagcaaccagcatatatacgcgaggcgacctgccctcggttggcctaagctcaaaattcacaacagagaactcgtcataatgtctctagtggatttttggaacaaatggggtgtggagattatgggtaccccatacccacacggcatggttatccgactagttataggggataacttatatatataaaatatgtaacagatcatgacttgggtattacgtttccctgtatattatgaaacggcctaaagtcctggtttgataagattgtaaagtagatttaggaaaccgataccgtattggttaaggtttctatcttgtaatcctgccccccatcctatataaggtgggcaggaggccctctagggggcatgagacaactagatcgtcagatctataatacacccggcggattcaaatccccaaacaggagtagggtattacctctcattgagagggcctgaacctgtctaaatcctttgtctccacatccatccacttttaggtctcgtgcgttaccccgttttattattgccgaattcatgtttcgacagttggcgcgccaggtaggggttcgccgagtttcctgtcaacaagtgtgatggaatcaatttcatgattcgtcggcttcgtctttgattcgtgagttttcacttcctcgctgccgacgacttcaacaatctctctttctccgacttgggttttaaccagtcgagagaacggcgatcaaagatctgtgtcatcaagttggaagcttcaaaccgtcatcgtcaccgatatctcctgtatctccgcaaaaatctccgcttcgggagctacactttgtggttacaacaatgaccaggttcgccgttccaatctaccaattattagattggtctcagatttaactactaattaaatcaatctatgtcttgcatgcactgattgttggctgtgccctccgagtcccctgatcgtcacgagagacaaccacggctggctagttgcataagacagctgattggatcaatctcggactcggctgactcaacatggaaaatcaaaaacacggagcagtacatacaagcagcaattttcactttgtcagctcgagtattttttaatgaagacgtatggctgcgggcacacgcgagctatatcaatgctcaaacttatccagcaattactggtcatcgcatgcgtttgtacgtgcctggaa

SEQ ID NO: 27175 - DNA, 314 bp, Oryza sativa
cccgtacagatcacttagtttagtagtaattccttttgcatcatttacgcaaatccatttgatgagatcctcttggtttgtggttgcacgggtcaggagtcggttctcagcggagtaattttactccatgaagctttttccgtgttgcatttggggattttttttctcccccgactccggttggttgcaatccttttcatttttacaaagtgcaaaacactgaaataggtttttgattgcttgattatttgttcttttatgagaaggggaaaaagaagggtgagtgcactgtgccgaatctgcttccctttagg

SEQ ID NO: 27176 - DNA, 186 bp, Oryza sativa
cgatgaaattgggcaaagcatctgtacagactcgttgtccaataataggtcacattccgtcttagatagcaacattttagaacctagaaagtagtaatttatttttttaaaattgctagtttttaaatcgttaagtatattaaactatacgttttcgttataattattttttgtttgctgatcagg

SEQ ID NO: 27177 - DNA, 205 bp, Oryza sativa
atttagctctatcggctgcttctcgctttagggtttctgccggtatcggctaaatcgtcttgctagattagattgacttagatatctaccaccccgaaaatcagttaagggtttgattgtctagatattatgtttcttttcatacttagtgctgcatcaattaagtttgatctactaagtcatgtttagaaccataatctctagc

SEQ ID NO: 27178 - DNA, 233 bp, Oryza sativa
ttctcaacggcccgaacctgtataaaccgctattgtctcatctccctaggggggcccgaccccctcttattcacactccaccacagaatcctcgaataccaatcactacccccggccgaaccaaaaaaggggggcctcatggttccctggtggaggagttcacccgccgacatctattctcttaaatctttctctcgtcaccacttcaaattattttttcatctgtggagaaa

SEQ ID NO: 27179 - DNA, 956 bp, Oryza sativa
ctcctaccacgtgaggccgggcggcagcggcagggagacgggcagccgagcaggcggcaggcgaggccggcgaggcggcgggcggccggcgagacgagtctggcgaggcccgcgaggcggcgggcggccgggcgggcgaggccggcgaggcccgcgaggcggcgcgcggccgggcgggcgagtccggcgaggcccgcgaggcggcaggcggccgggcaggcgggcggtgagacccgcgtggcggcactccccaggcgggcggcgaggcggcgggtggtggtgctcccggtgcggcggcgctccccaggcggcagcggagcccgaggcggccggcgggaggccggtgaggcggtggacggccggcgcccgatctctgtgatatggttttttttctgatctgtgtgatatgtgcggccgatctatgcgatgtcgattttttttctgatctgtgtgatgtgtgatgtgtgaatgaatttgtggagatgttttttgaatgatttgtgatgtatttggggataaaaatgcagcttgatgtatttggggattttgtgattgatctgtgatgtatttggggataaaaatgtagcttgatgtatttggggattttgcgaatgatctgtggtgttaaaatgattcgtggataatatgaatggtggtgctcgaaatcatgaaagcaggaaaaaaaagaaaaaaaacattagtcccggttgttaattctaaccgggactaaatctttagtcccagtttttaacactaaccgggactaagatcctctttagtcccggttattttaaccggggctaaaaatatgtatctttagttccggattcgtagttccggttgtataaccgggactatagggacgttgtgaaccggtattaaaaagggtttgtccaccattgcgagcctccccaagtgcggcaccacgtggctcaaggccctcgctttcgcctcca

SEQ ID NO: 27180 - DNA, 1501 bp, Oryza sativa
gatcccccatctcctcatgcagctctgtcaccgccttgtccatcgccggcttccaactcgctaactccaccaccaggggcttgatctcctccagcgatccaaccgaagtttgaatcgccgaattctgcttctgaatcgcagacatgacctccacaagttccgccaattgttgctccatctcctgggatttgagttgagctcgcgaatgatagcgtggtttctctagatactccaagattggtggctctgatacctaatgttacgatcgggctagagattttggggattttggaaggaagaggatgaacagagagcagaacgagagagaaatacttggagcaggggaaagagcagtagagacagagtttggtttcaagtttacagctcaaatattcgatatcctttcctctctccgcctgtgcttatatacacgcacggcatacagctggcctaagcccactccggcccagagactcggacattcggccttctctccctttgaggtcgtttcccagacttcacaggattattctcccttgccggttcagatacagtagcagcacccgtaacaccgcggcggtgcgggatgcggtggaggcggctgcagcggcgacagcgtgggatgcgaaggcagcggcagcgtgggaagagccgacgatctcggcgcgcacacactctctcgtcgccgtcgtcgagccggaacgagccgtgtcttctcgacagagctctgttcacgccggccacctcgccgggcgccggcctcgggcacagttgccaggcaggcggcaccgtctctttggcctgtgctacagcatcgccgccttggggttgcttacttgctgttgcttggttgcttgctgtttgaatgcttgccattgatgtgctattgttgattaatttcagctgtggcccaatgcaagccgattctctcggagctgaacgggaggatgaattagtctagcaggagtttgttagagatgcaaataagtcgtgaatcagttaatcgtgaccgagtctagcgctggcagtggcgcgggtgtgtgcatggagttcagagaaaagcggatcgtgggatggcgcgattttgcctcggattcctatttttttttgcgttgagtataagtagttctcttagctctttattctttttgtaaggtttacattcagttgaatgagaaaaacccagaaaaaattgccccatacattctcgcaagaattctttctctgaaacttctcctctgctctgtttgctgctctgttcgttgttgccgctgcagttcttgccgtgccgggcgtgaacagtctgccagcaaggtgtttgatcagagtttttttgctattgccaacaagtggtatcagagcactcaggttgagggctgatctgacaccatggcgttggttccggcgggagcgggagcggatccggcgagggggagctcggggagtgctttctcctacccacaactcacggcaacgaactacaccagctggtgcattcggg

SEQ ID NO: 27181 - DNA, 1501 bp, Oryza sativa
tttttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgctccggatacatgcaacatgaattcatgatcatgggtctattttatatgctcaaagactggactatttattattccccgtaagggttatcaactgaatacttgcgccagtcgggattcaatttttatatctattttggagtatcccataagggataatcactcagatcacatggtctatatcacccgggagcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcacgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttacttactcagattttacaccacatatgccatatatttccaggtgtggtgaaaccatgtgtcttttagggacttaagcacatctgttaaagcagtgtgcgcatggcgtatgcccaatactttggaaatttctttattcacagcattcaagcttctttataattgttttgctatgtgaattttcgataatgtagccaactttaggttacattcatcatattttacaaaacagtcggtatatcacttggatcatattattcggggattcacaccgcatatgctatatattggtatcaagtcacttggttgactataattatcaaaaaccattcggttaattggataacttattccttgactatatgtttggtttgttcagctaaccacatagtcgggggttacacctatcaggtgcatctattcgatgcatctgactttattttttcagccctccacagtcttctgatttggaaaaagtactcgggagatcatggcgaagatgattgaagcactcggctttggagtaatctagttcgagagaagattatctttccgactgtgaaggtctcaggggctactgtggagattatgggtatcccatacccacacggcatggttatccgactagttataggggataacttatatttatgtaatatgtaacagatcatgacttgggtgttacgtttcctt

SEQ ID NO: 27182 - DNA, 544 bp, Oryza sativa
ggttctggtcccatgtccaaattctttccgagtcatcgggaatcgaccgaacaaatggacgtccagaatctgtttcggtgctgcgtcgccgtattttgccctttgggccgtgcatcgtgttggagcccattaggttgcgtcaaggggtgttgcacgaccctaagactctatatattagtagccgccacaatctttaaggtttgggttttgcttaaattaatctgtcaataacagttttgccgatccttcggtttgtgagaccccaacttgtgagcttaatcattcatatgcaatttggttgtattctttcttgttcttgtttgtgttcttcgactcgcaagcagtgattagccttctcgacgaggtcaaccgggtttcgacacagttgataacaggaggagacatggtgctgcgatcgcagggctcaagagcgtgtttgttcataagtcggatcgacttgtgtcgcgactccaccaaatcgaccgtttatcataacaaaagatagggaactcttatccacatcatatggtcgggttgataagga

SEQ ID NO: 27183 - DNA, 1501 bp, Oryza sativa
tatgcagtcaaaacctgctgaagaaggcaacccttcaataaaatcaagtgaaacagttacccaggcatgctccggcacaggtagaggttgcaaaagaccggggtaacgcacacgttcagcttttgcttgcttacagatcgaacagttggacacaaactggcgaacggcctgcttcaaacccggccatgcaaacaagcgccgcactctgctgtaagtaacttgtataccagaatgcccacccacggcagagcaatggaaagcagacagaattttaagttgcaattcagagtttgcacccagccaaatgagcctcatataatagagaataccattcttcagagaataagaaggaaattgactaggagagagcaacactttagcgagcaattgagaagtgcaaatatcagaatcataacccttctgaacttcctccaaccaagagggcacgcaagatgacacagtactcaattgatacacctcattggatctgcaacgagacaacacatcagctgccttattctcaagacctttcttgtataccagccggtaagataagccaagtaatttggttaatgctcgttgttgccaagatgtcaccaaacgctgatcatcaagatgaatcaagctgcgctgatccgtacgaatgataaactcaccaaactgcagataagagcgccaatgatcaacagccagcaatatagcgagacactctttttcgtaagttgacaggcctctgttgcgtggacccagggatttgctaaggaaagccaagggatgtccatcctgcattaacaccgcacccacccccaaatcagaagcttcagtctcaattacaaaggtcccagaaaaatcgggcaacgccaacactggggcagaaaccaaagcagccttaagagcttcaaatgcagcttgatgttctgaagtccaaacgaagaccacctacttttttaacaaatcagttaagggccgactgatgatcccaaaagacttgacaaacttgtgataatatccggcaagtcccaagaaactccggacttccttaacattctgcggcactgtccaagcttgaacagccctgacattcttcggatcagtagttacacccgcagcgctgatcacatgacccaaataagtaaggctggattgagcgaacgaacacttagatcgtttgacctttaactggtgagtcgtcaatagctagaacacttgacgcaacagcatgacatggtcctgcaaattacgactgtacaccaatatatcatcaatgaacaccaaaactcccttcctcaataacggtgcaaaaatcatgttcatcaacccttgaaaagtggccggggctcctgtaagtccataggacataacccgaaactcataatgaccattatgcgttttaaacgccgtcttatactcatcttcagctcgcattctaatctgatgataccccgcgcgcagatccaagctggtaaacagactagcacctgacaattcgtccaataattca

SEQ ID NO: 27184 - DNA, 200 bp, Oryza sativa
tacatgggtatcaagaaatgtaaatattaatgaattgcttgtttacgaggaatgtctagtaacttgtttaaatccatgataagtagaattgcttattattggtctgtgtgccaatatgaaatatgacagtcaaaagtagatgagggagtagtatagaagttataaattttggttgttttgtcaaaatgtttctaaacaga

SEQ ID NO: 27185 - DNA, 1501 bp, Oryza sativa
caaaacctgctgaagaaggcaacccttcaataaaatcaagtgaaacagttacccaggcatgctccggcacaggtagaggttgcaaaagaccggggtaacgcacacgttcagcttttgcttgcttacagatcgaacagttggacacaaactggcgaacggcctgcttcaaacccggccatgcaaacaagcgccgcactctgctgtaagtaacttgtataccagaatgcccacccacggcagagcaatggaaagcagacagaattttaagttgcaattcagagtttgcacccagccaaatgagcctcatataatagagaataccattcttcagagaataagaaggaaattgactaggagagagcaacactttagcgagcaattgagaagtgcaaatatcagaatcataacccttctgaacttcctccaaccaagagggcacgcaagatgacacagtactcaattgatacacctcattggatctgcaacgagacaacacatcagctgccttattctcaagacctttcttgtataccagccggtaagataagccaagtaatttggttaatgctcgttgttgccaagatgtcaccaaacgctgatcatcaagatgaatcaagctgcgctgatccgtacgaatgataaactcaccaaactgcagataagagcgccaatgatcaacagccagcaatatagcgagacactctttttcgtaagttgacaggcctctgttgcgtggacccagggatttgctaaggaaagccaagggatgtccatcctgcattaacaccgcacccacccccaaatcagaagcttcagtctcaattacaaaggtcccagaaaaatcgggcaacgccaacactggggcagaaaccaaagcagccttaagagcttcaaatgcagcttgatgttctgaagtccaaacgaagaccacctacttttttaacaaatcagttaagggccgactgatgatcccaaaagacttgacaaacttgtgataatatccggcaagtcccaagaaactccggacttccttaacattctgcggcactgtccaagcttgaacagccctgacattcttcggatcagtagttacacccgcagcgctgatcacatgacccaaataagtaaggctggattgagcgaacgaacacttagatcgtttgacctttaactggtgagtcgtcaatagctagaacacttgacgcaacagcatgacatggtcctgcaaattacgactgtacaccaatatatcatcaatgaacaccaaaactcccttcctcaataacggtgcaaaaatcatgttcatcaacccttgaaaagtggccggggctcctgtaagtccataggacataacccgaaactcataatgaccattatgcgttttaaacgccgtcttatactcatcttcagctcgcattctaatctgatgataccccgcgcgcagatccaagctggtaaacagactagcacctgacaattcgtccaataattcatcaatgat

SEQ ID NO: 27186 - DNA, 1501 bp, Oryza sativa
tacagatcgaacagttggacacaaactggcgaacggcctgcttcaaacccggccatgcaaacaagcgccgcactctgctgtaagtaacttgtataccagaatgcccacccacggcagagcaatggaaagcagacagaattttaagttgcaattcagagtttgcacccagccaaatgagcctcatataatagagaataccattcttcagagaataagaaggaaattgactaggagagagcaacactttagcgagcaattgagaagtgcaaatatcagaatcataacccttctgaacttcctccaaccaagagggcacgcaagatgacacagtactcaattgatacacctcattggatctgcaacgagacaacacatcagctgccttattctcaagacctttcttgtataccagccggtaagataagccaagtaatttggttaatgctcgttgttgccaagatgtcaccaaacgctgatcatcaagatgaatcaagctgcgctgatccgtacgaatgataaactcaccaaactgcagataagagcgccaatgatcaacagccagcaatatagcgagacactctttttcgtaagttgacaggcctctgttgcgtggacccagggatttgctaaggaaagccaagggatgtccatcctgcattaacaccgcacccacccccaaatcagaagcttcagtctcaattacaaaggtcccagaaaaatcgggcaacgccaacactggggcagaaaccaaagcagccttaagagcttcaaatgcagcttgatgttctgaagtccaaacgaagaccacctacttttttaacaaatcagttaagggccgactgatgatcccaaaagacttgacaaacttgtgataatatccggcaagtcccaagaaactccggacttccttaacattctgcggcactgtccaagcttgaacagccctgacattcttcggatcagtagttacacccgcagcgctgatcacatgacccaaataagtaaggctggattgagcgaacgaacacttagatcgtttgacctttaactggtgagtcgtcaatagctagaacacttgacgcaacagcatgacatggtcctgcaaattacgactgtacaccaatatatcatcaatgaacaccaaaactcccttcctcaataacggtgcaaaaatcatgttcatcaacccttgaaaagtggccggggctcctgtaagtccataggacataacccgaaactcataatgaccattatgcgttttaaacgccgtcttatactcatcttcagctcgcattctaatctgatgataccccgcgcgcagatccaagctggtaaacagactagcacctgacaattcgtccaataattcatcaatgattggaaggggatagcgatttttaactgtaacagcattcaggtgacggcagtcaacacaaaactgccaagtgaggtcctttttctgcaccaacagcaccggagaagagaagggacttgaacttgg

SEQ ID NO: 27187 - DNA, 1501 bp, Oryza sativa
cgtagacgcccaacagcggcggcataataggccagccgtgtaggcggaggaaccaatcggcggcgacggagtcaggccggcggtgaagacgtagacgcccaacagcagcggcataataggccagccgtgtaggcggaggcaccaatcggcggcgacggaggcaggccggcggtgaagacgtagacgcccaacggcggcggcataataggccagccgtgtaggcggaggcaccactcggcggcgacggaggcaggccggcggtgaagtcgtagacgcccaacagcagcggaataataggccagccgtgtaggcggaggcaccagtcggcggtgacagaggcaggccggtggtgaagacgtagacgcccaacaacggtggtgtgaccaaccaaccatataggcggaggcaccagtcggcggcgaagtcgtagacgcccaacagcagcggcataataggccagccgtgtaggcggaggcaccagtcggcggcgacggaggcaggccggtggtgaagacgtagacgcccaacaacggtggtgtgaccaaccaaccatataggcggaggcaccagtcggcggcgacggaggcaggccggcggtgaagtcgtagacgcccaacggcggcggcataatagaccagccgtgcaggcggaaacaccagtcggcggcggcgaaggccagccggtcagtgaagacatggacgcccatgaacggtggtgtgaccgaccaaccgtataggcgatgacaccagtcggcggcgacggaggcaagccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccaagtgtgtattgatctgacgatcaggttgtctcatctgccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgt

SEQ ID NO: 27188 - DNA, 194 bp, Oryza sativa
agtgaacacgctatcaggcattgacggagctagcaccatgaggcttccggttacaatagccgacatacgtgttgtgggcttgtggcactcgtcgactccggctcgacgcacaggtggtgcatcacctcctccatcttgagccggtgtgctagggacttcgctttgtcatggccaatggtgatcgccttgtcagc

SEQ ID NO: 27189 - DNA, 1501 bp, Oryza sativa
attgatacacctcattggatctgcaacgagacaacacatcagctgccttattctcaagacctttcttgtataccagccggtaagataagccaagtaatttggttaatgctcgttgttgccaagatgtcaccaaacgctgatcatcaagatgaatcaagctgcgctgatccgtacgaatgataaactcaccaaactgcagataagagcgccaatgatcaacagccagcaatatagcgagacactctttttcgtaagttgacaggcctctgttgcgtggacccagggatttgctaaggaaagccaagggatgtccatcctgcattaacaccgcacccacccccaaatcagaagcttcagtctcaattacaaaggtcccagaaaaatcgggcaacgccaacactggggcagaaaccaaagcagccttaagagcttcaaatgcagcttgatgttctgaagtccaaacgaagaccacctacttttttaacaaatcagttaagggccgactgatgatcccaaaagacttgacaaacttgtgataatatccggcaagtcccaagaaactccggacttccttaacattctgcggcactgtccaagcttgaacagccctgacattcttcggatcagtagttacacccgcagcgctgatcacatgacccaaataagtaaggctggattgagcgaacgaacacttagatcgtttgacctttaactggtgagtcgtcaatagctagaacacttgacgcaacagcatgacatggtcctgcaaattacgactgtacaccaatatatcatcaatgaacaccaaaactcccttcctcaataacggtgcaaaaatcatgttcatcaacccttgaaaagtggccggggctcctgtaagtccataggacataacccgaaactcataatgaccattatgcgttttaaacgccgtcttatactcatcttcagctcgcattctaatctgatgataccccgcgcgcagatccaagctggtaaacagactagcacctgacaattcgtccaataattcatcaatgattggaaggggatagcgatttttaactgtaacagcattcaggtgacggcagtcaacacaaaactgccaagtgaggtcctttttctgcaccaacagcaccggagaagagaagggacttgaacttggttgaataactccctgctgcagcatatccttcacttgccgttcaatctcatccttctgggctgggttataacggtagggatgaagattgactcatgaaggagctgagaaatttcggctggtatttcaagagaggaatctgaatcttctagaggacataactcaacagtctacaaaaccgcatcatgattcattaagccctgcacctgaacaaccgaaagttcagagcatttctgagtattagcaaccacacccttcagacagacattctgttgttgatactgaaattgcaaaatcttgcttcgctagtcaatctgcattgggctatggtcaaccaac

SEQ ID NO: 27190 - DNA, 1501 bp, Oryza sativa
agttaagaactttgagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaatttaaatcctcatgcactctaggcgtctatatttatagcagtgagaggagttctggcgctcccgggaaagagaagtctcacacacatattaaattatggttcaagttaagttctctatcacacacactcatgacagtcctaccaatggcgacaccgatgtagggcacgcctctcggccctacctcaacggctgccccaccgtagcgcacttgccacactcaggggtgaaccatctatgcagggatactgcctccgctcggctatctaatccgctaggtctatacccattcgagaagtacggttgtacgggggtcgtttcatgcttaacttcatggctcggtccttaattgaccgaggacggtactagccttttccagataccacccaaatcctccgtccaccccagtcgaaaacagttgtttatttttatttctcctttcgcaaatcatgtcatcaatatcatggcaatgtggtgctcatgtctccacataccatatctcaattaccttcccaaaggtaattgcccaagcatatagcatttgataaatatgagcatgcatgattctagaatagcatttctaagcatttgtcatagttgactagggactcatacgtaaacatggttatgaaggaataaggggtaaacaataatcaaggcatggcataatcgcaagtaggatgttcatcattgcatgcaattttatttgtaaacaaaacaatttcgcaattgggatcaacatgttcaaggaatagtgatgacttgcctgctcaggatagtccttattctcgatataatcttgatcaaccttcacctcctagaagttgcagacgttgcctcacgactaaccgatacacaaagtctataatacgcgagaaaaaccaatattcaaacaacaatcaaatatgcacaacaaaatgtacttgttagggtcgtacctagggttgctcatactattattgcttgctaggggattccaatcatgctaagggctaaagtttcttaatctttctgttgtcatggtggtctatataggagctaaccaatgtagtatgaatgagatacgtatctggctactatgtggtttagtctagcaaatggctattcatgcatctatctaaatagaacggttatacactagaggttctgttgccggatggatttggatcggtcaaataattactgtgaatcatttgtattattattttattgatggaggctttattttaattatgtacatattttacttgtcaaaataaattataaaaggttaacaattaccca

SEQ ID NO: 27191 - DNA, 1501 bp, Oryza sativa
ataacggtgcaaaaatcatgttcatcaacccttgaaaagtggccggggctcctgtaagtccataggacataacccgaaactcataatgaccattatgcgttttaaacgccgtcttatactcatcttcagctcgcattctaatctgatgataccccgcgcgcagatccaagctggtaaacagactagcacctgacaattcgtccaataattcatcaatgattggaaggggatagcgatttttaactgtaacagcattcaggtgacggcagtcaacacaaaactgccaagtgaggtcctttttctgcaccaacagcaccggagaagagaagggacttgaacttggttgaataactccctgctgcagcatatccttcacttgccgttcaatctcatccttctgggctgggttataacggtagggatgaagattgactcatgaaggagctgagaaatttcggctggtatttcaagagaggaatctgaatcttctagaggacataactcaacagtctacaaaaccgcatcatgattcattaagccctgcacctgaacaaccgaaagttcagagcatttctgagtattagcaaccacacccttcagacagacattctgttgttgatactgaaattgcaaaatcttgcttcgctagtcaatctgcattgggctatggtcaaccaaccaatccatgccgagaattatgtcataacttcccagaggcagcaccttgaaattggattgaaaggagaaaccctgcacccaccaaaggcaatttgtcaactcccttgagcagtgcagtatacccccatccgcaatcctgacttgaatagcaggaacaacacgcagcttacagttcaacttgccagccagcttttcagacataaaactatgcgtgctgccagagttcactaacatgagaatttcttactgctgaataagtccttgcaatcgaagcgtacagacagatttcgtaccaatcatagcatcacgagaaatctgacagacttcgccttgaggttcagactcagacccaatgtcagtagttggttcaataatctcaggcataccatcagcagcagaatcagctaacaattccaaaagctcttccacaatatgcaactgaacagtaggtccacacttgtgatcgcgactccaccgttccccacatgtatggcataatccctttgctttgcgataagctctcagggcagctaccttatcttccactggcagtgtccgttcatcagctcggccaccaccaaatgtcttggaagcaaacgacggtgtagcagaacgggccgtagctcggtaactcgtcatagcctcctatcgagcagattccagtacttcctcctacaggcaagcgagatccacagcagtatccatgtccgtgggacggtgtaaaagaatagcaccatgaatatttgcccgcaacccatctatgaattgagtaaaaaaaacatggaatcccaagaggaatgatgagcgtgaaactggtgcatta

SEQ ID NO: 27192 - DNA, 1501 bp, Oryza sativa
gccaatgaaatcacgcgctcggcgccctgcttccaaggctcgctgccgtcggtcctcagcctccttcgcggttcgctcacgctcatgctggtcacgccgtagccgttcttgttcttgtgcttgacgctcctgctccagtcggcgacgctcaatctcgcgacgtgcttcggtttcccgggcttggcattgctcctccgtctcattgtcggccatgaagacgccgaagtagagaggggtgtagttgtcttctaggcttccgtcgaagtcgtcgagatccgggtcgttgtagtagcgagagccaaactcgtcgtattccacgatgtcggtgggacgcgagtcgacggtgggagagctgtagtagccatccagctgatccgtcgaaaccgtgccgagtggttggaggatgacgccgacttccctgaagctaggcgaaatcggtgttgaagccgacttccgcctaggcctacgggatgaaggcgctgtcatgatggagacggtcgccaaatcgtcagggagctccatcaggatcggtgggtaagccccatcatcttgatctggtgacgttggagaagatgcgatctctcccgagtggtttgaagccgactcgattgagatggtcttgaagtaactttcagccgcgtttgggagtccaaacgggactgaaatccggttctctcccgactggtatgactccgagtcaaggagagagatcttgccgaagttgttggtgacgaagtcgaggctgccgaaccgaaacatctgcccgggtgggaagacgaggtcgtcgatgccggagatggaacccattgcactgatcggcgaaaagcttgacgcaacccctacctggcgcgccaactgtcgaaactagatttcggcaataataaaagggggtggctatcaagcttgagaagtgtatgggtttggagacaatggatttatacaggttcaggccttcttattcaagaagtaataccctactcctgtccggggatggatccgccgagtgtattattgattgtatgatttgggaaaatcaacatatgcccctagaggcacccggaccccccttatatatgggaaggagtccgtgttacaaaagataatatatatccctaacggaatatgcagatacagattaaatacagtcgtaaccgactaagtctcaaggtatttccttgatgtacaagttaagaaacaaacccgagacacaaataagatattctatctatatttggtatcctgtactcagtccaaataccatcgccgtgtagatatgggatatccataatctccacaccttgaaagttcacgaaaagcagtaaagtgtggctaccctctctggcaatcaggattgcttaggaaacaagtttgttaaatgtatgctacaatggtgccgtatctaaaattggatatgcgttgaaaaagataatttggctaatgtggcaaagaattctgcaaacgttgttcacctctaacgtttatgttgtacttgggtataact

SEQ ID NO: 27193 - DNA, 949 bp, Oryza sativa
ttcatgccaagatctgctgaatagcgaagacaaagactgtaaacggcgaaaaaataaagaatatggtgcatcgaatagatgcacctaattaggtgtagcccccaactatgtgattagttaataaactaaacatatagttgagaacaaaataatagcacagttatgcatcatatgacaaaagcatacgcggcgcctaaagaggcattctagccgactgctttttagccgtaataaaaggaatccgagtggtttacactctaaaaggttcacgaatgaacatacttgacaggcatccgaataaaaaactctaaaaattacccaccaagtattataaaaattatggtaatgaataagtccaatagcctaggctatgactatttaccataatgaaaacaggtatataacataccaaggaaatgactatgataaaaacaagtcattccaaattaaccctgacagcttttgtagcctaaaaaagcttacaaaaacagcataatacctttctgtcgggcaccttttaatttgcatagcattaattccaaagaattatatgaccgcataaaaaggaatttatcagcattgggcaatactattgtgcgcataaattgccaaagcaaaaaatgcctaagtccctaaggaacacaatgggccacgctgttaaaaatactgggctgaggtactgttcaggcctaggcccatttgcacctccgatacccttaacaagaaaacccgagatccaagcgacgcttcgtcttccccgccggaactctcgccattttccccactccttgcaacagtgcaaagcagcgccggcgaactagggttcaccattccgctcaaatccaccttcgaaaagtgcatcaaaatctctcccgtgatccaccgccttaatcctttgcctctccctagccatccctcgaatcaaatcagcgcattcgagtgaaatcaa

SEQ ID NO: 27194 - DNA, 709 bp, Oryza sativa
taagaagtaatttaatgaaatctaaaagtaatttagatataatatataagtaatttgaatttttttcataaaaatatagttatgtgagatctttttataaagatttaattgttatgaacacaatggtgtaatcggatcgtaaatcggatgagtaaatctaagagaaaatttcataacaagaaaaaaacatacacttttgagtatactagatataaaattgaggtagctagttatgaacatacagagaacggtttagttgtagacacgtccattaataaacaattaccttctaagtacggaaactcgacctaccatacacagccttagctaggtggataacgactattcgcgcatgcataataaccagcaagcatatatatatatatatatatatatatatatatatatatatatatatatatatatatatatatatatatcacacatgctggaggctgccattattatacttaaccatggctagtaccagcgttttaaatctcccgctatagctgccgctatctaccgctataactatttgagaagggttctagctatttgctctcatatacaatttaacagctatagcttcatttagcccgctatagctgccgctatagctgtttaagaagctaatcgctaaatggtttagcccgctatttaaaacattggctagtaccaccaaccaacctactcttttggggccagt

SEQ ID NO: 27195 - DNA, 1501 bp, Oryza sativa
tacataaaccgaactagcatgaaactacaacaataaaaataatataagaaaacttcagtataagctatgacgactactggataaatatgattagggatattctagggttgccctagggcgccaaccccttgggcttagctcatgacccaattacaaggctcgaggcctaaattagattcggactggataaggtacgtagattgttttgcagatttctgatagcctaggaggaattttgatgtgggactaaaaccatatgaaagtagaatccataagctttccaataagtccttatgggccccaagttttcttctagcacgagatcaacggctagtctcgaatccgaatataaaacgtgcgaaatttcatctcttgctttctatggactaaaagtgacgtggtgagttaagactagacttggagaaagtcttggtttggcccccagtgaactttttttgatcatccattattcctttgcccaaataagtacctctacaaatggaacacataaaactcatggtgcagtatcgtctgtttaaatatataacatgtaaattgtacatagaaaacatgcacctttggttgctgaatgaataaggtatccatggtcatatccgatctagtgatatcctaatcatttagttttatgtagtagtgagagagtgcgcaacagaagaccgagccatggatctgccgagccagttcaccatctcctgtagggcagcctatatgttgcactgtatgtacaccgctgtctgtacaaggtgtgacaccaacacataagtcttattggattttataggagcagttatacccaagtacaacataaacgttagaggtgaacaacgtttgcagaattctttgccacattagccaaattatctttttcaacgcatatccaattttagatacggcaccattgtagcatacatttaacaaacttgtttcctaagcaatcctgattgccagagagggtagccacactttactgcttttcgtgaactttcaaggtgtggagattatggatatcccatatctacacggcgatggtatttggactgagtacaggataccaaatatagatagaatatcttatttgtgtctcgggtttgtttcttaacttgtacatcaaggaaataccttgagacttagtcggttacgactgtatttaatctgtatctgcatattccgttagggatatatattatcttttgtaacacggactccttcccatatataaggggggtccgggtgcctctaggggcatatgttgattttcccaaatcatacaatcaataatacactcggcggatccatccccggacaggagtagggtattacttcttgaataagaaggcctgaacctgtataaatccattgtctccaaacccatacacttctcaagcttgatagccacccccttttattattgccgaaatctagtttcgacagttggcgcgccaggtaggggttgcgtcaagcttttcgccgatcagtgcaa

SEQ ID NO: 27196 - DNA, 812 bp, Oryza sativa
ggtgagctccgaatgggttcggtgaactcgcctcccgccgccgcgtgggttggcgaggagcgccggatgggagccgggggagtggtggtggtggacgctgtcgacggcgtggggcgagcggggccggcgggggaatgggcgagcgcgggctgcggccgacgacggcgcgggccgaagggaggtgggcggcgactggaggtagagaagaaggtgagaagaggggctgacgggtggggccctttccacgctggcacgcacggtggcacgccacgttggcaaaagtggcaaatagttaagaaattacctctctccagtggcaaattattttatgcaaacctaagaggggtatttggataattggcaaacctaaaagtggcaaatagttaaattccctcgttttttgggcacaagtcgttttttttctgggacaaccgctcggtctcatgaatcagtttagtctgggacggagggagtagctagctagctatctaggctcgtggctgatgactatatatcaatgttttaaatagcagactaaggcatttagcggttagcttctcaaacaactatagcggctaaattatacatgagactatgagaacaaatagctaaaacccttctcaaacaactatagcggaagacagcggcagtttaactagatatttaaaactctgctatatatacgtactcgccatagtcagcgcggacgatatatagcacagctagcctatcatgggtagcaccggcgacgaacccatcatcatggccgggccagtgccgttcgtcgacgtcgtcgtcgacaatgccggcgg

SEQ ID NO: 27197 - DNA, 183 bp, Oryza sativa
cctccacccctctttatatggcgcagggtgacgggggcccaccagccattgggctgggtgcccccgatcagggcgcgggtcaaggcctccttgagctgttgggctcaaggggagggagatctatctaacattctcccccttgatctcactatttcttttagcctttttctattccatcataga

SEQ ID NO: 27198 - DNA, 1501 bp, Oryza sativa
aggagccgaggaggtagttaagagtttccttcgctggctcgagctactctccgccaaacagccggatcagctgtttcgcatagccttcggatgttaccggctcccggccgctccggcacgtgccaagccaaacactccgagtccacgacattcgccctctgaccagtgacgaagctacatgtaatctgtatagtcagctaaccccataggtttttgcaaaatagataaaaaaaattgatatttgtgttgtaacaatagaaaacttaaaaaaatttatagctttgaccccgcaggtttttgctgctggcttcctcatgcatcaggctgtgaccttgccagttggcacccatcggtcgggctagggctgtcaacgagccgagctcgagcgagcttgcttgcctaggctcgagcttgtgtgacacaggctcgagccaagctcgaatcgagcctagtcctccttcgagcttttaagcaggctcagctcgagctcggttaggctcgcgagctcgatcaagtataagacaatgtatattttgatggcaaaattttgcaaaaaaaaataattttaattaacaatattgaaggaaaaaaaatgagaatctaagattaatatatgatgccaaaatacaattttcacacgaatatatactaatttatcctcgagctactaacttatcatataaaaagataaatatttcacacacagttaggctcgtgagaagctcgagctcggctcgacaaagctcgcgagcttgcagctaggctcgggttcggctcgttaagatctcgagctgagctcgaatcgagtctgagacgagccgagctcgagcaactcgcgagcctcgtgctttttttgacagccctacgtcaggcctcccacagggccgacatcacgtcaggtccatgtcgcgctcctcgtgttgctgagtttcccggcccaactgccaaacccgtgtgtcgcgatgaacgcacgttcacctcacgtcctacctccaagcattccatcccgagttcggatgcctccgacagacaagctgtgtttagattcaggggtgaaaagttttggcatgtcacatcggatatacggatatatatttgaagtattaaacgtagattaataataaaacaaattatagattccgtctataaactgcgagacgaatttattaagcctaattaatccgtcattagcaaatgtttactgtaacaccatattatcaaatcatggagcaattaggtttaaaagattcgtctctcaattcacacgcaatctgtataattagttattttttcgtttatatttaatactccatgcatatgtccaaacattcgatatgacagggtaaaaaattttgccgggggatgtaaacagggccaagaattcctgtcttttcggagacattgcctgattgactatgacacatgtgagtcgcgatgcgccggtgacaacctggccaaaaacaacaataaggggaatgagaaagaaggtgaaaccacatct

SEQ ID NO: 27199 - DNA, 1501 bp, Oryza sativa; identical to SEQ ID NO: 26935

SEQ ID NO: 27200 - DNA, 1501 bp, Oryza sativa
gaaatggagctcaccggattgcgacggcgtcgaggacttctctcaccggcgccggagttggcacccccgttcccggcgaatccgaggcggggtacctcggttcttccgcgaaacgagacaggggcgagagagagtgagagttggtcggccggtcgggttaagtacggtcgccggcggagatggggaggaggagctcgccctcttccgcgctcaacgcgtgctcacacgcgtggcgcgcggggtctgagtcgtgggcccgtgtggagagggatgtgaggctgacaatggggtcccactaggcaagagagaggtgtagaaggaggaagtgttggacagggctgaacctagcctaaggcactgacaagtggggccaactcgatggaaactaggccagggagagagatatgggtagaagactggtaaacttgatttttagattaattttcggaattattttctcctctaactttgtagcttcataacttaatgtgtggaccaaattatctagtgttgaatttactggaggtaaatgattacacctagattccattttctttggttgcactcaaaaataatgggtagactgctcacagaaattaaacaaagatgggctattagaaagctagattgaatttttaggaggcttaaacagaggaggaaaattctagaaaaattacatttattcatgataactaatctagtgtttgaataaatcatttcccatgttcacttatgtgcagttcaatgtacttttggatgaaatatggttttagccaattaaatttaatttgatttcttttagttgtctgcttcaaccgattaatttgagatatcaacttgagtgttaacatgttaccaaattacagaggataagtttgtgctaatcattgtccacataaatttttccatgattttatcttgcacaaaatattttagagaattaagttgacctttgtttgtatatgtgttcccacttcataattgcatctaatattattatagggattacattaaacttgttttagactgagaagatgatatttgagtttaatattaagtccacatgttatcactcaagattaactataggtttgtttagtgaagtaattcttttagattatgctcatgggatctattatggaatgcaagaccaaaactccaaatgcacaaagaactcgagcctaggcatgcattatgtacatgtatgcttggtgacatttctagtctaatgttgggaatgaaaagattttattttgttctcaaattttaatcatgcaatggtttaagttggtcatcacctaaattaaaacggaaattttggctctcaaaattggagaagttaacctctaactattttgacaagaaattttaagtcctaaaatttcgggtatgttacataatagagtacaaataaataactatttaatattcgcaaacaaattattacagaggtagatagttcctctcaaagaataaccttctacgcagcggaaaaaaaaat

SEQ ID NO: 27201 - DNA, 1501 bp, Oryza sativa
ctaattcatcttaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatatgaaatcagaatgaggccgttcaagtctctaaattcatctaaaatcatgatctacatgtttgtttactttttatgtattgtttatttggtttttattagtctttttccttgttttgcgtgatagtttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggttattataattggactagttgagctttatatatatattggttcaactagatattagatatgattgcttagccatgcttagaaacattagcacacatttgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttatcttttgtatagcatggttcattgcggggcaccagactgagaagtggcggagataagcccacgggggtcgctggggagtccatgccttgttttataagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagcaatgtttttcgtgattagtcccacacctctcaccataattttagatgttataactggtaataatttgcttagctcctggtttggagttagatctgttcagccgggtatggttgttcagaatggttgggcctgtgcagcatgggtgtgctgttcagtgttggttaaaatttctgattaattactccactgttttacttcccttaaatgttttgctaaatgctgcttttgcaaatgagccgatattatgccatcctttggtatccttgtgcacttgcatatttgctgtgtggcttgctgagtatgtcatatgctcaccttgcaataatcaatcaacctcagt

SEQ ID NO: 27202 - DNA, 1501 bp, Oryza sativa
cgccgcctccgtcgtcggcatcgtagcggcgtggtcctcgtcgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgtgttcgtcctcggctccgcgtcgtcaagcctcgtgccggccgcagctcgccttcgcccaaggatcgccgccgaagccgtcccctcgccgttcgtctccgttgtgcccgtctgtctccgccgcgcccgttcgtcgttgtcgttcccacgcctcgtcgcgtggtggtaaggttccctctccctcgctgccccgtcctcgtcctttcggtgtcgcccgtgcccgttgtgcggttgtcggccccggtacccgtgtaccggtgtcggtagtcgttcacgtgtgcgggtggtgaccgtgtagtgtccgtgttagtgtgcccgctcggtagccgcgtggtttccacgtgtgcaggccgtgtggtgtctagtggagtccgtttgttggccactcgcctcggttgacacacgggatccgcttccgtcgacccgtggaccgtctctgtgcactcggtctaccgcggtcctttaggttgacatgtggggtccgcatgtcaacggcgcagccttcctgtcttttccaggctagcgcttacacatgttttatagttgcaaaacctaattacaataatccgcaaatctccatataacagcattaaacttcggatgatcatatcttggtcatacgaactctgaatcgacccgttcaagtctcctaatgtttgttataacctaaagaaccctgtgctttctttttatgtgttgttattgcttctttataggcttgtagctttgcttgtgtgcttcgcgtagctttcgtcgttccggaggttcccgaagcgtggttcgtggtcgtcgccgaaggttcggaaagccgttctctctgagcaaggcaagtcacatcatccttgaacatattgaatcccagtttgtaaaattatgttgatttaaattattgcattaccgctttatttaaattcccgcgttatcactgttttatctagccatgcccaattacctttgttatgaccttattattgttattgttattattattaccttgttcaccctagaataaataaaaccctaactagtgggtactctattcatggttccactagtataaatttaggtagatgcttcgctgtttaattaggcaacattaggtggttttataattttagactttgggaattctcatatcatttggacactatggaattgttggattatggtggaattggacatacacctctctttctctttcaaaacccctaaaacctgttttcggtggggtttgggtgcatgccagttaggggaagtagcaccccggccactataaggactaaa

SEQ ID NO: 27203 - DNA, 326 bp, Oryza sativa
ttgagggaattaaaaatttcctttaaaaattattggccgggaatattttgtaatattctttgtgccctaatgtactctccggaattttccgtgaattttcggagctcgagaaatagttttaatagcacaaagatcattgcatcaattaaaataaaaagaaaacaattaaaatcccccttcctctctttgggccattttcggcccaagtcttcctttctcttccgcggcccgcgcgccttttccctctctcgggccggctcccctctcacttggcccgctcgcaaaagtctgttttgcgtccctccttctcttccttcgccgacagg

SEQ ID NO: 27204 - DNA, 329 bp, Oryza sativa
ttcctgcagcccaaaccaaaaggtcaaattcagattaagctgtaaaatttaaattttgacttatataagtataagcattaagtcaaacaatgaggtcggtctctttttctgaatccctttgcaaaaagaaaaggttgtttttttagttctttttttttcttcagacttggcaaggtacagcaaatctcttttctgaaatgatagtactactttttttcagaattggctatagcaagtttgaactgactgagtaatttgcaggattttgcattaatcttgaacagatcacttctgcacttctaatgcgcatgcacactctcttttttagg

SEQ ID NO: 27205 - DNA, 1501 bp, Oryza sativa
atttctttttccttttactcctagctcgattatacattgtgcatggcactttggtcaaacgaaacaaagagcaaccacaaaagttcaggcagttcaaaatgctccatatgttcaagcaaaaaccaatgtggtgattcaaattcaaattaggtggacccggcaaaattcaaattagatgaaattcagatgaaccaacgttgtgttcaagcatactatgatgaagaggtggcttgttttgttagcttcttaattcccttatacatcttgacttacccttaatatatatagactgtagagctctctataattaatagtaatgttataaggttgaaaagccttaagtgatattcacatgctgagacttttgttctatattattgttacaggcctacaaaagtgatatattttattttgttctctccgtcctttaatggaagggatcttggtttggccatacctctaattctgaaaataattacgaagatgccattagctcatgtgatttttgataaaaaaaatgttttagaagggacaatcgctaacctcctctccagtaaaacaattaaaagatcagcattaaggatgtgtgaatgtgtgatccgttgcctagagttaattttataaattgattatccgagaagcaatgagcagaacgttcatgtaagatttgagatgatttcattccaaactgaagcatatgtcagccatcaattgagtggcctcacaaaggatatataatttgcaaagcctagcaaactatgcccattgcccagcatcaaacagcccacaccaaggcccagtaagaaaccattgcttgaaggtgtgatgatggttgtacttgtataactatatttgactgaatttttccagaggtcatggtcatgtgctttgaaattcttacaggggttacttccctcccatttgatttgcaaatgtttgcttcgagtcttgcactcttgcttccatttgcttcgcacatgtttgtttgcttggaaaaaagtttcagcacatgtttaagaatgaagaccattgaactcgactatgatgtatgcatatgtaagctatcagcctatcacatgttttgtctaccattccattccaaaacatagttatttctttctaacactatgaatagcgacgtatttgggacggagagaatacttgttagtatgaaatagtatatatttacttagtacctcttaatttctatttgcaaaattattagcagcatgcattagacattctttaggaaggaaaaaaaaagaaagtttttttgtcacatgctcaaagcaagttggataatcgttttctttaatttgatactcctactaatttggaaaaggaaaattggaatccgtctcatcttcgcttgctctcttctcttctccgaggtgccaaacatatccgtccctttccctctcctcagcttcgcgtcaattccagagatcaaaaccctagccaacccctcctcctcctcctcttcctcgcgatccaccggcga

SEQ ID NO: 27206 - DNA, 1501 bp, Oryza sativa; identical to SEQ ID NO: 26322

SEQ ID NO: 27207 - DNA, 499 bp, Oryza sativa
gcttttcaaaatatgtatccgtatttgaatcggtttttaaggtcattcacttttgataatacagaaggaatcatataagaaatatatttaagaaaactcgcatgctaacttgagacgatcggactcctaactgcaactcatgattttctaaatactccgtatccaaacgaactcccatagtgaatttcatcttaactaaacaatacaacaataataagattaaaatagacttcacccgttgtaacgcacgtgctttttttctagtaaaaaaaataaccgaggagggagtaccttacaaagttagaaagaatattaggacccaatggtgaaaggtggttttctcttaatcagttttgattatctgatagcaaagggttgtttaggcatgcagatttgggaattgggacgctttctgctcagaaaacggatcacaaatacatatctttatcctaatatggttccgtattcagcttcaatatatttcgtgtggttcaatagg

SEQ ID NO: 27208 - DNA, 194 bp, Oryza sativa
tataaatcgcccgggaaaccgctcctgccacttcaccacggcacagcgagctcgccgcgaagagctttcgccgaagaggtagacgacgacggccgacgacagtgtcacgtgctcacgttcatggtgcggcggtgcgcgccccggtaaagccgaagatggtggagctctcgccggcggcgatggagaggtactcc

SEQ ID NO: 27209 - DNA, 1501 bp, Oryza sativa
ggaagagtgcatgccagacaacaatttgtttgttgtagcaattctcaaaataaattcgtgcacatagcacatggttcccattcaaggactgatgtaccagtttttggcagtaactgacccaacaccaggtaggagatattgatgccaaactccaagcaggcaggaaggtggcagcttagctaatctaagacaggccaagtgcccatatagccagtcttcagggcgacataaaactcatctagaattgatatttcaccacataaatcatcacaatacaattaatttatttatacttgcagagtatactgtgaatgtgccatttcaagagccactgctgctggacagaatctgtgcgagactgatttccacatgctagaaagtactacacgcgaaacaaaaactagctgcaaaccccccaaatttataggagcacaatttgaaacttatcccttccagcaactaattttctacagtgccagaccagatcgaaccacgagattcctcaacgagagcccctaaaacgcaatctctagaggcagaaatcagtcacaagattcacccccacgcaccttgctcgaggaactcctcccgtagccgcccgcaccgatgggcgccgcgacagacgcctgcaggacaccacagaaagcgaaagttagcgccacaggatgcaggaaaagccgggaatcgtgcggcgggagcggcagcgtacctgagccccgagggcggaggccatcgccggtggatcgcgaggaagaggaggaggaggaggggttggctagggttttgatctctggaattgacgcgaagctgaggagagggaaagggacggatatgtttggcacctcggagaagagaagagagcaagcgaagatgagacggattccaattttccttttccaaattagtaggagtatcaaattaaagaaaacgattatccaacttgctttgagcatgtgacaaaaaaactttctttttttttccttcctaaagaatgtctaatgcatgctgctaataattttgcaaatagaaattaagaggtactaagtaaatatatactatttcatactaacaagtattctctccgtcccaaatacgtcgctattcatagtgttagaaagaaataactatgttttggaatggaatggtagacaaaacatgtgataggctgatagcttacatatgcatacatcatagtcgagttcaatggtcttcattcttaaacatgtgctgaaacttttttccaagcaaacaaacatgtgcgaagcaaatggaagcaagagtgcaagactcgaagcaaacatttgcaaatcaaatgggagggaagtaacccctgtaagaatttcaaagcacatgaccatgacctctggaaaaattcagtcaaatatagttatacaagtacaaccatcatcacaccttcaagcaatggtttcttactgggccttggtgtgggctgtttgatgctgggcaatgggcatagtttgctaggctttgcaaattatat

SEQ ID NO: 27210 - DNA, 571 bp, Oryza sativa
tagattaaaaccaaaatataaaattaaaatcaactcaaacgcggatgacgaaccaaaatagattaaaaccaaaacataaaattaaaacctacttaaatacgaatgacgaaccgtggaaacatcttcgatttttataaccgactcaaagacagatgacggaccgcgaaaacatctttattttttttaagtagtaaagaagagatagagattccttttcccctctatttggaatattgtatcagcgacacataacacatatatgcatgcaagcatcacaaaatcgaagctgaataccgaactagggaaacagattagttgctactccctccgtttcacaatgtaagtcattctagtatttttcacatttatattgatgttatctatctagatttattaacatcaatatgaatatggaaaatactagaatgatttatactgtgaaacagataaggaagtagtaatatatgtctagcaacatacgcgctgcgcgactgcaaaggtatcggccatgagctgcacactcgtcggcttcaccgccttcgccactggcccattgccgtcaccaaccgca

SEQ ID NO: 27211 - DNA, 1501 bp, Oryza sativa
agaagattaattgaagaccgattattgcaaggcaagtcacacagatcttaaacacaatcctttgagcatgttgatcctatatttaaattctctatttatttcaactgtgcatttactttcgaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgttttcgtgattagtctcacacctctcacaataattatggatgttatacctggtaataatttgcttagctcctggtttggagttagatctgtacagccgggtatggttgttcaggatggttgggccgtgcagcatgggtgtgttgttcagtgttgattaaaatttctgattaattactccactgttttacttctcttaaatattttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaccacgttcgagctgaagaggcccaggaagaccagggcgtactgatgggtatgttttctatcaactccattccagttaaacttctctttgattcaggagcatcgcattcatttatatctttgaaagcaagccaacaacacaatttgaccagagttaaattaaggcaaccaatgttagtgcattcacctgggggtgaaataaccgtggatacagcttgtattgacgtacctattcgccttagggatatggtgtttccctccaaccttatggtgctgatgcctcagacccttgatgtcatattgggtatagattggttaacaaagaataggggagtaatcgactgtagacgtagagaagttaccctggccacaccctggggatcggatatgagagcaaccatggatcaagatcctagactaaccgaacgtgccggaggcatatttaccatgctacccctgaaaggaatgcccgtagtgcagcgattccctgatgtgttcccagaagatttacctggaatgccaccagatcgtgacatagagttcattattgacctgatacccggaactgcccccatatccaagagaccatatcagatgccggtcaat

SEQ ID NO: 27212 - DNA, 250 bp, Oryza sativa
gcttcgcttggctggccgcgagtgctgcgtcatcctcctcgtcgtcttcctcctcgcgatcgctgctcgatcgtccactgctcccaaccaaaaaatttaccgcctctctctctctctcccacgattcaccaccacgcgcgatctcctccactccactgccgctgctgccccttatccccaaaccctaccgctgccgccgcatcctccctccctcctcgcccgcccgaggcccgacgcttgcggttgcagg

SEQ ID NO: 27213 - DNA, 350 bp, Oryza sativa
tgctctccctctcctcctcctcctcactctccctctcctcattatggcaagggaccaagcccctttttccccttctttttccctttcccgaccactgccggtgtcactgcctccgcgccgcttgaccgaccgcgccaactcgctctccttgaccacgccagcccacgctcccgcggttcgatttccgccgctcgatccatcaccttcgccgcccaacgcatccacgccgtcgccgctttctcactgcccacgaaaccgccgctgccgcccgtgaacaccagccgagctcccttgaccgccaatgtcggtttccctcctccaaaccgacctctcctcctcgcctataaagc

SEQ ID NO: 27214 - DNA, 1501 bp, Oryza sativa
taattaaaactcaatcaatcatatgttaataccaccttgttttgcgtaaaaaacttaatcttcgtctcatcttcaggagaaaagaacacaagactatacataagatggtacaaaatcaactatggcacattttttgttaaaaaaaaaagtcttggttcggtagcggttacttacaaaatcttgtctacgcctccaaattcatcacaatggaggaatactggaatatgacatcaacgcaggggaatttgtggagacggctgccagccttgtgggctcacatccaaacgttgtctcattatgtgggctgggctggcatataatgcatacgagctagcttagctattttctgttttgttgtgtcattctttgttgttaatcacaattgcctttaactaatcaatctatcggggtctaatggtattctataccggggttatggctggtaagataaacggggtatacgatggttgtggaaaatcgtcggggtctactgaccccgacgctttgctgtagcttcacccctggatatcagtgactcatattctgcgagatggaagggacacagattttttgagaggaaattggcttccaaaaggaggtagtgttgctactaccaagccgcttccactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtcagggcctgtcaggcccccccgggatctttagtcccggttgataacaccaaccgggactaaagatcgtaaccaaccgggactaaagatcccggtgatctttagccccagttggtgctaccaaccgggactaaagtcccacccctatatatatgtcttcttcctcctccagctgcccgagcaagcttcaaaatttcttccaaaaagatgggaggtcatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtaga

SEQ ID NO: 27215 - DNA, 1501 bp, Oryza sativa; identical to SEQ ID NO: 27202

SEQ ID NO: 27216 - DNA, 1501 bp, Oryza sativa
gggtacccataatctccacagtagcccctgagaccttcacagtcgaaaagataatcttctctcgaaccagattactccaaagccgagtacttcaatcatctttgccatggtctcccgagtacttttaccaaatctgaagactgtggagggctgaaaaataaagtcaggtgcatcgactagatgcacctaataggtgtagccctcgactatgcggttaagtgaacaaaccaagcatatagtcaaggaataaataatccaaccaaccgagtggcttcgataattatagttaactaagcgacttgatattaatatgtagcatatgcggtgtaaatccctgaataacatgatccgagtgatataccgactgctttgtaaaatatgatgagtgtaacctaaagttggctacattattgaaaattcacatagcaaaacagctataaaaagcttgtatgttgtgaataaagaaatttccaaagtgttgggcataccccatgcgcacactggttgaacagatgtgcttaaggaccttgaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacatgacaggccacacctgaaaatatgggctgcagacatattaggccttggccaaaaaatatgccttcgataccctttaaaggatgacgcatgtaacatgctcccgggtgatatagaccatgtgatctgagtgattatcccttatgggatactccaaaatagatataaaaattgaatcccgactggcgcaagtattcggttgataacccttacggggaataataaatagtccagtctttgagcatagaaaatagacccatgatcataaattcatgttgcatgtatccggaacaagtccaaattggagacataatacttgtgtttgaactagtaagcccctgagcatatagcttgtccttatgtcgtagtcacaattgtctattgatggtagctgacgcagttggcatagagacaagataaccaatatagagagaatattgcccaccagaggtggcaaaaatattggtggtagtgaagatagtgataccaatcaaaagtactgaagtcgcatagccatgaaggcgaagaaaccagtcggcggcagtcaggtcagccagcaatgaatatgaaggcgctc

SEQ ID NO: 27217 - DNA, 1501 bp, Oryza sativa
gcggagaaccccttctatctttgtctgtatatattactacttgcgtttctctttctttcttcccttcggtttctcctcctctcgtcggtttcttcgctccattgttctgttccttgctcgagaaactcccactcgttttgctcctgttcaacttttcgttatggcgtggtaaggcctggatcaatgcgtgtggttctcctgtccgttctgtcatttgggttttatgtttgttctctcttgtttgtttgcttatgactgcgcggctgttcttggtagcattgaccctgcaccttttgttccatttaggggaggcaatctgcatgggctgcaatggacctttaaaggttcctgatcatcttccattgcacgtgtgcgggctgcttctaagacctagcaggtacttttggttgttgctggtttcattggccttgtgttatgctttgcttcctacattcttattcactgatcatgctccgttctctgcagctctgttccgtcttcttccttgcctctgttcacagcttgtgtgttcgcttcgtggtgcgttttagtggattctgcctgtcgacgagcatattccttgctaaaggtattcccgcgctattaatctttctgtcctttatttatggttcattggtttagtattttgtttctattgcctgcattcatcgctgtctaaatctgcatgtggttgctccagagctttcggtcgttttatattgttcgttcactgtatctgtgtggtttgagccactttttttgcccgtgttctttgcttcattcttttcttgcctctgtaaaattatgatggcagttagaaacgcatgctatggatagagtgcgtagggtacgtgccagccggcagagaagggccacaaatgttctgtcccaacagagtgcaatgcatatagaacatgctatcgttccgctagggcagccccatcaggaaagtcggtgcaagaggaaatgttcgttgatggattttgcacctcagctggcaaagttaaataggcaaaggcgttccctcctgcgttcaaagatggatccgtccgttcctttggccaatgtggatggtatgctctttttgttgtctgtgatggtaggcttgttttttttcgtgcagtttaggttcataggctgttttactgtctttgttcgcagcaaatcacactgcacgagccaacggtagttcctcccggacagacaaggagtatatccgattgctaaagggttcggccgctgttctgaatacgtgcacgtaatgcattgtttttttacacgagactatttttgacattgtccagcgcttttgtggcagcatcatacccagacagatcatactatggccctccgacgtatgaatgcccgtattgtggtgccatgttctggtaccaggagagggtcaagagtgcatctgctatttcaaaaagaaaaataatttacaatctatgttgcaaaggaggacgcatacaattgccaaaactgcgtgcccctcctgagc

SEQ ID NO: 27218 - DNA, 1501 bp, Oryza sativa; identical to SEQ ID NO: 26985

SEQ ID NO: 27219 - DNA, 908 bp, Oryza sativa
atatggaatggttggcctgggttggcttgggacgagctgggacccaaggtcgggttgccagttcggtccaaatcatcgtaggccttgggttaaggcaggttcgtgagggttcacggccttgtttaataacactgtgtagctctaggatcgtctttacaaaatggctttgggcaactaagtgatttttaaatgcggtttactgcaaaacttaatccctatattattattcccttgtacttcccttgcattaatcatgcacctccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacacagatcatcaccttcgctgaaatactcctcttctgatgattgaatattgcaagaatgagcatatgacatactcaacaagctacacagcaagtatgcaagtgcacaaggataccaaaggatggcataatataggctcatttgcaaaaacagcatttagcaaagatttaagagtagtaaaacaatagagtaattaatcatcaatattaatcaacactgaacagcacacccatgccactcaggcccaaccaaacctgaacaaccaaccccggtcgtacagatcaaacctccaaaccaggaattatccattccaaaccagg

SEQ ID NO: 27220 - DNA, 1501 bp, Oryza sativa
accgaaaggacgaggacggggcagcgagggagagggaaccttaccaccacgcgacgaggcgtgggaacgacaacgacgaacgggcgcggcggagacagacgggcacaacggagacgaacggcgaggggacggcttcggcggcgatccttgggcgaaggcgagctgcggccggcacgaggcttgacgacgcggagccgaggacgaacacgaggacggggctgcagcggctcgcttgacgaacgcggacgacggacgagaacggctcgacggagggacgaacgccacgacgaccgggaacgacgagaggacgacgacgacgacgacgaccgggaccggcgaggaggcgacgaggacagccggcagcggctgcacggggacgaggacgacgaggaccacgccgctacgatgccgacgacggaggcggcgccgcgagacgacgagccgggcgagagggaacgggatgatgacgacgaacaccggcggggttcggtcgaaggggaggcgaggccgaggacgacgtcgcgactgcgatgccgaagatggtggtggaggtggccgaccggtacacggcgaggagggacgggcggccgaacaactccggcgaggcggacggagaggttcgcggcgacgttccggcgaaaccgagggcaggccggggtggagggcgatgcggcgtcgccgagggaggagacggcgacgtcggccgacgctctggcgcggcgaccggggcagccggaggagatgtcgacgaggaggaaggtgaggccggcgcgggcgacggcgttccggcgaaattcgggcgaggaggaggtgatgccggggaagaaggcgatgccgcggtgtcgaaggagaagacggcggcgtcgatcggcgcaccggcgatgaacagcagccggctggagggagtacagtggcaccaatgccactggttgccggcgggggcaccgttccggcgagtttccggcgaggagacggtaaggccggtgaaggggacggtgttgcagagccgagggaggcgacggcacggccggacgatgctccggtgaggagggagaggtggctggaggccggccggcgtcggagagggagaaggagaaggcggggagaggtgatacgaccacggggaggctcgggaaggggctaaaacgatagaacgaaggatgaggatcccattttataggatgggggagagagccggccacgggaggagcgggaacggcgacgggaatggcggccggcggcaaaggaaggcggccggacttggcgcggccgttcccggcgattgggggcaccattcaaggggaaattaagggggaattgaagaggagggaaaggggattaattccccctaattaattttggaattaaccgagtgaatcaagcggatttgagggaggattggcgctagggttcgcacggggagagggaagccgggcggcggctggaggaagaaggcgacggctgactgacgcgtgggccccacgcggggcgcgcggtcagc

SEQ ID NO: 27221 - DNA, 1501 bp, Oryza sativa
gggcttactagttcaaacacaagtattatgtctccaatttggacttgttccggatacatgcaacatgaatttatgatcatgggtctattttctatgctcaaagactggactatttattattccccgtaagggttatcaaccgaatacttgcgccagtcgggattcaatttttatatctattttggagtatcccataagggataatcactcagatcacatggtctatatcacccgggagcatgttacatgcgtcatcctttaaagggtatcgaaggcatattttttggccaaggcctaatatgtctgcagcccatattttcaggtgtggcctgtcatgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttcaaggtccttaagcacatctgttcaaccagtgtgcgcatggggtatgcccaacactttggaaatttctttattcacaacatacaagctttttatagctgttttgctatgtgaattttcaataatgtagccaactttaggttacactcatcatattttacaaagcagtcggtatatcactcggatcatgttattcagggatttacaccgcatatgctacatattaatatcaagtcgcttagttaactataattatcgaagccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggctttggagtaatctggttcgagagaagattatcttttcgactgtgaaggtctcaggggctactgtggagattatgggtaccctatacccacacggcatggttatccgactagttataggggataacttatatgtatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 27222 - DNA, 1501 bp, Oryza sativa
atttcatatctataatattccggcatcgtgacatactttttgccaattccatcatagttactgtatttaatgcctaaatggaatccgcgttcaccatatggaaacaacaaaggatattgcaatgccatataagatggatgcaagggagaaatctggcacaggccacgacctttatcgtagacaagcacatcaaatttgtattctttcgcagaaaaatcacctactataatagcagctatttcactgttcgttggtaaattgtattgcacatcgtcttttgcattgcaacctaaaaggcgaagtgtcacttgctgattgccatgctgaataacacgttctctagcatacctaaagctctggacaagagtattttcagcatcaagcatcgatgatagggcacgaattatctcaggatctgctttatctgaattatcaccgtcgttttcaaatatatttaatcggttttgtaattcattttctggatcatacacatataattgcgcaaatttgggaggtgagccacaggatggcacaagagtaccaatcctatggtgcacaactccattgatcttgaatacataaggtgcatttccagtgttaatcgatttatcaatagctgcacccattgagctgaaagcaaacatcgaattatacgatcgtatttgcctcaaaaaatttttcgaacgtgcatcaccattatagttcaataatgatgctagtggctcaggaggggcacgcagttttggcaattgtatgcgtcctcctttgcaacatagattgtaaattatttttctttttgaaatagcagatgcactcttgaccctctcctggtaccagaacatggcaccacaatacgggcattcatacgtcggagggccatagtatgatctgtctgggtatgatgctgccacaaaagcgctggacaatgtcaaaaatagtctcgtgtaaaaaaacaatgcattacgtgcacgtattcagaacagcggccgaaccctttagcaatcggatatactccttgtctgtccgggaggaactaccgttggctcgtgcagtgtgatttgctgcgaacaaagacagtaaaacagcctatgaacctaaactgcacgaaaaaaaacaagcctaccatcacagacaacaaaaagagcataccatccacattggccaaaggaacggacggatccatctttgaacgcaggagggaacgcctttgcctatttaactttgccagctgaggtgcaaaatccatcaacgaacatttcctcttgcaccgactttcctgatggggctgccctagcggaacgatagcatgttctatatgcattgcactctgttgggacagaacatttgtggcccttctctgccggctggcacgtaccctacgcactctatccatagcatgcgtttctaactgccatcataattttacagaggcaagaaaagaatgaagcaaagaacacgggcaaaaaaagtggctcaaaccacacagatacagtgaacgaac

SEQ ID NO: 27223 - DNA, 1501 bp, Oryza sativa
aaatatatattgttttacttaaaaatcaagttcggtagaactcgaactgagcctgtctaaaaacgagctcgagttcaaaccaagcctgccttaaagctcgaatattttataggttcggctcgagcttgtatcgagctcgagcctaggcagacgagatcgcttgagctcggctcgttgacagccctactaccacgtaagaggggtgtccctcatcaatgccggtttgaataaacttgacaccaaaaacaaaaaaaaaaacaagttcaggttatacacatgctaattcacccggtactgatgataagacattagtgtcgggtcttataatattccggtactgactgttcggcgacacattattgtcgttgtcgggtcttgccactaagcaccacgttaactagctgtagttgaatttgttttatctcgttacaatatttaggagttgaatttgaactttcatatttataaactgatatatcacatggtaatatatctttttctttttttaatttttgtcataattatttgagttacatataaacaacgaggtaacatccatttaaaagttcaaaatcgagaacgacgatgtatcccggtggtagattgtgtgcctatcaaaagggtagaaaatatttaactatatgttgtaaaccacaaactgtgactaaatattaaaaaatacatgcagcactttgaaaacagttacggatatagaataaagaaaaatgctatgtttgtgattattattttcgggattgctatctgtcattcgaatgaaatttagggatgaaatcttacagattttggaccattggatccatgccaagattcgtgccaccggcttctctcctccaactctggagggctctccttcttctccagtgccggtgacactccaactccggcagggagcatacgggttagggtttggggttggggtcaaggtaggaggggggttggggaaggggaagaggggggtttcctcggggcttagagggatgaccgtggacgacggaggaccggcagtgggcggtggactttggcaggtggcgaggcggcggcgccgccgccgaagccgcagggatggaggagggtggtgagccggcgtcggcggtaggggcaaagcaagcgtgtggttaggaggtcacaggtggtggttccagatccgttagcggggagccgttggagaggtgggcggtagggcggtggtggcgggggatcgcgcgaggacgggaggagtggtggcggtgtgatctgaacgcgggaggaggagaggagttagggttaaaggggtctgcatgaatcttgaagcatattcaatggtccaaaatttgaatattaggaggtgggattttctgtcactagatatgtagaaagcccctatttttttttaaacggaatggttttctggtcattgagggatatacaagtgttggagctctcagacaccaacttaccgtcgttccaagccttgtttctgcaggcttagctatggccacca

SEQ ID NO: 27224 - DNA, 1501 bp, Oryza sativa
cgaatcttttgagcctaattaagccatcattagcacaggtgggttactatagcacttattgctaatcatagactaattaggcttaaaagattcgtctcgtgatttccattcaaacagtgcaattatttatttaaagctccatgcatgtgtccaaagattcaccgtgatgttttagggaaaaaaattggtaactaaaccaggccaaacctaaccccagcctagataaatagtatagaggcaaaacctattattttaggaaggataacggatctaagagacgtacgggggtgtttagattcatgttgtaaagttttggcgtgttacatctgatatatggatatacatttgaagtattaaacatagactaataacaaaacaaattacatattccacctgtaaactgcgagatgaatttattaagcctaattaatccgttattagcaaatgtttattgtagcaccacattgtcaaatcatagagcaattaggcttaaaagactcgacttataatttacacgcaatctgtgtaattagttattttttcgtttatatttaatactatatgcatatgtccaaacattcgatgtgacatggtgaaaaattttgcttggggatcttaaacaccccttctttccaccatgcttctttattggagttgacttatagaggttggtttttgccttgtagcgagtttgggaggcctactgtctctggctgcaacggatcacggtaaggctccattcaaagaaaaagaatggaatacgacgaggcggtttttggcagatcacctagaatctggtccgactaataagtactggcaatcgatagtagaagttctttaaatcatctataatcaatagtatataatcaattttaatagtatagtcaactactgactccaaatcatatataatcaattcatacaatagttacatactacactattaataactggtcccatatatcatacacatattgtgtcttggagtccgtgctacagctggctataaatctatagctcgctgctcttctctctcctcttttatctccttaaaatatactccctccattccataatataagacacaatcacttttcttagatgttccataatataaggcatgtacaagcatacaattaactgtgacatcttctctattaaattactacttttttaaatcatctactctcatgttatctaattctattggatgcatgcattatatttattaggatgatccgaacaacaagatgagaataattatttgttggtctttgggttatgggtggttgtgccttatattttgaaatggatggagtatttgtagctggctgatagcctgctattgtatctgctctaagcagagagaagggagaaaaagatggaggagagctgacagccaggcaccacttaaaaactattgtgtgttataattaataaaggtgtcagggttacggataaggtataccctctacctttggatatacgtcgtgtattgata

SEQ ID NO: 27225 - DNA, 1501 bp, Oryza sativa
actttcaggtctccccttatttactgaatgaatggactatatcaaagtcgcaattttagaaactagtatatatatgtaatatcccatgcatctcacgaattaattaaccacttgaagatattttactaaaagtgtcggaatgtcgttctatatacgtctacacattaatccaatatcttgaacaattgtggaatggtcatcctagctatacccaaaattcaccattccctgtcactgttctttctaaagatttttgcatcacgagaaaagtgagattttgtttttgatgggtgatcgagttaggtgaaggccggccgaaagaacttcaccagctcagggaatatttatgtttcagttctgagtttcataccgaggcactctttgatttttaggaaaaacaaataaaatttggaggattttaatcgtaagataaattccttggaatgtctttgaaacaaatgattgatttttttaatattcttataaaatgatcaatcttatacatattttggaagaaagttggcaagaacttcaatctatctaaaattttattttgagtatatgtgtttcatcctattcctctatttttccctgtgttttactgaaacgatcattcttgtattttttttctcttatgttttataatactttgttttgcattcgttttctcaatcatgtgtttcaaaagaagccctgaattctttttttttaattgtttaagctattttttatttttacttgttattttgttaatatatttattcctgtaattacgtagacatataatccactagaataatccagtcaataatgttttcaaactgcacaataatgtattgaaataagatattttgcacgtgcatgtgggcatgttgtttttcggccattccagtctgtactacaaaacaaggtaagcatggatgaggagatactccctctagtaaaaatatttgatatttgactggacggagtacttctatttttctttttgtttgttttatgttgttaagcctttcaaattaatgagcaggtacagggggcgaatatatcatctctactttatcaacagtggtcggccatggctttatatcatttgagagctggaactctcctatataagaacaatcatgtgtggcaaaatgtgtaatcaggtcagcgtgtgcagtgagctgtgtaggaggaagcaaaggaaagcaaagcaaaggtaggaaggaacaaaggcatctcagagaaagctctttgccagcaactcccacacactaatccttagctgcatcactgcatcctgaccttgatgtgcacaaattgccttctctgattctctccctgcatcctctgtctatatataagcagccattacaaatagcatgtcaccaaattacccaagctagctagagattacagtacttgatctcttatctctttccagggaaaagtttcttctataattaattagtagagtttgcacttgattagtaactttcattagaggcaaagttga

SEQ ID NO: 27226 - DNA, 157 bp, Oryza sativa
tggtgtggggaggtttggagatgaacgggggcttttataggactttgggggcaaatggtcggcctaatgatgatgtgacggcggtgcacgggctcggaacgacggcgacgcgcgcggcgcgaggcaacgcgacggcggcgcggcgcggcagcggcga

SEQ ID NO: 27227 - DNA, 1501 bp, Oryza sativa
ccgaacccagttcatcctcgtatcctttttcatttttttattctaccttcacccctgctatcttagagaagtattcctgtcaactcttctcgaccatggagcaacctttgtttgagctgtctgctcctcggggtgaattctatgagccacctccttcatcggagcccatttatacaactggctatgaaattcgtcccgagctaattagtatggttagggaaaatcctttttctggccttgatctagaaaatccctaccatcatatgcgagactttgaacaagtctgctcatgccttaagattcgtggcatgagacaagaaactgtgcggtggaaattgttcccgttctctcttcaagagagagcaaagcaatggtacacctctaccgttggatatgtaaacggtagatgggaaaagcttcaagacagattctatcttgacttcttcccagttacccatattactgcccttcgagtagaaattctcagtttcaagcagatcgaaaatgaatcaattggtgcagcttggtccagattcactaatttagtgcagtccggaccaaccctgtccttacccgagtatgtgcttctccaacatttccatacggatttgggtaaggaatctgcattctatctggacataaccgctggaggatcgttcatacacaaaacaccgtcaggaggaaaaacgatcttggattgcattctagaaaatacttccttcatgacgcagtccaatgaacctcggccggaggcatccgtgtccaagatagaggagcctctaacgatcgagccacttgctaaaccatctacttctgctagctcgattgatgagaaggttcctgagcaccgtctgtcgagaatgaagaaattcagactccggattgtgccgcaattatgttcagggaaggttttgacgaagactacggcaataccctgaactattttagcaagaggaaaccacctgttccgttgtcacctcccgatcctatggaacttgggttcctgcgagaaactgtccaggagttgacatccataatgagagacgaatggctaagggaggcagagctttcatccgaagtaattcggataaataccgctcccgaatcattccttgccatctggaagggaacgatgtcggtattctctacagtccaactgtcggggccaacctcgtctctgagtcttttgcattcgcttatttaagtgataaggcagtgacctcgacaaacaaattcttcaagcatccgaatggaaatatgatcgaaggatttgggattgtgcaagatgtgcttgtctgctttgaagacagggaggcgatcttggatttccacgtctttgaagtccaagactttgatatcctaatcgggctgtccattgagaaacttctcatcaacacaccccgattaggtagcctcaaaataacactgggagagaatgaattctcaattctattttcgcgggcaaggatcaccttgaccgaccctctcccagaaattgagt

SEQ ID NO: 27228 - DNA, 1501 bp, Oryza sativa
ttgttgttggaacctatagttaccaagtagtacatcgtatacaacaactagttgagtgagactcttacctgaacataagtgagaggatgaaggtgaacaggggagttatattaagaaagataacggaataggatgatgtggtatccttgaggccatagtagtagaggctcattggcacagagtacctgcatattttggcatgtcagaagaaaaactaaaaataatttgtctcaggaagtaataaatagccatcaagaaattggttattgagtataatcaaattgatggttttttagtgtttatccttgcttgggttgatgttatttccccttctctatcaataaataaggcaatgtcttcatctttgccttttctatttattttaaataaaggtggctctatatgcagtagagtctttcaccaaattgctactattatcagtaaataaatatcttattattggaggctaagtttttatttatcacaacaactctgaacagactaatggtctatatttgtatcattgtttttgaaaaaaaaatctttcatcaaagtttatgctgttatccttctaaggaagctcttagcagatttatgagttcatttttgttgttgaagcacatatctagagtttgcagctttgtgcaacaaatccttctaacaaattatgtgcttgtgtactccctctgttttaaaatatagtaacatttgtagtaaggtaactattttaagaaggagcgaatacaaccaaaatcagaaggtgtatagtcaaaacattttaatgttaataaatgtgtaattattttcttctgtgctttgccagaactattttgagagaaatatcagagtatatataatcaagaatattatcaacctctgctttaaaatatatgcttttgtgttacataatggttttgcaaagatgaattacatgtgcaataggctgcctggatgcacagacagagggaaacaaacaaaaatctaaaaatttatatatgcttttagtgttacataattgttctgtaaaattgaatcctatgtgcaaaagcctgtctgaatgcacatggttagatggaaatagagggcaatccgaagtccaacacagacctggaactggaaggacaagtgaaatcaatcttttccataagggaagtgatgaagttaagaaccaagaagtgagcactctgttctaatgctaagttagtgtaaatttatccttctccctcccaatttacttgggtttgctatcgttgcattggagaaaatttcatatctagagttgttaggaggtggagctggcatatttatacaatcatgcatgtttttgaaatatcatcatatattaatatcatgctgcggtgcttcctcagtagtctcaaaccaattatttttttttaaaaaaatcctccaaataactaattatctaaaattgtctggtctacacagctagcttattggtatattttacaattttctctcacgtaggtgagttgcaacctac

SEQ ID NO: 27229 - DNA, 1501 bp, Oryza sativa
atgaaaagaaacatgatatctagacaatcaagccattgactgaatttttagggtggtagatgtctaagctaatctaatctagcaatacgatttagcagataccggcagaaaccctaaagcgagaagcagccaatagagctaaattgatatgctaagactagattagcggagacatataataaagatggtcacgatataaggactaaaatatctaaaacgacatagtagccccgatagcacaagccatcgagatgggttacctcttgcgaagcgaactcgtcgaaaagtaaaagcgaaaagggtggcgatgcgctgaagttgtattggattgtctcctgtattacaatgttatgaggttcatatttatacccgagtacaaacttagtccattatggacacgactcgaacctttctaaagataaaatacaaacaagactataactatcctaatcaatagatacaattaccttaattgagctctatctctgtttgggaattgtttgggaatgatggttatcttaatataggcccatgtcgaccccaagttatctctatcggctgtttgccatatcggccaaatcaagcctttgtccagtttttagccgatacgatactcagctgatgcacagtccgacttggagataaactcgaatccacaccaaatctgcctcgatctccttccttctctgaatctgatgcaaaattccagtgttaacacacatccatcatagaatctgaagaaccaatctttgaagccctcaattgattaattttctctaggatacacaatggcagcttccccaaaggacatgcaccttcttgtgctgacatcttcatcatcagtataagttgttgggaaagctgacaaagctaatgatggccttgtgtacatgttaatccacagctgcatgaaccaccaaggacctccataattgattactttatcttctaaatattgcaagcaacagagtgaagcattcgataaactgagccaagcagatatttccttagaggaatatgcttcttctaaaccaaaaattgagcaaagtgctgatagtttgcagttggcccataggttgaaccacataatacatctctttctaaccacatggccaggaatgcaacatgttcccttaaggaaacagatcatgtgccttgatattctgctatgtatcctttccaacctccatggatctgttttacacttaatgtccagtttgaaggggttgatggaagtcgtgacattcagacttgttagcatcttgacatgtaacaacgatggagtcatggggccttgccagaataagaaacaattgagtgtatttgaccagaagtaggccgcagcagatagcatcggctcattcttcttgacgtgtaataccccagaaatatccacaagcctaggatgccactaaagaaacctataaaagtgccaaaacaaagaaatttcggcaacacctctttatacacacacacaccatggtgccccatatgagtgtca

SEQ ID NO: 27230 - DNA, 210 bp, Oryza sativa
tagacacctgcgaaaagtttcgaccaagcaaccgatctttccgtcacctcggtacgtgttcaatatgttgcgcatatttgatctgttcatgttatactgtgtagtttacatgtatagatctaatgatgcgttcatgctagttttcatctgtaatgtcatgatttatttatggaatagattaaatcattatatgtctataatctcaacaac

SEQ ID NO: 27231 - DNA, 907 bp, Oryza sativa
gatcgagcgccgccgcagcttctcctccacatcgcgcgcgtcgccatcgctgccccctctccctgtgcgcatcgccggcgcctcctcctcaccctgttcgcatcgccggcgcagccccctcgccccgcgcgtgtccccgcgcctccccatcgtcccgcgtgtcgccggcgccgtcccctcaccccccgcgcatcgccgacgccgccgtcttgcgctcctccaccaccgccgtcttccgatgtggatcttgaccggaagaactccgggaacaagggcgaggctgtgaagcagggggctggtgccatcaaccacatcggacttccgtcgttgctgtcatctatcaatcacctcgccggtgagaaccctccccctactgaaaccacctctctttataaattgtgaatgctgatgagtgatgatcctgtgataatcttttcattaacaaatcatgaagtagcttatactagtgaatctcatgtattcatcctgcctcatacatgttttcttcataagttcacatggttatgtagaatatattttcccagattgcaggaaagttgaatattagtgaatattttttttgagtgtagggaagtttgaccaactcatttttactatctagatttttagaattttgatttcttttactgccaggtgatatatcattttccacaatgtaagattggaaaaaaagttttgtgtaaaacaacagatacatgtaaatatccctgaatggatgcttgatattgtgttctagcaaatcacttaggtttagcaataaaaaaaatatgtactgtgtttattttagtggtagcttgatgtattatgcgtgctagcaggatatattctggacatggttaatgcttttgttttatatatttgtagagtgctatggctcgccttccct

SEQ ID NO: 27232 - DNA, 1501 bp, Oryza sativa
gaaaaactcgggaaagtttagatcttcgccggaaaaaggaaaggttgaaccgcgaaattggaaaggatttccatataaacttttggggatttcttggggacaaggaagaggagattgagaggattccattcccgcaaccaattcggaaataagagcaacggagaggttggattttggaaggggatcggcggcaacaggcacggcatggctcggctctggctctggctctgtccagagctggaagatgaacagtagcgcagggaaggaaagtagacttcttgccgggcttttcttttcacagcctgattagaagagggagcaaaaccggactttggctgagagaagaagagaggatgcaggctcgggttgggccggcggaagagagaggaaggaaaggaatgggccgattcagcctaagacaagggaggagaattttattactttcccaattaaaataatcacttaaatgatctttgaattgttaaaaatacttccaatgcgcaaataatttcaagaaaaatcctgaaaatacttggacactcaaagtacttaacaaaattacaattagaccatttaatgattaatttaatatgtgggtaattactgaaatgctctttgtatgattaaaattaggaattgagctccgaaaaatccgagaatattccagagagtataattaactatggagaatttaataaaaaattaaatccatccatgctttatatttaggaaattttatttcccacatttaacttcacttgtaaattaatgaacatttaatataaattctaataatcatttattaaataatttataaatcctgaaacaaaaatcaggatgtgacaaatctacccccttacaaagaatctcgtcccgagattcggaacggctagaaagaaaagggcataggtaaactgcagtctaccttattattccataactcagataattattctaaggctttaaagaaaactactgctgctttgaaactggtggctgagctgtaacacttgaagacgcaactcttgaagacgcaactggcactgcattggctcctgtgacgacaatgttgttgacttgcggctgctgatgctttggcttcggacactctcttgcaaagtggcctggcttgtaacagttgaaacatacctgctgctcccttccactactgttattctcttgagtctgatcctgctgaactagcaccggctgattagcttgctcgatgttaactttattgctttcattagtctctgatttgatctcaccaccgatgttcaactgttgcgactgtccttgacctgcagaagaaggttcaccaatttggagtggcttgatacgctgcctctggctactaccttgtgcctcctggaatacagtcattttccttttacggttatctatcctgttcttcttgtcttcaagtcgaattgctttgtcaaccagctgctgaaaatcaacatagtcatgagagatcaatgtaactgacagttcatccttc

SEQ ID NO: 27233 - DNA, 1501 bp, Oryza sativa
gaatttgtgaccaccggattgtcttgagatttgggcggcatacaaggaaaaaaactgcaagtcatccttgggagggagtcaaacccacaacatgtggcttcaaagcttgtgaaggtagccacaacttccgggggtaaattttgacaagttatgtataaactagattgcaattatagtaattattgtgtagttataatttaattacatttcaaatatgctatatacttatatttggtttaatgttgtttggctgatcttcaagtaaattatcgaatgttgtatggctgatcccctatgaaattacctaattgaagttcatggtagggataaaccactttcataccgattaaaagtttaaaacaccataaaatatattatggatgttattatttttttaaaaaagctaaggatgaaaaaaaaattggttctgtgttggaagtgaaaaatatattttgagcaaattcaattaccaaacatagacttttttccaataaggataaaatgtgattatatatttctgacctctggatactgtgcacacacaaaccaaccaacaaaaaccattgtcccctgtttgatcaggatgatgacttgcatattgtagcatccatcttgacatcgaatccatgataggtaggaaccacagctgcatgtatctcactactactccactcatcaacggctggcttttgacaattaagcgacgatccatggagcgcgaaaatagaaccgctcttttggaaaaaaaagaaagagagatcgagatcgcgtactgcgggtctgtttggttgttgcctaacattgccataactcagtttgccataggtgtggcatggcaaacaaagtgtggccaacaatttgttggccacaagtgtggcaatgtttggctagaaaatgagtatatgacatgtagacccatgaaataagaaagtgtggcttgccacaactgaaacaagcaaccaaacgctaagctaacaatctgtagcatgcctaacatgtggtgtggcaatgtgtggcaccaaaccaaacagcccctgcatgcatccggtggcaacgacggctctgacgacgactcgagaggatattaatattagtaaagccggtggctatatagcagcgcattatggctgtccctcttgcccatgatcaatcattgtgcatgcatggcttggcttcttatatactccctccgtttcaaaatgtaagactttctaacattgtccacatacatatagatattaatgaatctaaacacacacacacatatatatatatatagattcattaacatctaaatgaatatgggtaatgctaaaaagttttacattgtgaaatagaggtagtactagcttaactggtgccctgaaaaaaggttgatgcttttccacagaaaaaggagagcttggatcgatcctttgaggcatctggccaatcttgttctggcttatgcaacaatcagggtgtacacagacacaataattaactttggagctttctctaa

SEQ ID NO: 27234 - DNA, 1501 bp, Oryza sativa
ttattctaaggctttaaagaaaactactgctgctttgaaactggtggctgagctgtaacacttgaagacgcaactcttgaagacgcaactggcactgcattggctcctgtgacgacaatgttgttgacttgcggctgctgatgctttggcttcggacactctcttgcaaagtggcctggcttgtaacagttgaaacatacctgctgctcccttccactactgttattctcttgagtctgatcctgctgaactagcaccggctgattagcttgctcgatgttaactttattgctttcattagtctctgatttgatctcaccaccgatgttcaactgttgcgactgtccttgacctgcagaagaaggttcaccaatttggagtggcttgatacgctgcctctggctactaccttgtgcctcctggaatacagtcattttccttttacggttatctatcctgttcttcttgtcttcaagtcgaattgctttgtcaaccagctgctgaaaatcaacatagtcatgagagatcaatgtaactgacagttcatccttcaagccttccaagaacttctcctgcctttcctcgtcagtacgcacatcttctggagcataacgtgccagacgattgaactcatgaagatactctgccacggtacgatccttttgcttcagtgtcctgaactcacgcttcttcaaagcaacaactcctgcaggtatatgtgtcttattgaatccttttgtaaactcttcccaagtgattggttgtccttctgctctgttcatccggaaatgatcccaccattctgaagcaggtccttgcaactgatgtgaagcgaaaacaactttctcctgatccgtgcactggaggagttccaacttctcaacaacgtgcagccaatcacctgcttccactggcgcgagtgttcaccatctgttgcagattagagaagataggaggataagggttacactaaagacaagatcttaaccagtttaacactgatctgatgtgtgtagaccattatattgttcaagttgattaagcaagcaacctagtatagttacacgctcatcattgaaccccaccaatgacgggaatgcaaccatacctacacacaagcaagcaacaaacgttctaccctactaactattcttcaaggatagtttggcggcataggttctaaggtaggattcaaacttcattccatcttgaccacttggcacttcggtccttcctcgatccacttgactgacctccataagttgaccacatcaacatcttctagtttcaacaactagtttcagaactactcaagttgaaagcaggaggggagaggatgataaaatgatttatagagaattctagagaaggaagaaaggaaaattttcacaaatcatgttttcggaaaatttgtccttaaggttattttcacaaatcatgttttcggaaaatttgtccttaaggtttgaccatttggcttatcctacagtcgagatggctc

SEQ ID NO: 27235 - DNA, 1501 bp, Oryza sativa
taacaaatgggcgtatgccacgtagcgggaacagggatgggaacacaaaggcacagcccgagagaggcgtttttgttggaccaattttgcacctatccgataacagcgagaaatccgttcgttttcgcagcaaatcggccagtctggactctggaggctctcgctcgctcttatcgatcgatacgaccagaccggaggccatctcactccagagctcgcgggattttttgacttgaaaatagcgtgatcgcctctcatgtcatgcagatatcgtgatgcgtgagaagaaaccgtctatcctcctataaactctcgagcatgcagtccgttgtgcattcgtgcaacgcggttaagttagttgttgttgcgatccatagatagagctaaacccctaactagtaactacccagagagaactgataaggccagtgtcgagctagccagctgacggccgccacagtttgcttgatcaaggctgatcgatcgatcgatggacatcaccggcgcgggcgctatgggaggaggatccacggccgccaccgccgccgcggcggcgggggccgggtggaagacgccggtgtcgatggtgctggtgcagctgttcatcacggggcagatcctgctgtccaaggtgtccatcggcggtggcatgttgatcttcgtgctgcttgcgtacaacagcttcttcgccgtcgtcttcctcctccccttcgcgctcatcttcgagaggttttaatcttctccggtttttatttgtgtgtgttttaaagaaattttacgtttcttaataaagtacctcgaggtacctaaatattacactaaatattacctaaatccgaaggtatcaaattttacaccagaaaatatgtacatcctgataatttctcaggatgatgaaattatccgtgtttttatgatcagcttgccgtgaatatttgcagatttcgcatcttcagaatatttttttctcttcggacaaacattttacaaaactaggatatcggaatgagataatttatggtcatccattagtgactcttttctaaatttattgaaaaatcattttgtaatgtcaataattataaaatgtatgtctagtttaagttgcgaatcaattgattcaataatgaataacaccacatgtatacttctgatcgaataaatggataaccctggaattaatcacccgctaagaatactgaatgtgattgtaattaagaaaagtaattagcagcggctgtatgcattctaaaatcgggtttcatggtgaaaatttaatatgctgctaatttggttttgtgtagaggcaagtggagggacatggattggggtgcattcggatggatctttctcaatgcgttcattgggtatgtacgacatgtgtatctgaaccttcaaattcagtcaaactgtccataattatacttattatttaggaacaagtccaaataacccctaaacttggaactgaagttcgtttagcaccctaaactttaaaacc

SEQ ID NO: 27236 - DNA, 1501 bp, Oryza sativa
tgctatgtgtatagcctgacgcgttcagcgctctggtttgtcatttatgagctatattttgaccttgtacacctgcttggtgggtggagcccataatttattgagttaaaagtttattgtttttttggagtgggtatagtcagactggtgatcaaggtatagtttgattcgcacacacaccagttgcccaaatattatgtcagtaaaaacaattgctgctctgatatatcatgatcacctcatgtaactctgtatccttaagagctaccatttggtactgacaaccctcccacggttttgctgctcgtcatatctattcacttgttgtttactttcctctttttatgtttgcagccacctgagacaaagggtcataacctcacatgctgtagcgccgctctagcggcgcaggcttgtagagcgctattagccgtacaccatgagaaattggaggagattggacttgaagcggtagcgtgcatgtctcttgaaagccttgagcagccagacctaatacgatggctcatggacaggactaatcccgtgtcgcgcccggaaaaataccttctccagaacgctagtgtattaatccccgtcctaggaaaagccagggtacaccaaacaaacatgataaaaaaggcacatctttattatatcgataatatttacattattacaaaggcatttcaggcctgacaaacaaaaataaatagcagcggactagtgggcctacggctctatcttcataggcgctcaactggggtataagcgaggactccacccaggacttcttcttcagagcttctcttattgaaggggggggggaagatagagcaagaatgagtacaaccacagtactcagcaagtcacacaaggagatgcatgattaatgcaagggagtacaaggggtaataatataggggttaagttttgcagtaaacagcatttaaaagtcacttagttgcccaaagctattttataaagacgattctagagctacacaatgttattattcaaggccgtgaactcacacgaacctgtcttaacccaagacctacgatgattcagaccgaactggcaaccagacccaggtcccagctcgtcccaagccaacccaggccaaccattctacattttagttgttaagcaggttttaagaattaaaacactaacttgggtacattgctaggcttgcccataaccgagggcgcagctattcgaatagattatactctgatcagaggtgtacatctttacccacaagacacgtcttcctcacgtgtaaccacgtgccacataccaccacggcatacggacggaagacgtgacatagttcccaacccatcatagccataaacaagagtaccgacccaacctcgcctacggccggaacccccgagataggtaggcaggattgagcccctagcagcaaaacaccgaccctgtgccatgacatctagactaccgagccgcaactcgtgtagccttcatttgtcctaga

SEQ ID NO: 27237 - DNA, 1080 bp, Oryza sativa
tcagccaaatatttcaaaattaaactcaaattcacacgaacgagtttgcttcttcgattcttttctggtttattctttctatgttggttcgggacctagtacttcttcatgtactattatgcaagtgtccgatccaaactcctgaaatgcattcattgattctatcttcaatgcttgttaatattcaggttgagttcttcttttcaacttctaattcatttattcaactcctggttgactgccattgagttttgttgtctaaaggagacattgcccataatcgatctcattgccaacttctattggttgcatgagactgtatgcgaatatccatgcatatacaaggagatgcattttcatatgcttcttcttctttgcttaatatttcttgatgtgggtatgtaccagcgttaatgtgcactccaacagctagttttcttccttcatgggaaggtgcggtacgcctattctgaggttccatactgtttgccagatctcaactagctccccttctattcggtgaggtacctttcgtgactttgagtatgatagtccctcttgccctgatttcaccagacgtctccgcttactttaggggcatgaggagccggagtttcttgtccaattctttttgttcgaggcctctagataagacgaggggtacctttactttctttggtatcaccctcctccggtgcatttcgttcatgcaacttagtcaaaatcttcgaaatcacaaaagtatttacaaagtgatttggcagttttaattctttatgcaaactgcattcactagtgtggtgtaacatgcattagtcccggactatcacatttcctgacatttcctatctaagggtacattctttccccctaaatgattggaaataattcttatttgtcaaggaatttaggcttcacaactatctccgtaaaaggtttccgactttcggagagagccttttgcaacgtattatgatagtgggatatgcacataaaccaaacagatgcaatagcactagttgcaggatggatgttcatgccgatggtctgaatttgcttccagagtctgctgctttcagg

SEQ ID NO: 27238 - DNA, 243 bp, Oryza sativa
tttgtgagcttccacaatactgcatcttccacactccttagtccttactgagtttgcatgccctgcagctcatccctaagggagaaattttccactaccgccctgttagatagtgcatctcaaatgtccctcacccatctgtgattgatcagtccttgttccacagtcaacctagttccgtcgacataactaaagagaacactggtggagaaaccctttgtagtcccggttcgtaacccccct

SEQ ID NO: 27239 - DNA, 1501 bp, Oryza sativa
gtacacctctaccgttggatatgtaaacggtagatgggaaaagcttcaagacagattctatcttgacttcttcccagttacccatattactgcccttcgagtagaaattctcagtttcaagcagatcgaaaatgaatcaattggtgcagcttggtccagattcactaatttagtgcagtccggaccaaccctgtccttacccgagtatgtgcttctccaacatttccatacggatttgggtaaggaatctgcattctatctggacataaccgctggaggatcgttcatacacaaaacaccgtcaggaggaaaaacgatcttggattgcattctagaaaatacttccttcatgacgcagtccaatgaacctcggccggaggcatccgtgtccaagatagaggagcctctaacgatcgagccacttgctaaaccatctacttctgctagctcgattgatgagaaggttcctgagcaccgtctgtcgagaatgaagaaattcagactccggattgtgccgcaattatgttcagggaaggttttgacgaagactacggcaataccctgaactattttagcaagaggaaaccacctgttccgttgtcacctcccgatcctatggaacttgggttcctgcgagaaactgtccaggagttgacatccataatgagagacgaatggctaagggaggcagagctttcatccgaagtaattcggataaataccgctcccgaatcattccttgccatctggaagggaacgatgtcggtattctctacagtccaactgtcggggccaacctcgtctctgagtcttttgcattcgcttatttaagtgataaggcagtgacctcgacaaacaaattcttcaagcatccgaatggaaatatgatcgaaggatttgggattgtgcaagatgtgcttgtctgctttgaagacagggaggcgatcttggatttccacgtctttgaagtccaagactttgatatcctaatcgggctgtccattgagaaacttctcatcaacacaccccgattaggtagcctcaaaataacactgggagagaatgaattctcaattctattttcgcgggcaaggatcaccttgaccgaccctctcccagaaattgagtcagcggaagaggttactgcagttcctcctcatgagtctcccgaggcccttctggaagatgatgtccccgacttcatcaaggaagaagcagatcccggtgagactctcgacctgccaatcatggaaccgtcacctcgacctccgcttgagcttaaacctctacctccaggcctacgatatgccttcctacacaatgacagagaagcccctatcataataagtgacaagatctctgaagacgagactcaacatcttctcaccgtgttagagaagcatcgttctgttcttggctactcgcttcaggaccttagggggattaatcccgcactttgcacccatcatattcctattgaccccgagagtactccctctag

SEQ ID NO: 27240 - DNA, 371 bp, Oryza sativa
tgaattctatatcggctattttattcccgaagtggaattttttctcctcctaagatgtttggcgtttcctaagaaattttgtgatttaaaattatgtcctagacttcatctaattattaagttcttaattatatctaaagtactaccggcaaattgattccttatggagatgactaagaattaatctataacaatctataagaattcatctaattatattttcattaatcctataattaaatgctaatatttttaaatattttaaatctccccctaatttttcctttcttttctctccctctctcttttcttttcttttcttttcctctcctttctttcttttcctctttttcttttctttccctcccagc

SEQ ID NO: 27241 - DNA, 1501 bp, Oryza sativa
gggtaaggaatctgcattctatctggacataaccgctggaggatcgttcatacacaaaacaccgtcaggaggaaaaacgatcttggattgcattctagaaaatacttccttcatgacgcagtccaatgaacctcggccggaggcatccgtgtccaagatagaggagcctctaacgatcgagccacttgctaaaccatctacttctgctagctcgattgatgagaaggttcctgagcaccgtctgtcgagaatgaagaaattcagactccggattgtgccgcaattatgttcagggaaggttttgacgaagactacggcaataccctgaactattttagcaagaggaaaccacctgttccgttgtcacctcccgatcctatggaacttgggttcctgcgagaaactgtccaggagttgacatccataatgagagacgaatggctaagggaggcagagctttcatccgaagtaattcggataaataccgctcccgaatcattccttgccatctggaagggaacgatgtcggtattctctacagtccaactgtcggggccaacctcgtctctgagtcttttgcattcgcttatttaagtgataaggcagtgacctcgacaaacaaattcttcaagcatccgaatggaaatatgatcgaaggatttgggattgtgcaagatgtgcttgtctgctttgaagacagggaggcgatcttggatttccacgtctttgaagtccaagactttgatatcctaatcgggctgtccattgagaaacttctcatcaacacaccccgattaggtagcctcaaaataacactgggagagaatgaattctcaattctattttcgcgggcaaggatcaccttgaccgaccctctcccagaaattgagtcagcggaagaggttactgcagttcctcctcatgagtctcccgaggcccttctggaagatgatgtccccgacttcatcaaggaagaagcagatcccggtgagactctcgacctgccaatcatggaaccgtcacctcgacctccgcttgagcttaaacctctacctccaggcctacgatatgccttcctacacaatgacagagaagcccctatcataataagtgacaagatctctgaagacgagactcaacatcttctcaccgtgttagagaagcatcgttctgttcttggctactcgcttcaggaccttagggggattaatcccgcactttgcacccatcatattcctattgaccccgagagtactccctctagggaacctcaatgatggctcaataatgcaatgcgagaggttgtaaagaaagaggtcttgaaactcctgcatgctgggattatctatcccgtaccatacagtgagtgggttagcccagtccaggttgtgccgaagaagggaggaatgacggtcgttgcaaatgctcaaaatgaactaattccgcaacgaaccgtaaccggatggaggatgtgtatcgattacaggaaactcaacaaggc

SEQ ID NO: 27242 - DNA, 1501 bp, Oryza sativa
aaattttatttcccacatttaacttcacttgtaaattaatgaacatttaatataagttctaaaaataatttattaaataatttataaatcttaagacaaaaatcaggatgtgataagagagctccacggtgagaggtgggagatggcaagcggtgagaggagcaggaggacaacaaatgaactgaaacgacatgtgggcgcaaagaaagagaatgaataaagaggggagagaggagcaagctctatacccagttttacgattgagagacgtgattcgaccaagggcagtacttgagagaggtaaaatagacgtaatatcttacataaaattttatatcttcttttacaaagtataaatttaggggtatttacattccgtagttgcatagtcaaaattttctaatgaaaaaactttttgtaaaaagaaatcctagtggaagtttctatccttattcaaaagtttctcgtacaaaattaattttgtcatcaaattaaatttatctcataaaaaactatagtaagcgacttttaaatttaaaacttggtatgtttgtaataaaataacacaatttgctctaaccatttcacacgaggtacacagattatgtgtaaagcaaaataggtatacgtcgaatagtcgccaaaaaggctaacgtgcgcctacgcactagaaatagagctcgctcatcacgtatcacatgtgcatgtgtcaacgaatgcatccacatgagcggaatcactagctgccatgaaaatcggaatttgtaacaaatttgattagcgatgtcattaacgattttatgcatgactagccggacggtttctgctttctaacatttagaacttacaatttaactcaaaatttaaaaactttcaactccaaattgaattacatctaaaattcaaaactttaaactcaagattcaaaaatttcaactctttgaaaaatttttagtcaagatttgaaaacttctaactcaaactcaagatttgaaactttgaactcagatttaaaaacttttaagttaaaatctaaaaaactttcaactcaaattgaaaacttttaagtcaagatatatccaggtttgaattttttagttgaatgttttaaaatttgagttgagagttttgaattttgagatgaatgttttgaaatttgagttcaaaattttcaatagcatgttttgaattttgaggtgaaagactcaaattctaaaatacatttaaaaaattcaccaaacatacgtaaaaagaacacgggaaaaaggctcacgtgacaataagttgcgaaaaaattgaaaaaaacaattgtggaaaaaaaaagtgcgtggcagatgtacgtctgcaccaaatagaaaaccccacttgtcacccgcaaacttcatgcattaacatcaaaacccgcaaatgtagattttagtttaatttgttgggccatccacatgaagagataagattttatacattccacatgaatcagtaataaagtgtcaattcaaac

SEQ ID NO: 27243 - DNA, 1501 bp, Oryza sativa; identical to SEQ ID NO: 27198

SEQ ID NO: 27244 - DNA, 1501 bp, Oryza sativa
ttatttaccttgtctatatagctaccatcaaaaaacactccttttctcctgcctaccagcagaatggcatggtttccattctgattaacgaccatgtcttctggatcctacacggcacatcgaaccctcttggccttgctgccagcaccctctattggttagcaactagctaatgaataaaatcagacagaccaggaaatataatctagaacaatcatcattctcttccctgaccagtatatagtttctcatgcaagatacgaacagatttcatattcgtgtgctaatgcagagtgacaatgcagttcacacagacatacctaagtgatattaacatagcacaacggttagccttgcaacattatgatacacagatagattccagccacacaagagagcgtaggccatgaaataactccagctacaaacaacccatactaatatcgtgcacaaaagctacaaactttagtatcttacaatgacgtatgcatatatccaacacaacagtcccacacggcagtctaaccaatcaaacaacccatatgttacatacagcacgctgtaatacatgctaacatgttacggcacagcatactaatactcaacacaaaagctacgaggctacattgtatattatatagcacatcatatacaataaactaaatagttggcttcttggcatctttcatagacaactgatctttctgatgtccttgttgttctattcaacgcccaccatacttcaggctccagtcagagtcaatgctcatgcacaaagagccatcggccgaaatactgctttcctcaccatcttatacagcatacaacaaaacaggtgttacttttagtttccatatgtagttccgacatgcatttaaacgccgcagaccaaattcatacctgcaatgcgttgcagcctaacttgactttcaaaggcttctctcacaacatctggatcttcatacagttcaggatccttctctgtatgtatgacagattagtactaacatcatagatagaaaaaaagtcaattgtccaatataataaatttacaatcatacaatgaatttaccattagccacaacatctttttctggatcaacgtacggtatagcctctagattaagcatgaaaaacttaatccagactccattctctgtcccatactttatcttcaagtatttatactttgggattgattcaatgctacgagcaaatccacaaatataatactcctttttcattgcatcaaaactatatgtttgtacatcacagaaagacgatactaatctttccattttttccgggtgacacacatgctcagcgacatttctgatcttaatttcaacctttgttgtccattcttcactgcctagaccaaattcatcacaccactccatgtcagcgctaacagcaggagcactctccatcctgctaatattgtccattgccaggcagataactgatgcctccctacatgacatatccaactagaagagtt

SEQ ID NO: 27245 - DNA, 1501 bp, Oryza sativa
gcggagaaccccttctatctttgtctgtatatattactacttgcgtttctctttctttcttcccttcggtttctcctcctctcgtcggtttcttcgctccactgttctgttccttgctcgagaaactcccactcgttttgctcctgttcaacttttcgttatggcgtggtaaggcctggatcaatgcgtgtggttctcctgtccgttctgtcatttgggttttatgtttgttctctcttgtttgtttgcttatgactgcgcggctgttcttgctagcattgaccctgcaccttttgttccatttaggggaggcgatctgcatgggctgcaatggacctttaaaggttcctgatcatcttccattgcacgtgtgcgggctgcttctaagacctagcaggtacttttggttgttgctggtttcattggccttgtgttatgctttgcttcctacattcttattcactgatcatgctccgttctctgcagctctgttccgtcttcttccttgcctctgttcacagcttgtgtgttcgcttcgtggtgcgttttagtggattctgcctgtcgacgagcatattccttgctaaaggtattcccgcgctattaatctttctgtcctttatttatggttgattggtttagtattttgtttctattgcctgcattcatcgctgtctaaatctgcatgtggttgctccagagctttcggtcgttttatattgttcgttcactgtatctgtgtggtttgagccactttttttgcccgtgttctttgcttcattcttttcttgcctctgtaaaattatgatggcagttagaaacgcatgctatggatagagtgcgtagggtacgtgccagccggcagagaagggccacaaatgttctgtcccaacagagtgcaatgcatatagaacatgctatcgttccgctagggcagccccatcaggaaagtcggtgcaagaggaaatgttcgttgatggattttgcacctcagctggcaaagttaaataggcaaaggcgttccctcctgcgttcaaatatggatccgtccgttcctttggccaatgtggatggtatgctctttttgttgtctgtgatggtaggcttgttttttttcgtgcagtttaggttcataggccgttttactgtctttgttcgcagcaaatcgcactgcacgagccaacggtagttcctcccggacagacaaggagtatatccgattgctaaagggttcggccgctgttctgaatacgtgcacgtaatgtattgtttttttacacgagactatttttgacattgtccagcgcttttgtggcagcatcatacccagacagatcatactatggccctccgacgtatgaatgcccgtattgtcgtgccatgttctggtaccaggagagggtcaagagtgcatctgctatttcaaaaagaaaaataatttacaatctatgttgcaaaggaggacgcatacaattgccaaaactgcatgcccctcctgagc

SEQ ID NO: 27246 - DNA, 1501 bp, Oryza sativa
taaatatatctgggtttttttttcacttggttgcacgataaaatctcggagggaataacaaggaaacaaaatttccctaattatctggtacatgcaaccgataacaaaataatcgtctcagatgcgaacagaacctcagctcgcaaaccaatctgctacctatcaatcttctgcgcaactttctctacggtggcgacgcacacttgcaaactcaaaccaagactaatctagagcttaaaccagcacttgactcgacagtggatcaaaactcaataaagcaaaagctgaatgaaattgcgtggctcaaaactaatgtttggtgatggaagaaaaaaaaatatttcggctgtatggtagacgatgggaaaaaaaatcagaaaaggaaaaaaaagaaaaaatcagaaaaagaaaaaaaaagagaaaaaaaaccagaaaaagaaagtgtggaattttttttttgttggaatcttggagagagttgcttactatagcgagttgtggattgtccgactgtgatcatttgcttgcttaagctaagattgagtctaggctacgccagcaattttaactagtactttggattattattcaatttcacatttctgtttgatttatgctattccttgtgatatagttaagcctaccaagatccacatactagtaacctttacaggttcggctttgcaatcgctccactcatcaagcgtgtcattgtgccacgaaccagccacagtagtttttgcattcattgagaatattataagaatttggtatatgcttgagtgttgagtgccttcaaaacctccacatatatatagattgttaggaactgacactttcttgtgagtttcttttgcttgctaacgatgtcaggtacaagttccgatgaaccaacactggagaatctagcgcataaactgaagggcatggaaaattggtatgaagagttgatgcgtaatagtaaatcatacaaggaaagcacagataaacatttaaaaaccttaagtgaaagcctggtgaaagtagtggatcaaattgagaaaatgaatcaatcacataaacaattaactgaaaacattcagaatatgaatattggacatgaaaatattgtgcgacgcattggtttacttgaggctgcaggtgaagaaggtgcaggtgccactgcccatcgacaccaaagatatgacaatgaagatgaagagcaatctgttgctgatgatgaggaggaagacgagagtgttagaaatagaagacaacgtcgagttagggacaaagatgatcctttatctaaggtaaaattttactatgccttcttttgatggtaagtttgagccttctgtctatctagattgggagttagctgttgagcaaaaattctcctgctatgattttcctgataataagaaagttaaagctgccagtagtgaatttacctcctttgcatctctatggtggaatgatatatgtggtagaggacttagacctagaacatgggatgata

SEQ ID NO: 27247 - DNA, 1501 bp, Oryza sativa
tgaaaacctgacatataagttctaaggaaaaagtccaaattaccctctaaactttggatggaagtccgtaaagcactctaaactttaaaataggacattcaaccccctaaactttataataccgtttatataagttggatgagtttgatcacatgtcatatgctttggacatatatattaaaattttgacttaaatctttctgtttactccttattagctctcacttacaacataataatagtatgacactactgtataaaaataaattgataacttataactgatgatatccaaatatgttatattagttagaaaaaattatttgtttaagcttccaaaatatgcaaaactatcatccaaaaccatcttatggggtaatatggatggtatggtaaagtttagggtgttggatatccggttttaaagttcaggatgctagacggactaccatataaagtttaggggggtatttggacatttttcaagttctaaatacatgcaaaaatcgctaaacaggtataggtattagtatgtcaccaccaaatctcatgttcaaaccaacttcatgtgcgagggataaaacaaatttgttagctcacaatttcaaaggaatacttgttacaattcgaaattaagagtcctttcagaggaagctcaacatttatgacatactccctccgttccaaaaaaaaaaataaacctagaaagggatgtgacattttctagtataacgaatctggataaagggttgtccagattcattgtaataagagatgtcacatccttgcctaggttgtgtttttctgggatggaggaagtagtacaaactgatttatatatggggatatgtgcaaatagaactacacatttgctatggactaaaaaacacaaatctattcagttttgccctcccatggtacatgtatgtatatggatctgcaactgacactactggagaaaccatatttccccggtcgaccaaaaaccacaatagtctaggtttgaatagaaaccgggactaaagataatttttttgtcccggtttaaaactctatcgttccaagatgatctttagtccctgttagtgttaccaaccgagactaaggatcatatttagtcccggttcatttaccgtcagattttctcagggggcctgggatctttagtcccggttagtattatcaatcggaactaaacatcgatctttagtccgggttggtattatcaactggaactaaaaatccatatacaatatataatccctagggcttatcctccaaactcatcatctcccctctctctcagcagaccgttcttatcctctcatctcccctctctctcttatcctttacggcattcttatcctatcttcttctgccttagatcaaggagtgagagactggcgcacggcggtggcagcctgtgtgcgccggagcaggcgggattggccgtggaagatgcggcagcggctgccagaagtggtcggtggtggtcgggctg

SEQ ID NO: 27248 - DNA, 1501 bp, Oryza sativa
tttctgaggacgtccatattcctgcctctcaggaagtggctccatcggcataaaaatcatcatgcaatatcccatcccacacaagttaaagaatttagagtctagccaagtgtaatacatgtcccggtgctcaataaccgcgagcacggctattcgaatagatttggtttactcacactgcaatggatgtacactttacccgcactccgcgactgcccaacacatgagcctcgtcccaacacatgagatgcgccacggcaaagcctttagataacctcgcattggcagtacccgctccatgaacttaaatcctcatgcactctaggcgtccatgtttctagcagtgagaggagttctggcgctcccgggaaagagaagtctcacatacatattaaattatggctcaagttaagttccctctctcacacactcatggcagtcctaccaatggcgacaccgatgtagggcacgcctctcggccctacctcaacggctgtcccaccatagcgcacctgcctcactcagggctgaaccatctatgcagggatactgcctccgctcggctatctactccactaggtctatacccatacgagaagtgcggttgtacgagggtcgtttcatgcttaacttcatgactcggtccttaattgaccggggacggtactagccttttccagataccacccaaatcctccgtctgcccaatcgaaaacagttatttagtttatttctcctttcacaaatcatgtcctcaatatcatggcaatgtggcgctcatgtctccacatgccacatctcaattaccttcccaaagataattgcccaagcatatagcatttgacaaatatgagtatgcatgattctagaatagcatttctaagcatttgttatagttgactagggactcatacgtaaacatggttacgaaggaataaggggcaaacaataatcaaggcatggcataatcacaagtaggatgttcatcattgcatgcaattttatttgtaaacaaaacaatttcacaattgggatcaacatgatcaaggaatagtgctgacttgccttgctcaatgtcttgcgggtcttgaccttcgcttggatccgcaactccctcgggctctatagttacgtgcgaaaattgatttgaattcggttagaattcaaataaaaatccaaatgaatccaaatgaaagtcgaatgcgaaagtcgatttctttatattaactttattattcgcgaactaaggcaaacccaatttcgattcaaactattttgcgggtataaatattttgttatcataagtttttaatttaatctacccgagcattatatccatataataggttagaaatttctatcgcgagctaaatattggacggaatcctagaaatattatacgatttaatttagtctatgactaaatgattaaatataatacacgggtaaaatccctagtagttaaatccgaatttctaccgtgaatcgattacttataggg

SEQ ID NO: 27249 - DNA, 1501 bp, Oryza sativa
tgcgccctccccctttgactcgctgacgtgtggggcccgcgtgtcggcgccggccgccccttgctgacgtcagcgaggtccttttcctttgtaaaaataaataataattgcgcaataattcgtgaataattctagaaattcatataaatggctcaaaacttctaaaattcatatctaattcattcgaactccgaattgagccgttcaacttgcaaaattcatctaaaattgagctctacatgtttgtttagtttatatgtactgttaccttggtttttattagagtttttcctcattttgcgtgccagcgtgtagttcccgtcgtttcggaagatcgcgttcgcaaggataagagttcggaagattgtttgaagaagcaaggcaagtcacacactccccttgagcatgttgatcccaatttataaatgttttaccgtttacaaataaatatgcatgttttgctaattacatggggtcagggtattacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattatagtattagacctttttagtatcagaatgagctgcgtgctcgagacatctggccatgcttcatggtcgtaattatccaactaaaatgcaactgaatggtgggctgtgggtgcatggttttgctggtcgcacccatggcagttaaggaccagttcgcgggatgccctggaaaaacttatcgtacttaccacaagccagcgtgggcaacggctgggcttgtagtgtagctttcctctagctgacgcatccaggcaagggtgggcgtgatggagttcggatgggccctgcgacggtctatgcggcttctggattcacctaggcacgagaggggactgctcgctgccttgcgaggagtgggggtgaaacctgaggtgtggtgtgcttagttagagggggttatgcgaagggtcctgtcacggcctctttccggtatgtcgtggtggcatgtcggcgcacggaaacgtgtcgtggggctgtgtcttgtgggtacagttgtacacctctgatcagagtagaactattcgaatagccgtgcccgcggttatgggcggtcgaccagattcaccgtgattagtcccatcttaataaatcgacccaatacactgtagttcaggtgggttggttgggcctgttcaacgtggtgtagcgttgatcagtggagatttaatgttactttaattactcaaccgttttactgttttgctcaataaagtgttttacaactgcctttatgcaaatagccacaaacccctccttgtatccccttgcatgtctgcatcgttggtgtggcttgctgagtacggtggctgtactcagccttgcttttattcccccttttcagaagagtagtgcttctgagctgaa

SEQ ID NO: 27250 - DNA, 418 bp, Oryza sativa
gatccttcagaatctctgttggatgtttatggaacaattggcccctacgtcgattcacgttctgatgttataacgtcaattacatttgtcaccagcaaggatacatatggaccttatggaacaggaggaggggttcctttcagtaccccagtgaaaggcaacagtagcattgttggattttttgggtatgcaggtagatacatgcatgcgataggcgtcaacgtggatgcaggagtggacgagaacgtaaaatcccatccatgtctacttatgttctacttcctctgtttcaggttataagactttttagcaagaaagtcttataacctgaaacggagatagtattaattttttcagttatatatattgtgtaatattttcctaatttttggtttactggattgtaatccaggatcgg

SEQ ID NO: 27251 - DNA, 1501 bp, Oryza sativa
acccagttcatcctcatatcctttttcattttttttattctaccttcacccctgctatcctagagaagtattcctatcaaactcttctcgaccatcgtgcaacctctgtttgagctgtctgctcctcggggcgaattctatgagccacctccttcatcggagcccatttatacaactggctatgaaattcgtcccgagctaattagtatggttagggaaaatcctttttctggttttgatctaaaaaatccctaccatcatctgcgagactttgaacaagtctgctcatgccataagattcgtggcatgagacaagaaactgtgcggtggaaattgtttccgttctctcttcaagagagagcaaagaaatagtacacctctaccgttggatgtgtaaacggtagctaggaaaagctgcgagatagattctgtcttgccttcttcccagttactcgtattactgcccttcgagtagaaattctcaatttcaagcagatcgaaaacgagtcaattggtgcagcttggtccagattcactaatttagtacagtccggaccaaccctgtccttacctgagtatgtgcttctccaacatttccatacgggtttggataaggagtctgcattctatctggacataaccgctagaggatcattcatgcataaaacgccgtcagaaggaaaaacgatcttggatcgcattctagaaaatacttccttcatgacgcagtccaatgaaccccagctggaggcatccgtgtccaagatagaggaacctctaacgatcgagccatttgctgaaccgtccacttctgctagctcgattgatgagaaggttcctgagcagccatccgtcaagaatgaagaaattcagactccggattgtgccacaattatgttcagggacggttttgacgtagactacggcaataccctgaactattttagcaagaggaaaccacccgttcctttgtcacctcccgatcctatggaactcgggttcctacgagaaactgtccgggagttgacatccataatgagcgacgaatggcaaagggaggcagagctttcatccgaagtaatccggataaataccgctccccgaatcattccttgtcacctagaagggaacgatgtcggtattctctacagtccaactatcggggccaacctcatctctgtgtcctttgcattcgcttatttaagcgataaggcagtgaccccgacaaacaaattcttcaagcatccgaatagaaatattatcgaaggatttgggattgtgcaagatgtgcctgtcttctttgaagacagggaggcgatcttggatttccatgtctttgaaatccaagactttgatatcctaatcgggctgcccattgagcaacttctcatcaacacatcccgattaggtagcctcaaaataacactgggagagaatgaattctcaattccattctcgcgggcaaggatcaccttgaccgaccctctcccagaaactgagt

SEQ ID NO: 27252 - DNA, 721 bp, Oryza sativa
ccggtcacgtccggttgaacgggcggccgtgcccccacgccgcctttgtctccggcggagtgggggtaggtatgacccatcacgtcagagcgtcactcgaaggagggctaccacaagtcttcacttatttatgagggaatgacagggctgtcccccgtgtcaggcgggggacggcgctgggacccactcaaggaccggttgctgcttagcttccgggggaaggcacggattgaggccctgtcaaagtggagcggggtccccctcccatggaggggtaggtacaggcggtgcatgtggtatccccttgagctataaaaggaggaccttgcccaccgagacaagaggacgactctcagaaaacctgaactctaggagaaggaaagcgagagtgctctccagagtaaaggatcctttgtaaaactcatccataatcccaaacacaggagtagggtgttacactccatagtggcccgaacctgtataatccgattgtgtgcaagctagccggtagtcttaggggcgaacacgtgttttccaagaggcgagcctcagcccccggccgaactcacgaaaggggggtcttgcgactccccgccatcgaggatcttccctcgacagctggcgcgccaggtagggggagttgcgcgcttcgagaaaaagtcgttttcttccgccccaagtttctctgggccctagacgatcatggtcgaggtcctggagg

SEQ ID NO: 27253 - DNA, 368 bp, Oryza sativa
ttaaattttttgaataagacgaacggtcaaacatgtgctaaaaagtcaacggcgtcaaacatttcgaaacggaggtagtagtaaatttattttgttcgtgccctcaaatagttataaatagattaagaatcatccatcatctacagagaaaacagtagaatcattacaaggatatcgtctgtcgttctgcaaaaaaatatttagataaggcgagaatattaattaacaagccaactaaaagacaaattataagtgatggtcacagaacgcaattaacattctagttttgaaatggttaaatcaacaattatattacaataatccatgtaatttagggtgtatactaattaacaaggaactttaacagg

SEQ ID NO: 27254 - DNA, 507 bp, Oryza sativa
ccactgcatgtcgttatgtgaatagctttgggaatcaataaataaaaaataggtaaaataggttccacggcatcgaaagtttccaagtattaaagtgcaacggaacctttcgatggtgcaaaccaacattcgaaaactttcaatgacgtgaaaccaattttacaaaaagaaaagacaattattgttgtaggacactacaatttgtggttttaactctaggacacgtcaaaagtcgatctttaggggaagacactctcaaaatgtggttatttgttgatgggcaccgcatacactaaaatattaaattccgattgaataggagagataaacaacatgaaaggtcaaaaatgccccgggtcgacttgtcatattcttcccccacatctcactccctctcacactccagccgcaatagcacctccgctcgccaccggcgaccaccacggtcctcccacctcgcctctcctccacctacactgcagcggcgtgacccgtctcccttcaaca

SEQ ID NO: 27255 - DNA, 1501 bp, Oryza sativa
aatatgtttggtctgaaacttcaacatattttcgtatatttttaacggaaacttttgaatctacgaatataagtatgcttggtttgttatcttagcaaaagttagtaatgacaaaaatttacagggttgaaagtgaagacaaaccaaacaggcattatgtatgtatgatggtgcacctaccaattccagtatgtcaacagagtagttcctagcaaccggtgctcagcatttcatttgggtagtgaatgttcaatatattcaaacgaacagcagctaaaatatactccctccatatatgtatgacactgttgacttttcgatcaacgtttgaccattcgttttattcaaatattttgtgcaaatatgaaaatatttatatcatgcttaaagaaatttgatgatgaatcaagtcacaataaaataaatgataattacataaattttttttaataaaacgaatggtcaaacgttaaaaaaaagtcaacggcttcatacattaaaatgaaggtagtattatatatgtagtttcttaatgaacaatacaacagtcagcaggagtacgcgacaatcttatgataaacaaagcaatatcaagaagtagaaaggggaggcatatgcacacaaactaatgcctcaacagcatttggccaatctcaggttagaatttgcgaatgtagatcccaaatgtttcgaggcactgctctgcacggccaaagaaaccaacgatgttgctactatactccaacggatcaactttaaacggagtccctcctccttgtccaaaaggtccataggtaccaccatttgtgaagaacttaagcgatgtaataacattcggcattgaattaaacggacctactgttccagaaacttcccttagaaagtcgtgagagccaagccgaatctacaaggaaaggagaaccgttagcaaactatttatgtataaaaagaaataattaattggcaccctatattactggacaggtattttaagattcagttattacttaccatttggctactttcactactagcacttccccaaggacctgaagtgtgattgtccccattaacttcactataggaaaattcgagggaatcaacaacaacagaactataaattgttatgctttctagacggtgaggaactgtctccatgacatattcgattcctccatttccaccccaaggaccaatcttgttgaacccagcctcatgagaacaaaccacaaaaaaaaattagaaatgaagaagaaaattaatcgagaacagacatacaaaaataacaaattaacttcttgcagtaagttagtaccatctccatctcctctcctcttcctccaattgtttgcacatcagtggtcaattcctcttcatcaagtactgtgggttgtttcggatgaaggtagacgccgattgcatcaatataccagcccgcacgcccaaagaagccaacaatactgtcagtactctttgttggtgcacagaattcagttcctcc

SEQ ID NO: 27256 - DNA, 652 bp, Oryza sativa
ttttctttttttcgcccgcacacagtaactaccgttcgtttcctcttttttcttttttttagttttttttcccacacatacaatgtttccttgagtaacaaatttactaattgggtttatggtagacaatgcttttccctttacaatgaagtaccccaaaaatatcatatcagtaaaaaaattactactggttctatatagggtactgctcgttcttcttcttgcacatattacacaggcatcttctcttagtaaaaaaattactactggttctataaatggtactgctcattcttcttacacagattgtagaggcatcttctcttagtaaatagattacttctgtataatcaggtagagttgcaaatgtagtaatagatttactcttcgactaaactcaaatggcacaaaatttacattttaaccatactgccacataacgtagtaatacttttactcaagtgtatttttcacgtgaagtaatacttttacttttagtcaggtatatttttcactggatcactcaggagaaaccaaattaggagtaaacgatcaacattttcaccaaattaggagtaaatgatcaacatgtcactgtatgggtaaaaaaaattacacatccacaggcaaaaaaaaaaaagagaaggaaaca

SEQ ID NO: 27257 - DNA, 1349 bp, Oryza sativa
ggcggcggcggtttggggatgaggaggagcggcgaggaggaggagcagcggcgtgacggatccggcgatcgctccgcgtggactgcggcggcggcggatcggggatgaggaggagcagcgacgaggagcagcagcgtggttcggggatgaggaggagcggtgacgaggaggagcagcggtggtggaggatgagggaggcgagggagaagaggcttcgtgctcctcctcgcgttcgcccgcatctggctcctccctagggtcggagcactgcagcggaggtggaggatggaggaggatcagggacgcggcgatggtttgttccctcttcacttatgcttagtcccctgctctgccgatggtggtggaggtcctggatagggcggatatgacggaatcgacagcggcggagaggaggccacatcccggcgtccggttcacctcctccatgcggtggctggtgcaatccgagccatcgaggtgggcgacgatgccatcaaaggggtgggaagactggtcgttgccggctccatatccacaccagtgatgcggcggaccagatccaggtgcttcttgcttcttttccccacgaagagagacaaagagggagaagaaagggatgccagtgatgctgcaatgcaacgtctcctctgtgcgcctggcatcaaccccatcgatctgatcatcttctttctcctgttcgtcttcgttttctttccttcttttctctgacacgcccattgattttgcaaagatttcactgtggtgatgcctgctgagtactgttctcataatgcattcagacggttggtggtgctcccctccaaccgagtgaccgtcagcaggagagggcggtggcatcctgcggtggctggagcgacgactggtgctgctccactcccccaagttgagacctattggaggagcaggcggcagcttccggcggtggccaggcgtaggcatttgatcagagattcataatgtacacaacagtgcatcagatctttgttgggatacatacatctgttttgcattccgttttcattgatttgcaggtttcctgatcagagcagtagaacaccacctgcaacatgcacatactctggtgtttctctgcattggctatttttgccaacaagatcatcaacaccccaccctccaggtacaaatatgacccttcacatgctttgatctctctgggtgcctgcggtatgtttttcacatgcatccaaatatgttggtaactaggatttatttttggggatttttttcctcctgaatagagcagagcagctcgactgcctcttgtattgttttcattagtcttctgagaacatttagttgatatgcta

SEQ ID NO: 27258 - DNA, 773 bp, Oryza sativa
tgaatactaaaccttccaatataatccaatgtataattacaatgtaagtataagtaatttatggtgtaaaaactatctgattattttttataagtagtaaatatgacgtcgattcctgactaaaaatctttaaaaaaaactaaaatataattattctagctacgaaccagagcattttatatcttcaaatggagttgtttcgtaacacctcaaaaactataaatttcaaatgttgacattttttttggacatttcgagacatttttttttcaattaatatcgcatctgcttttgtagtttcactagcgcattgacgaattggttaatcaagtcacctcttgatcacagtaagatgtgtcacttcccaggttgggacctcgttcacgcacgaaaaatagcgcctaaattaccaagtcaacttttttaaaaaaaaattgtccaaatattttaaaaattagaagtaccattccctgtgcagcaaaaccgaggaggtagagagaaaaacaaaatgatggcctcaaaatttacaggattacgactaaatccagccgcaaaaccaatactaaccaccagtacatatatcgtttcgtttgcgccctaccactcttgtggataaggctccctcccgccattcttaattactatacttatcgtacgccgccgccgtcgccggccgccgcacgtctcaccgccgcgcgccggcccagggaggaggaggcgagagtgcgagatccaccacccgatgacctcccaggcggcgacgacgacgacca

SEQ ID NO: 27259 - DNA, 1479 bp, Oryza sativa
agttaaataattagaatacccacatgcgataaatatccagaatatcgcggtcaataatagaaaaccatataaaatcctccaaataaagtacgaatcatcatgaactaattgtgccatttgatagatcctgattttagaggaattctggaagttgaatggagtcaatcggggctacggttcgaaagatatcaatttctgaagtttgggagaatttataaaccgatgaggagggtgtctcgggaaggacgtgattttggacttccatagagggctctgggttgtagagggacacaatacagactttaggtagaggaatgaggctggggatgagctctgaaggatattctatagacttttgtagaggaatcaatctctcggaaaaagtacaccgaaggtccctcaacttatcatcgagatacaaaatcgcctccaaaccgcaaaaccagatacaattttgctatatatttgtcgacaaattttctcccaaaaatttgacagatgtaattacagtataatcgcagtgtaattacattgtaactcgcatgtaattacactgtaaccataatataacttgtatgtaactttcaaaaatctctccgtaacatgttatttcggtaaaatcgaggtcgtgagaataaatcatttcatatatgtgtgtgctgtgatctttttgttcatcactagaacaaatcttgtaatagatctaatgattcaaaattacgtgaaagttacatacaagttatactgtagttacatgcaagttacagtgtaattacatataagttacagtgtaattacagtacgatggtactataattacatctgttaaatttttcggagaaaatttatcaacaaatgtataggtgatcccctttgatataagcatggcaagcaacaagcaatcaacagcagaccccaaaactagcagcaggtctgcagcatcaagagcagcacatcatcatgaacaacagcaacaacaactttcagcgccagcaccattattcaggctgtgtttagtttagcgtaaagtttgtattttggttgaaattagagatgatgtgactgaaaagttgtatttgtatgacaggttgatgtgatagaaaaagactgaagtttggatccaaactttagatctaaacacagcctcagtaacagctgcagaattcagaaaaaaaaaaaagacagtatagaagcgcgacaccataacgaagacagtatagaaccgcaacaccataacgagcttgcagcagcagattaaagagatgccttaatcttcagcagttttgcatcaagggcagcaaaggcaatctgtcaaaaaaaaaatcacaagcgacaacccaccaccacggattgaaactcctctaataaaaaaaagaaggaaacatggcccaattttgaggaatactgcaagagcaaagattgggattattcctctgcatcgttgaatgaatcgctgatgggcaaattgcttcagacaga

SEQ ID NO: 27260 - DNA, 187 bp, Oryza sativa
attattctgtgattgttccgacttttttaacagcaggccctgttacgttacaacgatgttttttaagtgccatttccttctgtccattgttgctccagaaatcgttttttggtctcctttactcatcagagtcgtattcctcttggagttgttaaccacgctagaacatatcttctctttttaaagg

SEQ ID NO: 27261 - DNA, 311 bp, Oryza sativa
agttaaataattagaatacccacatgcgataaatatccagaatatcgcggtcaataatagaaaaccatataaaatcctccaaataaagtacgaatcatcatgaactaattgtgccatttgatagatcctgattttagaggaattctggaagttgaatggagtcaatcggggctacggttcgaaagatatcaatttctgaagtttgggagaatttataaaccgatgaggagggtgtctcgggaaggacgtgattttggacttccatagagggctctgggttgtagagggacacaatacagactttaggtaga

SEQ ID NO: 27262 - DNA, 1043 bp, Oryza sativa
gcatggataaaattagagctatcaatcatttcttaaagataaagaaaagctttttgttgaaatcaagacaattacatcaaaatgatacaaaagatcttgaaatcagttatgacctctacataactaatatacacaaaagaaaaagttttaagttgataaagacacgctaacatctatcatacttagactacatcatcacccatggtccagagtaaactactccttaaccacctgcttcaaatgttgaaacgtacatatatctgcaaataaaagttgtcaagccacagctagtgcataattaagtacataacctacaaagatatcaaccacacttgagcgatattttaagtactcgagaggtataaggtggtaccaaaattttttaatgtaaattttcgtacctcctactaacggaggtactatgagagctattaaattttatagtagaaaacgtggtatctcccggtaccttctcagagactgtaaaatcactcatcacttcaagtatattatgtgctcgtccatgaattcatggaaccgaggaaaatttatcttcaagtatattatatgctcgttcacgaattcatggaaccgaggaaaatttatcacctgtacttgggaagaaaaataaaaatgtcggtattaattgcttgtgtttcctgagtattattctttcatcttccgattcatatttgtaataagctcccaactatatatgaattacctacctagttcaaaattccttattcatccttgagttcccgttagattaattaattcctttcatacccggcgccccgagttaatttcactgtctgtgcctagctagtcttgcattttctggtggaataatctaagctaaattccaaagactacttgactatccggagactaattaattggctgatcactctcatgaaggagatgcgctgctggtgccttactactccagctaccgttctctatttatggcgtccaaaatcaattaaacagctcaccatcagcaactaattaaaacccatgagcctgccaattcgttcaga

SEQ ID NO: 27263 - DNA, 1242 bp, Oryza sativa
gggagggagtgcacaaggacgacgcgacgtgggtcagtgggtgggagtagataaggacaacataccgcgctcggctcatcggctcggctcgttttgtataggtgtaggtgtctgttttttaataaaccggcatctatagtattggtaccggtttttattaatgaaccgacacctatagtgacttaaagatgttggttcttatttttttccgcgtgcggaggcggaaaaggcctgtaggtgtcggttttaaaggaaccggcacgtataaggcccatccctttgagggttcttgtagtagtgaatgcaaactgcaatgtctaccgctattctatttcttgaacccaaactcaaacatatctatgggctttgacaccacatttttggatggatcctgcagctttcgagcttctgattagtcctaaactcaagaataagtgctttgaattcatttcctgatggatcaaaggttcagcataggctgattactcttataaaattccggtggtgaatgttttatttcattgcttcacattcagcaaaaaagtttgttggtgctccttttttttactcagtccctagcaaaaaaataagaacaaaaatttcaacaaagaagacaggctctcaatatgctgcatttggatgcaactaagacagagccactgcatcgcccattccaatccaaaactacttgtgactgtgagtaatgaagactctgccccctaggtagggatgtaagagggccaacccatgaatctacttatatactacctccatattttaatttatgacgccgttgatttttgtccaacgtttgaccattcgtcttaataaaaatttttatgtaattatcatttattttattgtgacttgattcattatcaaatgttctttaagcatgacataaatatttttatatttgcacaaaatttttgaatgaaacgaatggttaaacgttggtcaaaaagtcaacagcgtcatacattaaaatatggagggagtatcaaataaatggtaacccactggtttttatgtcatgactcaacttgccgcgccttaagatgcaagtgggttgatctataaacccatttacagatcccatttaggaacccgtggattaccaactaatcttgtctataaatgggttcgtgggttgacccgcttacacccctaccccctaaggagcctggcccttgcctctcgtatccgacggggacactaccgcggatcaactgcttcctctga

SEQ ID NO: 27264 - DNA, 1501 bp, Oryza sativa
caagagggatcaaatcttttattcacttggtgtttgtacacggataattacacatatttataaagtaagaagggatgtgaagatattataaaaattttggcgtaccacatcggatatacggacacacatttgaagtattaaatgtagactaattacaaaacaaattaccaaaaactgaagttatttcggaacggagtaagtactatgattggatcaacatatgttggtgcttgcccattcaatttatccttactctttggtgttgaaataaggttctcctagccggtgttcggctctgaacgagttgcatgtcatcaaatcgccctctctcactcgatctggtggctaacctgatgattctgaagattttcggacggggaacatcgaactgaagaacaagttcagcagaacagagcaaaaacagaacaaaacaagataaatttttgcattgcgtaatgccgtgcagcttttcgttttttttctctatttattcacctccatatcaaagaagtctgttacatgtaaaacatgacaaatgaaacagctagatctgagagtccgtgccatgcatcccacgatctgtttccagctcggtcacaaccgactaaaaacacggtagtagctgatctgaataatggttcctctggactatttccagtcagcctattacatgcacgatgagataactgaaaaactaaaaatgcagctatacacgaggaaatatgaatgctcaagattatcccaacattgccatggctccgacgtgaaagcaaagcactgccaaaatagaaagacgtccgtatatatgcactcatgcatcaagtcatcggtcggggtagtggactggatcaagtcagcagtccacgggtcattgccactctactgtccctagcaagacattgacctcaaataaatatggcagataaggacttgaccgacgccctgacctcaaataaatatggcagataaggacttgaccgacgcccctctcgagccctttttacttatatgggtaaaaattttgacgtgtcacatcggatatacggatacaatatttaaagtattaaacataaactaataataaaacaaattacataaattccgcccttaaaatgcgagataaaattattaagtctaattaatccgtcattagcaaatgtttactgtagcaccacattgtcaaatcatagagtaattaggcttaaaagatttgtctcgtaatttacacgtaatttgtgtaattgtttttatttttaatatactctatgcatgtgtccaaatattcaatgtgacagggtaaaaagacatactatacaacccaagcataactatttttttggataattgataaaagtacaaaaatatataaacacgtgaaaaaaatcgtatagtaggtaagaaagaaaattttagaactcatatctactatattatcacataattctctcgcaacaacttgcagcgtaccatctagtatatatataggctgcagtgaatttat

SEQ ID NO: 27265 - DNA, 1501 bp, Oryza sativa
gttttatcttcttttctcatactacattgaaaacaaaagtgaaaaggaaaaaacaatcaatgcttaaaatagatttatagaaagatacttcttaaccatgcaaaagttacttccaattaacattgtagttactttaaaaattgttaaacttacttgtgctgattaaatttaatataatttaatttctagatatatagagtcatatttttattcctacaacgaatttacttctaatgtcgtgacaaagttactttatttttgttttatgttacttttataatatatgtaaattacttttaggctttattgaatttacttttatatgtcttaaaagtaatttagatatattataaaagtaatttgtattttttcatcaaaatataatcatgtgagatcttgttataaagatttatttctacgaacataacggtgtaatcggatcgtagatcggatgagtagtttaagagaaaattttatttgaagcataggtggttcctatttgcttggactaatattatattttcagtagagtaatggcttcagtggtgtcacgctgtaggagtaaaccgagaggcttcttggtgtagattttgcactaattaaagtgtgcaacatcaaacattccagtgatgagtcacggtagttagtcctgtttgcctccttagcaattgtgtggcactagctaagctattattatcagtgaaaaatacattctacatctcgttatgctggtcgaatcgaacgcatacgaaaaggtttcgatttcagcactggtatatatgatctcgtcgtatagttcgagcagacgaagagcttcaccccaggccttcttctccacacatttgcctgaatgatctgtttcagcaacagcaatatctgcttttataccacctgctattgacacttgtatttcaagttagtcatagagccagacattctcgatgctttccaagcctatatatattaattacagtatttaattagcatctcagtggctcagtgtcacagcattgtaaatgatacttctatgacacaaagcattcttgctcctatgatagttttatctatggcattcatataatgatcatgccaaatcataataaataatttgagtttattgacccgaaacaacaactgcatacgtcgaaagacgtggttactccacagtggttggaaaagaagtaaagtgtattaatttgagaatttttcttggggatccccctattacatggccttatgagactatttatagcccttattacaggatcttactactagggttttagttatacaggggaatttacatggttacccttatgaaagggatatttacatgggtgcatagtgtaattgaggttcatagacctctgatgggtcgtcgggcgatcgtcggcccaatcgcccctaggattgatgagccggaaaaggcttcttcggccctcgcgggggcgaggttgctttggtgaagtcgtctcccttcggcatatactcttcgccctgc

SEQ ID NO: 27266 - DNA, 1501 bp, Oryza sativa
atgcggggaagcatcagctaccgatgctttaagggtcattgtttcctctgtctctgtcaggatcagccttcacatggttctcatcattaccatacaattctgtacaaagttgggccaacttggagaaatagttccataaatacttttatagcggaattcacgagatgaagttgtccgatttaacgttgatcaaacataagcatgacaaatcggttcaagattatatccagatgttcagagatatgaggaatagatgctttagtttggccttgacagattcccagcttgctgatctcgctttccagggcctactagcaccaatcaaggagaaattctcgacccaagaattcgagagtctagctcatctagttcagaaggtgacggcacacgagcaaaggtttcttgaagctagaaaagcatataaaaaggggaacaacattttttgaccgggaaacagtgggcgaagcccccacgattgattttcatttataaaagcagaaactgtacaagaagaggatgaaaaacattagtacatatgtctctgaaacaaaagacgattaagaccctgaggtagcaatggctgagtgggcaagaaacaaaagagtagtcacgtgccaatatgtcaaggactccggaaaggaggaaaaatttgattttgacatcaccaaagccgataggatcttcgatttatttcttcgggagaagcaaatccacctccctgctggtcatgtaattccatcggctaccgagctagggaagagaaagtactgcaagtggcataactcggggtctcagagcactaattagtgcaaggtcttcaggcagcagatccaatccatgattgagcatggaagaatcaagttcgacgaccaaaagaaatccatggaaatcgatggcaatcctttccctgtcaacatggtcaacactggcgaagggatagccgatagaagaagctaccgtcccaatgctgctacgatcatcaacatgtatcagaggaagcttgagagatagaaagaggagagttatggagacagcaacaacttcgaccctcattgggactgcgaattatttagattctgctggaacggagggatgaggctaccctcgaaggaagattgcccggggtgcagtgatgccgacgagaaccatgtcagcagttcaagccgatttcaccccgggaaagaaaatcggtcgatgcagaggaagttgcctgttcatcagagattgggaccggtctatcaaaattctgtacaaggggaagatggggaggatgaagctaggaatcaacagtggtgtccctctggtattttcaccaaaactcagaaaacaagggttcaaaggatgaggagtagggaacggttccaagaggtttatgaggaaattgaccatcggctgaagaggaccaagcaagaatggcgcataaagagtaaaatcgttccagccgatgaggtcgacgccgacaaggcaaaacaggtaagtaaaggaaagaccatcgaatctt

SEQ ID NO: 27267 - DNA, 1501 bp, Oryza sativa
cagtgccgatgacagagtccacggcaatcctggccgatgctgagcccaaagattgatacagggctcccaagagatgtttgcccaagggaaactgccttttctctgcaagggcttcggccagatgctactagttggaggtagggccacagcttgggccacataacaggaacttttcggccagaaagcttaacttttccttcagggtaaccagaccagtccccgtgtttgtagtgataaaactagtccaaccacctatactcttggtcttataggaaaattggcctttagagttcagactaactgagttggctgccgacgtgacatccaagccagtgatcatgactatatctaaaagagttggcgtcatcggcccctaaccaaataagaaagcattgagggtgtcggaccagaaataagttgcagccgatagcatggattcatctctcttcatatcggctaaagtaagaagcagacattgagaaatccctagttcgtcccaatgggcttgcttgtgtgtcgatagtctcttatacaagtctggccatgtcttgacattggcagctggccaggacttgaaagtgttggtccaatggattaggctagggttggtttgtctaaaggggattcggttggttttggcattgaggaactgagtcgggtctgagttgccggttgggcccagaaagaactggttttggtggcacggattggggattgcaacctaatgggaaagatgctacagtagaaaaaaaaagggggaataaggagtcaagattgctatgaaagaatcacgcaaaggaaaagaaagaaccaggagcagttttagccgataagcagttacctcaggaaactcagccgccgaaacacttgagggattgacggccatcaccggaataccaagcgccgtcgaaaggaacgcctatgtagtcgccgagaaaactgacggaaggagtagggtgctccgttgactgaaggcaaaagaagcggaagggacaccgtggaattttttcgagaaggtggttctatttaaaggaggacgcggcaccagccgaaacagaaaagaaactctagatacaaactgaaacggaatctaacaaatctacaacatccctaacatcggggacttgggggcatttgttaacgaccaaatttggtgaggccatgggctggatccaaagccagaatcgaagctgatgtggatgaattctgtctaagaaaagcagagtgcgtgtcggctatgagcagcataggctgccgtatatatatcagctggtgccaaatccaacggagataagtcgatgcaggcagcctcggaaagacaatcccacatctatcatcagggttagtcaaagtacttgataggcattgccacgcgaggattgaagtccagaaaaaggcaattgtatctattaattaggatattttcagtttccttacggatatgtttgctaagagtccgcctaagggacttgttcgtattttaaattgtaatattgataga

SEQ ID NO: 27268 - DNA, 1501 bp, Oryza sativa
agggaatatgcagctcacatggtgtccgctgcgtgatttcatcgacggggcaagtggtttggtcctgagtttgcatggcgtccatgctctatgatcctacctgcctcgttgaggtgcagctgctacgattgcctgaggggctgactattacatgaggaatgtacagctggggatcctagcaccgatgtgcggccatgtgttcatccaccttccttgccacctcctcctgcatgcttagctcgtaactcgataccctgtacttaagatctgcaatcttcacctcagtatctctcttgttcctcatccgactcctgtacgtgtggatgtcctccttgaatccaatcttccaaggaaccacgcctttccctcgtgttcgtcttggatgctcgggagtctgcagggcgagtgacagctcatccttctctctatcgagtcggaacgtgccctgagaagatgcttccactgcgtctgttagtcgactggcagcttcgcgtatctgatcgctgaacgccagggagccatcaacggggttaagcgttccaccatgagcatagtaccagaacttcgatcgatccggctatttagtggtggccggttcgatacccctctcaatcaagctggcttccatctcctcccacttcggcatcgcgacgctataccggcctgaccccaggtggtgatggtactttttctttgcagcattttctttgtttcggtccatcatcgcttgcccttgttgccctgtcttgtaagcaacaaactcgtcccagtgatcccttagcttcgggaatgtgttgaagttcggtgtcagccccttcaggatgtatttcttgtagagttcttccttgaagcactagaactgttctaccattttcttaagagtccactgtttcactatgttctccgtacccgcagggagtgtgaacgtctcgagcattgtggtccacaacatctctttctctgattccgggacaaagctgtcataatccccacgtgcccttgttctaagccagtacaccttgctgataggcacgttatccctcacaacccaaccgctgtgtcgtacgtaattcttggctgcttctgctggggcactaggtcggccgtcttcgtccacttcagttttaatgtgccgaccctctatcttctttgcggcacctcgttgtctgcgtcccctcttctgtgcagacgagggttcatttccactagcctcctccccgttcccctcctcgttcccctctacgttcccctcctcattcccctcctccacgttcccctcctcattaacttcctcgttcaagtattggtttggatcctcgttcccctcttcttcgttccagtactggctgcttccctctgcgattgtatcatacagtatctgttcgttatcgcgatcagccatctgttcatacaagaaatatttccatatataatattaaatctctagtaatcatatgctaactctagtaatcatatattaaaactctaataatcttatatt

SEQ ID NO: 27269 - DNA, 325 bp, Oryza sativa
ccaaattatcctcagaacttctgtttagttactccacgcgttgactcatgacaatgcacctcttcttgcaaaagaaaaactgatagtgtaactactagccttcctttatgatcagggttagaacaaattataagttttttcatgcataatacaggcataacccgcctttgatgagcatttgcagataggtttgcctttgcctcccttttatagccaattacactatgttttttgtaaaatcatagtgtgtttgattgttattttgtgattaacaattgctatttgagaatattggttttttgatatttggagattattagcaaaa

SEQ ID NO: 27270 - DNA, 788 bp, Oryza sativa
ctgaggaagaacggacttaaggaagctgactctcgttctttggaccccgcagaccgaaaagaaaaaaagttcgtcactttttctctttcacatacaccgggagaaagggtgacgatagcaatcccctttgcctccccggccggggagcccccgtggaggttgactatctccactatgaataagtctttctcgagtaactcagactcaacgtgtaggcgttggaagctgaaataggagatgggtcgttccagctcggcaagaggattccggaacatccaagtcctactcctagtggtgacagcttatgcttcatttcctttgaattcttctttcgatatgagcgagcttacccaaaacctatcacttataccagtgcagatcttatttatgtgcatccctcgctgtgactactattcttgttcactctctatctaaatgatagaagtatttaatcaaatcagaaagagccctaggatttgaccaaaacggcataattgaaagctctcgtctcagtcgctcgcataagaaaaggtaccgggttgctttgtgatgacgaataagcagccagaaatgaggggaggagactctgcctccatagtataagttgctatccacttatgcttggtttgtgatttctttgatctcgcgcatttgcaatgcggtgctcgtaatttccccaagaggttgctatggcttggaggtctaacggactttcatccttcgacgcctataggcggcttcgctatcgctcatgacttggttcgcacccctcgcccagtgggaagtca

SEQ ID NO: 27271 - DNA, 1501 bp, Oryza sativa
ggcacgaggcggcggtggaggcgagcagccgggcgggcgaggggcgcagatggtcggggaggaggcagccggcggcaggtgggcgaagggcggaggaggcccgcggcggccgcgcgcatcgtgacggtggcaggcaatgcgagcaaggagcagcggcgcgagcgcagtcctgatgggggcgacgcggacggcagggcctccactccggcgaactccaacggcagacccagtatgtccatcctctctattccccacggtacaatccagatggtggcgcaagttcatctgagctgagtagtttggggatagcgtaaggagagaaactccaaattaggcatggggagggcgcggtttggaggaagtctaaaaatggtgtgcgtgatagaggatttgctagagcgtgttttttcatctccatacgtgaaaaatgagatggatggcgggatggaagagctgctgggatgctctaatgaacccagaacccatgatgctgcccaagattgtcaggtggtggctccactagtagatactactaagttggtatgcgcataggtgaatgcgcaatgtgcttctttaccaatgtcacccattctcaaactaaaatccagtaacatgagttttctcttatgtacatattacaaaaccataaaaaagattgcacagagatagtatccacagcttcagttagctggcaggcaaacagatgaaacaacctttgcctagttattattatataaacaaaagagagagaaaaggagatggaagcatatcaaaacagggtagggagtagtaataagtaatttcttggcagaaatttacagtttcgtaattgaagaattgccggtgcaatgtatcacaccataccatcttccacaaattaacgtcttaaattgtccaaatacaataaaaggtacctctagattaaccattgtcacagtaggtaattaatgtgtttgatttgtactgctctctggcactttgcatatcatataaccctacgacatctcgacatactccacgcatatccatatttggagttttgctttgctttgaatcagtttcttgatcgtgcctcattgcatggatcgctttcttcaggtattagctcatgtggatcaaaattcaactgcctactaggcctaattcagtgcgagggcatggtgaccgcaatagtcaaaaaatcaccctgttcctcttcgctagttagaccacctagaaaactcatatttgccatggctggctggaaatgagcccacgaacccaagttgttcccaaggttgtcaggcagtgactctagctagcagtagatgagtctgactgctgcgtgtataggtgcaagcgcattgtttttctttcccaatgccccccattctcaaactaaaatcatgtgacacgctttgtgatttgtacatgttacaagaccgaaaaaggtaatgacaaggggagagcatgtattgtttcaattggtagataggaggaggaagcaaccttacgtagtgat

SEQ ID NO: 27272 - DNA, 439 bp, Oryza sativa
acttggggagatttgattcatcagaattcgaattgatagttatagcttttctgactagcgacccctgttgtccttctctttttttttctaaagacgcagcagaatcgtcaaacgggaaatcaaaagtgggaagttgattgtaggatttctattcctcactctcgttagacggagagtaagcgacttctattagcaccggaccgtcgagtcgaattgatcgtgtcatgtgcaacgtccatcaatggtggttcattaatgtccatagatttagactccttccccctcccttatatgcaaaagatcgagaggggcccaaaccaaaccgagaacgtaaacagaattcgactcactctcgtatggctcgccctcgagccctgggccctatcgaacaaatagaggaaaggacagaaaggggaaaaagtaaagtctaagcgacata

SEQ ID NO: 27273 - DNA, 1501 bp, Oryza sativa
aatatggtgctacagtaaacatttgctaatgacggattaattagacttaataattcgtctcgcggtttactaacggattctgtaattaagttttttattagtatccaaacaccccatatgacaccctatataatacccgatgtgacacgctaaaactttagaccctgatttaaacatccccttaattgtcttgaacaatagatacacatagctgtccccactgacagccagcttgcttatcaccctgctattagcttttcactctgctattaagtctctgtaactatttataacacaatgtatctatatgttttgtcattgttacatatatagagagagagatttgacacgcacagttcaaaggggaagatcagctgagtaatacaaacagtgatcgttgtacactcttctcatgcctgaccttgttaaacctaggtttgtcttgcgagtttagttttacatggaaatgggtggtgtcatgggaagaacgtacaacgcttgcaccatttgcagtggggttgttattcacttattccctcaagcaaaaggttgaagcgatgatggttaagggtaaccgggactaatgcttttgctgccaattacttgggttagcagcaagtttgacagatctatatatattaatggcgttatctgggcatgtatgctgaggtgagactatgcgaattgctgcactaaagagtatcacggtgatcatcaggcatgggagtatactgtatgctcaactagctagtagctggcaagctggttgcataggcacgttcagcaaaactaataacatatttatgtcctgctaatgatgtatcaaattcgattacttatgttttctattgaaatatttatattgtgttatgactcttttttttacatgggtatgttgttggttcttattctgaacagtagatcaaattgtatggaacacaaacagttttagtaaatcttgttactctgtacactaaatgaggaaacaatatgggaagttcactttgtaaatctagagaaaaaaagtagtagcatggattataatgtcattcccctctacggacatgcatttctcaattcaatccatagatctcagaattaaaatacattatgggctcttttaatttagtgccaaatcttacactaccaaattgttggtagtctaaatactacttatgtgttgtttggattgattccagaacttcctaaatcaatagaaatatctaccaaagtgttggtagtaccaaattttcattaaatgtgttatccatatttttctatagggtatattatcaccttcatttagatttcactgttttttaatatgataaaattgaagggctaacctgcaaaatttaccattaggtaggtagtggaattggagattcactgcaaccatcgtaaccttctctcttcgaggctgtgtttagttcagtgtaaagtttggattttggttaaaattagagatgatgtgactgaaaaattgtgtgtgtatgacagg

SEQ ID NO: 27274 - DNA, 569 bp, Oryza sativa
gtcagattaatagcaggtatgtcaacataaatcagctttaaaactgaactttaccgaatttgtaaattagatgtaaactcattttgcttgaatttctaaaaagtatctttttcctatgtatcattgcttcattttcatatgcagtgatgagcccaaggaaaacgccaaaaaggtaatttcttatttgaagctaaaatttcttatttcaattgcagaatcgtttgaatatttcttttaccgagattccaggccctcttctcacataaaaaatccaattcctgtctaccactgaatttgataggtctggcattcaagtgtagcacttatgacaatcctttatatttcaggttatactgcataaaaaaatatttgaaaaattatatactcaagctatacctggggcggaatctggctgtccccaaagttttgtgcagagaaattaatggctgaagccgtgattcttttagctgtgaagaagatttgtgttgccttgggaaatgaagcaatcaaccaagctacttcaaaattcaaaaagtttgtttcgcagataacagagcttcaaggaagca

SEQ ID NO: 27275 - DNA, 1501 bp, Oryza sativa; identical to SEQ ID NO: 26989

SEQ ID NO: 27276 - DNA, 1501 bp, Oryza sativa
ctctttgttatgttgtgctaaaggttatttaagaaagagtgataaatgcaataggtatatgtgtttagcgtttatttttcaacctatgtgcttgttaagatgttgcattataaattgtatgaaatcatgaatttttattgttgattcaagcttaattgtaaaatctttgattcatggttatactttaatgcatgcttattatattatagatgggttcatcttctttttattgcaacacatgacatgatatgctatatgtatgttaagcttttatacattaatgaaataattcctatgctttatgaaatcattgtcaaaagggggagaaataatgtgaaaatttttagatcttttggagttgtcaaaagggggagaaataatgtgaaaatttttggatcttttggagaagagttaagttttagaagagaagagtttttaagaagagcatgtttttggttcaattgggaatttctttcttttaaaaaggggagaaggtttcttgtttttggttcaattgggaatttctttcttttaaaaagggggagtagttttcttttggatttttgagcacgatgtgtacgtttgtacgaagtgtgctttttaccgcttttgtttttaatgttccaaactccaaaacatttttaatgggtttgccaatgtgttcatcaagggggaaattgtaagatcaacgtgtgttttgatttttattctgtgatgaacaattggcatctgtgattattggttttgatactggagtttattcacgaagtggttttggagatgattggagttcacaggtgaatctacaggaaatcgctgttatttcatgtgaccggtcagaccgggaaggtgttgccggtcagaccggcggagatcgagcggtcggaccggccggcccgcggtctgaccggccgacgctgtgtcggtttcggtttcgggttgtttctttggatatctgtgattgtttcatggttatggcttctagatagatactatacgtatgtaatactgtttgtttgctaacaatgagtcaagtgggagatagcttggtctcggaatatggtttctttgtttgtttcatgtgtaggtgactcaatgcctcgagagagtatttgcggtgatggtccgggagtcggcttggtgttaagacaatgtccgtggtagtcagatatcatgcgggatactaaggctagagttgatgcacgtggttgatggagattccatatggcatacgatggaggtattgtgtgcgtatgggatgcggagtcgaatttggaagtagtccaaatttggtatgattggttatgtagagtttgtttcttgtactaggaggtttcctatggggattaggactcttagtatgggtttggttcgtggctttaggctgctgtcttacaatgcatcgggagaatatttgcggtgatggaccgggagtcggcttggtggtaagacgatgtccgtggtggtcagatatcatgcgggatactaaggctagagttga

SEQ ID NO: 27277 - DNA, 1501 bp, Oryza sativa
agtttagttagggtttcgagtttagtcgagatttttgtaaggagtgctgttggtgcactttgtaaacacagagagaagcaataaagttgtcatctactttgagagttcttcgatttgtgtttcactgggtttcggcggtctaaccggcgatatactggtggtcagaccggcggcgctagggcggtcagaccggcggcgctagggcggtcagcgacaggtgatctcggcggttcgaatggactttgatctcggtcagaccggcgtgttccaggtggttagactggtacaactactttggtcagaccgcgagccatcgatttcgagggtaacttttattgccgctaaaagtttttggtttttgggtataccaatcattcacccccctctggttggcttagttcttgtgattcgatcctacaagtggtatcagagccacgtttgctctttttgatctttaccgatcttgagtttttgccatggctatttctaataagtttacaactaagcctcatattttcgatggaacggatttttctcattggtgtagtaggatgcaatcttacattatggctgagaattatgatctttggagaaaagtttctcatccttatgtgattcctgaagctattaatactgctgctaaaaaattgtttttgaacaaaattgcaaagctcgcaacattcttttgagtggtatttctcgttcggattatgatcgtgttgcttatcttcaaactgctcataagatttggattgctttgagtaattttcatcaaggtacaaataacattaaaaaacttcgtcgtgatcttttcagaaaggaatacattaaatttgagatgaaacctggagaagctttggatgactatctttctaggtttaataaaattttgagtaagcggtcagaccggccggcgctgtgtcagtttcggtttcgggttgtttgtttggatattcgtgattgtttcatggttatggcttctagatggatactacacgtatgtaatactgttgtttgctaacaatgagtcaagttggagatagcttggtctcagaatatggtttctttgtttgtttcatgtctaggtgactcgatgcctcgggagagtatttgcggtgatggaccgggagtcggcttggtggtaagacgatgtccgtggtggtcagatatcaagcgggatactaaggctagagttgatacacgtggttggtgaagattccatatggcatacgatggaggtattgtgtacgtatgggatgcggagtcgaatttgaaaggagtccaaatttggtacgattggttatgtaaagtttctttcttgtactagagggtttcctaaggtgtttaggactcttagtatgagtttggttcatggctttaggctgcctacctcatgtataaatagagggggagcgtgaggcttcccggattcgcttttgagagcaattgagttgagttttaagttagggtttcgagtttagtcaaaatttttgtaaggagt

SEQ ID NO: 27278 - DNA, 1501 bp, Oryza sativa
  unsure (1)..(1501): unsure at all n locations
gtcaaaggtaactggactcaccagtgaccactgatcactgaccatgcatgaagccgtcaaagatcagggtttgggcccgtcacaggtgacaatggccagtgtagtcgaatctaagtttccataatccataaataataaaaaaaagattacgcatcatagaattatcgatcgaggatatgcttacttagatttcccatccctgcctccgagtgggatatttatcaccgtgcgtggcgtggagactggagactcgatccatccccgttggatcatcactacaggcggcgcgcgccgcctgtacacagctagcttaaattttaagggcacacacaatatgattccccgcaaaaaaaaaaacctgcatatgattaatgaaaatcattgctcattgatagtatttgtagcaaaagttatcagacacctaaactaccncagttgctagtaattatagttacagcacaatcattttttttgacataattacaacaaaagttcctaatgacaattaacccatacgaaagagcactacaacactgaagataatccacattcattcaaagccacaccaccgttggttttcggatgaccaaagggttttgcactagttgacctactttgcatatcaaatacgatgaaaaggtatagctgcactttaaactgttaaaacatctatattttcattgaagggctaggcatttgtcatgctatggttaaatttgcttccaggaaatcttaaaacagaaaaccaaaacaaatgtttcaagcattcaatggaatcaccctctgcctctcgtcctccaccaattaccttttctacaccaaaagctcaactaaatttcagtacaaactatgggtataatataatgcactcggtaccatggggcctacataggaagagcaaacaatcagtattatagccatttcatctctaataggacatgacagtaaaataaacctggaaacaagcacatgacggattttatccttactatattaattttcaaaagatatatttgtggcacgggatataattttttattttgtcatgatacataggaggaaatctggtagggttaaatttcttcgtgattcttttttaagtgtcactaaacatggatattatcttaaaatcaatttaatacattaataatgcattcagtacacgtaacggaagaaaggtctaaaagcctaagcttatttcaactattaaatttgagtcatatcttagtatgattcaataacagagaaacaacgaaactatagtgaaagtatacaaatcatcaaccttcaccaagaccactttaggaaatcagaaatacaatactacggatggacatccattagtgccaaggtgggctcgatttctgtttataagaatcaagcttggccgagattgctgaactgacaattacgacacttacccaatcctcttgaaaataatatcttgtctccttttgatcatagatcaaactgtggagaacaaaaatgttggttccaatcc

SEQ ID NO: 27279 - DNA, 1098 bp, Oryza sativa
gacgccggcctccaagacgccgcctccccgacctcttctccacgaccgctgaccaggtacgacgccccctcctcctgaacatgagatgatgaatggatgaattgcagtttggatggatgacttgcttaaattgaatggatgaattgcatgattgatgaaatatatgcatatttgagatgtgaaatatatgaggtgatgaatttgcactgtttgtggatgaaatatatgcagttttagagctattaatctttttgtattagatgattttaggattaattttgctgcgttggctgaatgtagcatgattttgaattttttctgcactagtatagattaattttggccagtgatgttatgtggccctgctactgctcttattgtgcctacttgttcatttttttatctacaattgtttatatacatgatttatataccactgctattgttgccccctgtacttcttgttaaatggccaaggatgaattgctcaataacattctatctatacttgttcttttctttatggataagaatagattatctacacttgttgatttatatacccttgttgtctatgtgaatatccctctgttgttgctgtttatgtgaatttccccctgctgttgctgtttatgtgaatttccccctgctgttgctgcccctgtggcatatatacccctactgctgttatatggccctgctactgctcttattgctgctattatatggccctgttgttgctattgctcttattttctgcacttgctcttttctttatggataagaacagatgaactacacttgttctattttatggattgataagaggagactatctacacttgttcttttttctagattgataagaggagactatgtacacttggttcttttttacactttactttgggttgctttttctcctagcacctgatttcctctttttttttgccttcatgcaaatgatggtaattcatgcataatttctgagcaaaactgaggccatatctttcatagtataccccgtattatattggatctaatgctatttagtataatggttggaaatttataagatttttcgcgaaaattagacca

SEQ ID NO: 27280 - DNA, 1424 bp, Oryza sativa
gaatcgatgtatatagggcaaaaacattgggtttatggttttcatttttttattgcttatgaagtttgtcaggtcaacaatcttctgtgcttcagcgttgggagtttctattttctccaactgtttcttcaagctatttttggacttaattatacttggaacaacatcctacaaatgcatgcaaagttgatctggttaggtataaaagtcaccttctgtccaagaactgaaggaaatgatcgcggcacggaaactcccaaatgtaattcttgtgcaatttgcaagccaactttatatgtgcttatgtgcttcctgaaatccactaacagatttgagaataaaatttacgaactagtcgaggttttcatgctatcttcgctgtaaaatagagttatactagtatacttcttatatggttgaggcagaccaatttactgcagtatagtgagaaaatatggacccatcgaacatagcggtgttaatctttcttgtttttctccaattgatgttgtggaggtggtagaatagtctaaattgatacaatctaaattctacatgatcaaagatgtaaattcttttttcccttggaatatagtactgttttgctagttctttttgctgagcattgtggctttactaaattttaataatataattgatgacttgcaacaaatatgttgagattttagaccaatggggctttaataggagcctcaaattacatagctagcttcactgttctctccactcaactgcaataaatggataaataatccaataatagtagagttgataaaaatacggtttgcgagttatctagtgttctctttcttaacaagataactatgtatgctttttaacagatgcaagctgggacagcgagcgagcatgaaggcggctcccttgttcacaagtttatgagtgatgggggaaatcatccattctgtggcagatatggcccatccgatggcagctatcgtgacaggatcaatccttggaactctttgaatgtagcaaaaatcgtttctgtagttgtaaattgaattccaattgcacatatcaaagaggattaactcaaacatatatgaataactgggcatgaatgtatatttggtgggaactcattatcatctagcgagtaatatctattggctattgacaggcacgattaaaggttgacagatatgcttgccagctacacattaacccgagcatttttgtcaggaaagcattaacttgcattgattcatttgatatttttggatttgcgaaataatttctttccacaacatggcgattgttgcaatccgatctcccactataaatccaccatattcccctttccttgatttcacatcaatctaaccatctctcctcaatctacaggtgcattcttgctagaaagtagtgaactgcgtaggcca

SEQ ID NO: 27281 - DNA, 266 bp, Oryza sativa
tgttaccattgtatcacgtcgttgtctgctgataatgaaatcgaaatattttgtttgtaagaaatgcacaggtataatgtggaacgagttgatttaatatgcgctcactttttaagtagcttctgaaagaaatgagaaataattgttacttttgtctgtatacaccatattacatcatgcaaattaaacccaatcaagcaatcatataaaacagagtttaacatgattatctccctacttctgcaaaattgtgacctatgctgtcc

SEQ ID NO: 27282 - DNA, 300 bp, Oryza sativa
ttggtccttcctgttactagtataccgtatagcgttgagaggtcgctatcttgcgctgctcacggtgatgagctttgcttggatcgattaggtgatgcagcaagcacacggttcttacctcaatctagtctcgattagacatgctacatagcagcttaattattcagatgtcgtttttctccatgtttgtgcggttgcttgatcattcctgaatcctgatacatactgataaactcaagaggctcatttaagtgcatctgtgtgtacccgtgcaggcattcaacatcagataggccaaga

SEQ ID NO: 27283 - DNA, 732 bp, Oryza sativa
ttgtaaataaggttttggttgtccaatggaacacccaattattcagaaatttgctctgtttacgcataattaagttttttttgtgactgtgaatagaatttaacaaagctgcagttattgtgtcaaaattgctgaaaaattgcccatgtaaatttgtacttcctccgtttcacaatgtaagtcattctagcatttcccacattcagattcatttgtcaaccctatataaaatacgacataatcacttaataacatgtagtaactggaacaaatcacgatatttagacagaagattgaaacatggagatcttgtcaagctattttataggagagtttagaagttaaaaacaaagattctctcttatgagacaaaagataataattctatggttcgaattagagaagtttgatagccatgcattgtcgattgacaaacatactatttagttttctcattcatattttaaatcacagcgtaatcttttctttgtaacttctagaaaatcttgcttgcaatcactttgctaataatttgataacaccattttcgatattcaatgtgcaagatacatattcctgtcttttttggataggcttcacatgatttatatctaggttcaataacatgtttatatgctaccatcattaggttcttgtgcgtgattgatgatgtttgggaaaaatcagcgtgggatgatatcaaacttgctgtgcaagatgctaaacttggta

SEQ ID NO: 27284 - DNA, 549 bp, Oryza sativa
gttttctctaacttcgatgtagcagttatgttgcattcatttttgagctttgcatctagtacatttgcatatatccaaagctttttctgccctaatcaatataaaggtcgcggtataagatttttttcaagagtgatgaagtttttcatgaatttgcagtaactccgtacatctattcatgcttatttggagtctttggactaagctatgtttttatcgttgcacaatatgtcattcacttctcatagaaaatatagatttttattgaaatcttaggttagaaatgttttttttcatggatagattttatagtattagatagaggttttaaaagctgtgcttctgataccagatcagtcagatgacattataaaacattaatattgcttccaaccataaacatgtaaaattgtaaatctaatttccaagttttccttgttctttctggagaataactgtttatttacgaattttttagtacttatcatgcttcgaaactaccatttcatcatcattgactatatctcattcttttcttctgtcttaagg

SEQ ID NO: 27285 - DNA, 263 bp, Oryza sativa
acatcacactcgagtctctcagcttaagattgtcggcttcctctagtgcagatgaaggtcttaaggtacagctgagttgctattacattactgtttgcttattgtttatttccttgtgggatgttagttatagccttataccagtatggttgcaattagacttctgtttcaccgttttataacttccagtgctaatgctataacgcgtaaaaaggtccagatagtgcatttgttcttttcaatcacctaatgtttccatgtca

SEQ ID NO: 27286 - DNA, 636 bp, Oryza sativa
gtggtttgtccagatatgaaaaagtttgtacctggagaaggttgaagtcttgcaatttgctactagttacttgtccttttggaatcagacgagaaatttaccatgggacatctacacttgcttcttttgagcctgattcatttagttgcagcagattactgttgtggattcctgtatggtggattcatggtgtgtttagaacagttttgctaatagggaagtaactggagcatgagtttcagagtacttaatattgggcttgatcacatttcgtcaagacataacttctgaataaaatggcaagaagatgagtccttttccgttaattcagttggctagaaagggtgagcttgggttcaaccaaccttgatatgtagtaaccaaatggggtgactaggtcagatagagctgatcagctgttcttgacatggttgaagaatgtaccactggaagcaggaacatttacagtacaatggttgtgctttacgtcgatattatggatgtttgcttctttatgtccttgctgcagtatgctccatcttgaatagctattcattgatgtacaatttccatttcgttatgttcttgacgtacttgggttctataaaactaaaacagatttttttttttgctgga

SEQ ID NO: 27287 - DNA, 1074 bp, Oryza sativa
agttggaatgggaagtttactttgatttggtaaaagagtctcagtttagatctctagaggtgtttgcatcaaagttagttcgtaccgtagaaaatttggatctaaacaaatctcattcttatcattacgttgagaagaattttgtgacatattattctcgtcgtggagggggtgcaagtaagagtgagttggtacgagaagacttggagggtgaaggagagaagaagagacctttgcttggaaatgatttatgggaggcaggaccatcaaagagacattgcggtactgatgatgtggatgcagcgagggtgatgaaaagggagttagtacaagaggggcttgatctaagtgaacatttgtcggcgagtgttcattggtcgtcgtacggagtcaaccctgaatacccgacagaagtagcaggccaatatgtgaatccagatgattacttttatgtcgaattgagtggtggtcacgattctgtctcagtagaagtcaatagagatgatgttgacgaggaggcaagtgttgagcaatatgatgttgaatttgctgaagactctgatgatgaccgtccattccctccacttactaataatgacaagttagcattagaggaatgtcgtgcgtttgagaaggtgtttgggaggaagccggacattcctgagtttagggacctaacacatgcccatggtgcactagtagatggcggcatcaacctagatcagttgccagaaccattccagttggatggtctcagaaagggtttagagttcccatccatggtcgcattgaagctatggctccaggagtacgccatcgtgcaccatcgtccataccgtgttgtcaattctgccgcaaataggaggtacactgttaaatgtgaaaacccacggtgcaaatggaaggtccatgcaactaagaggtctagtggcacgtggaggatatcacgggtaggtaaggaacatagttgtgctactgccgaaggttcagggagccaccggcaactgacatcaaagttcatagcaaataggttatgcaatgccataaaactgcaacctacactctctgcttctg

SEQ ID NO: 27288 - DNA, 809 bp, Oryza sativa
gcaacgtggtgtagcgatggacagtgtttggttaatattgattaattactacaactgttttactgccttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattatcgtttgtgtaccctggctggtcctggacagggatttaatgcacattcagcttagaaattctggttcgagaatttctgggcgtgacacgggctccgaaactacacgcgaaacgggacaactcaacaaactgcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttggaaaagaaaaagaaaagaaaaggaaagagggagggattatagacttttcctcgggcggctagggcgcggcccaagggaaaaggagcggaccggccgagctaaa

SEQ ID NO: 27289 - DNA, 1501 bp, Oryza sativa
tttgtaagtgtaccaatagtgtactaagtgttgaaattgtattgtatgatggtttttaggggcatggctacatcgaaatgcgggacctatatgttttaagccattacatacttcatccattagagaggcattcatgtttatttttaatggtgttatcatattattcggtagatatgatatatttatactaattgtacatatgattgaaaaaagtgatgaacaccgggttatgttgtgtagatgaattttttagtgtattaataatgtatcatttgtttaagtggtgctaatacagattcatttattaaaagtcatctaactcttaaaacaattatagtaagtagtgatgacaaacaaccagtttatatatgaccaggataaagggatttttatttaaatctaagagacattcttatcacattagtagtatattaaaatctaccatctattttatggtaaatatattcctttttttattgtaggatgatctaaattctcttacactatatatatagtgattatatatatagtgatgtatgattccttttagcattctttttttaataacaaataagatgcctgtgcatctatgcaaaattcttttctgatttatattccggaaatgttctacaacttatattccgtcgttatagagtttgaaacacaaactataatacatgcccacgcgaatgcgcgggctacctttctcgttgaaaataaaaagcacttccaaagcatcttcttctaaagggctaatagcgttattccaacggatgtcacttatgacaagtatctaaggtatattggtaccgcagcacctatggtctattagaacttcactatgtcccttaggacaaagatgttaaactagataagacctaatgccaattgtaaaatcttaaaatatcttttctaccttaaaagctaaccaataaggtaagggctttctctcttatacattgtttttttatccttcaacaacaaatgtgggaccgttcaacataatccatcatcaaaattacaacctcaagattgctaatcggattttgggttgggaatagattcctctttatttttcagaaaaaaaatctaaaaattgactgacagtaataaaaagtgtgtccaccctactaccaacaattcaaaaaactagaaacaaatatctcatcctccgtttaaaaaaaaactaatttgcaaagatcaatttggacaaacaaataattatctggactcatattcctacaatttttttaatcgaaaggatatatatctgttgtgctctctctctcctcaattatagattctctctaggaacgtgatgatatagcagaaattgttttttagcctgctggcttgtacttcctgctttaccgacgttgcttctcggaagcacacacccagtcgacgacgacttgacttcatccttatcactaaaaacgccgcctgagtaatacaaagaggcgtaggcctgcctgactataattggctcgatgatcgactg

SEQ ID NO: 27290 - DNA, 1501 bp, Oryza sativa
atatattggatttttttttgaagtaacacatactcctacgtacattaattaactgtttccattcgcatgcgtgatggagcaatcgacaggccacgcagatgtcacggaggaaaagcctagcgtcccgccgtcgagcgtaacaaagatctgccgagttttacgtatctgcaaacgatcatcgtcggccgcaacatcggccaagccgtgatgtgtcaacgacggcaaatgcatgcacgcgggaataaataatggaggcaccgattaggatcaacaatatggttagtccattaaatatgtgtgtaagctcgatcgatatggaataatgagaaacaaataaacaatgagaaacaaatattcaccatgtttattactacctctgttttcaaataaatagtattgattagtgtaattttgaactaaccggcatcaaacaaaaagaaacagagagatacttgtttacgttacttcttttgtatacgtatccagccgcgatgttcggaaactgtgtaggatcgagattggcatcgatcagtaagggcatcaacaatgttactttttagctgccggtaagaagcattaaatgctcttttcctatccggtagcaagctctgtgagagtggcgaagaattaaaatctggtgataatatctattaccggtatattactaccggtgaagaagagataaataatattatttatatagtgttttaatagaactttaaaaaaatgaaagtggctgttgctgtggggtgatgctcggatcgagatgacatcgatcagatggtgaaagaattgtttaggctgtgttcagatgcagttcctaacttcaaacagtgcgcacgaaaaacgaagtgatcaattagcgcgtgattaattaattattagctatttttttaaagaaaatgataatatgattttttaaagcaatttttgtatataaattttttttgcaaaaatcacactgtttagcagtttaaaaagcgtgcgcgtggaaaaggagaggtgagtgttgagaacttggagtacccaacacagcatctaaacaatagtttcaattatccctataaactgtggcaacaaaataaattcactaaatatatatgtttgtaccgaacaaccttagaaaagactgaccagaaaagtgcatgatctgcaaggtagccaggtgcatttttagtgataataagtgtgtacttcgaggtaaattttgctacaggacgcttcgacttcgtggagttagccgtgggataccgcctgaactcatttttagaggaaaacactccataaatatggtaatttgtcaatggacaccgcacctattagaataataatttctggttgaagaggagagagaaatcacgtgaaataccaaaaatgcctttgggccaacacgtcagctctcctatctctcttctctctatcttctctcccagagggggcatcggtcgccggggcggaggacggcgaggacggtaggagcggccgccgcgggcttgcggcg

SEQ ID NO: 27291 - DNA, 223 bp, Oryza sativa
caccaaacagggccaaatttcttcttagatggtcaaatttgttcctgctgatcactgatcagacttgagactcgagaggcaaaagcagatcatatttgggcccggcccacaagtgacttgggcccgcttgcttgtgggttgactaggggtactactggacaggctggtggctggcctcgccggaaggcttggaagcccgcgttgactagtggcggttggattg

SEQ ID NO: 27292 - DNA, 1501 bp, Oryza sativa
accgccgcctgtgcaatcgggaggctgtgtcaagctgcagccaccactccagtctgacggcagcgacaagcaggatgacaaggtccagccactgccactgcagtcagatggcggcaacaaggagcagccgccgcctctgcagtcggagggtggtgacaaggagcagccgctgcctctgcagtcggagggtggtgacaaggagcagccgctgcctctgcagtcggagggtggcgacaaggagcagccgccacctctgcagtcggagggtggtgacaaggagcagccgccgcctctgcagtcgggaggcggcatcaagcagcagcagcaactgccccagtcggatggtgatgaccagcagccgctgctgccccagtcggacggtggcaacaagcagcagcatatcagggtcgtcataatcagtgtgcaagatggcatggatgaagctgctgttggagagaccatgctcaagcgttacaagagtcactggcgtaatccatggactgatgaggagctccacgttgctctccaacgacctccgattctctcggagattacaaaggccatggttgacaagctgagacacccgaaagaaagggagacagacaatgaggcagaagacaggcagaggcttgccaagaaattgagcaatgaaaatgtgctgcttgttctttccggtttgaattacccagtgttatggcatcaggtcctggaattgttgagctcgacgggttgctctgacagtgcagtaatactctgcacaaatgatagtaagatggcaaaatattgctgtgactctgccaaatgtgggcctccggtaatctactctctcgttgatatttacctcaacaaagcgctcgccctgcttccccacagatacgatgacagacacttgaaaggaattttgtgcaatatcctcacccaatgctgccctgatgtcttctgcatgaagatgttcctccatgccctctactacaatcctgaaacgacggaacaccagttgcaggtcctgaatacaagccttggtaaagaatatacagatcatgggaggcaggacagaataatggccttctgctaccaagcactgccaaataattacaagaactgcttatggtattcaaccgttttcacccgtggaatcagcatgcccgatggcgtccgaagagcaagtttactaagacgatgggttgcccaaggcttgattacccaagtggatcagtcgagtgcagagattgaagctgggcactgtttcgaagccatgctcagacagaagcttattgttccttctggactcagcggtgcacgtaaggtaaagagctgcactgtgcatcctgtggttgccgatttgatagacagggagtcttcgacagttgaggacctattgctcaacaaccagttgccacttgacttggatctcctctactcaatccggaacggcatgcaactccatccggctaactctaatatcacaaggttcttgaactcactttccagcacttcaagg

SEQ ID NO: 27293 - DNA, 351 bp, Oryza sativa
atctgggtccaatgaaccaggccaaggcaagaggacgggtagtgggctaggggcatttttgtcctttaacaaagatctctctaagggttggtttggtgaggcctatattgggccttaccaatatttggcaatttcaatagtgtttattgctatttggtttggagccaaattttggcatgcctaagaaaataggccatttcaatagttaatttaggctattttggcttcaatccaaacacaatttttcctttgccaaaattagccatgccaaaagttaccaaaatttgacattgacataaattggtaaggccaatttaggccacaaaccaaaccagccctaaatgacaaaaa

SEQ ID NO: 27294 - DNA, 1501 bp, Oryza sativa
tatctcaggcctggactttttgtcaatcgttcacccattttttatgaacggttaattagttgttgcaagggttcacccattttttttaagaaaaaaaataccaatggcatgagctttgacgaatatattaagaagaatagagtttacaactacaaagtctaaattgctatgaaacgaatgaaacatatcagataagctcaaaaagctaagagaaaagaatcatagcagtctgaaagcatgtattttggtctatttcttccataattaatcttacctctctctgcctccatggattttgcgtaaaaaacccttttgtttctctctagccaagtgttccaacgggaggttagaagagttccaacgatttccttttgcttggagtgaggattcgtgcttgctagatcattctactaggattatattgaggtttccgggcctggcagcaagattctttgcccacatatgtacacattctcaatcaatctattgccgcatgagctttctctacaccatggtatcatacgcttttgatctaattttcttccactaaccctcttgttgccggcctctgctcgacatgcccatccccaccctactcctcgccgccgccttctctatctagcatgctcacaacgccgatcttcctcttcaatgtcattgccgtgcagcctctggcaataatgattttgggtttagaatagtttttaagacctatatgttagttgtgatcgttgtctacctataatgcgtctaaattttggattttgatatctcaagaatcagataggacaatcctattgttcttcaattcgtgattttttatatggttttcatttacatgttgaccgtggcaaactaatcttcgaaccatttttaggcgtcagcatcaaaggagcagacaagtattacggcacacagtttttgcatcttgtgtgggatgttgaaatgtgtgttcctatgatcaattgcatgtgtgcccagcggattctcaagacaatccagcgagagaacaactgtctagtgttttgagttgaatcctaagaacgtgacgagcaagcctattaattgtcaactctcaacacaacagtaatatgagagactaaaatatcatgagtaggaaactagatcatggcactcttggcattattttggtagcagcgtgtcctttttctaaaataactgagctcttcctttatgacaatgaaataatattctgggctcagctgcatgggatcgttttcactaaattttttttgatacggagttctggcctctgaataggtaaagagaagttctcgacggcaaggaagggaacactgaactttctatgattttcaactagtttaacctatttaaaatcagacgatcgagacggaacatgcatttcatatttccatgtgaactccaacaactcgaccaaaacgcatacagattacagaatacagcagtggatttcagagcactactgcagccaacgatcgacccagagattcacatgagc

SEQ ID NO: 27295 - DNA, 615 bp, Oryza sativa
ttctccatgcctgcgccgcctggagcagcatctcagagacgtccagcgtcggctcgcccaccgatcgccgccctgatacaatcaccacactgaacacacaaagaggaccaaattaacagtcacgcatcccaggcattcgacgaaacccaagcagaggacgtgacgaacagaaacagagggcgttctcctaccatcctccgccgcgccaccgccgacggccaccgcgttcctccccgtccccgtccccgccgcgtccgctgtcctcgtcggcgccaccaccgcgcccgcgcgctccgcacctcgtccgcctccaccatgagccgtccacgtcccttcctccccgcctcgcccccgcattctatcacccccctcgcctctcccacccgcagcagccacgggacgacggggacagcgagacggaagcgcggccgcgcccgcgcgagcgtcgccgcccccgccccactccgcccacccgcttctcggcggctcgctccgccgcgcggcggcggcgatcaacgcctcccagcgatccatcccccgccgccacccgccctgcaaatcaccccaccaccaccaccaccaccaccacgcccaaaaaacccgcaccaaattagc

SEQ ID NO: 27296 - DNA, 1501 bp, Oryza sativa
atatggaaattaaatgatgatagcgatgagagctgttatatttttcatcaacgaatgagaaaggtaactgaaattttacaaatgacctgaaatctaaaccctccctgcttaaatgacaatattatatcaagacaagatttttaatggtgtgtttcggtttgccgcttatcaaattattttgacagggtaataaatgaaacttgccatatagtattatccaactaggctccaaagcattgcaactgaggatccctcgagtgtgttgcatgttttctttgtagcatgagaattatgcacaaataaatatcaggacggttcacattgaccctacaagataggtttgatttagttcctaaaattcttttacccaaaaacgtcacatctaatctttgaacacatgcatggagcataaaatatagataaaaacaaaaactaattgcacaatttgcatggaaatagcgagacgaatcttttgagtctaattagtccatgattagccataagtgctacagtaatccacatgtgctaatgacggcttaattagactcaagattcgtctcgcggtttccaggcgagttatgaaattagttttttcattcgtctccgaaaacccctttcaacatctggtcaaacatccgatgtaacacccaaaaattttcttttcgcgaactaaacagggccatagctcagttcatcactcgtgaaaaaaaacatatatttatttttagtgttaaaaatgagggatgtaattaaaggagctctttcttctcaaatacgcaagagagttggcatattattgcatcggaaaaggagaaaacataatacacgacagactcaacgcatcacgaacgcaccacaaacaaaaagaaaaaagattacaccctaaactaacaataggatctttgacaccaaagatcaaagatggcttcttcttgatccaccagttaccaagcacaacatcaattatttttttatgggaattactgttatgtatttgtccaacagtatggcatttattaaaaaaatatttacatcatacaaaaggacatgaaaaccgtagaaaaaaattacaaagattgtaatcaatcaagaacattgaatcaccaaccaaagaaagaaatcaaagcattgactgagcccttgactacaatgtagtaacttctacatttgttagagttgattcttttaactctctcgttttaattcaacctgtaacagtctctcactcatgtactcttaatttggatgtaaaggaggtacacaacttaattctttaaaaattaatattgattaccaccaagtttaaccccctatagcatcaatgcagtagctttgttagagttaattcttgtaactctcttgttttaattcaccctgtaaatagtctctcatgtatggctatatatattttaaagtttgcatgcaattgacagtaagaattatctcattccatctctcgctctcccagttctttatactttttcatgcctggtatcttatg

SEQ ID NO: 27297 - DNA, 1501 bp, Oryza sativa
attgtcggtatgtctgacacgaacggtattccattatgaacaaacgcttgctgaagaactgtattctgccctccaacctagttcaagatactgttgtaaataccagcagtacaatacatggaaaaatgtgtagcaaagtatcgatacatatgtaccttgacatttatcttaagggcaatattctcgaggtattttatatttgtatctgttttaacattctttggtaagcagcactgagaaaccagtccaagcttggtctcacatacacgcttaatttttcctatagaaacatgcaaaatgacacctcaaagctaacagaaagcacagagttttttagcattaataatttcataccatagttgcctctttcttccggaagaatgacaattaatagctggagttgttcttttgcagtgctgtgaatagacttcaatgcagcagctatgttcagatcattaatagaccataatggtaccaatggccactctttgaaatccttgcaaccacaaaataaagtgattgttaatgcaatatgcaacaatttgaataacttggattataaatcaatgcaggaaatagcataccattccaaggaagttgcacgtcttgatcatttaccacagaatatcttaactgttgaagcaggtacttttgaaaaatttaaacaagcccatctctcgacttttcctccatttaccaatttctgaaataacaatcaattcatactcaaaaaaatatagagcagaaaacatgcactctaacaattttgaattttaacttcaattaaagggaatatggcactttgttgcaatgaagcataggtgatatatacttatgaccctgcacactatatgatgtatggatatttatgcatttcgtgtttgttgtttgttgtggtgactgaaatgcctggttcatattcaatgtatgaaacaaatggcctccaatacttttcctccaactagctaaacagagatatgacaaatcacagatgtcctaatattaaccaaaacaaagaaatttgaagttttatcaaatgtgcctttcacttgtgtgctacttgagtatgtaattacactatatgtgagcacattacgtacatactgccatgttgaagaacaagggtaagtaataaaaaatgcaatgtacgaaataggatggcagattcacagcctaacaccataattagaaataaataatgatgcatataatcactttatgacttcacttgtctatggagtttgtagaggttaggttgagttcatgaggcttccatttcctttctcatgtcatgtgggggcgccactaccaccgcaggagcaggccggaggcacagttgcagcaagcagcatgagtcaagggtgcaaacttagaaagaatcatgcaaggaaagtattaattaggaggaaataaatgtcattccttgtattagatgccaagtgcctataaggcatgtaatcagcaacatttgaagataagcaatttgagatcaaaattccta

SEQ ID NO: 27298 - DNA, 1501 bp, Oryza sativa
acggtgtcaaatattttgaaacggagggagtatatctctaccacaaaccctccgtgttttgcttttgaatataattaagaatttaagagtgatgcgttgtatctttttttaatggaaagtgtgatgcgttgtatcgatattcagaacaattctcttttgaaataaaagccattccatggataacttctgtacaaactacatagggatcacttctatacacggtatacacccgtcattatcaatgtcgctgcagggctgctgtgatacacggtacacgcgaatcaccacagccgagatagcattctacttcttcattcctctgcttctaccggacagaaggtagcagattgaagaaccgtctattggccgtttgctgtaacaaacgcgtacgtccggcccgtgcgtgtgccattgcttgtcgccacgacgtcgtcagcaaaggtcaccagttctccatccgctttttttcttttttagcgaaataattctccgtcagctagccgataggatgaaagcaggatggacttactccctgtctaatagtacgaatctggatatacatatatttagatttatagtattaaaatatatcatatccaattatagatttattttttatgggacggataaagtatgtgctttaaggccgaatttttttatttttacatttttttattaaaatatttacaaaaaatatttttttgttttgaaaatttacaaatctagtcgcctctcgccctttggaagggagatttttaaaaatcgctcttccagagggcgataggggacctaaatgcaaattttttatttgtgttcaaacccttctcaccagctttaattccttaaaaacgaataatgcttattcaatactctaaatgattttaaatggaaagatctacaacttttgtataaagtttatctccatccgatgtcatttcaaatgtagatctgagattttttaaaataggttttatattttgtaacgaatattttatatctaaaagatcttaaatgaaaaagttgttaactacaaagttgtagagctcctcgagatctacaattttgatataaagttttatttcatctgactttatataatataattttaaattgtaaaatcatagagctacaacctatgctgaaaaatttgtatttaggtcccttatcgctctctggtagggcgatttttaaaaatcgccctcctagaggacgagaagcgacaagatttgcaagtttttgaaacaaaaaattgttttttaaatattttaataaaaaaatgtataaataaaaaaaattcggcccactaagccataatgggaccacctatacatttgtcgataaattttcttctgaaaatttgacagatgtaattatagtacaatcgtagtgtaattacactgtaacttatatgtaattacactgtaacttgcatgtaactatagtgtaacttgtatataagtttcacgtaattttgaatcattaaatctattacaagatttgt

SEQ ID NO: 27299 - DNA, 1501 bp, Oryza sativa
cggcaagcagcggaagtggcgcggggctcttggtttcttggtgcttcggtcagcgagcgggcggaggagcttggtgctcttggtttcttggcgattgggtcggcgaagcgacagagatggcgcgcgcgggggaggggggagggggggtcttgttttattggcgctctgatcggcgagcggaagagacagtgacgagctctttgtttcttggtgctccgacgaggagagagcgcaaagaggagagaagttcgttgcgacggttactgcacagggctctaggcaccaagaggggagaggaccctagccagcgatggcggggttgcgccgccgccatagggattcgatggtgccggtggaggtcagatggcgctggggatgacgagttggtaggcggcggcgaggtggccataggaggagggctactcttccgcactaccataggctggccagtgaggaggaggggagggtcctcaggcaaccgcattgccgggcaccgaccaccatgcgcctctccccaccacacgccaccccctgctcgtcttcagccgcgcggagagaagtaggatgggagatgaggggagagaagatcgaggtgctaacatgtggggcccacatgggtcccacgctgactcaaccgccacgtcagatataaccgaggtcaataccgtcttaaggacccagagtgacccgattttgtaagataagagatgtcatatatttgtttttcggttgagtgacgattttataattcggtgacaagttgaggaacctttcatgtatttttttcctttccaaactcgtaatccagttgattttaggtgggctagaattggatgtcctggagtcggtataggcccagagtaaagcccatcgtgctcccaaatcctcccaagcgtcaagtccgcgaacagctgcataaatggagagcagcaaatgttaccatgatgttgacgctctgctcccgtctttgtgatattgatgctagaggctcagccttcaggcaatggtggtgatggtgagttagctagctagaggttcattcaaaccgtcgatctccacaacaataccacactcctacttcctccgttttatattataaagtgttttgagttttaaatagatgttatatgagtcaaaattcatatgaatgaatattagtaaatctaagcaagagatgttgaggtcaaaacgtctaatagtatggaaaggagagagtacaaccctaggagacaggtcaccacagtccacaagcatttaacagtagaacatcacgcctaggacacgatcagcaatctttggaaccttcagaaactcaggcaactcagaagacacttcattcctgatgcttgatccatcgccaaacttcccgagatagcttcgtcctcgggctgcagcaagatgagcatagtatagtgggggaactgcatagcaaagttaaaaagtttatgacttcaagcctaatcagtagccctcaatagtccaaataaaaagacacacaacg

SEQ ID NO: 27300 - DNA, 1501 bp, Oryza sativa
accagattcgtgaattttttttaaaaataatattattttaatggaaaatcgcaaaattataggtcggctagacgaaatcgcaattttagcgccctgtcgaactggggcagttcgataggtacccctgtcgaactggggcagttcgacaggccctagttcgacaggctagttgtccaagaaaaaaaataaaaaagtacttgaacagtacccgatagggacgtatcgaacagggggagttcgatagggcgcgtggcatggacgtatcgaacagcgggagttcgataggcagcgtcgctacagtgtcgctacagtgttttccctttttttatgttattttattacctgtcgaactgtaccctatcgaactggggcagttcgacaggtaccctttcgaactgcctccgttcgacagggtgctaaacttgcgatttcgtctaactgacctataattttgcgattttccattaaaataatattatttccaaaaaaaactcccagattcgttgccggttatctttcctagcagcataacgtgacataagcatacatgacatcaatcagggaatcccatcttgcgtcacacttccatttcaccttcatgctttccacagctttggtttcttacctttttcgatttcgtcgttcactgttgttagtcaaggtgacctttcactgttgctttgcttgtgatgcgtagtacaagagctcatacttttgtttcgttagtgctggtggtacatggtgcacctcctatctttaagacctttttagccaaaggaatcaccttgggaccgtgcaaacaatcaatcaatgctgtagtatttaccaatgtcgaattccttcgtttccaagtaagctctaatggtgtatactacacagagtcaaaccttgagctcttaaatcattaatagattcagaaagttattaaaaatccaatatatagataaaattattagatttatttacttttatatagttatattcttaataactttataaaaatataattagaacaataatgatgatacgtatatattgggactgctccattcgtttcataaaaatacaaggttagtatgggatgtgacatattaggccattcctaacccaataattaggatgatgtccatagcattaaataagttgttacctagaatgaaacatgatgtggcaatgacaaaagagaaggaaaccaggtcttgcgtgagacatagtttctatacaacatttaaaacatcatgtgagataagtagcattaaatttaagtatgaaagagtggtgtttgcattgagaaagtagtgtctagggagtactagtttttaataatatggagtttatgaaaaccatgtctagtgttttgggttggaactggtattatgtactagatttttctaataagaatatgtttttatttttttaaattctttttggaagttgcaactttatagaagtttactatattactgtagccatggccttctacataagcaacggaagactc

SEQ ID NO: 27301 - DNA, 1501 bp, Oryza sativa
tcgccttcgacgtactgcatcgggagaaggtgacaataaggtttttgggaagcgctttgcgcgactgcttgctgttcatccacaatagctcgtctttctcttcgctcgggtgctgcacgctgttgtcaacgcccggtaccgcgagtccttcccgctgtgcagctgagcttcgaaaaccctcaatacgtattcgttatgtttcgcatattcgatctgttcaaggtttactgtccaatttatatgtgtagatcgtataatgcgattatgctagtttacatctgcaatgttatgatttatttatggaataaattaaattaatatatgcttatatattcaataattatatgacaattaatatcaaatggagggagtatatgtcacaggcatcacataaaccgtggtcgtaggagaatcggatgtcgtggttgtgtgcatagaatttttcttcttttccaattgatgaggatcggatcccttaattaggcagaacaatccgcgtgtcaaaagcttttgacgagtattggcatgcaagccacgtccattcgaattcatccgggcccacatgtcatttagggtgcgtttggttggtgaaaagaaaatttttagatgcctcattggacgtttgatcggatgtcggaaaatgttttcagacacgaatgaaaaaactaatttcataacttgtctagaaaccgcgagacaaatttattaagcctaattaatccaccagtagcacacgtgagttactgtaacacttatggctaatcatgactaattaggtttaaaagattcgtctcgtgatttccatgcaaactgtgcaattagttttcgttttatctatagttaatgctacatgtatgtgtccaaagattcaatgtgatattttttgaaaaaaaaggggaactaaacaaggccttacttagcttcccaaggtaaagcagcttgtgcgctactccctctataaaaaaaaacccaatctagaaggagatacatcccctcctaagagcaagtttaatagtatagccaactaatagttccaaataatctataatcaattttatagccaatatatataatagttacctataaacatatactatactattgatacatgatcccacctgtaatacatatattgcgtccattctatgctgcagcgggctataaattatagcctactgctcttcactttcttctttttatctatatatgtgtttagagttggcttatagtttgttattgtatctattttaatacaacaaatttggataaagaactgtccagaattccaaatttattattctatatgagaggttacatgttggtttattttaaaggacggagggattatatatggagtacatacgtatccatcttggtcgccgatatcgcgcgcgcctcatctcttccaacttccaagtggtaagcaacagaagccgaggccgagccagtgcagagggatcggggatcgccatggttgccgtgggatacatcgtgggagcca

SEQ ID NO: 27302 - DNA, 1501 bp, Oryza sativa
gcgtccgtgcgtgcatatgtgtggccgaggaaggaagacgtccgttcttcccacgtgccggtggccgtttctccccccgaccttttcatgtttttaagttctactcccttcatttcgagttaaaagacgtttttactttaagttggatcaggtttgtagaaaaaagtagctagtaacattttcaacccaagacaaatttattatggaaatatattcaattattgatttgatggaactaatttagtattataaatattattatatttgtctataaacttagttaaacttaaaatagtttgactttgactaaagttaaaacgtcttgtaacctgaaacggagtgactaccttcgttttcatattaagtcgctttgatttataagtcaactatgttcaaatttaattaaatttatagaataattaaacaacatgaaaatagctttattatatctagcattaaatgtatatttataatatgtttgttttatattagaaatgtttgattcgaaaaaataagccagatcatcatataatatgaaatggaggaatttgaaaacttcaactcatcggtgccttcctcggtcaattatggtgcagtggttagctggtactagtacgtatcatgatgttgatcgtgtacctcgtattatccttgaccaagtgaatattgatgtgccatccaatgtacctgtccaagaatatggatccattcaaaaggacataaaagaatatagagtgttgccgttccccggcatttccatcggaaggaggactgtaattacccaccgtacccttcaatcgcgaaaacaaccttacacataaatttcttcttaaagatatttagatggtatacatgaaaatcacgtgtgtagatttatctcagaaagtacttttacaaattgtgattttattaggtttctaaaaaaaatgcaatacgaagtattagcggaaacagtatttttaagactatgtcagaattgctttttgtttgatgggagggagtcaccgctagaaaatcgatttttcatggcgtttatctattttttttctctgacgtctataagcgaaaaccgccagcgaaaatttaacgagggatgaggtgctaagaactgccagcgaaaaaattcattttcgttagcggccgggataagagaaccgcttgtaaaaatagaggtctttttaaagcgggcctcttaagtgaccactagataaaatcaaaatttcgctggtggttgccaaggagcgccgaccgcaagaagttattcgctatattaaaacaccaagtgcggactccattttatccactgactagtcactccatcttatcctcttctcctcaccacctccctccagattcatctcaccccacctctcggctctcagctgacacggcggataagatgacggcgatagcggaccgcgactgcggcgactgtgaaatcgacgcgcgcaaaagccgggcctcccccctccccctccccctcccccgcgcgctgcgatag

SEQ ID NO: 27303 - DNA, 1501 bp, Oryza sativa
tcaacaagctcgccgactccatggtcacatggattgaggcctgggatcagctgaacccaccaaagggagctgttgccaccgcaaacggcactgccaagagcaagtgagagggcggtagtataaaaacttcgtttgttcatgtgaactgcttatactgaaataccgaaatacttttggttttgttagtgctgattgaactgagatcgcttcagcgttgtaacttcaaatgtgtcacctccctggacaaccgtcctggctgttctatggtatttacaattttttttttctttttggtgtgatgaaacagttgtaatgtcaggatcgaatcaccttcaaattagaataaagatattggttatgtttacatatcgcatcatgtgttttgttggtgttgtgcagttatgcttcctttttgtagtgccttgataagacttgcattaaaaaaaaattaaaccatccctggatgcaccaattttatgtcagtttaaattatctgttcctaaattttgtctctccagtgcacaagcaacctgcttggaattgataataatacgatagtaatcattttatcaaagaaatcataggatttacacttacacatacatggccccattgtaaaaagaagaaagaactgccttcacctacgactgcatttctgaagtttttgcttatctgaacaaacagcaaagaaaacacattattttgaagcttgaagttcaaaatcacctcctgtactgtaaagttgcggaggagtaccttttccaatttggaaattatcggctatttcgtcatttaaaacacaaatgcatcttgcatttcaagtgccaaaaaaattaaaaactaattcgccgttgccggggatcgaacccgggtcacccgcgtgacaggcgggaatactcaccactatactacaacgactttgttgttggcagttctaggaaattattttttatttatttacttccagtgtttaaaaggaagagaagtagagaacttcccatgaatgtgcagtacacatatgaatatatataatagaagatggactcttccacatatatatatatatatatatatatataggacactcatatggggcaccatggtgcccgggcaccatggtatctaatgcacaaaatcactcaaatttttcaaaattttcaaattgtgagtatatacctagttataataatttgatttatacctatacttatcaacaaaacaactcaaatttaactttatttcacaatccatgattacatacctaacaaattatatgtatggatgctatatacctagaatcaaaatctaacaaaaacaagttcaaattcagttcaaacttgctttaaactagttagtaaagtagttaatgttaatacctaagtaattgaaaaagtttcattctcatttgaattgggtatatactcaatttcaacaatggtgcccgggcaccatggagcaccaaacaaatttactatatatatatatatatatatatatatat

SEQ ID NO: 27304 - DNA, 1266 bp, Oryza sativa
gtgttcgtgaaaagaaaatactttgccggtgtaagtacagtgcggactgcaagaggcaaatcaccggcgatcgatcaccggccgacgtgcgaggcaggcaaagagacgagcatctcgagagaatcacaatgtcgtgtgtctcgtcaactcattattgtatctgtataaacactcaaaagtctcctctgtataccttggatctctaaaaagtttcattttcattccttgggatgaagaaatggcagctataacatatccagattcattgtattaggagatgtcgcatccttatctaggttgtgcttttttttgagacagagggaatattccactactttcgtcaaaaagggttaaatcctgactatgcatctggacaaacatttatctagatttatagtcaagatttgcggagccatcatttggcttattcgcggaataagagaaatggcatatttacaaacgaaaagtaatttgtgaataaaattttatatacgtgttcttagcgatataaaagcaaagtctgaaaaataaacttcgataaaaaaacctcaaaatcacctctaaatttaaaattgaaaattcaaattttagctgataagtataagcataagcgagaaaagatgaagcccttgatttttttttatggacggaagaagtagtactgaaaatgaaagacgctcattgctcaccctggatataaactaactaaaattaccgatttgatcaggtaagtactctgtcagcattgatctttttctttctttattttcaaaaaaggcgattagttgatgtactagtactaatgcgtacgttctagcagccatcattttctgttaggcattgatatgttaccggttttgttttccttgcagctcacatggagagaggagaccatccatataagctgaaacgtacgtcctttctttcgtacgagcgtgacagatgatcacaccatctactcctatattgcaggcatcaaaattcactagctttaattgaaacaaattgtttgcttcagtgcttcacactttatgttcttttttttttaaaaaaaactttattctactgtatattatttagaccattgattttaattttattttcaaaatattcaattcatctttacaattaagtaaataatagtatggtgatgtgcgtgtagctgtagctaaggtccatggcgtacgatgtggaaaggcgtatttgcgtgtgtaatcttcaagtaatcgcgcgcagctcgtactcaaagacgtttttctgactggt

SEQ ID NO: 27305 - DNA, 1501 bp, Oryza sativa
tattaatctatcttgtttattttttttcaatttttttcacaaccgtttggataacatgcagataatgaggggatgtcccctcgagagtttagaatagttcccaactcggtgtataaaaataacattcatagattcataattgaataatgtagttatattttaactattttatgagtagatgatcatacaaagaaagatgtgtgttagggataatgtcaatatcctagacaagaaataaaaaaaggaacagaaggagtatttggtagcatagaagtagcttgaccttaatactaacacaataatgagagagtattgttgcctatccaaaaattttgcaaatttgaaattatatttatcacaaaaggcatcatttaggtcccttttttcccttacgagctactgatattatgctccctccatttcataatacttggtgattttaagttcgcattgttttagtttggccattccaattttataaataaacttttagtattagattatgtaacatattattaaagtatgttacatggtaatggtaaatatagagatataaatcccatccatcataatcataaattttaaaagatattaatggttaaactgaagcaatcaccggtcaaaattgccaaatattatgaaataatagagtataggaataccaataatgaaatatttaaattcctcccattaaacaaaagatattagcataaacataagcagtttgcttaattgaaaaccataaacatggttatacttgaacagtatagctatgtcaatcagtttattgttgtcctaaaaaatccatttcaagaaataaacaccccaatttgtgagagcaagttaatagcaatgggcaatggcaacttgcaccatgtatagctaacttggtgacagtacacactaaagggacaaaagaaagttgtagtttcagttaaagcaaggccgggtattaatttacttcccattatcttaaaaaaaaaaagggaaatgaaaccgaatgcatcaaatgaacaagttaagtaagctggtcaccttatattccacctcgaaattaactaaacaaaagtatcaaaccatatgtcatgtaaagctggccgcgccatttataccagtccaggagttgtcagtaacttaagaccttactggcctggttagaggagccgcttaattagcaaggcgtccgtgcatatttcaactgaagtgctgctctaatgatttccagaaataacgagacaaataatacaagtttaccggcctagctaggctttggtaataagcatcacttgtatatgctacagtacacaagagtataagcatatgataaacctagataagcacactaattaaaatttaaacatatctttctttccgcccgtactgatgaagcacatgaattttttttcacctattattccattcctttttatacaaaaaaaaatggaagtgaacgtgttcaccaatgctacgatgattgatgagtccccaagaacaaaactga

SEQ ID NO: 27306 - DNA, 1501 bp, Oryza sativa
accttttcaagctcatcttccacagcttttgcgatctcattcttctgctcaaatgcatcatccaagttcatctttggaacactagccctgatcactgcgaggaagaaagttctgttagcattgaacaatagaggcaaaacatagagaaggtaatcagaagagtatgaactgcaaatgcatcggatgcatgaatgttcacagcatacaggaaccttaccatcaaaaacatacgactggatttgctccctggtgttgctaagcctgtaaaaggcgtctgatgccttctcagcaagagcacggtattgcacagatgccacaacattgacaaaaacattgtcctgcagatatccacaaaatggtatacatcgtcagagagctcagaaaaggtgggtttattctttgatgcatcatgcattagtgtaagtgaagaataaggaaaacagagatatgtgcacataaccatcatcagtatgttatcataaaggagtaaacgaatggaacaaaatgcaagaattttgagaaccattttttatcatgcctgacaattgctccagacacttgccatgaaatataaaagaaaccagagttaagaaaataaactggggaaccttagtctttgtttcacaacggacatccagctgctgcacacgcaaggaaagatatccagcgatctgcttccctatgcaccagggtaaaaagtggcatccaggctcaagaacctcatcaaacttcccaaaggactccttgatggctactgtcgattgatctacttgtaccaaaccgagtgcttgacccatggcttatctagaaaggaagaaatgcagaattacaaatggtgccatatgctaacgaaacaactaacaactgaatgttttgccataatcttgcttatactccgttggtgttaacttctccaatggaaattcatatttcaagtttttagtacatacaaacagaaacaaaagatatgaattaaaaaagataaagccatggcttcaaatgaagatgaatgtatgtcaggacaatagattgcccaacgcatcccaaatgaaaagtcaagcaattgcaatttcagataacttagaccaaacagtgttgcaaaaaatatgtatatcttgttgaaaagcatatcatgataacacattactcaaacttatactgtgtaatcattccctgaaaaatgcctaagattactactccctccgggctgataatacttgtcgttttggacaagggtgaggtcaaactttagaatatttgattatataaatcatttttaaaatatttgtctttcaaatatggtgactacatatatagattggtcttaaaaagtactttaatatgatcatatatttgttaacacttttttacatattataataggaaataatggtcaaagttgttttttgaagaccgtgcgcttgtccaaaatgacaagtattatcagcccggagggagtacatcacaggctcacagaagtcaacagggtaatagatgtagc

SEQ ID NO: 27307 - DNA, 1501 bp, Oryza sativa
tcaaaaactcaaaattctcttatattgtggacggagggagtatacacaggtcaaacctgcatgaatccctaggctgtagtacggttctctaaccagcaggatggacggcctcggaaactcacaaatacgtacgtcgacggcaacacgttttttacagaaacagaactcgttcaatctacacttacacacccacaatttttacaataatacttctcgatcgagtcctggtttatggacctttctgtgtttctttagaatccagagggcgtaggtaaaaaaaaagcttaactgttctctggctcacgcagtcccacagcttattagccgcctaaaagttgttaactatacagtaatttttgttaatttgcagatgatctcttctaaatttattatcatgaccgttcaattttatcatacggctgctttcacttcacatattgaggatatagtttcagaaaacaatcaaacgattaacattgacgtttgccgtccgtttgttggcttagatgtaggtaaggtcgtaaggatacttccttgctattccttctgagcaaagaaacgtgtatatatttgggagctttgaaatgcaaatattatttttttaaaaaaacaattagtatggaaattgtatgtctagatttgtgctgaaaagttgcttttattataggacgagactaccgatcaggtgccgcacccgatccaggcgtgcaaaaatcaggtgctgtcactagtggagaaaccatctttcgtcggtcggccgatttccacagtagtcacggatgcaataaaaaccggggctaaagatgatctttagtcccggttcaaaagggtaacgggcatatttgatctttagccccggttcgaatgctgtcagggcatgtcaggccccccggaatctttagttcccaaccgggactaaagtcccacccctatatatatatatgtcttcttcctcctctagctgcccgagcaagcttcaaaatttcttcaaaaaagaggggaggtcatgccaaaatttctattgaatttattttggtgattacatacaaatcggaggtgtctaaaaggtttgcaacttcatcctccaatgttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggttttttttgactcatgtagatggatcggcaatggatgtacg

SEQ ID NO: 27308 - DNA, 541 bp, Oryza sativa
attgtattttttagaactcaatatgcagttaatgtcaaatcattatcttcatatatcatttttatattatttaaacatggacatatatcatttctataatatataatatgcattctttcatatattccacggcaaagcgtggggtatcaagtattgaaggcggctagctggttaattggtttccaatttctggtgctggtcataggttacccgacctccgtcatttgtttcctttgggcttatatttggtgctttttatatattagtcctctgttttaggttataagacgttttgactttgacttaagtttatagacaaatatagtaatatttataataataaattagtttcatcaaatcaataattgaatatatattcataataaatttgtcttgggttaaaaatgttagttttttctataaacttggtcaaatttaaagcagtttgatattgattaaagttaaaacgtcttataacttaaaacggagtgagtaccaatttatttgacaatgctcctatattacccttttttttcacagg

SEQ ID NO: 27309 - DNA, 1501 bp, Oryza sativa
gcatcttttctgtaagtggaaatatgtcgcgttcattttgatatgctggatttcccttaaattgcagagctattcagcgtcatgaatggggttggagctttcatctcaccgaggtgatgatctaatctcttttagataatgaaataactcagtcacaaccgctgcactggtaggtacacaaagctcattagcatactcctatttggtgcaactgcataaacagcttcacttcatctgttagaacgttgattcccacgttttctatgaagtactgtgtttcttttgttctgaactatcacagagttacttgggaaaaccttttggatttgttctctggttttctaaaagagcaggactgaatgatagtagtattgagcaaaacaaatgattgcaccagttttgggtaaagagacctaattatgcaaccagggagggtaacatacacacaattgcactaacttcgatattggcgtgaacggtagaaaggaattttgataatccagcttccctatttcataattattttgactattttagtttcaaaccataaactttagagcaattttacggtccttaaggaggtacaatgaggtaccaaattttacattattttttttgttacctcatgatacctcatagtacctaggtaccaaatttacaatagaaaaagtgatacctcatggtaccttctcaaggaccataatttgatttggcatagctctgtgtaaaatctaaatttgattctcgtattgatatatacacctaacatgtattggcatttggtggaacttgaactttgaacccctcataacagtaaaaatattgagcatcacaacagtgcttatagttttttcgttcataaatatcagaaatctgtgcgttgtttatcagatagcaacataaataacccactttaggtaccctgaaactatagcataccttcaatcagcccatgcaacttctcaaacttctaatatactaccaccatggacataaaatgcatcttgattccgtacctggcaagcaagagagagactagactggcttatgtatccatggtgtagaatagaatctcattccaccatttactgtcttgaatcatcgtttgttcagaaatttagagcttaacctcatcactcatcagtgaccatgaagtttggtgcctcaagaacaatatccttagctgggcatgaagacaatgtacctacaatagaagaaatattacttttcaggacaacacaactcatcataaaatccctgctgtgtcacttaagctagacagtcagaacgcacagtcctaaaatgcgtgacttgactgacttctccagtgcttcagcagtttctctgtagattttaaggagagcaccattaccacctctgctggaggtagtaacagtctgcatcatagaaagatatgaagcctgcagatcaatacatatattagtacactagataccaaagacgtgacactatagcggtatgttaagaaaaaatctgaact

SEQ ID NO: 27310 - DNA, 1501 bp, Oryza sativa
gcagcagcgcccgagcggcggcgggaccacgctcagcggtggaggtaatacgtccaacggcggccaaccgactcgcggagggggaagcattacatccggctacgacggggacaccgtcagtgccacacccaatagcagaggtggagctatggcgtccgacagcggcagcataggaaccatgcgcttgtaggggcatcaaatggtgaacaagatcgagccagctcacatggtggttgccatggatttgtactgctcagcgatttcaagcgatgtatcaaggcgtatccacgaaatatccagatttactttgttttatttgttagttgtgaaaatcatggatacgtacgggacacatatcggagcgtatccgataccgtatcatccgatatggatacgtgatttttttgccgtatacaggtaacgtagtgcctatcaacttgtatgcaaagcttcgcagcatggatgaggcaatgttggtgtttcatgcactcccaacaggaggcccaggcgcccaactacttggaatacggttatcacaggatacgctcagattgggtgtggtggaaggatacgctcagattgggtgtggtggagtagccgtagagttgtttgacagtatggggatttaaggtgtccgtcttgataggtttgtactaacaactaacaagtgctctgcacttggctttctaaagggtggcaggcaaatacatggttacgcatatgtgacacgtgggcccaaaattttctttttatttttattttagtgtcacgtaaacgccatgtcgatgccacgtgggatgaagaggggaaagttatacctggttttgcggttgaggggtgcatttcaaccagatgcatgagttgagggacgcatattagacttattcctacatgtgtcgaagttttaccaaatgggcttcaacccaataggcccacgtaagctcggcccatcgacgtacaaaccagccctccgagacggaaaacccaaaaccctcgtctccctcactgtcccgtccctgcggctgcgctccactcgtcgccgccgccgccgccgccgccgccgccgtcgtccgcgtctccgtctccgtcctcgccgaggtatcccgtctcgtctcctccgctccttgcgtcatctctctgctgaacaggggaggggcgccgatctccatctggcgagcagagcaggggaggggatcctggtgagcatccacatcctgattcatctctctctcccaccgggactacttttgtctggaatttgcttgcgttcgttaaccctagctcttcttctagatctggaagaagctcctctcttaatttcagagccttaaccttaatacaagtaacagtttgttgtttgttccccaaaaagtttggccaagttggatccgccgctgcctagttgcagaaatgggatgacatatctcttttctttagttgagacctaatcggtggagctcgcttttctgatgtttattgatgatagtttagtttaccaaca

SEQ ID NO: 27311 - DNA, 1501 bp, Oryza sativa
tagtattagaatacatttatgacatcgaataactttatgatgtctttttttactgttaagtttatgatatttaatgatagttttaaggcaaatctacatacgtgtatttttcttaaaacaaaacatttaagaaattattaatggttaaagtgtgaggaaccagttaattaaaaatggacacaattatatttaaaactcttgctaagtatttatttcattattttgctaagaaatataattattttggacctacttgtcattgacactcgtgtcagtctagcaaaattcagctatacaacgcatgagtatagctgaattcagctatttttttaccatgagagacgggtcccactgatcattcacattctggtagacatcagccacaccatgcaagttactccgtaactatacttcgtaatctttactccccattaatcatccaaaaccaacagcaaacacacagactttggtgcgccccctgaacggtgtatgtcggttactcaaacatgtcacttaccggtgggtcctccttgcagcgccgctgatttattcataagcactatccaaaggacaatcacacagcaggaaagcgtatctatttaacagcttcggctaagtttggtaatatccatctcaaaatataaatatgtttagctaaaaatttaaacaattatatattcatatttataattaaaatttattatattttaacacgaagatagtaattctataaattatcgcgcccttcacatcaatgatctacacaagatcatccacactttttatctcacccttttctactgtacacatcatgcttaattgctcattcgcttagtagcaggagcagtacggatcgggatactccgcattagaatattatctctttttttaaactacattggaatattattgatgcaagttatatcatttgcacaatggcccatcctatccaccctcgatttaaaatgatgggctagatcagggatccggatcctctgcagtaatgcataggtgcactattcatgttagtagcacaataaatcaatgcatcaaacaatgtcgatccattaacgaaaatactgtcaaacattgatgagtattgtagcatatttattgtagcgcacgatctaatccatctgatcaaacagtctccattccctctaatgttgggtattgtagatcaattcagaggatcctgattcttagattagatattcagatgctaagtaactatatgatgaggtactggtcccgatcttccaataggtagtgataactctcgatttggcggaaacttgacacacacgattcagctttcgatcgacacgatccgaaccctgtaattgtagcaccacgtctcctctggttatcaaccgtgcactgcccggttgacctcaaacaatccgtacatgcgaatcgaagaacacaagcaagaataaggtagattgcaacttaattgcatatgaatgattaagcgcttcaatttggagttctacaaact

SEQ ID NO: 27312 - DNA, 1501 bp, Oryza sativa
ctggcttttatctactttgaaagattatgatcttacttttgagaaagtacatctcttttgtgataatactagtgctatcaatattgctaagaatcctgttcaacactcacgcacaaagcacattgatattcgttttcactttttgagggatcatgttgagaaaggagatgttgaattgcagtttttggacacaaagttgcaaattgctgatattttcactaaacctttggattctaatcgctttgcttttcttcgtggtgaattgggtataattcatccttttggcatggtttgagtgggagtttgtatctcatggttttatcaagcaataatatgacaatgaaaaacttgagaaaagagagctttgtttatgcatatggtattttcttgtgcatgctagcaatactttgaaggtttatttgtctctagcatagcttgtatgtattctagtcttttcatgagatttagattttgcttttaagggagatgatgcatgacacttaaattctatacttgaattaagcaaatatgcaatgttgatgctaccatatggtttgatctataaatgctttatatatatgctttattgacttgttattcctcaaatagctttaattgctcattgtgcaaaagagaataaaactatgaaaaaaatgaataccgaatccttggaaacagtcttgacgacaaggacgtattcgatgtgagcaaaataatgggtgccgaatccctggaaacagtcttgacgacagggacgtaccctgaataaaaagagaaaaatatgagcaaaaaggctcaagaaaagaaaaagttaaaaaaaattctcttggttattttgtgctaaaaggttatttgagaaagagtgatcaatgcaataggtatatgtgtttagtgtttgttcttcaacctatgtgcttgttaaaatgttgtattataaatcgtatgaaatcatgaattttgattgttgattcaagcttaattgtaaaatctttggttcatggttttactttaatgcatgcttgttttgttatagatgggtttatcttctttttattgcaacacatgacttgatatgctatatgtatgctaagctcttgaacattaatgaacataattcctatgcttgatgaaatcattgtcaaagggggagaagtaatgtaagtaatgtgaaaatttttggatttttggaaaattcactttcttttcaaaattcactttgaagtaatgagaagagcatgttgttggttcaattgggaatttctttcttttaaaaagggggagaagttttcttttggatttttgagcacgatgtgtacatttgtacgaagtgtgctttttaccaccaaatatcaaaacatttttataggtttgccaatgtgttcatcaagggggagattgtaaaatcaaagatgtttttgattattattctgtgatgaacaattgggcattggagattattggttttgttatttggaatttattcacgaagtggttttggaga

SEQ ID NO: 27313 - DNA, 1501 bp, Oryza sativa
attggaggggaatctttcagcccacgtcggatagtccgatattttaaacctccaaggcaacaagaaacagagaacgaagttccatgaaatttcggactttccgagacatcggactatctgatgttaaatcggagtgtccgatattttagaagcaaaaacttcgtcctcaaatagagactcaagttccatgaaatttcagagtctctgtatcatcggactatctgatccaacatcagatactccgacaaatagaaaaactcactcgaaaggatttttcaaacaaagacagagagtgaagttctgtgaaaaatcggatagtccgatacatcggatagtctgatttcaaatcggatagtctaatgttgctcaagtaaaaagtgcaataactttttactccgaactccgatttcgaagattttggactctatggaaagctagtttcgtgggctatcaaacccaacataaaaaatggtccaaaaccttcaagatatgttgaaaaacttgcaaagaaacccggtgtaagtgttgtgacaagtgaaacaactcgggattaaaattttggcttaggtttttcaactcacacaaagatgaagcattttgagcactagtgttctaccaattatatgcatgtggtatccctcttaatagtacggcattcctacgacacaatgcaaggtaaaagatacaatataccatttgatcattgccgcattgcatcgtgatgttgcattcatggggtatgcatctcattacaacatgtcgaggacataacaaccttcatatttgcttgaataaaagtgttattcctctctaatcgcattgtaatcaatcatcaaaatcattaggggcctagatgcactttcaggtattaagaacataagaactggcatgatgcataattagaaagtagttaactttcaggatgttacagctgcctggcttggcatggtcaaagtgccttgccccgctacaatccgcatcagatggatgagagatcgacaatcatatgtgaccatgccactgtttcaaagatttcaacatatccattatgctggtggtaagtacactcagttatgtaaaagataaaacaaggttcaccaaacctttactcaatagtaccaccatgtgaatatggcttgatcgtatatgttatgcttcatttgtttatttttgtatgctctagtttgggtgtgttcgtaagacatccatagggtttttgatttaagcatggtgcttaggtcaaaatggtctgcgttaattaaattagacatgatgttgaattcgattaatgaaccattagagctagtactttcatggacataggatgcatattgtgacattccggcccagggcttaatagaattaatagaatactcatatcaacaagttgcaacttcttttccggaagccgatttccaaagaactccagggttaagacttcttttccggaagccgatttccaaagaactccagggttaagtgtgcttggcctggagcaatt

SEQ ID NO: 27314 - DNA, 1501 bp, Oryza sativa
cattctagggcccacatgtaagtgggaagaagaaaaatgtggggtctgcatccattctttcctctcttctcttttctcttttctcttttctttcttttcttcttcggcgagcctgggaagtcatcgtcgccgggcggaattcgctcgccgctgctcctcctacggccacctccatcgttgttgccccctccttcgcccgttgtctgctctgcctcgcctacctgctttacccgccgctaccccaccaagcgtctaccccctctgccgcccgctcgctcgtgtcgtccctcctgccgccagttgaagagaagaaagaaaagagaaaaggagaagaaagaagagatgggaacccacatttttttctcacttacatgtggatcccataattttttgtattattattttgatgactaggatgccacatcagcgaaattagagatcctatattgctataggacccaaattacacggttttgtaaaatttagggggtgaagatttctggtattagctgatgagcttattcttaaattctttcaccccatgggcccttttcctcttttgatctcctcctcgctgcactattgtaacattctgaaaatgtgtcattttctaatcttgcatcatgctgattcttatgttcttaataaccttctaaacctaggaaaatataattagagggacctcctaaaactaactcgcataaaacctctctggtatttaatcccttttgtgtttttcatttaaaaacatatttggtatttcttgttgaaattctattttcaaatattaaaccttctttcgactaaaactcttttattcaaatttagtttaaaaaccatttttattattatgaattatggtccaagaaatcctccaatttttgtccttgaacctagaccaaagtaattccaatctcattggaattaattgttagcccatcctttgatcttaaacccatcctttgattcttgatccaaatatccaaattcctccttttgatctagccaccaatttaatttctgtagcttgatttcctctttggcacaagaattgtattattgcaaatattgtgaataattgctcttgtgctaagaaaattccaatttatattcttcactcaacttccccttttagccacaaatatacataacaccaattttagagttcaaatcctatttattgccttcaactaattcccttctatattcccaaaaatattttgaggaatattattaatttccattcctatttgagtgcttccaaataaattccctcaaactccacctctaaatattgcactcaaataaattaggaaatatcttttgtgaattctttccaaattcaaattctttgcaaaacctagttatccaaatcaagtattcaaattaggcttctttctttttgtcatcgggccgaaactccattctttcttcctttttggcccaatcccttttcttttatcttctattttcctcctccttcttgggctgccggcccagc

SEQ ID NO: 27315 - DNA, 1501 bp, Oryza sativa
gtgcgtgcaaatgcacatattgacagtaatacaacttcttgtgtatcaattctaacaactaaacatgttgcatctaggccaaaattgcttcaaatgcaaatgaccaatttactcaaaataatgtacatacatccataaaaacaatacttcatttttaaagtcatttatacgtggaagatggacaaaacattatcaatcaaattaactatagacactgcataggtacatagtcttttgatagataattttggtgtagggcatattggcatatagactcctcgtctagatattcacaaattcgatgacattgtatctacttggacacaattaatataaatttagctgtagcttatcttctatgatagtcatgcactaataaatatctctaagtcaataatatactctcttcatgatgagtgtatacatttattctatacggagaatatataattgtgccttctacaaatgttgcgacaattagacaaagagaagatatatgaataattctattactcatttgcccaataaatgtatttgctacatgcaactacttacatgatgtccttttatgcaactttctaccggtttacttctagtaaataaagtgcacaaaacgagtacaaaatagtaaagaatggttttctatacacaccttttattacaatcctagcaattaacatgattttctgctattcaaaggtatgtgtaatttacagaactactaacccacagaacaatcaattaccctaaacaaacaattgccaggaaataaaccataaaatattatgctttcaaaaggggtgctaaaacaaaggtttcacaagttcatggaagctcttttgcctaaaaacaatgtttttaggattgattatgattattcaagaaactaactaaatagttaaagcaaatatttagaaatacgggactaaggaataaatccttaattcttctctatttggcgtaaacccaattcatgaaggttcaaagtataaatggcgaatgtatattccccgtagtttctaatgtcccataggacttttccgcataatttccgaattccgcataataccttggaaaccaaggacttttgaaataaaatgccattttcggaccaaaatcacggttcgtgcccgactccttttaataggccaatttctacttggcccacctccttatactagctagctttaaaacctggccagcccatctcatatgtcgcctaatgggctattacgaccttctcccacaagaagtgggtgaggtatgatccaattgccattcttcaatggagacaacggatggaaccaatggcaaatgtgctagtgagccctcggtagagatggacaactatggcaagttgccatggtcagaggcggagcggcggtgcaacatctagtagcaccgacaccggcattcgttggcatcaagccgtgaccggcgtccgacaatcatagcttcatgttacgtgtcgatgaaactcggctcggcatacaggccggca

SEQ ID NO: 27316 - DNA, 1501 bp, Oryza sativa
ttttcactttcagtatttctttacatcacacaacatatgatcgagatcatctgcaccatcattttctgcaacagctccatccacctcgcctgttggattttctgcaaatccatcgtattgagcccagtctggaatattgttgtcttcttcttcatcttctttcattgcaacccctaactctccgtgcgaggtccaataattataactaggcatgaatcttgactccaacaagtggacacgaagcggtctcgatgtagagtgctccttctagtttttgcattttttacatgggcaatatataaaacccttaggcttatgggcattggccacactaaaaaaataatgcatgccatcaataaactccttcgaccatcggtccacggtgtacatccattaccgattcatctatatgaaattgttgacggaaaacacggcagcttgggagatctgcttaactccagtgcagatccaaggttgcctcgagtgcgctaagggcgtgccagctggtttgatcctgctaccagcaaggaacaaaaaagaaagcgagttagccgataggccgatgacgtatcgttgatggtctcagccgatgtagttagaccaaatcggctatagactgagtagatcaaagaatataaaaccctaaatatgccgcatcggctgtaatatgatctgcttagtttgataaaatagattttagacgatatcatgaaaatagctgatggaacggtatttagagtaagataggtaaataaatataatgtactagctaatactctagtacaaacttatataaacaaattaatccatagaaatatatcaaataacgatcaactaccaagcttggcaacccggccgatactgatctagatttgatatatttatatggagtgatatgtctatataagtggcaaatatacataaaactaatgaagaagcatgtatattaggtaagattggtttaaactccaatactatctctaattataattaattctaggttagtttttaggattctagacaagagtaggggtgatgcatcttaaagtaggtaaagaaacctaaagtataaacaatcaaggaattaaatatttttcaagatggtagatgccttagttaatctaatctagtaagacaatttagccgataccggcaagaaccctaaaacaagaaccagccgatagagctaaattgagcatatgatagcagatggttatgataaaaggactaaaacatctaaaccgacataatagccccaatagcacaagccatcgaaacggattacctcttatcaagagaactcgtcgaaaagaagaacaaaaagggtgacgatgcgctgaagttgtattggattgtctctattattacaatggtttggggtttatatttatacccacgagtacaaacttagtccattagagcaagtttaatagtatagcctactactaacttcaattcatctatagccaatgtaatagccaattcatacaatagttgcttg

SEQ ID NO: 27317 - DNA, 157 bp, Oryza sativa
caaatcgagtatctgtggagcatctctgtgcgtctgcatgctacaaattaatccagctgacaccaactatatatattttcttagtcacattggcattttacggattgtgaatatgtacgtactgatacatggtgatatttttctcttttcttgcagt

SEQ ID NO: 27318 - DNA, 207 bp, Oryza sativa
acatatagttttacatatttcacaaaagtttttgaataagacgagcagtcaaacatgtgctaaaaagtcaacggtgtcaaataaaacgaaacggagggagtattagttttagggttggaggatgattctataatccgatgataagttgaggaacttctatgtacgttttccgtttggaaataaaacagcatcctacacgtctgtagg

SEQ ID NO: 27319 - DNA, 613 bp, Oryza sativa
acacactagtggctacatcatcatcacgaattcttcaacctagctaattgggatggtgcatgctttgatacttcagattaattatgatcacctaatattcctagactgccggaatcattttatcactaattggattatgtaccttattaatttcaatcaatcaaatttacgactaaatattactcctacatagttatataaagttgtgacatttatactttaatacttcgcagaaatacacagcggccagttatatcatctatatggccttgtttagatcccaccctaaaatttttcaccatgtcacattgaacgtgtgaacacttacataaagtattaaatataggctaaaaaaataactaattacacaaattgcgactaatttgcgagacaaatcttttaagcttaattaattgctccatgatttgacaatgtggtgctacagtaatatttactaattaccgattaattatgcttaataaattcgtctcgcggtttactgatggattatgtaattatttttttattagtgtccgaacaccccatacgataccatatataatatctgatgtgacacactgaaactttacacccctattggattgggataata

SEQ ID NO: 27320 - DNA, 870 bp, Oryza sativa
ttacatattttcttaattcccatgtcaactttaaaaatatttatattttaaaacaaaagtactaattaggcacgttccatataatattatgccatgtttagatcccaactttttacttcaaacttccaacgttttcgtcacatcgaacttttctacacacacaaatgtcgtatttagttttaaagtttttcttcaaacttccaacttttccatcacatcaaaactttcctacatacataaacttctattttttccgtcacatcgttccaatttcaaccaaactttcaattttggcgtgaactaaacacagccaaactttcaacttttccattacatcattccaatttcttcaaacttccaattttggcgtggatctaaacacagcatcactcgtgtcgtccaaagtttgtcgaaccgaagaccgcaagttgatgttgatatgttctttctttgctactactccctccgtctcattttaagtgcaattgtagtttttcgtatccaacatttaatcgtctatcttgtttaaaaaaatctatgaattttttaaagaagtcacacataaaatactatttatgttttttatctaataacaataaaattattaatcatacaaatgtttcgaataagacagacgatcaaacgttagatatagaaacctgtaactacactaaaaagggacggagggagtagtatctttcctcatgctctggttggtgtaaaaaaaatgtatccgatccgttacaaaatataaccatttctttgcaacatactcccttcatctaaaaataaacaaatttaatatataattactttatcttaaaataaacaaaactagtacgggatcacatcgagctagtaagtagtagt

SEQ ID NO: 27321 - DNA, 1501 bp, Oryza sativa
ctttctgtcacctcggtacgtgttcaatatgttgcgcatatttgatctgtttatgttatactgtatagtttacatatgtagatctaatgatgcgttcatgctagttttcatctgtaatgtcatgatttatttatggaataaattaaatcattatatgtctataatctcaacagatcgtgcatcctagctttgcatggatacacgcccaaatagtatgttccattcgaattggtcatcgcgtactcctttagttcatccttaaaaaaataaactttaatcccttcatcctataaaatatatcaactttaacctattataaaaatcaactttaatcccttcatataaaaaaatcaacttaaagtcattatgtggatgcacgatcgagcaatttattggtgaagtttattggtgaagttagggcctgtttagttcttccaaacctctaaaatggtaaaagtttttaccgttttgaagcatattttgtcaaaatgaatctaaacactagtagtaaaagttatcaatttaatatttgtcatttgaaaatttgaaaatctagagtagtaaattttgtcgaaaagtgcgttgggagtgctctctctaccagaaaaatggtagaatatgcatctaaacagtaactattaaaacttcaacttcaaatgctaatttttttttgtcaccaaaacttttaccacagaaaattgatttaaacatgcccatagattataaaaatcatgaacgaacgagtctgagtcaatgttaacggatctatcgatctggataaaaaatgcatatctaattttatttttaaaagttagatattatcgttagaagttaaaaggtccacggatgtgagtgacaacttatttagtgtgagtgaaatttagttacaaatgttggtgatttttaatttttattttactatattctaaaccaaccaaacaagcttcctttccagatttttagtgctatgttgagtttcatatgttactatgttgttactagcctactactacctacatctatataggatttttataaatgagaatgttctagattttttgtgctacgttgagtttcataccacttcttccgtcctatgaaaaattaatcctttcatcccataaaaaaataatctagtattgaatgtaacacatatagattagttgtactagagttctagattcactttttgttaggatggagaaaactagggtgttactagcctactatactattacctacgtctatgtaagagcaattacaatagcacgctataagccagctataagcatattttaaatagataaaggaagagagaagagcagcgggctataagtctatagccagctgtagcacggactccaaaacggaatgtgtgtatgataggtgggaccaggtattaatagtatagtaagcaactattgtatgaattggctattacattggctatagatgatttaaaactagtagtggactatactattaaacttgctctaagatt

SEQ ID NO: 27322 - DNA, 1501 bp, Oryza sativa
gtattgtcttcgatggaatcagataactttgtacagtctgcagttgtgccactgatatgtgggccccactttagtatggcccacatgtcagtggcataactgcaaactgcacaatattagaggagtctcatccatcttcgatgctgggtgttcccaacccttctccctcatattctgcgtgcacacttttaaactgctaaacggtgtgttttttttgcaaaaagtttatatacgaaagttgcttaaaaaaatcatattgatccattttcgaaaaaaaatacttcctccgtttcacaatataagtcattctagcatttcccacattcatattggtgttaatgaatctgaatagatatatatgtctagattcattaacatcaatataaatatggaaaatgctagaatgacttacattatgaaacggagggagtacctaatacttaattaatcacacgctaatagaccgctctgtttttcgtgcgcaggagatttgttctcaactgcccacaacgaacacagcctttgacatgaagttggagtttaatttgatgcattctcctaattgtttcccctctttagatatgtgatagatttgtcatttgcacatggaaagctaggtagcagatagatttttggtgggccatgcattcttgccaatcccacattgataattgatggtggggaagcacaacttaaaagatagtctcatccattagacaagtcttttgggttgtatagtcttaagacctaaaattgtggcctcagtcgagcctgtggcggagcgagcccaatgtgattcgggtgacccacagtaagtgagccaggttgcgcactctaacaaatattttgcatcttattccgattatcacttgacttagggcctatttagatcctccaaaatggcaaaagttttatcattttggagcactttttaccattttagatctaaacactagtagcaaaagttggcaatttggcatttgtcatttgctagtctagggtagcaaattttgccaaaaatgctctgggaccatgcgcgtgctctctctctctctctctggtactaaaatggtaaaactttaggatgcatctaaacaccaactacatgccaaatcttttcccaccaaaacttttaccatttaccatttgctattccaaatgaatcaaaacggacccttagcaaaaattatgtaccgcctaatcatacttctcaggcggcagctgcaaatcgaacaatcaaatatcccgcctgcctgaccaggcaaaaaagtagggggctgtttggttgctgccctcgcctggagaccattgctcaggcaggtcgatccgaccgcaggcgaccgaaatcggacgcctgagatcgacgcctgagccaggcgcgaatctgagggcagcaagcaaacgcgccctagaactcatctgtcaggcatgaaaaaaaatctcaggtatgctgttcaggataccatggtcaggcggcagctgcaaatcgaacaatcaaata

SEQ ID NO: 27323 - DNA, 1501 bp, Oryza sativa
ggcggagagagaaatccccactctcactccatccacctagtctaatccagcttgctgccgctgctgctgttgctgctgcgtcacctcagtacctcacctcatctcatccatcgtttgctccgtttctgtgggatttccaccggctgattctctcgccctcctcccataaagcgaccggtggttcgcaccggacggatgccccaatctttgcatcgaggggcaacgaagcgaggtcacggatgcgggcgatgccaccgccgtcttcttgtccctagatccatcaaggtatccatttctttctctcccccctccgtgttgcccgtctctctgccacttcttgttggtctaatcgagcaagaagggggatgatggtttgtgtggtgtggcaagaacatcagggcttgggtttcttggtggtggaggttgttgatcgattctcgttgtgccccccctttgctggaggcagatcgatctatgtgggcaccttctgttattaaggaattatattcctttttcacggttttcaaggcttcgggagcatcataaacacgtttatggtgttgagtgttttgggtcttttacatctgtacagttttatatgaatcctataaatggacttaaaactatttgaaaaaaaggatatttgtgagttggcaaatatggaacctagttaactcattgccgaatggtataattttgcatattaaaaactttcttcaaggatgagcagaaaatttgagttcaaaatcaaatccagttgcctagtactttgtctgcatagaagatgcagggcacaagaattggttatgtaatgctgatacttgaccaattcagttgattctttactgatattcatatgacaggaatacaggattcaacctatgttcctaaataacaataataacgttgtcaaattgcaaatatgagtcatcctccgggttctgattagatgtttgttcatcctccatgctctgattactgtgcgtgcagtgttaggaggacagagacaagaaaatgcttgtatatctgccaatatcgtgttcttggttgttcatatccttggtctctcatgctttcaagttggccttggccatcagtttatgctctgtgcattacctagctttgtttaatgtgtattggtcaatcccgagaaaaaggaactacatgatgaccttagttcatgcttattaaagcagtgtcatatctctcatttcaagccatggaactctttccattgaaaacctcatttgaaacaacggttgaagtacaacagtagaacacaagattagtatttcttaaaaattgaaatcctagaatttagccagcattttatatgcactgatatgcatgcttgcactttgtggattatgtgtttgctctgttgcttgagtttattttatcctccttctgtgtgttgctttgagcgtgcttctgttgttaaactgatgttgatgttttctgtttatgattcagtgaccagttctctgatcagtgagaataa

SEQ ID NO: 27324 - DNA, 1501 bp, Oryza sativa
gagtgtttttaggctagcttctcgaagatgtctttgatgaacaaatgtataatatgtagatcttgtatgcatccacggtcctcttcagaaggaacgtgtagtgtacaaggaccaaggggggccgggtcccagaccagatcgggacctaggctccatccagtccataattttaatatgtagatcttgtacgtttccacgctcatctcaaggaggtatgtgtaacctacaaggacagtgtggggcaaaagtctgccgcaaagacttatggtatcttagagtttgttagagataagtgtcgtgtccgatatggacatagtttgtaattctcgggtataaatagaccccggatcccatataatcaatgaacacacgttcaatacaatctcggtgcatcgccaccctttttactttcgttttgtttcgacgagttcttgctttcgggttgagctgcatcgatttcgatcttcaacaagaggtaaaacttgttatggcggcttgcattctcgggattagtgcttccatctttatgatactctaatcttgtttatgtaatttgtcgagttatcatatatcttacataatctctagcaatatcgctatctaacctacaatcggctaacatctgtcggtagagggcaaccgattaggttagacatcaatgttgacttagattatataggatattcaccactctatgaaactttcaatggcttgattgtctagatattgtccttcttttcatacttatagctgcatcagttgagtttgatcttataagtcatgattagaatctcaatctctagcctgcttcttggttgccgattagggtagtatcggggtttcagctgatcttacctgatttaactatatttactccatatgcttcgttgatatgttaaatctgccctttatgttaagatcttgttgcatttaagtatattaggcctttgtttgatatattttacttgctttaatatcttaatatagagtggtatcggagtattagccgatacatgctagatctatctgatcggctatgctatgaacatatatagtcccgttattaatatatattttgatctaagtgatttatactgtctcggcatggcgaccgatctatcccaatcacttgatttaagtatatatcgatataaggagtatatattgttaatatctacagccgatcgagtagatttagttccttcttatttattcatgaccgccgatcgatacatatatgacatcggcccaaagataaatgatatgtcatcggcactcagccgatcggctatcgtttataggtttaaccgcggtttctttgtctttgtttcttgttgattgtaggatcaaatcaactggcacgcttgcatacccgaaggcgagttttggacctgcactggagttaagcagatatcccaggcctcgtgttttatgtcaacacgcttttggtacgcctggtgggacagatcagaagtcagaatcacaacaacagtttttccca

SEQ ID NO: 27325 - DNA, 1501 bp, Oryza sativa
caagactccctcctcgaggtgctcctcctgaacaaccagctctccggctgcctcccccacgagctcggcatgctcaccaaggccgcagtgttcgacgccggcatgaaccagctcaccgggccgatcccctcctctttctcatgcctcaccagcgtcgagcagctcaacctgggcggcaaccgcctctacggagagatccccgacgcgctctgcaagctcgccgccgtcccagccggccgcctcgccaacctcacgctgtcgagcaactacttcacgtcggtcggaccggcgtgcttgtcgctgatcaaggacggcgtcctcaacgtcaggaacaactgcattccgggcttcgccaaccagcggcggccggcggagtgcgcgtcgttccacagccagccgaaggcgtgcccggcggcgagcgccacccacgtggcgtgccccgccggagctgccaacgctgcggcggcgccggcggacagggtggtcaaggactactccagctacgtgacgtacgccaccctgcacgagtgagcccggcgccacggcacgggcgcacgacgtgcgtgcatgcatgcagtaggggacagctagaagctagcgtctcggggtggtatttgctcttgtattcttgtgttcgtttgttgtgctcgtgagtcgtcattgtggtttgttttctctgcacgtgtggctagctatggctgtcacgtctagatctcacctcctgtactcttgtgtactgtactatgtgaaaatcattggtgattactaaagtttggtgtgtgccctgccctacatgtttgataaagtttacatcatgtaaagcgtatctttcaaaataacggccatatttagttgcacccaaaatacccccaaccttccaactttccattacatcacatccaaaactttcctatacacataaactcccaacttttttttccaaactataccaactttccccaaactttccccaaacttcaggaactaaacacagtcatggctatttcaacgctatttcatcatcaaacaacattttcgaaatggcgagccacgtcaaattgcggaccacccatctcctcgtcgcgctgctctgcttcgctgcagcaacggccgaaccatcagaagggacgagctcagcatcgtccagccccgcatagccgcaggacttctccagcgaccacgcgtaccacgtgatccagcgcttcaagcggtagtgcggcaccatcgatcacgtacgacccgaagaacgtgacagccacctgatcctgaatcggccatgacatacgcggtgtgcgtcgtcgctggcgataaggacaagaatggtgccagagacgggtagaggcgccggctcggtcgttctccagctacgtgacatgatatgccactccgcacgactgagatgccgcagctagcgatgggactttgcgtcacgccaccacggtggtgcgcttggctatttcgcccgtgttcgttcgtagggctcgtcgcggtgtaccactcg

SEQ ID NO: 27326 - DNA, 196 bp, Oryza sativa
aaataatcgtgtgagccaaaacacggcaagtataatgcagtttaaaatcaaaatcaacaagatttgtaacgccacaaaatcatgtatagcgcagataaaagcctgaattgaaatggacaattatatacccaatttggaggggcttctacaaatgcaagtaaacaacatacggacgccaaataagtcaaactgaaaa

SEQ ID NO: 27327 - DNA, 1219 bp, Oryza sativa
atttcgaaggagtatttggagggattatgaatttatgataatacaaggaactcaaaggatggaaggtcacttatattttttttattcgaggttatgtttggatcatgaatgaatttgaataattttgaatcgacggagaactaaggatttcaaaggaggatttgatttcgaactccaatagtatgtttgggaagggttctcggggattaatgttcattacaaggatcggtttaattgagatctctggcattagatactaaatacacgcaaagaaccaatttttttcgaacaaaggattttattaaaatagttttttaatggttacacggaaattgggatgttgcaattttttaaaccatcaccttcctaaaaaagcaaatatgatacgatatcctgattactcacgggtgaaatgttacaataatatctgtacgcttgcggatttatctgtgatcgtaataaatacaaacaataaatctcgcagtctgcctcggtgagtctgcctcggtgagctagagcaaacgtttgttaatgggaagaacaactaaacaaacattgattagcccttttccgaactccgcaagatgcatgaatcatgacgcgaaaaatcgacggctcactgacgaatccaaaaatatcctgcggctgcgaaatagcaatgttatatatgtttatgttatttttcagcgagcaagattagcaattgccaaaggctagccaatattacaattttaattttttttctagaaaaaacacatcaatgacgggttacaaatatacgctaccatgggtaagcctccctggtgatggattgcaactcaagtacatcgccgataagcatccgtgatcactactacaaaaatgattttcgcaagcaaagccagtgaagattttcgctggcagtgcgatccaagtgcgaaaatcgattttcacaggtggacccttaagagaaccgtttgcaaaaattaattttatcaggtgtacccataagaggaccaccagcaaaaaaaaaatgccaaaaaaattaatcaacatccagaccgccagcaaaaagatttttttttgtcaaaaaattaatcaacatccagagctacaatttcaaatccaatccaatccaaattcaatcaattcaaatccacatcagatccatactcaaacccacctctagagaacaccacatcaatttttcactccatttcaacaagcaaacgtcaataca

SEQ ID NO: 27328 - DNA, 1501 bp, Oryza sativa
gaattggggggcatgtgttaacaacggaattttgcatcagacttggagaagaaagagaaagatcgaggtggatttggtgtggaattgagttgaattcagagtcggactgtgcatcggctggcatcgtatcggctggaaacagggcaggggcttgacttagccgatatggcaagtagtcgatacaatatgacttgggctcggtttgggcctagattggaataaccgtcatagccaattagagataaagctcaattaaggcaattgtatctattaattaggatatttaagtttgtttgttagagatttggcaggagaccgccatgtagtcttgtttgtatcttatttttaggaaagtttgagttgtgtccataagagcaggtacaatagcagactattagctagctataaatatattttaatgagataaaagatgagagagaagagcagtgggctatagatctgtagccagctgcagcacggactccaagacgcaatgtgtgtatagcatgtgggaccatatattaatagtatagcaagcaactattgtatgaattggctattacattggctatagatgaattgaagttagtagtaggctatactattaaacttgctctaatggactaagtttgtactcgtgggtataaatataaaccccaaaccattgtaataatagagacaatccaatacaacttcagcgcatcgtcaccctttttgttcttcttttcgacgagttctcttgataagaggtaatccgtttcgatggcttgtgctattggggctattatgtcggtttagatgttttagtccttttatcataaccatctgctatcatatgctcaatttagctctatcggctggttcttgttttagggttcttgccggtatcggctaaattgtcttactagattagattaactaaggcatctaccatcttgaaaaatatttaattccttgattgtttatactttaggtttctttacctactttaagatgcatcacccctactcttgtctagaatcctaaaaactaacctagaattaattataattagagatagtattggagtttaaaccaatcttacctaatatacatgcttcttcattagttttatgtatatttgccacttatatagacatatcactccatataaatatatcaaatctagatcagtatcggccgggttgccaagcttggtagttgatcgttatttgatatatttctatggattaatttgtttatataagtttgtactagagtattagctagtacattatatttatttacctatcttactctaaataccgttccatcagctattttcatgatatcgtctaaaatctattttatcaaactaagcagatcatattacagccgatgcggcatatttagggttttatattctttgatctactcagtctatagccgatttggtctaactacatcggctgagaccatcaacgatacgtcatcggcctatcggctaactcgctttcttttt

SEQ ID NO: 27329 - DNA, 896 bp, Oryza sativa
taatattcttttgagtgggatttctcgttctgattatgatcgtgttgcacatcttgaaactgctcgtgagatttggaatgctttgaaaaactttcatcaaggaacaaataatattaaagagcttcgttgagatctttttaaaaaggagtacattaaatttgagatgaaatctggagaggctttggatgactatctttctagatttaataaaattttgagtaatcttagatctgttgattcttcttatgatgctaattatccacaatctaagatttctcgtcactttttgaatggtctcgacatgtctatttgggatatgaaagttacatctattcaggagtctgttaacatgtctactttgactttggattcactttatactaaattgaaaacacatgagatgaatattctttctcgcaaagttgattctaaatcgagtgctttggtttcttcttcttcttctttggttgttgatgtttcttcatctatgccttcttttcttgctgcttttaatgccacatccgatgatcaactcgaacaaatcgaggaggaggatttggctttggtcgctaacagaattgctcgagctatgaataatgccaggaacaggaaaagaggtggtccaaatcgttgctttgaatgtgattcaattgatcatcttcgttcgcattgtcctaagcttgggagaggcaaaagagaagacaaagatggtgagaagaccaataacaacaagcccaacaactacaacaagtcaaagggttctaaccaagggaggaagatggagaatcttaggaaggcttttcaacaagtttgcgccgctttcgagccactaagtgatgtagatggtgaaagtggagatgatgataatggaaagaatgtctctgatgtttgcttca

SEQ ID NO: 27330 - DNA, 1501 bp, Oryza sativa
tcgacgggtaccgtagatcggataaatatgatattaaggtaaggctgtgtttagtttacatcaaaattgaaagtttggttgaaattggaatgatgtgatggaaaagttaaaagtttatgtgcatagaaaagttttgatgtgatggaaaagttggaagtttcaaaaattattttggaactaaacacaacgtaagttggtataagaatatgacatcaaaacatattggagagactagtgtagctattattcgaaagcttattaatttatttactgtgttcaaggcatgaccacgtgataggagtactcaagaagagttacatctaagttccgatcatgatatgataaacaaatcttactttttctttcccaagctagcgcataacctctgaaccgataggaagatcgatgacccgcatcctacaacttcaagaagtatttgtagcatacccgagcaatggaccggggaagaaggagacaaagattatactggttcaggtccctcgtaaggtaatggccctaatccagtttatatgagattgatatgtagaaaccacagaatacacagagaatagatgaattcggcgttaccggcgagatccttgtcgagatggttcgacgagttctcccggcgagtgggcttcgtgtcctccggcttcgtaaactatggtgggtatgttggtgctatgattcaatcctttgaacccctatggggtatgccttttataccgtggattgccttagtctccaaataaaactcggagacaacgaaccttgcactatatagaataaactcaatcctctccgagtaagactgttaatcacccagcctagaagaatattttccataatatcttgtagattcccttatcacatatgggaacataccgtatatataaaggtacagcgtattcgtattttttataaggcgtaggatagaagatatgtcttattgataaccatgacagcactgaaagaccaaatatatagttctagaacaggatgaaagacaacttggagttcagagaaaaagggcatcctggagcatttccagtacgtagctttgtcgagctcgatattatcactatctcgttttgcagatagaatttgagatcctcatatttttagatgcatctgttctatcgtgtggcctttaatcgggcccacggattcacaaaccgtaggttatgttttatgatctacggtagttatagcacaatctatttaattaacggtcggatatttctggttaacatgagagcctaaaaaaaagcccaattaatataggtatagatagatagatatagaattgaactacaaaaatgtccgtgcgttgcaatgggtaaaaaaattctaataataatatacgtttttcatgcataatcatgtcaatgacaatgattctattttaacgagccgcttgtttttttataaacagtgtttttttttcttgcgcgattttctcaaaccatttttcagaaatggcgcgtttcgttttttccaa

SEQ ID NO: 27331 - DNA, 1501 bp, Oryza sativa
atttcataacatatgttgtgataacgtgcattgcgcgtccacgattactattaatatcaaaagcaggacaagccgattaaggttttgttaggatcttcatttgggatttggttaaccgtgagcatgcttcctaaactattaaccgatatattttactaaaatctttagtaaaatgtttcctaaaataaatctaacaaatttatttttcaaatttatagtaattaatacttaattaatcattcgttaattgtctactccgttgtctgcaccacttactaacccagtcaaaccatacttatgaatgcaacctaagggtgtgttcttttgtgcaggttcccaacttctttccaaggatcaaacccccctcccccaccctccctagggcccaaaacccccctcccacctcggtcaaagcatcctcctgctggtcaaacccgcccaccactttgctgttctcgtcttgcaggaatcatgcagtaataggacggtcatcgtgcagtaacatgacaactttctcacagtaacaacgtcaaaaaacagtcatgatggatatagttttgttaagcgtttttttatgaacgtcatggtgcaaacggattagaaaaacaagatatgatgtgagagatattgctctctaaagattgagatttatctctttttagtccttgtctcactggaacgtcgtagtaacgcaacggccaatgtgtagtaacacgactgctttctgcagtaatgacgttgaaaagtagttatgatagttctagtttcgttaagcatttttttttacgaacgccatgatgcaaataggttagaaaaataagacatgacgtatacgttactactctctaaagatttagatttaaaatattttagctttacaaactatagtatagtaccactgttactatgcatattcttcgagtaaagtataccggcggtccataaacttgcaggagtgtgtcatctaggtctttaaactctcaaaatgcatatccaagtcccaaaacatgtcatagtgtgtcatttaggtcccaattcaccataaccccttcaggatcctacttggcgttgatgtggtatgccacatggatatgacgtggtattattttgactgacaaatggaacccatttatttttttttcctttttttctctttttcctcttcattctcctttctatgtgaactgagcaaagaaaggaaaaaaaagaagaatgagaagaaaacggaaaagaaaaagaaaaataaaagaagaaaaaaagaaaaggacacgtcacgtccatgtggtatgccacatcagcgccacgcaggatcctagaggggatgtgtcgatttaggacctagatgatacactttgacaagttctgggatctggatatgtattttgagagtttagggacttatataacacaaccctacaagattaagattaaggactgccaatacactttactccatattcttctgttactacaaaattcgccatgttgttagtgccaaaca

SEQ ID NO: 27332 - DNA, 1501 bp, Oryza sativa
gcaattgctatcttcttggaacaaaattggtctttgataagtttgagaaaacaattaggacttgattttttttctttgatatttaccaactcaattctgtcaagagttgagcataatgaaattcattcccttccataatatcagaggttatactagattctagatatgctagattctgcatggatagtttcctttatagtactggtattgacctaaattgtctgtagctcaagcaacatcatcttaatataaagtaggaataaacatgagaattcagaaagcatgagcactgttttcatctatgtgtaaaatcatgaactggaataataagcaaacaatttatatatattcctttctaatgtcataatttcagctagtactataaaagaaagttaggttgtacctccaatgttgtacacagagctctaaacttcagcacgaaagtttgtacagaaacaaacaactcattcatgtatgacccaaatatcagtataccagcaaaataagataaaatcacaatcggaagatttgataagaaatgtgtaacacatttggggaaaaataatcatgagcacttccatcagtataactactactgagatggatatgtctttgaccaattaaacctttgtcatataaaaggacacataattcaacaggacatcaaatatggaaccatggatcaatatagaataatctgcatggcaaaaagtattgtttttgtacatggtactcacatgatatttgttattgtagacgatgctgatgccatggatcaagttctgcaagtaaatggaggtcacaaccataatgcctttccttttgatctcaactttgatgccaatgaggaagacctacaataccatctaggtaagccctttaaccgacatgactatcagatttacaaaaaaaaagataaaatgtggttttacccaaaggttgtagaataatattatttatctgaaatcatgtttttaattagaagttagtaatattatatcatgccaactacctacaatagtccaaccgtgtcatttggttgtattagttgcaataacaattcaggattataaattagacatttcagcacatagtaaatcacaaagaataatgagatttaccaataaatgcattgatatcttgtatttacatacaattgtcatgtcaatcggtacactaccacagtaatctaaaagaaagcacataaactaaattgtgtcaatgtctctgtccctcttagatgtgatatgtacggttaaatcatattacaaataaaaccatgtggtgaacctaaaaagttatgccataattttgcaagcatgttgatcaatgacaataaaatattacaattctgaattggtacatatgactaaccttataattgctgttgtagacatgcaagagtacggcgtgtatgcgggtgatgtggatgttgttttcgaacaagaggagttggttgattcagatgaggaagatgaacatcaaaacaaaaatctgacca

SEQ ID NO: 27333 - DNA, 1501 bp, Oryza sativa; identical to SEQ ID NO: 27273

SEQ ID NO: 27334 - DNA, 1501 bp, Oryza sativa
  unsure (1)..(1501): unsure at all n locations
tcggatgcttggacactaattataaatattaaatgtagactattaataaaacccatccataatcttggactaattcacgagacgaatctattgagcctaattaattcatgattaacctatatgatgctacagtaaatattctctaattatggattaatttgcctttaaaaatttgtcttgtgaattagctttcatttatgtaattagttttgtaagtagtttatatttaatattctaaattagtatctaaatacagagaataaagttaagtctctggatctaaacaccacctaagccttttgctttacattatacacacgtttatatgtcgggtagactgaaagatgatgatggagttaaaactacacggatgaaatttgttagattgaaaagctcaatcacagcccaaaaaaatgtgagttgtattactataggccctgtttaggggtgtttaggagagaggaactttagcccctctctccaaaaaataagtccctacagagggactttgtttagttcctaaaaacttttcgtaaaatcatcacattaaatctttggacacatgtatagaacattaaatatagataaaaagaaaaactaattacacagtttacatgtaaatagcgagataaatcttttgagcctaattagtccatgattagtcataagtgctacagtaacccacatgtactaatgacggcttaattaggcttaaaaaattcgtctttcggtttccaggcgagttatgaaattagtttttcattcgtgtcaaaaaccctttctgacatccgatcaaacgtacaatgtaacacctaaaaatttttatttcaccgagtgaacaggcccatagtaccattaccatccatgcatgcgcaaaggatcccgtgggccagagccacgtcgtgccaagtgcggcggcctgcgagggagacgcatgagaagggggggcatgatggattgcaggaagcaatcgatcgatcagcgatcagctctgcactgcctgatcatctccactcgtctcatctgagttcccccacgtccacactccactcttactttttttttctcttctcgccacccaccgagccgggccccagtccccactgtcgctgacagacagacaccccccccctcccccccgattcgtcgaatcccacacatttactcctcggcacccaccttccttctnctncttcagcaccaccggcgntactagtataaaacacggaccgatcctctgatcccctcaagaagagcgaggcagccatcgatcgtcgcctctctcgacaggtgggggaattagtcgagcgttcgtaccgctgctcctttcaatccattcctttggctcttgtgcagctcgatccatcgctgctgctcattaatggcgtttgtttgattatggagtagtagtactttgtttgtttgtttcttctcctgtgtgcttgactggtagttacttgttgcagcagctggatggagcggtgcagcgtgctggggctgg

SEQ ID NO: 27335 - DNA, 1501 bp, Oryza sativa
gatgagttctggaaaatcaccttgttctgcctccttgatctcacttagtacccgcgtgcacacgcactcgctgcatcaccattatgttgtcttccgtatcgtagtatgcgttcatctgatcatcaagctaccactgccaagacatcgtgttgaacagtagatccttttacgaatatgtggcagccttgtcgccatggatcacataattcatggatggaagaacaattacttatgtttatatttgagccaaattaatttggatgtgtacatggatcatacttcgtttagggattgagggtagaaatacagccaaatattgtgtatgaggatgttttgcatagaagtgccatactaaggctgtgttcgcatgttcttgatgggaactcattccctccgcacgcaaaaacggagcgatccattagttcatgattaattaagtattagctaatttatttttcaaaaataaattattttgattctttaagcaactttcgtatagaaactttttgcaaaaacataccgtttagcagtttgaaaagtgtgcaagcggaaaacaaggagacgagttgggaacaaggggtgccgaagcaacttggcaaggcactacagtatgtgtgcagggaagttgcaagcacaatacaaagattacacactaaggttgtgttcggtacacccttttcccaatccctctccctcgttttccacgtacatatttttcaaactgttaaacggcgcattttttgtaaaaagtttctatacaaaagttgcttaaaaaattcaaattgatccatttttgaaaaaaaaaagctaatacttaattaatcacgtgctaatagatcgctctgttttctgtgcgtactattcccggttgaacggagcctaagtcagtaagagcaggtaatttgtactgaactccatcagcaagctctggtattaacatgctctgaacatatattaatgacggaggtcagtggcatatccctaatctaaataaaataaataaaaaaagcatatttccacatcactatgccgtatcaggtcatctcagatggacactaaccctcaccttcgatggatttcccccggtcaaggattaggggtcactggtgactctagtcacttttgacgggccagtattttaatttcccgtcacaggtgagcgtctccacatgcccatgtttggttgcaacccgtcacagtgagatacctaagacgggtgcaaagtttgtacctgtcggatgactcacctttgatggattgaagtaacaaggccgtcacagatgagctcacatgtgacggtctttgtttacgacccttcagttatgaggtattttcgaaaaacaacaatttctaaatattgactagactcatgatttgctagccacactctctgaaaaaagaaacatcacatatatcctagccatacccaatatcacatattctccattttagcacagatgcatcccaaaattaacatcatgcacacatgcattccaaattt

SEQ ID NO: 27336 - DNA, 1501 bp, Oryza sativa
tgaagaggatggaggtggtggtggaagactagaagcctgagcagcagacccatgggtggaggtagaggctgtagtcataagacgacgaaggagccttacaagctcttgctcggtcgatgtgatctgctgagagcttgactgagaagagccctgtcgagagccctgagaggtgcgatgactctgatctctcttcttcttgtagcacatagaggcggtgtgccctgtcttgctacagtacccgcaaacaatgcctgaaggagtactaggagcaccagccgcaacaggtaaaggtgatggcaccacaacaggctgggcagagacatggacctgagaaggcaagccctgtgcaaccaagacagaggtggactgctgtgcaatgcctataccagcctcacgacaacgagtctcttcagcccgtagctcaggcaaggtctccaacaatgaaggtcgagggcgtcgtgccaacagctgagctcgaacaggctcaaactcaggcctcaaacgagacaagaactcatagaggcgagtggtctcagtctggaccctctggcgctgacaacaggtacaagtgcgacaaacatcagcgccctgtaggtccatttgacgccacaccgcagacatcttgcgaaagaactcatccacagtggcatcaagctgacgaagagattgtgcctcattcacaacggcaagaaacatggcatcgttgcgaggctcgtactgctagcgaagacgggtccacatcaactcagagctagcaaggcccgcaatgtcgagtgatatgtcaacctccatgctcccaaccaaaatagccttggcataggcctcctgctctaaccaagtctcatatagagagagatctgtttgatacgcctccatagcagcagcaagatcatcaaggagaccacgcttagtgttctcatcagcatctgccgagatggcaggctcagcaggcaaggttggacaaggcgggcaaggccgatcgccgatgaggtagccccacaaccactggctgcacatgtgtatctgcatatgcaatgcatactcccggaagttgagtccgttgaagatgaccggaggcttcagaagagaaatggcacccggttttcccgagggcggcgccatcacagtagaggcagtagctttagacggtggaagatgagggagaagcaggcagcggcagcagaggcagcgcccgcccgtggccgcccgcccgcgagcaggaacggcggcgcccgcgagcaggggcaggcaacgcccgcgagcagaggaaggtggcgcccgcaagaggggcggtgactccagttggcgtggcggcgaccccaagaggcagaggcgcggcggcgacactgccggcgcggcggcgaccacaggcgaggtcatagggcagaggtggcgacgctcgcgcgagagagaagagggatccagtcacgtgagaggagagagagagcttcacgacgacggcggcggatgtggaaccctaaaccatatgctctgataccat

SEQ ID NO: 27337 - DNA, 1501 bp, Oryza sativa
caataccagtactataaaggaaactatccatgcagaatctagcatatctagaatctagtataacctctgatattatggaagggaatgaatttcattatgctcaactcttgacagaattgagttggtaaatatcaaagaaaaaaaatcaagtcctaattgttttctcaaacttatcaaagaccaattttgttccaagaagatagcaattgcatcaatgcacatgttatagatcatttttacagagaaatggcaaagattttagagtgatttatgcaagccatatctacaaagatcaattgttttctattcatgtttacaaggttacctagatgtatttctccttggtggtcagatgcatacaagttgagatcaaaaggaagcacatggttggcacctccctggaaatcacctccaggaagctcatggttggcacctccctggagatcacctccaacctggtcatcctcctgatcagccactgcttcattgaggttaggtacagcatgttcatctccatcatctaatgctatatttagatctaaagccatggatgtgtttttgcagagatatgaagggataaagtgggaaggaaagttgtgtttttgcagagttatgaagtgataaagtgggagggaaacttctgatttgaaacttgtagggtttgttgtggtggggtgtgctaaatttgtattacatcccgccaatgaagtggcacttaattcttcattcaaattatttggcaccttggcgccctatgtctgcctgtgtgtttgagtatggagtactactcctgttttattaatgtgtggcagtagtaatactttatttgtacctaatgattgggtgtactagtactgagggtagtttagccttttgctctttgtcctaaaactaccttgggcttccaggaatcccttctttctgggacggagggagtacttgtatgatacaaaaatctcgacgggaaagcccatgggcaataatgactctgtccaccgccagattttttctatgctcaagaggcactccaccacatacattaccatgaatgagttgattaaaaactcaagtgaatggctcaacaaatttcttatacaaccagagccaatgcaccatacaactctcgacatgggtcttgttaggaatgagaggtagaaccaattctgccgagcataaaaggatgcatccaataggtgcaaggaaccccaaatctctctccattgtacaaactcgctgctggtggatatggagtgacttgatcaagtctgaactgctaagccacccgatctgggtgatagggttcagcgaggcataggtcaacatgcttaataggaagcaaaccacactgaacagataagcaaaacatgcttatttaaaggttggtttgtagggataccaatggatgttggcatctttgcataaaaatttgaaggcttcgtcaggactgaaacgcttgggggttctaaacattgtgttcaccatcatggatttccgagaacca

SEQ ID NO: 27338 - DNA, 1501 bp, Oryza sativa
ataccccacatgccaggatgccatgtcatcaccctctcccttcctcttcctttcccttcctcctctccctctcacttctttgcgcaggctggccagcgggtggggaggaggtcggtggccatcaggaagatgaaatagaaagagcaaatcaaagaaacgagaaaaaggaagagcagcccgcaggctgtcctggccgccgacaagcagcacgccacgccatctcaggcgccgcgctgcgctgccattgcacacggtcgctgccgggtagcccatgccgtaaccgccaccctagacttgcatggccatgctgatgccgccctcctccgtcggaaaatgccgtacgttgcacagccactccaccccgcgccagggtcgccgcaccggctgcaagcgctgatctggcaactccgttggagggaaagaacaaaaaaagaataggagaggaagaagaaaaagaaaaaaaaaaggagcagcaccggatggccgcgccgctggacgagccgccgtcttccaccatgccgttgtgcacccacggcaccgggttcccctccttgctgtgacaaccgtgggccgctcgtcctgcgcctcgcatgcgctggagaagctgcgcctgtcccttgtccaacattgccgccaccatcgccgccgcatcgcccgtcgtcggccgctgacttcctcctcctctccggcctcaccacgccggcttcctccccacctgtcgaccagcctgcgcagagaagtgagagagagagaaagaggaggaggaagggaaaggagggcaaagagagagggtgatgatgtggcatgctgacatgtggggccatgctgactcagccgccatgtcggataaaactgggttcaaaaccaccgaaggatctaaaatgaacggttttgtaagttgagggatgtcatatatctgattttgctgatggggacgattttgtaactcgatgactagtagagagaccttgggattatttttccaaaaacaaaaaaataaataaggagtggtttcgggcggagaaaagcttggaccaattgaacattgccatatcatagtttttaaggatttatgttaggaaaaggtgttcgaagggaaagggaacgggtctgaatttgatacatctgatttttggatggagctttgcatgcaatgtatggatgagttaatatttttgttggcaccagaatcaaaatgtatgttcaatatccaaaatctgaatttgaagtctcattcaactgtgcttttagcaacggtgtttgatagcaataattcagccatcattgaccctgtgacattaatttgatactgcgcaaagcatgtgcatcccctggtcatgcagtaagttcatgtaacaacaggtggttgtggacaccttccagttttgaactatactgccaagtgcatcacccttcaatttataaaggggtaaatgtaggtacctaaaacctatgtggacgatttattcgtacgtggatgatttgttgtgaacgatgaacc

SEQ ID NO: 27339 - DNA, 1501 bp, Oryza sativa
gaacgggcgtcgattaaagcatgatgacggtcattaagatgggctcctcagtcaccttaatcagtttcctaaatttgacgcacagaaaacgctccatttttctaactcactgcaagctgatccaacgctagcaattcctcatcgtgtctgggtggactttggactggttgagtttctatcaggtctatgaatcgaacaaagatggcacttgatccaacggctgtaaggtgatgataacgtggcttaacctggagacagctttataggagttattcttgtagtgggaaccaactatataggaaaaatagattgcagagctcgaacttactggctcaacccaatttaacctctttgttgccctcatcatgtagaaattacgtagtaacgtgacggtcagtatgcagtaacacatgtgcttttcgtagtaatgacgtcaaaatatagtcacgatagatctagtttcattaaatatttttttatgaacattatggtgcaaatggattagaaaaataagatattatgtaagaaatattgctctttgaagattgggactttaaagtttctatatctgcacaagcattactattatagcatcactggtattattacattttctctgttattgcaatatttattatgtgctattaccaaaagtgcagtaacgacctataaattttaaagtaacatagcatgttactacccatctatgataatattactgaatcatagtaacaaggttagattcctacagtatcataaaatttgaacaatcatacgtagcaagcaaacaataatctccaatcacatagcgtcacagggtgaattgattaggagaactatgagatcataggttcaagtcatgaattcatcactttatttttagagaagagaaaaaaagagaaggtttttgtcacaccctgaagttcttctcccaagcctaaattaaattaataagtggtcttaagaaatttcatgtgttaaagtaagagagaaaccctaatggaattaaatgcaaataataatcggaaatggcatgtgggatttttcaagagttctacatgtcaaaatatgctaaccggatttttagtggaattttcagagccctagaaataattttaaccaattaaaatcgagcacaagcattatttaaatccctggaaaaatcctttttcctttttctttttctttttccctccttttttccttttgggccaccagcccattccctcctctcccccgccggcccactccccctccttctcccacgcgccagctgggcctcggccagccacctcgcccgcgcccccacctcctctttaggtcaccgacaggtgaggcccacctatcgggcccgtctctcacgtccggccggcgccgccgcgcccgcaatcgccgctcccgccctctccgagcgtgcccacgcccacgtcgccctccccgcgcacgccccacacatcctgcaaccgccgccccactctcccgcccgcacccgcgctcgaga

SEQ ID NO: 27340 - DNA, 852 bp, Oryza sativa
attaatcttctttaattgtttttctcctgactaaaacaaaacgtctcgtgcacatgggcgtgtcaaaaacaccagcttatgtctgtacttttaatggagtgtaagttttaattagtcaattatatcaaaatcgtagaactacgctgagaacactttggacgtctccatagttagatgcataacgtcaaaacatacggcatacttacaaataaattttataatcaaagaaggtacaaagaatgttaacaatagactatatgttgtgtttaagatgagaggagaagatcgagaagaatacgcaaaacaatgtaaatattactacatgattattgagtattaactattttaaatttaaaaaaaataaattaatatgattatttaaaataacttttctatataaatattttatgaaaaacgtaccatttaactgcttgggaagcatgcacgcacacaacgaaagagtttttcttctaatccacagcgccgaacccagactaaatcatcaacgtttctgggtaaaatactccctaaccctctgctccaaaggttaacacagccataaagagtccatgaagagtcattgagtgcaaatgttggacacgagatgttacaactttgataccttttcttcctagcaagaaaaatatataaatgatttttttttctgaaacaaagttttaaactctgttactaatctggacaatcaacaattgggccgtcaggaaaaaatggatgcgagaatggaagaaacggaaccgagatatttctagagaatcatatcacattgactaattcgttcaaagaaaaaaagaactctgaagccagtagctgctaatttgattaggtgaagca

SEQ ID NO: 27341 - DNA, 671 bp, Oryza sativa
tatagggcgaattcgagctcggtacccgcttttgttaacttttgatgggtatgtacaaagtcctgaataagctgaaccattttggtctatttagtttggggtcttctctaccaagtcttttaggtcccatatcaccactgtaataaataacggagtaaatacgacaaatggttttcttgcctaaatgttctatgagggggtatattttgacatttcatctgtttcatctcaattatctgagtcttaagtcttagctacctcatgtaagatgctcttgaaggtttcgtcactaaaagtcggtaatactctgcttaaatgactttaccatttttcgctccatccatgatagctcacattgattttgggcagtttgtgttatcgcatattatgcatgactgaaagttgtacatgaggctcaggaacatcatcctggaaacagtcagcaactagcatgggatgtgtgctaagggttaaggtgtcccatccataagaccataactccatatatataactgcaagcataagagacaaaaagtttcatttggatggccgtatgagtgtaggataacaatttaagagaagtcgtcatatatcctgcatatgagtttgtatttacggtgctcattttcaaactcttaagactaaatcatctcgtttatctgattgtcagg

SEQ ID NO: 27342 - DNA, 1197 bp, Oryza sativa
attttcaaaattttgataatttcggtaaccctggcataaaattcaatttcgaaattttaaaccctgcccgtggaacgggcacgggcgaggtgtctttggatgcccaaagcgtctccatgaaatacgtcgtcggaattccatatctttagtttcaactcggagaataatatttgcagtagaaatataaatgggttaattcatgaataatttactattaaaagtttgatatctgtattatttacgactttagaagttaatataaaaaataaactgcaatataaaacctcaaaatcaactttaattcataataaattgaggcgaaaaggacctcaaaagcagctgataaagtcataatttcttttgaaataatacaactttaatgaaaaattgtaaaaagtatatggtgattgtttgaaatcacaaatttaacaccatatcgaacaaatcgttgttcaatagggtttaaacaaatcgagaacttgggatgtgcgtacatgcatgtgagtgggttgtggggcctatcgaactttgggagtttgataggccaccccatatgcttgctatttttttttaatcaagtcaactatactgtcgaacggccgttgttcgacacgtatatctgtaaaattttacaatggttgtttgataggtatcttatcaaattacggttgttcaacacggtgctaaatttgggatttatatcgatcaatatctattttcacaattttcattaaagttgtattattttttttgaaaaaacattcgataaagtcaacaggtaaataatgaaatgcttctaatatcccgtaggctcgtagcaaaagagatgtcggagaattttacctcatcgtctttctatcgtggcgaatttacagtggattttgttgagtttactaccttattatgaaaatcttgataatgtaaaaactccaaatgtttctattacaaatatatttaacaaaatatacatgctgtttaaaaccggattcttccgccctctccggtctccaccccatgtcgcatctaggtcgcacgaagagcaaccaccagctcccaaaaagaccagaaaaagagcagttcactagaaaaaaaaatgtatatatggactcgtatagcctatcctcgatcgtatgagcccgttgcaaggtttgacggcaagtcaacacattgatccggaaatatattttttcttttagg

SEQ ID NO: 27343 - DNA, 1401 bp, Oryza sativa
tggtggtatccaattagaaatgctctgaagaaatttaccagctgaaaccttgtctggttggggagactttggtttcgaaactgtgggcacaaaccattcctgaactgttccttcgagatgcttccaattcgtattaagaacgaaaccaaagattcacattaacatgaattggtataattatatgcccaaagcaatactgcaacttggattatttgatgaattgacacgctgaaaagtgtactagattcattggcaccgtgtgggttggcaaattacaaagccaagattctttgcttgcttgcttgcttttctagtagtaattctttgtgcttcccctgatccaggcaatcgctttcgaggcgatggccattgaaataatgtagtgcagtaactttaggtatgcctcttgccaacttgcagctgctatgtttgcataattttagcttagataaactgatgttgtattaattagttgtaggataatttcagtggctgtcattctcatgaaagggaaagggtgaaaacaataatgtttgattccttttcacaaattactactagtagtactagcataacatatttagaagaaaaaatatacagaaaaggatgtgataaacacaaggtctgataaaaaatatcctagaggagaagaacagcagacttgtgctgaccatgttggagatgcaaaggccagccacttttaatcagaattttaactaaagttgacaagtccccatttgatccctttacaatgtatccataccacaaattaaactcttggaacacaatttggaagaactaaagaagaatcccattagcactgaatcacatggctagattctctctgcagtccacaggtcgtgcagaaaaatcagcaaatccgtgggtcttaagtcttatctaatcctgtgggcgcccattggttttgcaacaattaaacaaggatattttggtcagtacttcactactcggaacggattcaactaagccacacacaactatatataaaaaaaagatcaaaacaaaaggtaagggtttgcaacaagaccgaagagataaatagaatgcaaaagaatgacttattttttcatattttacagatgaaccttatccgggaccatgataattaagccgttccattcaattcaaagatgaggttgaagttgcagccacccagcttgctactgcagaagctgactgcacaactaatgtgcatttacatagactaatactgactcactgagaccctgtttagatgggactaaaacttttaagtccttatcacatcggatatttgtcactaattataaatattaaacgtagactattaataaaacccataaataatcttggactaattcacgagacgaatctattgagcctaattaatccatgattagc

SEQ ID NO: 27344 - DNA, 259 bp, Oryza sativa
ttcaggtgtgctccgctaaatgttctgctataaattatttaattcttgaatgtttatcaaagcaagactttttcacaacttgcttgtgtattgttatattgatgtgcatgcaatgcacttttgatcccgacaaatttatttaatgttgtgagacattgagtttgtttttaggatcaactcaagtacttgatattattgttcagtgcaaaacatgaattaaacataatattttgtttaatcattttccataatctccagg

SEQ ID NO: 27345 - DNA, 170 bp, Oryza sativa
aacagcagcactcgatgatttgggactcaaggacatagtctaattcgaattatgtgcacacaaatggagaacttacactagccatgacatacgtaagctagtcctatgtataaacacgtatagactagaagataacccaggctgctatatcgcgtgacaccctacgtagg

SEQ ID NO: 27346 - DNA, 1501 bp, Oryza sativa
gtctgcatcatctccagccacgtttcttcaggttaattacagcggaaaaagatgatgaagcagagcatatgctgcaaagaggcaaagaggatatggtatatattcagagaaagttgtaacagatgctagctgggtaagctaaagccaaatgcagctacggtgatcatgcgacgcgccatggaaaagaagaacaaaggacgaacgacacagggttacagttttaatacaaagctgtcgggagcaagatggacgaacgaacagggtcacagagggcatcatgatcagtgatcaggttttcagtgcttaccaccctattgtttcccgatcaaaagacaggagttttttttttcttttaacctagtcttgccattgtttttagcctagtcttacatctacaaatacaatgccgttttactgaggaatatttgtagatgtaagtttactttgcaatgccctgctttgcgatgtcctatgcagggtagcaatgtattgcagtatttggggacatttgcggtgcttcggaagaacatgtgaagcaaaatcaccgctgagggatgtcaatcaaactcgacgtaaagttgagggatgacaaataaacttattccttctttacttcttttatcctagaaagacaccaacgtgtactgggcttgaagcccaatatgttctgggccagtagcctgtaatcacgcacgtggccatgttgggcttcgattaaactactggtatcagttgacccagtccggcccgttccatcaccgccgcctccgccgcctgcagtctccgccggagctacccctgtattgatctaaggggaagtgatcttctacgtgggttggcaacttgggcacaaacgtcaaggactcccatcgccggcgccgccgtccgagctcgagctcaccggctacggctgccatcgaggaccacttccctgagcaggataccgccgcgcgcgcccacgcgtaagtaaattctatcgccctttctgaaatgtatctcccgttgtctgtaatttggtagagaattattagtggcggatgcgagtgatactctggagaatctcccattcatcgtgtgatggaaactagcagtataatatttttctcacaattgggaatgccatttagcagttaactctggttgaattggcttcggcgtccaaaaattgcaactgaacttaaccgatctccagctagaattgtggttgctgaggattagatggcacctttttttttggggattggtttaatttagttttcgaccctcaattataagagcatctttcccatccttaccaaatcctgaccattgatctggcctcatcggacggtccaaaatcgatggtacctcgtcgtaccgcacgtacgtatcacaacagtaccgtgtgtgggagggtagttttgtactttcgcgttatctgtttccttctctgtatcgcgagagaatagagcctcgtattcgtcgggcaggagcaggagacaaacaaaccctaaatgccaag

SEQ ID NO: 27347 - DNA, 1501 bp, Oryza sativa
tctagtgtgtcttttttagataatagaatagaatctcagcttttgctcaaagagttatagccaattcttttctagtgtgcgtgtgagtattgatcgacatgtcgtttaattttatgaaatccaggacactttgttgtaaattttgtttttcaatgaagtgaaagggaagactaattccgttataagtttgaatgaataaaaacgagtaataatttataagcataattagctgtccagaattttttttccggaagaagtagagcaagctgttcaggacgtagatgtgtagataaatataaatatctaccagttattgttaagagagacttctcggactaggacactgcacgtatacgtatatatttgcatatatacaattagtgaaagattctgagtgcgcatatagtttagtttgaaacaggaatcatgccggctggtgaattggtgtataaatagaagatccagtctcagtctatctctctcatattccttcgatctgcagcttgtacgttggccttcttgtggtacgggcaggagtaggatataaaccttcacgccgatcttctccgaggctgactcggtcgatccagaggtatccatcgatccttaatttgaacataactacttttaagaatcctcacttactatatacatcctcctttctaaattgatcatcatataatacaatccaaaattttttgaattggtcatcatataaccgcatggacataaattttattggaatataattaattcaacatgggacaatagtttacattaatttttaggattaaattagttttctagaactttgacaactgataatatataatacttttggagtcaaatatgctcataccatatttatactttttagttttaagtaagagatttgctctggtcaaacaaaaagtatctcgaggtactcatactaaatcgtttgcgatcgttggatctaacaacgcccatcctgcccagctagatccaacgatcgaaaacgatttagtaccgtaaaataccggtaactcgagttactttttattgaaccggagcaaatctcttcaagtaaatatttataaattcattaacggtcgaagttttaaatgtttttatcaaatcttgtcctaaactttcaaatgttcagaattgaagcgagtatatatgtgtatcactaacgagatcgagtgcagggttggaaattccggaacgatattatttcggccgaaatttttaaattttaaatttttccgtgaattttggtattatttgttcaaattcaactatactttattcaaaatttcggaaatttcggtgagcaccgatcaaatcggctataccgataggttttctagtgactcaaatttgcatggcttgctcaataatgaattaatgatcttgaatttgctgatttcaacagaaaacgacaaccacatgttacgcacgccggatttgggtgatcctccggtggcggagatcactcacccgtttcaccctcacaagc

SEQ ID NO: 27348 - DNA, 1501 bp, Oryza sativa
ttgtttcctgtgcttgctatacttatggctctcaatttcataatattttatacagactgcttgccttatacgtactcccttcggtaacaaataagtgacattttagaaagcaacaagattaccgaaatgatcaatattgattgctagtataaaacctataaaaatatagcaaggacgttctaatattttgaaactcctttttgttttcaaagacaaatatacctatatcaatttttaaaattaaatcgaaatattttaatagaaattgatagtaaaagtttaaacacaaaacacattgacttgatgtattcaagaacatcaattattgttgatagggatgcagtaaaaaaataatatatttatttaaaaattatgaactgtactatttccttgaaaatgtttttattgcttatttcttaaagactaaattttataaaactacagatattttggctaaactatcacaaaactataaatttaaaatgtgtatcataaaactacagatttaacatgaaatttatcacataactacatatttaaagcattgtatcacaaaactatgcatttagaaatgaaattatcaaataactacaaattttagagtttatatctatagcactgttgatgttacaaaagttgtagctttctgataaaactgatgttatactatatatatatttaaatctgatgttaaactgatgttatatatgctcatttataaaattgtagttttctaatgatactttcaatctatagttttgtaaaaaaatatggttttaaatctgtagtttaatttgtaatacactttcttaaatatatagtattgtgatatattgatcaaagtacattaattttgtaaaatttactctttcttaatttttgcattagctgattttctaaacatttccaccataaattaaatgcgagatttgttaaatgcatccaaacgcgacttggaatgttgagtattacaactgagtggaaaaaaaagggtagtgttggaattttcaaaactctctctcctaaaaaggtattaattgcagttttggatgaaacagtaatggtaccggcattttccaactcaaatttccctgtgatggtattttgtagctgatcttcttgtagtggtattttccaacccaacattctttgcaacggcagtgatcaaatttgcagaagatttaatgtggacaagtagaaaattttcagaaattagttaaagattggaaagtgcatttagtaagatgggtaatgagatcataaccttcaacacaaacagctagatcataacctcctcttgtgtttccaaaaaaaaaaaatgttgtggagaattttatctgactaatattttttttagaagatgtattaaaaactcggtctctacaagtacatagccaaacatacattgtcaagagtatttagtttttggggcaatcgtatatttgaccctattttgaaagcaaactaccaaccaatttgaccttatttttttaactttgct

SEQ ID NO: 27349 - DNA, 1189 bp, Oryza sativa
tgttgtgctaaaggttatttaagaaagagtgataaatgcaataggtatatgtgtttagcgtttatttttcaacctatgtgcttgttaagatgttgcattataaattgtatgaaatcatgaatttttattgttgattcaagcttaattgtaaaatctttgattcatggttatactttaatgcatgcttattatattatagatgggttcatcttctttttattgcaacacatgacatgatatgctatatgtatgttaagcttttatacattaatgaaataattcctatgctttatgaaatcattgtcaaaagggggagaaataatgtgaaaatttttagatcttttggagttgtcaaaagggggagaaataatgtgaaaatttttggatcttttggagaagagttaagttttagaagagaagagtttttaagaagagcatgtttttggttcaattgggaatttctttcttttaaaaaggggagaaggtttcttgtttttggttcaattgggaatttctttcttttaaaaagggggagtagttttcttttggatttttgagcacgatgtgtacgtttgtacgaagtgtgctttttaccgcttttgtttttaatgttccaaactccaaaacatttttaatgggtttgccaatgtgttcatcaagggggaaattgtaagatcaacgtgtgttttgatttttattctgtgatgaacaattggcatctgtgattattggttttgatactggagtttattcacgaagtggttttggagatgattggagttcacaggtgaatctacaggaaatcgctgttatttcatgtgaccggtcagaccgggaaggtgttgccggtcagaccggcggagatcgagcggtcggaccggccggcccgcggtctgaccggccgacgctgtgtcggtttcggtttcgggttgtttctttggatatctgtgattgtttcatggttatggcttctagatagatactatacgtatgtaatactgtttatttgctaacaatgagtcaagttggagatagcttggtctcggaatatggtttctttgtttgtttcatgtgtaggtgactcgatgcctcgggagagtatttacggtgatggaccgggagtcggcttggtggtaagacgatgtccgtggtggtcagatatcatgcgggatactaaggctagagttga

SEQ ID NO: 27350 - DNA, 1501 bp, Oryza sativa
tttgtggataagggtgtcatgtcctgtcttcctgaggcctcctctttgcacgtattgggcccacgcttcatatatcgctagttgaattggggtcaaatcatatgcgttcttatcaattctggtccacttaggtgttatgaccagaaggatccaatgggcaccgcggcattaacatagtgaaagttaattaagtactgaaggaatgtgtcatgctgttgtgtatatttagataacacacttactgttgattataggcgcacataatgtactccttgtctcggcgggaccacaaggtgttgtagatgtaattgaccatttcttgatggtcattctggagatttgtgacagtgaccacttgtggatcaaggaaggcaatttccggtgcatgcttctgacaccattgccaacttaacctacacacaggataaacgatcttttaagtgagttaaaccgattgttattactagattgagttgggcgacaatacttacaaggagtagcacttaaggaggcttgtgtccatcgctcggagcctgtagagatcgaaaagatccttgaagtcgaccacgatataatttgttggaccaaggaatggctttccatcatgctctccaaggatatcggtagctttattcggcttcctggcgttagatttctccatgtagtataagtgaaagtccttgcaagcggtgcccattgcggcaagcacgtcatctccaaccaatggcatgcctagttggaactcctgtggagcgacgtatttctttttgacctctttgcccttagtctcttcctggaccttgcccagatctagcttccttggagctagaagcgaggcatgcacctttcctccccttcctctcccctttgcttcgggtttatcgagagtaattctctgaggggaagagtgtgctttcctactcttcttcatcggtgggggttcatgaatcgccttgctgtcggcctccgttcggtcctccccaaaatccgtgtcgtactgcaactacacatcgtaagattgtgcatgacgatcttgagcaggaggggctgaaggagcaaaggcgggtctctttggtggacgaccgcctggtgcagtggttggcctcgctgtaaccctgatctcaatgaggtccttgggccattggatgaaggtaccacgggcatttcctagtgagaggacctcgtcgttcggtggatacttcagtgggaacagctcgtattcaggcttcaccgagtcgacttgaacttttgcacagtcggccctgagttgcactccatgcacttttgtctctggggtcggcttgtacgcaagtccctcggctgctggaaccatgaaggtcggcatcaccctaactgtgagggtgcagctcattggttcctgcgatagattaatcaatttttttagaatattatatatcatatggattcgttaagtctttcatgtattgagtaagttcacttttaccgttatgtggttgacggcgccgtcgaccgatgttgg

SEQ ID NO: 27351 - DNA, 1501 bp, Oryza sativa
cagcgaccgtgtgcaatggcagcgcagcgcggcgcctgagatggcgtggcgtgctgcttgtcggcggccaggacagcctgcgggctgctcttcctttttctcgtttctttgatttgctctttctatttcatcttcctgatggccaccgacctcctccccacccgctggccagcctgcgcaaagaagtgagagggagaggaggaagggaaaggaagaggaagggagagggtgatgacatggcatcctggcatgtggggtatatgtgggtcctaagctaactcagtcaccacatcggataaaacggggttaaaataaccgaagaacctaaagtgaaaagttttataagtagaaggatatcatatatatgcttctgcagtttgggaacgattttttaaatcgatgacaagttaagataccttgggtgtactttttcctttttttttcctctcttaggctacgttcgttttcagtggttaccaactccccctctcgttctccatgtgcatgtttttcaaacggctaaacggtacgtcttttgtaaaaagtttctatacgaaagtttcttaaaaatcatattaatccatgtttataaaaaaatagctaatggaccactctgtttttcatatgggagggattagttcccatcctcctgaaacgaacacgccggaccagcctttctctctctcggcccatttcaacttttcacccttcactactgtgcagccaagttcagcacctccaattgtttcttgtcgatctctgtcagcttttgtcccaaatgtaacgggtggcgcacgagttaactgcgttggtttgtaagctctagatcggttctactccctccgtactataaaataccaacttactatcaaatgcaaaatattttagtattacgaatttagacatatatctttcaggtttagattaatagtaatagaatatgtcacacgtaatcctagattcattttttaatggaagagagtagttggaacagcacgccgcctgctgtgaaatagttggtgtccagtgatattgctggttccttaaattaaaaaaaaaagattccccagaaaaatatgatcagccacctccctgatctcctcctccgaaccacaccgttccagcacagccgggccgatcaccatggcgccccggccgccgaggcttgccatgctgcacacgaccgcatgctacgctcgcagctgcaactacctagctaccacgatccacagtggtgaaagctaacacaggtagagaaaccatctttggtcagtcgatcaaattccacaatagtcccggttccattaaaaaccgggatctggttaaaaaaaatttaatctttacacaccaaccgggactaaagatgatttttagtcccggttcatcccctgtcagaggcatgtgagggagccgagaatctttagtcccggttgatactaccaacgggactaaagattaccattttagtttcggtttattaccaactgggactaaaattcaa

SEQ ID NO: 27352 - DNA, 1501 bp, Oryza sativa
tattctaaggatgtcatgataccatgcatgaagtaactcgattttaccttcgtgatactacatcaatatcgatcatttttaaaacccatgattatcgttgagtatcatcgtatattgataagtatcatcaagtatgtatggaccaatatcattgaatatcatcaagtattttatcgcgtgtatatcaacaagaatcattgagtatcatcaagcgtactatccagagatatcacgacatagtatcaagtattacattataccaatataataaatcaatatcatgatatctcaaggtaccatgatatgatattatatagtactatacgatacagaatgatagatcgatatattatggactggtacgacacctcgagataccatgatatggtaactcaaattatcattggtatcatcaagtattattggtttagtgataaatattattatggtatcataaatatttcatatgttggtaccaaagactcaaaaacaggctttcacgactaaaagaaataggcctgttcttttctccaataggagttggatgaaaattaagattttcgtggtacgttttttaaactgctaaatcgtgcatttcgtgtaaaaactttctatatgaaagttgctctaaaataacatattaatctatttttgaagtttgtaataatgaaaactcaatcaatcatgcgttaataccatctcgttttgcagaaaaaacttaatcttcatcttcatgaaaaaataacaccaccatactctatcacaaaatgacaaaatgacaaaggaaatagaaaaagtaatcatggacaatcagcaagcctcgacacactgtcgggccgcgacgtcaccttcgcgcggtgtttgctccgcctccgcgcgatgccgggctactgctacttcggcctctccaagcgtccgcccgaaccgtgtcaaataactgcgggctgcggcgctgtccctccgtctgcgtgatccgacaaccgcctgtccgcctcgcctccgtgcgtggccggacccgacccgacccgaccccgcccagctgccgcgtgttgcccggtggggacgcctcatctccagtccacggctcaacgtccacgcacacgcactgcgcagcgcgaggaggccgcgcgccgcatcacatacacgggccacggcctcacgggggggccttcccgtggctagcccacgtattcccctccttcctgggcctaagctagcgcccgtaagccaaatcgcggccggtttccgcggatctccccgtggacctcctcctccgtgtggtgtgatcgccagtaacgcccaggagcttcgagagaattccacaccattcccccctaccaccacgcggcgcatcatcacaatacacagcctctgcttcccccggcaacccaaccgattcgcgctcacgccacctgcaatccgcgaccagacgcgcgggccgttgagatcaacaaacacatcgcacgcgacgccgcgtgagcccgtacgatcgccccctccc

SEQ ID NO: 27353 - DNA, 1501 bp, Oryza sativa
tgtccatgcggttatatgatgaccaattcaaaaaattttggattgtattatatgatgatcaatttagaaaggaggatgtatatagtaagtgaggattcttaaaagtagttatgttcaaattaaggatcgatggatacctctggatcgaccgagtcagcctcggagaagatcggcgtgaaggtttatatcctactcctgcccgtaccacaagaaggccaacgtacaagctgcagatcgaaggaatatgagagagatagactgagactggatcttctatttatacaccaattcaccagccggcatgattcctgtttcaaactaaactatatgcgcactcagaatctttcactaattgtatatatgcaaatatatacgtatacgtgcagtgtcctagtccgagaagtctctcttaacaataactggtagatatttatatttatctacacatctacgtcctgaacagcttgctctacttcttccggaaaaaaaattctggacagctaattatgcttataaattattactcgtttttattcattcaaacttataacggaattagtcttccctttcacttcattgaaaaacaaaatttacaacaaagtgtcctggatttcataaaattaaacgacatgtcgatcaatactcacacgcacactagaaaagaattggctataactctttgagcaaaagctgagattctattctattatctaaaaaagacacactagaaagaaatttaactttcagaatattcagcctgcccatatctgtaatagcgcgcacctctttgcaaaacaaatcaacaaaaaaattctctaattatttatataaaaactattatatcgctgtttctcaattttttatctcaaacaatgatatatggaagttttccaaaaaattgaaaaacctctcacaaatagctaaggtaatattagacaaccatacaacctacttgagtttgtgagatataaaattgagaaatataagataaaaagatataaacacgagcaatggtatttattaattttatatctcattaacgaacatgagtttgttcgtataactttgttcggttgtttattatttaaatatcacctatgtgtgtaattgttttgagttttcaccatatatttgccctagataaacaattagcaagttaattgttaattagcccatccattcgcaaaggctactgatgttgtcatttgtataacaaaatacatatctatttaagtttttccaattatatgcaactagttaatatttttacttcccatatttttttattaaaatggcagttgcattttctaattattaaatgattgtttttacatatggaaattatattcagttataaataaatctactttgtctaaattaataattctaaagttgtatttgttatagttataaaattctaaattaataattacatagtgtttttccttctaaattatatatagaatcaattccgagctagtcacataactgaaatattagg

SEQ ID NO: 27354 - DNA, 1501 bp, Oryza sativa
tggtctactgttaataaacctctgtcggcaccaaactgagcaaccacttctttttgccaaagttaaagtggagtttatctgtttttgccttgagcaagagagtacggctttacactttgcatatgcgcgataactgattgtaaagtctgtaacatcttggctataggttatgatgacgtgttatgatcatattgttctgttctaatactgaaatggtattggacgctagctaatgctatgatgccaactaacccttcttttgatgctgaactgtgcactacattgtgccggaaatcaagctgaaggtgtagtcactttgtattacatatgtcacagagcacctgtgtggcttgtgcccgtagtttggcatactttgatttattacgccttcctctcgcgatcgtgaacaaaattgatcagttatctggactgtttgcggtgtgcatttttcttaaatttgcttctgcgtaattttattatgcctgatcgtgaacaaaattgatcgattatctgaacggtttgggtgtgcatttccctaaaatttggtacttgagcttcttcattcaattatgcagttgacattcgacaatagaggactcggataagctaggactaaagttgatgtagaggcccaggcatctaacaaatgtatttgcctacagtacagttgtagattcattgtaacttgaaggctagtactaaattctttcgccatcaccaacttgtattcggcgctcgtagtgaaatgtcatttgtgttgcactgttttgatgtaaactagtacgaatagctgttagaatcatgaatgaataatcatgaattttgatgtaaactactactgggaatagctgttagaatcatgaaggaataatcatgaattttgatgtaaactactgagaagatatgatgctgaccaaatggaattatggaagggcaatgcacatcctgtcgtgttcttttgcctaatactgcacatctgcagcaatgctagattaaacacatagaattactgattattttgatgcttttttttatttcgatgaaaaatattgcacctacgtgtgcaaatatcagcattaaatgacaagttcgtcgcgaagtcacgaagagaattttcgaaacggaagctcctaattcactccaacttttttttctttggaaatgcacattaatgctatcataacatcgttacactggtgcagtatcatcccatccacgtcccacctgtgacaaaagaggaaaccactaaacttttacaaagcaaagttgacaattgagtatagccgaaaccacgagccaaactagcagtgtcatcttcacatttttaattgatgacactgttgacttttaaatatatttaatcgttcatcttatttaaaaaaaacatataactatcatttattttattatgagttgttttatcactaaaaatttcttactaatatttatgtcttacgtatttatatgaaatttttaaataagataaatgattaaacatata

SEQ ID NO: 27355 - DNA, 1501 bp, Oryza sativa
cgcctgcccttgttcacctgtcttatatgcaacgaactcgtcccagtgatcccttagctttgggaatgtgtcgaagttcggtgtctgccccttcaggatatatttctggtacagatctcccttgaagctccgaaactgttctgccattttcttcagagtccaccttttcactttgtcctctgtacccgcgggaagggtgaatgtctcgagcattgtggtccacagcatctctttctccgaatctgggacaaagctctcatgatctccgcgtgcccttgttctgcgccagtagaccgtactaacaggcacgttatcccgcgcaacccaaccgctgtgacgtacatagttcttggcggcttctgccggggcactaggtcggccgtcttcgtccacttccgttatgatgtgccgaccctcaagcttcttcgtggcacctcgttgcccgcgtcccctcttctgtccaacggagggttgacttccactagcctcctcctcctggttcccctccacatccctttccacgtgcccctcctggttcccctccgcatccctctcaacgctcccttcctcgttcaaatactggtttggatccttgttcccctcttcttcgttccagttctggctgcttccctccgcgattgtatcgtacaatatctgttcctcattgcgatcagccatctgttcatacaggaaacatctgctaagtcatgagacatttatgttttaacaatcttatatgctaacaatcatatgctaagtctaggtgacgtatattataggaccctagctagtcaataaattatatagtaagtctaattacaaatctaataatcttatattaaaactcaaataatcttatactaaaactcaaatagtgataaatgctaagtctaggtgacgtatattataggaccctagccagtcaataattatatactaagtctaattacaaatataataatcttatattaaaactcaaataatcttagactaaaactcaaatagtcatgtgtgctaagtgtaactgtcgtatattagaaccctacacaatcttatatgctaagtctaattacaaatctaataatcttatactaaaactcaaatagtgataaatgctaagtataggtgacgtatattataggaccctagctagtcaataattatatactaagtctaattacatgcatgataatcttatattaaaactcaaataatcttagactaaaactcaaatagtcatgtgtgctaagtgtaactgtcgtatattagaaccctacacaatcttatatgctaagtctaattacaaatctaataatcttatactaaaactcaaatagtgataaatgctaagtctaggtgacgtatattaaatccaatagtcttaattgcattacaaatataacaatcatatatataattacgtcacttgcctgcgcgaattccttcgagggctagctaccactccggcttgagggacgacttcgacaacgtcttttctgca

SEQ ID NO: 27356 - DNA, 1501 bp, Oryza sativa
agacgactacatccggacatcccaaatgtgtttgcgaggttgttaggatcggaatattaggttggatcattctatttcaaataatattgtaggcttgggatctatcagatttttataaggtacatattttttatataaattttgtaacatgttttaaaatttgaagtctctagtattaattttgataaatttaattggtactcaatgcatttcatattataagttactttgatatatttttttctattaaagcttctttaagtttgattaagtttataaaaaacagcaatgtctacaacaccaagtctcatcaaaaccaatatttaatatattttgataatacatttgttttgtgttcaaaatattgctatatttttctagaaacttggttaaacttaaagaagtttgaaaaaaatcaaaacgacatatgatatgaaacagagatagtatttttttaaatctcagtaggcttattcacgttattttcaacacacatgaaatttaaaagatgcttatgtagaatcgtagggtcgagatcttatgtaaggtcctaccaatctagtgagatcatattaaactcttatgctgttcgtgatgctatgaaaattaagataaatgatgggatttccatcgttttgggttggcatatctacgaataagatatgtatcagaataccaacgacctgtgcttacaacatgtaaagccgcggtggtctaggactcttgggacctatttgggggagtttccggtaggtgcagcttatcccagcatcagaagctccctcaaataatctagcttttcgtttaaattctgagaagctacagttgtaaaatctagaaaacaaactaggagctagaagttggaaaacccaccttctccatattcttggaagttagctaccaactaattgtttctcaaaattttaaactccccgaatacaaattggggcgtgtttgattacttgcattgcatgtgcctcccagtgccactttcctgcactgggctgtgtgggctaaactggccactgcctaaatgtgtgtaaatcacagatttaggccagcccaacaacatttcatcttagagcttatctggacctgtccagcccatacagcagggataccagttaggccgcttaggcccatgaaaagtgtatcaaaggctcgaagcacaagtgcctctatacctgagcaaccgcgccctacattcatctgacaatgacatatggaccccacagttctgggacccacatgtcagtgaaactgtcgtgatcctacatgtcagtcaaacgcgccggcgtctggtccctcttcctctcctacgccgccgccgcaccctctcgcaagaaagaaaagggaaaagaagacgagagaaaaaaccgagtgaaaaatcaaacccgcatatagagagagaggaacagcgaaagaccacgcgtgccatccctccacgcttgtagggtttccggatcggaggagagagccccccacgccgccgcagccatgg

SEQ ID NO: 27357 - DNA, 1501 bp, Oryza sativa
ctttctcagccgcatcatcaagatcctctgcagtgattaaggtcattccactttcctgcaacaggacatcacagtcaggtacgaaagtttccagtgaaggacgacttggcagatattcctacaaaaaaagaatgcatgcaagtaatttttacctttagaatcctcttcccttggtcaacattggtgccttccaaccgaacaacaacaggcaccttcaggtcaacctggcggtcaagagaatgattcaatacagtgcaggaaagttttatattgtacattaaccagcaagataatctaaattgtcccgcaaaaaacaaaaatataaaatcatcaatccaaggaaataactgtgtcattacattcccaagaaacagtaattgttaaaagaatatttctcaaacaaatacaagagaaaatgttgtggaacagacaagattccacaagaaattgtcatagggttaatctcaaatgttttatacttgatgcaataccagtagtactttcataaagaaaagaaattgttctgaaaaatttaatagaaaactatctcataagaaacttccacatttaatggaaaaggttaccatggaataagaaagattcaataggtatattgtaatttattaatttgaagcaagagggaaccacaataagctgctttagtcattaaatgaaaactacatacaaaatttgaagacaaacctgttttgctgcattcactattccacttgctatcacatcacatttcatgataccaccaaaaatgttcactagaatagccttcactctatcatcggaagtcaaaatcttaaatgcttccacaacctgaatacaagttatataaaaagtttataaatgaccaaactgggaagcataacatgcaaaaacaaaataacaatttagcatggattccaacaaacagattatcagttatatgaaaatcttttaggctgtgttcaggaggaggggttcggttgggaacccctcttccccggcacgcaaaacaaagctcatattattgcatgattaattaagtattaactattttttaaaaaaaatggattaatatgattttttttaaaacaactttcatatagaaagtttttgcataaatcacaccatttagcagtttgaaaagtgtgcgcgcggaaaacgagagaggtggattgggaaaatgggggggaagaacacagccttagtggcgcgattcacatgagatggtagttacaaaaagaattctcagcttattatacctgtccctctgatgcacttccaccaacatcaagaaaattggcaggcgtacccccatgcaacttaatgatgtccattgtagccattgccaatcctgcaccgttcaccatgcagccaatttctccatcaagcccaatgtagttcaagtcagctttggcagcagccacctgtaaaggtattagagataaactcataaatatcttcagtttccattctcagaacaacaaaagctgtaacatccctccagagg

SEQ ID NO: 27358 - DNA, 1175 bp, Oryza sativa
ggcgccaccgtcggcgccgcggtgatcaagcggcaccccttcttcagcggcgtcaactgggcgctcctccgttgcgccacgcctccgtacgttcccccgccgttcagagttgccaccgccaccgccgcgaacgccgccgccgcgaacgctgacatgtcatacgacgacgacagctgccccggcacacccgtggagtactactagacaagacaagacaggctatcccaatggaggaagctgccatggatgaacgtgcaaagctagggaggaagccgccattgccggcgcacgtggtgggggacgcgggacggcggcgaaccgaactggcatggcgcgcacgcgggcgccgcgctgtcgcgccaaatagttgccgggtgcgtgtccccccggacgggagtaaattattgctgcgcgtatctgactttgtctgaacgtggtcacttgcctggttggtgactgtctcaccaaaaaagaacttattaacgagtatctccatagtgctatactagtatatacaaatattttaggcccatttggacttttcgagcatgtaaccccgcaaaattcctatgaactttgaaacatgttgctcagtggtgagttgtatttatgaattctttttactagtaagatttgttcttccggtctaccgctgacaggccgtaaaactgcatataagcaataaaataataataatttgtggataaaacttaaaaatattcttcagtctacaacagataaactgtaaaatgacatatgaacaaacaaataaaaagttttaacctgtgttattcgtagtttaaaattgagttaacaccgaaaagtaagccacatggaaaataagaactcccaaacatcaactctaaatttgagttttggcaaccaatttataggaagagtaatgagatgatgctagttcagagatgctatctttgagatatgttaaaatgaagataaagacagcacattcaaaacgagaaattcattgacatatacttcctccatcctaaaatagaagtatttttagacttcaatatagtcttcgagatagtactttgaccaacaatacctgtaaaaataagatgttttaaattaaaagagttgcatattatcatagtttgtttaatgataaatcatgtaacatcaattttaaatgattgatctttttatttttt

SEQ ID NO: 27359 - DNA, 910 bp, Oryza sativa
gcttgcgatctccgatcctcaacgtctcgttgccgaagatgacgggcggcaacactggaagggctataccggagctgggatgtgtcgccaccgctgcacagaggggcatcatcttcgttatcgttgttgtttccgctccgacgggcgatggcggaagggggacgataggggaggcggggagaggagacgccggctcgtcagtggaaggggctggggcggcgtcggagtgtacagagagacggggaagagaaacggtgtgggccccgcggttggccagccgattttgactggccaagtttggccagcaaggaactcagtttggccagtcatatagcttgaaaagtgagatagctaatttgttggagtctttttttaatttaaaattgctaaattttagtttgaagagtgagatagccatgctgttggagatgctctaacgatggagtattatctcttgcgaccaaaattgctacaggaccgtggctctaataccaaaataatctcgacagttaagtaatgtcttgttttatagctctgatcgagtagcattttttcttgcaaaaacggtaatgagaattcatccttttcagttaatttttaggacgaagtgataatgaactactcctatatggccaaaactagcttgcaccttgcggttttctgcaggtctctcactctatgaaacattgcatgggtgtgagaaacgttgcacacagatcaacatttgtgtaagatccgagggtttaagagctgttcagattatagccaaaataaaccttattaagttttggcaatactaaatttttagcaagatagcaatattgctaaaattttagcaggatttcttatgtatttaccaaatttaacaacaaagtaaacaatattttttttaactttactaaaaatagca

SEQ ID NO: 27360 - DNA, 534 bp, Oryza sativa
atgaaaaaagtacggccgcaagctctttatgggcggccaaaattgcaattagccccttgccgccctctgtacgggcggcaagggcctaatcgcaattttggccgacggcggcagacggcgcggtcgacccaccgtctgccacctcagcttgccgcccaccattagagcggcaggggctatttctgcaatttttttggtcgatagattatttctgtaaatattaaaaaaaatctaaaaacgaaaaccccgaaacagaatccttctacacatacgccgtatttggtagtggtacggttcatgagctgcacgtacggccgtacgccaattccggtacgcatccccctccgacacgaactctcgtagtcacgcacgtattcacgtcgtatatctctctataagtttaatcagcagtagcagattacacgcgatacgggagcaaatcaaatcaaaacaaacagatccatgatccagttgttagatataaataaatatatagtccaaaattaaactgatcggattttaaatttttgacta

SEQ ID NO: 27361 - DNA, 1501 bp, Oryza sativa
aaacacgcactattggaaactgaacattggatatagtacttcgaccctacattacaacatgaccagtatagaaccagaatttgtattaaaatagggagtactttattaaacatgcttcaatttccctttgttcttaacccgtatcctggtttttcaggttcaagtgataatgagataactgtagaggaagcttcttttgtgcatactgaacctccgcaagatggctctgtcccacctgtggtttcctctaatatggaggtccttcatgacaaagttaaaaaacaagtcatcaaagaaggccatggcaagaaaccatcaaagttcgcgacgtgcttttgtatgtcataaatggtttgatcattccctatatttatcctggtgatttatagaatgaggctaatatattccaccttcattagcatttgtcttatcatcacatttcatctcgttgttgtttctatggaagttccataataagagaacttattctctgtgtatcaggggctcagaacatacatttgtaaagttacatgtactaggggctcagtatttatgctctgttgtactatctcctagctctctgtttcttttttgtacacttctttttaactaaattgccagtactggaactttctgtggaaagagcttcttattcagataccagaaatcatgaaatacttaacagtattttaggatgaacaattcgatgtacgcacagccttctctaacaccacaggcttactaataactagtgtggcacatagcagcaccaaactcataacaacttagagcaaatgatatttaaaactagtcatgcacttgtgctttgctatgaatcatcagctttgagcacttcttaccaagtggcacgtccatcatttgtataagcatgtcaacgtctgtctattacagatcaatcttccattctcagaccatgtatatacttattcagaaggagagcatctgcataatgtttgtttctgttttttctgttacagtgcactatagagcttgggttcaaggctctctgcataaattcgaggatacttggcaagaacagcatcccattgaactagtaattggaaaaggtgaaaataatgatacttcattttatccctagttcttctacactgcatgcatgccttctatagatgatacacatcaaatagcttactcttatgccattctgatcttatagtgccacaaataatctatgattctaataagggttttgaaaatcagttgatcgatcagcaactttcaacttgctattgatattctagttttttttttgggtgtgtgtgtgtgtgtgtgagggcgattgacaacttgcaaggacataaagactaaatagttatatttttattactaatatatttccccccctgttttctgatggttcactaaatatacaatacaggtacagggtaactatataactttcctacaaatatcttttggacactcttgagcatgtagagtatacctgggatttatcagt

SEQ ID NO: 27362 - DNA, 1501 bp, Oryza sativa
tcgaaggcaagcccgtcgaggatgatcggcccgtgcaggctggcgcagcacgggtggaggtcgaggttggcgccgaagcagtggtagatgaacccgcgcacgggatcgccgcaggcgtcacagaccctgcggcccgagggaggcagaggcttgggacaaaacctgaatatgcggcctttgtacatagggtgctgtagaatggccggcagaggttggagcagaacgtgtgcatgtcaaagttgcaggcgtcgcagcggtatctgggagcgtatcctggctccaagcagccgtcacagcggaacggcatgtcacaagtcgtggtcaccaggcgaagcttgtgctgcgggtggtcgtggtgggtgatcatctctggctctgccacaggttcctcctccggtgctataaaacatgtgtgatgcagttagcactatatgccagtgtatatattcgtaaccaaagcatatatatctcgtagttaattaatccagttaagtatttatcttacgttaatcctagcttgtttatctatttggattatgcggagcaagttgtttgcgtttaaatctaactctatcctaatttcatcactaatatattaatgccattacctcgtgagagataataattgatatttcacccatccgttttcatagccaaaacccattgtcaaagttggataccttctcttctctcccaaaagggatgaaaacttttaaagctaactctaccgtaatgtgatcctcatatattaatgccattacctcatgagacaccctttgagatataacatttcaacaatcagcttgcctatccaaaactctttgttaaagttgcgtaccttctcttttctccaaacaggggtgacttcagttctaccccctccatcaaaaagtcaagacatatttcactttctggttttctaaatgagatggacatatttgtagttttgatgcgctaaattaaattgttgactagaacccaagcagtcatcttaatactcattggttgcatgcatacatatagttccttggttttatcacatggtagatgagttattccccccttggtcttggtgaaaaaaaactgccttagacttttggatggaaggagtactacatatctgcctagcttatttcacatggccactcatcagcaggcttctcatataacttttggctttccaaaaggtcaattaatttatcgatttcaaaaagatgtgctgcacatgatttcaattggaaagcttacaattatctgtacacacgtaattcccaaaatttaggcgtgtatgactagcattaccttttaccccaaacaaagtttgcccaaagtaagggttggaatagataaaaatgacaatgaggtgtattaccttgacctggtgagaacaaaggctccgtcaccgtttgagacctattaagagcaacaattcaacttagatgtacaaataagacagattagtgcaccagttctcaagctgtgtatccgcatatggccaaca

SEQ ID NO: 27363 - DNA, 1501 bp, Oryza sativa
accttgccgccgccaagggcccgacctcgacgtgctcctccagtaaccgccaccgggcgtgctcgttctcgtcgcactttcccagccacagcccgaccccgacgtcgcaggactcgatctcaccgccctccccacgccgccgccgccggggggtccaagctcgcgacgctacccagccgctgccgtccgtcccgccgagacgaagcccgcagccccgcaccaccggccgctgctgcctccgcgtgttgtgaagtgacagggagagagcaacatgattcgcggccgcgggcggggagatgtcggcggggaacacgccggttggggccccccactccccccatgcggccggctcggcttcttcgccaccggacttttccgggcggcggatggctcctcggatgacttcacttggcggaaggcctcgtcgcctcctccccctttggcgttagggatgcctaccgaggcctcctcctcctcaggctctttcccctcttctctcccttcctcctctctctaccaccgaacctagctgctccggccgccggcgacgatgactgcggcggtgtcgtaccagtcggcggggaggggaggggagggacgccttcgcggcgtcgggtccgccaccacgcggcgcgggtgggccgcggcggattgctccggcccatcgaagcacgccggtcgacgggtgcataccgctgtcggcccgtgcgggaggcggcggcgtggaggcttatgggaggcggagcgactgcgaggccggaggggagcatggtgcacggtggattggtggtgtgtgacgccccgcaataattacggaaaaaaacgaaatttcttccaatcggtcgcttgggggaaggtagccgaaatcaggcgctccctcgccccaagatgcacgcccctctaggcctcactcacgtgtcccctgctcccaatcatttgtccacacacaactccatgcaacaaatcacccatatattttagaaactatctgttaagaaaattcgttttatttttttttcgaaaaaaaaaagtttcacctagtttactcacaatgtttcactatgtatagatctaatgttgcaatgaactgaaacattattttgtaacagatcaccaacatattttcaaaaccctctattatgagaattcgtttcacttttttgttccaccaaaaataatccagtgtacttataatgttttactatgtatagatctaacattgcagtgaactgaaatattctttcgctatttgctgaaacattgtttttatataaggtgaaacaacgcccgatttaaacgattgaacattttcgatctacttagtgaaataattccgatatacttggtgtaacatcgtgcaacatttaaaatataattcaataataagctaaaaaatttcgtcggaatatatccatgtgtggtcttgttttgaagatttaattgcaacaaatttaatagtataatcagatcataatttcgataaataatttaagataaaaaa

SEQ ID NO: 27364 - DNA, 1501 bp, Oryza sativa
ctagcttgttagtctcaacattgatttttcatacacgtacaggtgctaattaggaagcatatataaggactatagcagtgtttagatcccttcaaacttctaaaaattctgtcacatcaaatatttagacacatgcataaagcattaaatgtagataaaaaaaatcaattgcacagtttgcatgtaaattgcgagacaaatcttttgaccctaattacgccatgatttgataatgtgatgctacagtaaacatttactaatgatggattaattaggcttaacaattaaatttgtttcacagtttaccgacagaatctgtaatttgttttgttattagtatacgtttaatgcacgggactctaattatgggtgttcctctgtaatcaacatagctagcaccccttgctgctatgagtccatggtctcgccgccattctctttctgcgtgcctatgttacattattgacatgattgttacattggtggtcactgcaggagaaacaatctttaatactagttaaaaccccctttcgtaccggctgtagcaaccgagaccagtaaatcgagactatctttagtaccggtagaaagaacgagtacaaaagatgcatactaagtcaaaaaaaaaaagtgtgggatgtgagattcgaactcaagatctatcaactcagtcctcacacacgttaccattccacctactactatacacatctgacttgaatgtagatgctttctttttgaactgatcccagagacatcgttagtaccggttggtattaccaaccgaccggtactaaaaatatctttagtatgagttggtattaccaactggtgctaaaattgcatcgttattaccggttggtaacaccaaccgagactaatgctactatagcattagtctcggttggtgttaccaatcagtactaaagatatatttttattatagggtggtaacaccaaccggaattaaacatagttttaggaacttcaacttttagaaccggtactaaagcatatttagtaccggttcttgatctagtcaggatatttgtgttttggggtttaggataaaaaatcgtttctctagtagtgggtgcccccatttttatttaaagggttaccgggttatggagtctgatgctaaccccaccctctagctaccatatattacaactttaagtttaactacaacctattaggacaagtatattcggcacctattttaacatgctccacctcactgaatgtaacgccacccacaagtagtagaattatcatgtggattcaccaatccactagacttggggttttcttcttgcagattcctcgtgagatggttgatgagcctatgccagaatcaccgctaccaaaagcaatagctatcccaattactgtttccttctggtctacacctgtaatagtacaccctcacaacttgtaaaggtacgacaacaccttctcttcaattatcacaatcctactatccccgtgaaagggtcaa

SEQ ID NO: 27365 - DNA, 1501 bp, Oryza sativa
aaaccccctttcgtaccggctgtagcaaccgagaccagtaaatcgagactatctttagtaccggtagaaagaacgagtacaaaagatgcatactaagtcaaaaaaaaaaagtgtgggatgtgagattcgaactcaagatctatcaactcagtcctcacacacgttaccattccacctactactatacacatctgacttgaatgtagatgctttctttttgaactgatcccagagacatcgttagtaccggttggtattaccaaccgaccggtactaaaaatatctttagtatgagttggtattaccaactggtgctaaaattgcatcgttattaccggttggtaacaccaaccgagactaatgctactatagcattagtctcggttggtgttaccaatcagtactaaagatatatttttattatagggtggtaacaccaaccggaattaaacatagttttaggaacttcaacttttagaaccggtactaaagcatatttagtaccggttcttgatctagtcaggatatttgtgttttggggtttaggataaaaaatcgtttctctagtagtgggtgcccccatttttatttaaagggttaccgggttatggagtctgatgctaaccccaccctctagctaccatatattacaactttaagtttaactacaacctattaggacaagtatattcggcacctattttaacatgctccacctcactgaatgtaacgccacccacaagtagtagaattatcatgtggattcaccaatccactagacttggggttttcttcttgcagattcctcgtgagatggttgatgagcctatgccagaatcaccgctaccaaaagcaatagctatcccaattactgtttccttctggtctacacctgtaatagtacaccctcacaacttgtaaaggtacgacaacaccttctcttcaattatcacaatcctactatccccgtgaaagggtcaataacctagtggttacaagagtctcagtagcacataaggttctgggtttgactctccatgggagcaaattttccatgatttaacggcttgtgctttcagtggtaggcgacgtacccgtcgacagcgaggcgcctgtggtgacttcgtcaatctcaaggatttgcctgcgcagtcttcgaagatgctcataggggtagagtttacgtgcctccattgtgagtgtctgcgttgtactgtgtaatttttttaaaaaaatcctactgtccctcatggtctccgtggatccgaaaggtacggcatctaaaaatatctcagctataatcatacataagagattcggtttgacatggtattaaatacaagagattctgcgtgacatgggttagatatgtgtgattctgtgggacatggattatgtatcagagattcggtttgccaagcaaccaactatgtactgacccggtctaaggttctccactatttatacccttctggtcgatcgtctttctagcaccattcat

SEQ ID NO: 27366 - DNA, 1501 bp, Oryza sativa
atccgtcgaaaacgaatttggaaacatatatcccaaactatccgtttaggatatatgtttcctgaaactatccgtcaaaaacgaatttggaaaatttcaggaaatgaattcagatatttttctcggaaaacagaaacggatatgataatgctactatccgtcgaaaacgaatttggaaaatttcaggaaacggattcatatttttttctcggaatcggaaacgaagtgtttcacatgtgcaatttattagctccagacttttctactctaaatatttatatttatactatgtgccatagtaataacaattgcagttatagatgaatatagttctctttctccaagaaaataaagtgtacgactacttgtattattaatgataaaaactaaaaatattgatttattgtttcagaaaagatatcgagctacatctcttcattgattttagaagttcggcttaaggggtttttatattccgataaataagtgttaccgtattcgataatattcgattttgtttatgtatccgtgtttctgattccattccaattttgaaaagaatatggaaacggaaacgataagtggttttcgtccgtttccaaagtgttttcatccatacttactctacctttatctcaatttttttactactttaaaactaactatttctttatgatgactgatggtccacatgccactttatccatgagccaccatcgttcctcctctccgcctttatatgcacaaccagatgtcttttttccttgtcttttttccttccccgtcatcatacacgctattgtgtcatcggacttgggaggcagaagccgatccgatgaagagctagatcaggcggctccttcttattggatccgatgagagttagtgtgcgaaatggttgtatagtgactgaacttagagatggatagaattgggtttctagtcagcaacacgggttaggtgttgttgaaggcggctcaaagatgatctagatagaattcgcatggatgaggtgagatttttttgttttgtagacagtctctttttaaaatgtctcaaacataaattacttggtttcgtagacagtctctttttaaaatgtctcaaaacataattacatgcagtccatccatttataaaccaaattatacaactatgacatacaatcaaattcagacccaaatgaacaaaacattaaattttatcctaccagtccagactgggtatattgctgttttaattttccaactactgaaaatgagagaaaaaattgctaactcagaaaatggaaggattttccatctaactcaggaaatggaacgattttccattcttcaatgtagaagcacgcctaccatttgaaaaattgaaacagatagcgtctgccattcggcacgactgagcaagtgaatattccagtctcagtaggtggtgtaacattcaataacccggtgcagcgactcaagactgcaatatgctgcacgagcaaaacacggcaatc

SEQ ID NO: 27367 - DNA, 1501 bp, Oryza sativa
ttgcttctttgcctcttgcgagattcgacgcctgttcaactttgtgttcaactttgtgttcttgatatctccgacgattaatatccctggccggctcccaggaaaagcaggcagtgtccctgtcctttttcattggcttcctaacatgatatcctcaaaaaagcaatgtgcttatttcctcatgccacctattcccaaatgaagggtactcctgttaagcagtaggtactgtttcatttatcagatagacattcagtaagagacgagatagaccatgtattgaccaaaaaaaaaaaacagaggctatctggaaacacagaaatggaagagaggaaggagacataggaagcatcaatatatgggatattgtcggtggtaataagtgatgttaaagatattgatataaataattctcagtctctgcaccgagtattccagagtaagaattcacaaggccatctttaattttaggtgtcatttgaatttatctcgactaaaatgagtcccacaactttggctgtgtacatccgtttggatgtagaggccggtttaatccattatgtaaaaaaaacgagtcccacaactataactccataacttcatcaagacgatgatatttgttttacacgtcccaactcttagggattattttctttcaggtattactaattattggtcttctaaattcttttcactcccctgaacttacaaatgcatggcccacctaacttgtaataaaatgcaatataaagttacagtacacttcatgggagctttcttggaactattttaattaatttgtacgattctcacatgcacaaactaccaaaacccctgctcccatcttatttgtccgatttattcatggagctaaattaaatcacagcgtccagttacctaccgtacatctagtactaaaatccaacatcatcaatctgcaaacttcttgcgagcatcagcaagactgaaagtgatactgccggctgcagtctctgtttgaggagttgggcacagcaacctccatgaacgtgcagctggtctgttccccgatggccatacgccggagagagagagaaggagaagacggggagaggtggggcggccacgggagagcgcgggagggggctaaaactggagaacggaaggagggggttccattttataggcgcggggagggagccggcaacgagagaggccggaacagaggcgggaatggcggccggggttggcgcgtccgttcccggcgattgggggcacgattcaagggggaaaacgggggaaatcaaagaggaatcaatggagattaattccccctatttaatttggaaagagccggcttgaatggggtggatttggaggaggaacaacgctaaggttcacgggagagagaggaaggaggccggcagctggaggtcggggacggcctgacaggcgggacccacgcgggaggcgcgcggtcaacgtgcggcaacggcgcgcacgcgcgcgcacgtgcgcggca

SEQ ID NO: 27368 - DNA, 1501 bp, Oryza sativa
ttttatgtatacatatagttttatacatttcacaaaagtttttcaataagacgaatggtcaaacatgtttaaaaaagtcaacggcgtcaaacatttagggaaggagggagtaattaacaaattcatactattcaagaagttgtcaagtgactaattgcaaaaataaaaaagtgtccatgcaaaattctcagctggcgttggctcttggtggcacccctcgcccagaactactaacagcagcgcccaacattcctacaggtgggtgcagccgcaacgatcgcgcagaagccgaacagaaaagaggagacgtgtgatcgcgcagtgaagccgaaacaaaagagagaaggacacgagcgagattgccggctagatcttccaattaacgctatgttgtttcacgtcaaaattaaaaattaaaagtttaaagaaattagaacgatgtgacgaaaaaattagaagtttatgtgtaggaaagttcgatgtgataaaaaagttaaaagtttgaagaaaaaagttaaaatcgaaacaggacctaattaacctattagggccccattgaatccaagtcaaaggggcccttaatgtctcatgtccgagtagaaggacgcgagagtagatacagtgtcagtcggagctggtcctgaaattttggtagcccaggacgaggcaaaaataaagagccttgtaacattagtacatatgtatgtatgacaaataatttatatttcaaatagaaagtaatgtttaacttttagacatcattaagcacaaactattgttaggtgatagttgaatagcatacctaaatactataaaaagacatcaaattaaaattattcaagtttatattatgtctccataaaaaaatactatctgttagtgcagagctacaagagaaatgaatcaaccaatcgagagaagtaataaacccgggcccaaacctgttcattcaagctcctatctctagctataaaacaataggaaatcagcaaaattctatctgatttttatgttcaagatgttattaatcatagaccataggctaaagatatgataagattagttcatggttgccaagagagaccaattgcttaggaatgccaactagtactgatagatgtttgtatcgagaggagagagtagatgccttcgagaggaacgagatggtttcaacggcgggcgattcctgagtaggggcgcaagtaccgatgagcttccgggtttttgataacgttaacgtgcttgtgctagcacataatcagtgatttactactttacgtgtaatggccgtgcaagctaggcagacatattgtgcaaggctggtgtttgcttgaggtaacgggaacaaagggcggttgcactgctcgccctgccccaggatcggccctaggttcagatgacttatagtcatggtcggtcctgacatttgagaggtcctagatgaacttgacacaataggtctttaagaagttgaggctaaatatttttatttttaatatat

SEQ ID NO: 27369 - DNA, 216 bp, Oryza sativa
gttccaagttggatcagcaatatgtgtaatggtcttagagccagaattagtactactgtttaatggaacctatttcatatttaaattgagcatggttgtgctttagagattttgtatgactgatggctgttaaatagtttccaacatatgatcactggtgatttgtgtggactctactcgttaccagttgagattgccgtgttttgctcgtgcagc

SEQ ID NO: 27370 - DNA, 1501 bp, Oryza sativa
gggcgtgaccgatgtatatttagctaactatgacccatggagcaaacaaaaaaaagagaggaaggattgtcgaatcgaagcagtatgttccttcacgtacgaatagccagatttgttccaaggcatgcaacggcatcattgtccgcacaattgcccttgcactcaggcaagctagcgaaattctgcgggcattcgtgtcatccgcacatgcccaagtttgggattatgctttcgactgatcatggtcaaggatcattccgtagatcgctttctccacacaccagcttcaggcacaaaatgctagtggctgcacactgggccaaatttggtgctagaccatgcgaaatgtcagtgtcaaagacatgccctagcccctttccatcccttgacctcaattgcaactcaatcattccatggctgcattctgatgagctcattgtctcgagccactgatcgggttcacagatagtgggtcagttgttccgtggattggtgaattgatgtgcatgatagtgtgtatatctgctgtgctacttttccgacgccacccattcttaaaataaaaatcttctaacatgctctgtgtagcgtacatgcagacatgctacataactgtaagaatcgtagagatagttgtattgttttatatggtagagagatataggaatcaacccctgcttattgatcaacataaatatatataagatgagaagagaggtgaagtatatgaaaacaaggtttggtggttgtagtaaagtatatacagaggtataaaatggacacagataactagaccagacaaagtagatcctagaaagaaaacaaaattaactagaagatgaaatttgtcaagtaaaatgcaaccgctcctacgtcttgcgtactaacaccgatatggaataatagcttttatggtggtatttagtaatagtaaatgtagagttcctattttttaattaaccatatctatttacactaccaaatcaattacttataatagaacgaagggagtacagttgtctaataaggtagaaagtgttagatcaaggtgttttgattcttattctgtgatgaacaattagcatcggtgattattagttttgatatttggaattaatcttcgaagtggttttggagatgtttggatttacaagtgttgctggatatgtggtccggtcagaccggcggtatccgtgcagtcagaccggccgacgctgtgtcggtttcggtttcggtttcgggttgtttctttggatatccgagtttgtttcatatttatgacttctagatggatactatacgtatgtgatactgttgtttgctaacaatgagtcaagttggtgatagcttggtctcggaatatgatttcttttttggttcatgtgtaggtgactcgacgcctcgggatagtattttgcggtgatggaccgggagtcggcttggtggtaagacgatgtccgtggtggttagagatcatgcgggatactcaggctagagttga

SEQ ID NO: 27371 - DNA, 1501 bp, Oryza sativa
taaaaatcgaaattctagttaatttagaacatattaggctttgttcgttgctaccaagtttctgtacgaaagttgcttaaaaaaatcatattgatccaactttgaaaaaaataagctaatacttacttaatcacgcactaatagaccgctccgttttccgtgcgcggaagatttgttcccgaccactcaaaccgaactcagccttagagcatgtacaatagagccctaacgctggcgataatggttccacgttagctcgcgtgatgcgctggaggaaagaaggaaggtgagtgggcgactatttagtcgccgagctgctcacgaactctaagaagttgggcccacagatacaacacgaggggaagctggtccacgcaacgcgaggaagagagataaataaataaacatagatggttccgttaattaaaataaatatataatgtgtcagcaacttattattagagcacaactattgtatcatgtgtctcttaaattatactatatgatgatgatgtggaagaattggagctaagagcgggctgtactattaaacttgctcttaggaggatagacaaatgaccagaataatcttatttaatgaacccatatatgtatatatttcatagtataaaattgattagaatgaattttgagacaattaacccacataattagaaatacttttttttagtaaatttcacaaaactacacgttttgtagtccaagttgcagaaaaccacacacacttttgacacttggcacttaagtatatatatttttgtagtgtcgtttcacaaaaccacactatcaatgaatggattcacccgtgagatgatgtgactgtttcatctaggacgaggacatatcatcctattaccagccatcgcacgaaattaatagggtgccacatcctcatcctagatggaacgaccacgtcatctcaaaaggtgaatccatacatcgacagtgtagttttgtgaaactaaactactaaaatatatatatacttaagtgccaagtgtcaatatttgtggttttctgtaacttgaaccataaaacatgtagttttgtgaaatttacttttttttttttttttgataaaacctcatagctagaaatctcctgtaacacgggtatcttcccttcgctccgttggcgtaaaataaagaggaatctcgcgtctcgtcgtctcctccgctccttgcgccaagacgagtagcggctgaacacaacaggcgaggggcggcggtctccatctggcgagcagagcaggggatgggaggggatcctggtgagcatccacatcctctttctgattcatctctcaatcccaccgggactacttttgtctggaattcgcttgcgtttgttaaccctagcttctcttctagatctggaagaagcccttctcttaatttcagagccttaaccttaatacaagtagcagtttgtttgttccccccaaaagtttcccaagttggatccgcccctggttgttaac

SEQ ID NO: 27372 - DNA, 1501 bp, Oryza sativa
gaggaattccagctgaacataaccaagacataataagtgaacaattttatttaaatagataaacagtttcccgtattacacttacttcccccctgcagaagcatgtatagttttgactcataatgaagctgaggatgccttgattttacagattcctaacaaaataagagatgacagaaaaggtttaggtaatttgtcccagtgtcagcaaggacaagtaatcagtgctgacagtgactattcatgtcaatatagaaatacactttccaagtttccgaacaccttattttcattattaccaacattttctcatagaacaaggattgcaccatttaagaaagcaatccaatgcatacaggcttacaatatagaaatggcattcatgattagaaaggcaaagctggttcacaaaactagcaactacgtgaacttacaaggtaagttgcttgaaaagtagatgtgaccaaactactaacaatcatatcgaaataatagaagcttctaaaagaagtgcattgaccactgaaccggagcaataatatcaggagaatccttgaatgctgctttgaaacattgaaatagacaataaccaatgcttcacagctacccaacctagccaaaacatgcacaaggtattccaaaaggcttcgtttccccagacggaaaagctttgtttgcaggtcttacaggatgtgaacagaatcacgggcggctgccctgagtcctaatgttacaagagcagataatatagtatgacaagggttggtgggctgcctcatgttatttacagatgtttcagaataagtgctctcgtaaaccacacacatcacctagatgaagcaattaaataatgtcaacgatccaattggaagctgaaaaatcttcacctcttttttcttacttcccaattctgaacatctctaatagaccagttaggtcggagaaccaaaaaaatttagaagacctggtttctacttgtatgaaagagtatgatactaagcaagaggtcatgtcaacgatttcacaaggacgtatacatgtagcttcattcaaatttctgatcatgcagcaatgcaaactctgttacacctcaggtgatctaatcttttctaggagggcagaacaaaccatattcgcatcacaacatcagcacaaaagaaaccaatgcaatactaattactacaatatatacattggcgtaagaaaaggcttatatatcagaaacgaaatcatcttcacataccaacttgatggctacctcctcgctgctctgtatattcacacctgtaatcgaaacaatccatgaatcaacgacatcatcacaaacagcgtaaacagtaagaagaagaaaaacgaacggtgcctcgcaacgagcggcgatagacgagagatccgagaaccccacgaggaacgtaccaaggtatagctccccaaaagatccgctcccaatcttcctccccagcttaaacttccccccgatcacatgctccatccccgcaag

SEQ ID NO: 27373 - DNA, 1501 bp, Oryza sativa
agggagtacaccacagcaaatgcagaatattcttccatttaaggctgtgcggaaacagaagagacttgctactctcaaaggattcatttttggcgttccattatattctactacgttaacaattcttacatttctcactagaaacaaattacaatagcagcaagagtttatcacaccagctagtactagtataatttctatagatccaaattataaagcgggtacaaatggaaacagttcaaggcgtacgagagaagacgatgcttacccggttctggtcgacgacatcaacgatgacgacgaggcggccgtagtccttgccgtagttcaccagggccacccgcccgatctccacgaacctcttgaacggctgcacgaaaggcacaaaaaaaccccggtcaaacacacgcgcgcaatccaaagcaccaccaccaccaccaccaccggaacggcaacggcggcaagacgacgagcccacggcgatccacctaccattctcgcggcggcggtcgggagaagcggcggggggggggggcgcggagaagcggaaaggcaaagaggaactagggttcggcggcggcggtggtgggagtggcctataaaggcagcgcgcgggtttccctgagccggtggatcgccacccgaggccatccagccgtccgatctagggtcagaccgtcagagcgtttattctgcgggggaccttactgggcctccctgtttgggccctttcaacgcgtaatgggccggcccatttccgagctactcagatcaggacttgtgttacggcctcgccacaaggatcggtgcacagtaagattccgcggtaataataataaatctgtacggagtcgctggcctcgcctcgcctcggcatcttctactgctcgccatcgcactccacctcgggtgaaagccggcgccttttggatcacccctctcctccgatcgaccgggtctctgctgaggtctccacgccgccgacaggtagcgcgaggtaagggggaaaaatattggcttcttggtcaccggtttggatgtggccagtgtgtggatttcgtgatcagtgggtgtttcttgggtcctgggatctaagctcggaagattagtagaaagtgctttccacttcttggattagcggttcgggggtggcctggtggctctgatctgatccagggtcgagttgtttctgctgagtggtagaaagtctagaagaaatcttgttgctcggttagtttgtttggtgtgatgcgtagtggatagcacgggctaattgcttgttgttgatgtccctgatctgtgttttggtacaggtacttagcagttagcacaactgatcctgcaactgaaagcagttgctgattggggaattcattgccacgggtcatagtgattagaaactgttgtgggatcagtgtctctttagtgaattagtgtggatttttgtttgctacggccgatatgttgacgcattcattgttttctattgcagctagagaga

SEQ ID NO: 27374 - DNA, 1501 bp, Oryza sativa
cagatgaacaattctcagggcatataagtacgtaacatgttaacttcctctagcacgggaatgcttttcaacagttgacctttttgcataaagcaacacatacattgtgtatagctgcccatgggcttgcccaatcgttctgagctcacgacattcattattgccctatagttttccaaagataggtggaaaacagcataccctcggcagcactaaatttcattagacaggtaagacaggtttattctgtgggtaattgttgcataggaatgcattaagaagccttcagatcatcaagtccaacactggcctgcaagaatagtatgatggaagacatcacattagaatcagacaattacagactaaaggactaagccttcaaaatgtgagaggccataccagaaaatcatgattctctttgagaaaagggtaaaaggtcgtgcagaatttctcgatatcagcttttatgtcacccgttccactaatgacctccataaatttctctctattaggagcaagcttcattgccacctgccaatttctcatatgagcactcatacaaacggaggaaaagcaaataaaggaagcaaacatgaccaaattaaagaacttctcacagaaaggcaaagcccttctctcacccaattatgaactgaagtgctcttgtacgtattcactaaaagagcatatatgactgaaaacagttgggttataatgattctccactgtattcgagaaagaaaaataatgattttccactagttctaaagattgctaaaacagaaaaattgtctttttagtgaagttcttgagaaggaaccacccttgcattagtttatttaggcgtaaacattctaatttcactaaaataataatgttgaagagattatagtaacaccatgtatatgctgattatgcgggtcaacatagagagaacgactcaactgtaaaactagaactggcaagccaaccatgccatttcttcagagttttggtatatgaatcagtacaagcttgactcatagtccagtcttgatgctcaagcaggttacggaataattcaacaaggaagtccatagccctgaaagtaaaattttgagttaataaggctgcttaagctgcaactgaaaggtgataaattatccaagaaggtttgaagcacctcgtgagccacagaagtccatttgtgcagcttgacgaaccttttgcagtcttgttttgaacctcttcctgaaccatgctgtacaattgctcatattttgatgggtctgaagaatatttattttccagcctctgaagaatgaattagatcagttgttagcaaaacaaactagaaatctgtgggctccaaaagggatatggacacttctaagtaagcaaatcattctaaagtaaatatgatttatgcatctatcacatagataacactagaaatttactaatgaaaatgaggaatgaaacacaatgtattattaacagtgtcatgcagaaaaaggatgct

SEQ ID NO: 27375 - DNA, 212 bp, Oryza sativa
aagtaatattgaaggtctactcgcatgtgcgtaatatgtggtggacaccaaaatttaatccttgtgggtgaagtcatgcactcacaagtcacaactccaccactacaccacctctgcttccccaaaattttggttgtggtagtttttggctaaatatacattagaaaaaaattacacatgcccaccacacgagctgcccacccggcatggaa

SEQ ID NO: 27376 - DNA, 1501 bp, Oryza sativa
aataagaaaaaagaaaaggtaaaatttgttcgtgtggcatgccacatcagtgccacgtaggatcctataggagctgtggcgatttgggacctagatgacacactatgacaagttccggaaattcgatatgcattttgagagtttagtgacctagatgacacatccctataagtttaaggaccgcctatacactttactctaaaaacaagtggtccaagtaatataggtaagtaatataaataatataaaatgcattattcaaagcgtagagtaaatattcacttcatcttaatttgatcatcccataaacgaagaccacgaaaaccaagaacaccaaaacatctaccattctaaaattaggtactccattgtttcgtgtccaacaaaaaaaattaattcactttaaatgttgcgcacatagtatttcaggatgtacatttactctttgcataaataaacaaaagaaacactttgttaattagatgatgattattttggaaaaacctaaaaaatcttaggtgataatccaataaataatctgaaaagaacaactaagtgcacaaagttcgacttaataacttaaaccgatgagcaaagatattccacatgaaggttggtgaagaatccggttaattaatcatcaccagagctcctcgacgacgacggctgtgtcggcgagcttgcgccgggtccggtagctccggtacatcttctgcagcttggtcgccgccccatcctcgccgccgccaccgccgccgcttccggccaccggagaggaaacctccgcgtcgagcctggaagagcccgcgtgatccagcccggccgccgccgtcgccaccgccattctcgtggtctaagaggaagacgcaatagtgcagcaaaatctaccactcccttcaccaaatggagacgacgatcgagagagaaacagaggcaatggcggtgctagctagccttgtcgagaggagagggaacgcgaggaatttaagcagagagtttgtgtcgctgtatgtgacacgtgaaatggagaagaagaataactaaaatttgaggagaataattaaaagatgttttattctgttatatatatattctgttcgcgccaaaaaaaattccaagtagcctagcctacacgaagtcgaaaagtatcgtgctggaagcctggaatgtgtgtaacggtattacagtgatgactcaacgactggctgcatgctcttactgttcaggcccacaatcccacatggttactgcacaaacagtgaaacaatcgaacaaaatttaccaaaaatttaaaattttaaaaacttggttatgttactaatctcttatcgttacttcaccccaatggtaaacccgtcgacacttaaccgtgcggtaagggaaacttgtatgtgtgtgtatatatatttctgtaaaagagggtaaaaattttggctcgtagtattgatagagcagagtgaggaaaatccgttttcacttgcacataaatacacgatgagcc

SEQ ID NO: 27377 - DNA, 1501 bp, Oryza sativa
gaaagtgcaaagtaggaacggattatgcttcatggtttaaatttaccaacttggagtatatcctggaacaagaaaccgattaatttgccaactaattaatcggcatctgtttagtctaaatctcacctcgatcgataaggcgaccacacacaaggaacaagaagctcctttgggtttcttgctttcccactcgtcttgttgtttatcatttctggccatgtcggcatgctggttcggccgaggtgttatctagtgcttggctgtttcctgctccatgatcacgagcccctttcggtggttagtgttgctgatactgcaattaatcaccattgacacggcttcaaactcttgagccatgcattctccatatcttttttcttcttctttttccagcaaattaaaccattagtaggagtattcaattggcctgccgcccgcgtacgtgtcagatttcagtatggtcctcgtggaaacaattattgcaaacatactactccactgtactgccatgggacagctcatgacactatcaggaggcactcttaaaaatactcatgtttgcattagagattagataagggttcttttgtgtttgtgcaagttatggttgtaggaaagaaagaaagtatttattctcgagataagaaaagagaaagtatttatgaaaaggaataaaaacactgcaacaatatagaagctgaagaaagaaagtcattggtagtatatcctgtagacagttgcaggcagcaattgcaaaattcagatatgtcaagaagagacagacgatatgttcagtcatgatgctgactttaattttgctctttttttcttcaagccataaatggtaaaggtggcctaaccaaacactccaaatctaacactcaataacgtttcttgttcgtttttgccttgggagtttatgtttcaaactcttcaacaacctgttaatatagtgaggtggctggtccggttttagtcgatctggtgaagaaatgctagatgtttctgttacgcagttgcatgaagcaagaagcaaaaatatgcttcccaagtttagtcactgtcagtactgtatgacatggcttagtactgacagagaagagaacaaatcaaggttggaccaatgttctgtccaatgttgagtcagtgaacaaaagtcaacacgaaactatgtgctcctatttattcacctcaatttatcattctgttcatgatttagtcagtacaataatttattaaaacagtggtccttattgatgtacacatattacttcatgtttagacagatgtacacctatgatttaatcaaacatggatatcttaaattacaatataggttactgtcttgttcatggatcatcaaattttcaaaaaatacaggcatcatcaagttgcatggatgaatacaacttatcagtagaatgcaatccatgaatctcatttcagcaagatgcctgtattttttgatccatgtcactctcatctactgacaatacaggca

SEQ ID NO: 27378 - DNA, 1501 bp, Oryza sativa
aggaaggggatgagtgggtggcgcgggtggaagagagggtatatagcggattctgatcgggaatggacggccaggatgagttggagttggacggaatggggtaattgggccgaggtcttttctggttttgtgagctttgggccatagataagatatgttaagtgggctagtcttggatgggccggacgtgctgatctagcagggaaaggcccctctgttggaatccagcccattctgttcgttcgttggcagcagagaagtttgaaatgagttttctttttttttttggaaggaactcaactaaatcctgttaaaattctacagaaattgttgctttcgaaaggagctcaaggtactaattctaatccaaaatgtccatgttgcaaggcttcaataataaatagtcaaccacggtacaatcaggttgacaaatgaatatgaccggtcggaaattctggtcatcgaacttgtgtcaagctggtacaaattgagaaaccgctaggcaaaggggccaagttaaataatatataaaactaaaatccacttaattaggaacggttttcatcagtgaccaaattatttttgcaaaccatgatttgcatacaatgcatgttatgagatcacctctgtgccaactgtaaccagaaatttggacatgcatcgccatattctatccttacatctcaacatcgtcaacccacacaacacaatacaactgtctcttctcaagcatagtattgactcgccgtccagtccagctggatttcgctcgtcgttatcttgctcatcccgcgacgagtagcgagctgagcatcggcggcgatggagtggatgccggatgggcagccagctccggtgggtcgccgtcgagctgtagccgtacgcgacggctgcatgcgaagtcgacgacacgaagaaagagaaagagagatagtgatcgatcgagcgtgcgtgcgtgtggcgcacacgaagtacgtggggggaaaaaatagcccgcttcgcggcatcgaccgatcgctaccaacaggtgcggatctgctgaggtaagttctcatgtttttttatatctatattaatattttaataagactgataattaaacggtagcgtaaaactgaaaggtcgatagcataattaacttttaaattttacttttggaatacggacaccatgttgcatatgagccggggaggatgagatatacttttgttcttgtataagaagttttgaatttggtcaaagtcaaactgttttaattttgactaagtttatacataaatatagtaatatttataatactaaattagtgtcatcaaatcaataattagatatattttcataataaatttgttttgggttaaaaatgttactacttttttttataaatttggttaaacttaaagcaatttgactttgacaaaagtcaaaacgtcttataacctgaaaaggagggagtacttcacacgaatccttatcttagaaaattcgaaggcaaattaca

SEQ ID NO: 27379 - DNA, 249 bp, Oryza sativa
  unsure (1)..(249): unsure at all n locations
gtgacgcattgcaacaacaggaggcatgataacaacaaaaaatgagaccattcagcatcagatttgaacgttcactaaagcatgagcaataaaacatgtaatgagttcagttcttgatctatcanaatccaaggcatcagactagatccacataaggttccaaaactcacgttgacaaacagtttcatcagggataaagtagcagatttcaagtagcattaaaattaactagatgatgataataatagg

SEQ ID NO: 27380 - DNA, 1501 bp, Oryza sativa
caggtttgggcccgggtttattacttctctcgattggttgattcatttctcttgtagctctgcactaacagatagtatttttttatggagacataatataaacttgaataattttaatttgatgtctttttatagtatttaggtatgctattcaactatcacctaacaatagtttgtgcttaatgatgtctaaaagttaaacattactttctatttgaaatataaattatttgtcatacatacatatgtactaatgttacaaggctctttatttttgcctcgtcctgggctaccaaaatttcaggaccagctccgactgacactgtatctactctcgcgtccttctactcggacatgagacattaagggcccctttgacttggattcaatggggccctaataggttaattaggtcctgtttcgattttaacttttttcttcaaacttttaacttttttatcacatcgaactttcctacacataaacttctaattttttcgtcacatcgttctaatttctttaaacttttaatttttaattttgacgtgaaacaacatagcgttaattggaagatctagccggcaatctcgctcgtgtccttctctcttttgtttcggcttcactgcgcgatcacacgtctcctcttttctgttcggcttctgcgcgatcgttgcggctgcacccacctgtaggaatgttgggcgctgctgttagtagttctgggcgaggggtgccaccaagagccaacgccagctgagaattttgcatggacacttttttatttttgcaattagtcacttgacaacttcttgaatagtatgaatttgttaattactccctccttccctaaatgtttgacgccgttgacttttttaaacatgtttgaccattcgtcttattgaaaaacttttgtgaaatgtataaaactatatgtatacataaaagtatatttaacaataaatcaaatgatagaaaaagaattaataattacttaaattttttgaataaaacgaacagtcaaacattttttaaaaagtcaacggcgtcaaatattttgagatggagggagtatatgcgttgtttgagtaaatttcagttgtgtcagttttaggacgaagaataacactcatcttccctctatagcattcatatttcattatcactacttcttaatggtctttatttatgcccactattatgtaatagattttcctggacgacgccttattttatttctatgcggttcgtaaatgcaaccatatagaaaaatagagaaaccagtgttaggctgtcactcacacgagaaaatatattgtcccgtgtgggcggcttaactcactcgcacgaaaaaaaaacttcccctatccctttctctctctcctggcctctccctctcgaaatttcaaaaaaaatttcatcctctcaactctctctctcctccccttcgtccttatccttatcaccacctcatccttattcttctcaccacccacccctctct

SEQ ID NO: 27381 - DNA, 1501 bp, Oryza sativa
ttcttctaatgacttagcttttgtgtgtggtggcttctctcttgccgctttacactcagtcactgaggagcaattagagaagatccctgaagatgatcttgctctttttactagaaaattctcaagagcttacaaaaatgtgagagatagaaaaggaggaaaaaccaatgaaccatttgtgtgttttgagtgtggagagcctaaccacataagagtgaattgtcccaagttgaagaagaagagtgacaagacaaccaagaagctcgagggacaagggcgaaaggggaagaaggatttgataaagaaggcgatccacaaggtcttggcggctcttgaggaggtgcagcttagcgacatcgactccgacgacgatgatcaagaaaagggggacaaggacttctccgggatgtactgtctcgccaacaacgaggacttcatcaacctgtgtctcatggcacttgaggataaggatgactcatcggagcatcatgaggtatgtcttgatgatatcccttccttggatggttctctttgtgatgattcttgctcagataatgactctgttgatgatgaactaagcaaagaaagaatgacacacttgatgattgaaattagtgacaagtataggtcttctaagtataaaattgagaaactaaaatatgaaaatgatggaatggcgctagaaattgctaggcttcgatccatgattcctgaggaggatacctgttctacttgtgcttcatatctttctgaaattaatctcctcaaggataagttgaaatcatgtgctttaggagctgggaatccttctagtgctagtgctgcttgctctacttgctatgaaatgaaagttgatatgagtttgcttgagatggaattgaaagaactaaaagaaaattttgttcatgataggataagtagttgtgaaaattgtcccattctcactagtgacaatgatgaattaagacaacaagttgacatgcttaggaccaagaatgatttgctagaatcttatgctactaaggagcctgttcattcttcatgtgctaattgtgttatcctggaaactgaactaaaagatactaaaattgtcattgattatgtcaaatctgttgattcatgttcatcatgcatttctctgaaagttgatcttgagtccgctaagagagagaactcgtacctacaacaatctttagagaggtttgctcaaggaaagaaaaagttgaacatgatcctagaccaatccaaagtgtccataaacaatcaaggtataggctatgattttgctgagtctttgaggataggtacccatgagattttaggtgtcacagatgggatgatagaactagctcaaaaacctataaccttcaagtctgcaggtttcattggaaacactagttctagtacacccaaaacctcagaaccaaagatggtacctatgactagcaagtctaagtctgtagagttacctagacccaaaaatccaaaacaagttgagcac

SEQ ID NO: 27382 - DNA, 496 bp, Oryza sativa
atcggctaaattgcgttgctagattagattagcttagacatctaccaccctgaagactcagtcaacggcttgattgtctagatattatgtttcttttcatacttagtgctgcatcagttaagtttgatctactaagtcgtgcttagaaccataatctctagcttgcttcttgattgtcaataagggtttcatcggggtttcagccggtgagttatctggacgttgcatcagctcataaggattgcatatacatataagttagatttagccgatgacaacaaaggtttcactgtttaatctaatcttgtggatttcatgacatcggacctccagccgatgtgtgctttaacctttggatcgatgcttattctatcatatcaatgctagccgattggtttatactggattatattgttattttattacatcatcatcatcatctgattgcctttatatcattatctacattggacatatagccgattgcttaaaccct

SEQ ID NO: 27383 - DNA, 1501 bp, Oryza sativa
caaggagtgtatcttgcgcaaataaacacagaaaagagggcatgtttattgttacagtagggtatgtaaattcgtaccttttataaccctgttgatgaaccgtatgattacacttgatattcttgtattttgcctgatggcattgttcagtacagaggctatagccattctgttagcttcactagtaccggcaatgcaaatttttgcgctgaccttgacacctgacaagtgcttgaagcccacattttcaaggttgtattgctccactgtgctaccattgaattccatctttaacctttggaggttgggcatagctccttcatcaaatctcagacttgatacagtactacacttgaatttgaagtacttcaaaacatggaatcctgacttgtcaaatatgataggttctgcaggggttgtccggacatacagtgagaaaacagtgagggcattcagcattgagagagtctcaatgtctttcctcaggagttccatgactgctactttcaaaatacagagtttctcaatagttatgatccaactgggaagtctatggaagacgcaaacacgtggaaacaactcaagcctctgcagaaggctacaaggggggggaactttatctaagaaatccaagaaaatggcaatgcttgaattttcgttatcattagaatcttcagagaagcagacaggaacaactgttagagatttgaggctcttaagtatcccaataattgaacccaacagtttcatgttgtgcttaatatggtcagaagtggctatctgaggacatgcgagttgaagatcctgcaaattggtcagttcttcaatactctgtacactccctgcgtcaacaaagtaccctagattgggtggaagtctgaagtgcagcaacggcggaagatgaacaacttctgatctcaaaaaggtcaccattgcaccaatatgcagagtcctgagatacttcagtccttggagctctgatggtaagtctatgcaaacattaccttcaatctgcaaataagtcagtagaaacagttcacgaattctagtgaggtcaagaaattcgccatgtttaccatgaaggaatagaactcgaagaagatgaaactccgaaatggaaggcccgcacttccaaaatccagaaaacacaagtgatcgtagttgtgacaatctaatacatgctggtgcctttgcatcttttgaatatccgaaatggagagagagtcgtcgaactttgtctgctagtcttataccagactgagaatgatcaattgcagtgacaaaattctcttccattgccttgcgtttgataaagttaagaaccatgtcatgcactgtgcaagatacaacctcatcactacagctgatatgttcagtttcaagtattcccctatggacaagctcataaaaatgattccttgcagcttcatccaaacttttcccttccgtcgcacttacaaaatcttcagctacccattgcttaaccagatcgtccggattg

SEQ ID NO: 27384 - DNA, 1501 bp, Oryza sativa
tctgttaattaattcttttactccaaattttcccatgataacacgtgggccgggtaaggtagcaagtagatactccagtaattattgtgctagcttgttagtctcaacattgatttttcatacacgtacaggtgctaattaggaagcatatataaggactatagcagtgtttagatcccttcaaacttctaaaaattctgtcacatcaaatatttagacacatgcataaagcattaaatgtagataaaaaaaatcaattgcacagtttgcatgtaaattgcgagacaaatcttttgaccctaattacgccatgatttgataatgtgatgctacagtaaacatttactaatgatggattaattaggcttaacaattaaatttgtttcacagtttaccgacagaatctgtaatttgttttgttattagtatacgtttaatgcacgggactctaattatgggtgttcctctgtaatcaacatagctagcaccccttgctgctatgagtccatggtctcgccgccattctctttctgcgtgcctatgttacattattgacatgattgttacattggtggtcactgcaggagaaacaatctttaatactagttaaaaccccctttcgtaccggctgtagcaaccgagaccagtaaatcgagactatctttagtaccggtagaaagaacgagtacaaaagatgcatactaagtcaaaaaaaaaaagtgtgggatgtgagattcgaactcaagatctatcaactcagtcctcacacacgttaccattccacctactactatacacatctgacttgaatgtagatgctttctttttgaactgatcccagagacatcgttagtaccggttggtattaccaaccgaccggtactaaaaatatctttagtatgagttggtattaccaactggtgctaaaattgcatcgttattaccggttggtaacaccaaccggaattaaacatagttttaggaacttcaacttttagaaccggtactaaagcatatttagtaccggttcttgatctagtcaggatatttgtgttttggggtttaggataaaaaatcgtttctctagtagtgggtgcccccatttttatttaaagggttaccgggttatggagtctgatgctaaccccaccctctagctaccatatattacaactttaagtttaactacaacctattaggacaagtatattcggcacctattttaacatgctccacctcactgaatgtaacgccacccacaagtagtagaattatcatgtggattcaccaatccactagacttggggttttcttcttgcagattcctcgtgagatggttgatgagcctatgccagaatcaccgctaccaaaagcaatagctatcccaattactgtttccttctggtctacacctgtaatagtacaccctcacaacttgtaaaggtacgacaacaccttctcttcaattatcacaatcctactatccccgtgaaagggtcaa

SEQ ID NO: 27385 - DNA, 312 bp, Oryza sativa
atcccttatatttagggacggtgggtgtcataggtagtgggccgaggggtcgaggccctagggataaggatagagttggttggataggattagactgggtcctccctccatctatataaggatggtttgtatcatcattctaattaagcaatgaatcaagattagtctctcccaacctaagtccccctctcatccctagcagccgtcgccgcccggctatcctctcggcggtgtttaccccctatgaatcctaacccataacagtgggagtattgttttaattttctaaaatcaccacttttattcataatg

SEQ ID NO: 27386 - DNA, 1501 bp, Oryza sativa; identical to SEQ ID NO: 27363

SEQ ID NO: 27387 - DNA, 1501 bp, Oryza sativa
actatttggctaatggagaagttgatatgttaaaattgatatgaagcctttttgcaggcaacttgtggaacacttggtctgtctacagcaactgtcaaactgataggtccggatggagaggagaagattgcatgtgcagttggaacaggtccagttgatgcagcttacaaggctgttgatgatataatacaggtgacagttgcaatattcttgatggttcttgcactaatataccagtttaatgggatggaatatggatgtgttttttcaatatatgagaatgaaacatcctgcatctggtaacataactttcagcatgttgcctccatgataaatatacaagaatcacaagaataggagattccatacttaataaggattagcgtgtgatgtgttacgacttatgagcatgctttcaacaaaatgaatgcactattttgatgttaacagagaaattacctacatctactttcttgatttgtaaactatctgcattcattttagtaaaactggagaaattttgaaacatctaagaataatttgcaattcacagatcccaactgttcttcgagaatatagcatgacatcggtcacagaaggcattgatgcaattgcaactactagagtggttgtcactggagatgttagcgactctaaacatgctttgactggtcactccttcagccgggcattcaggttatagtcctttatactaccttttttttttcactgggcaccttccttctatgttgtttccaacatctataattgttattatcaatttaatttttcacatgaactaataatttctttgcctattgatctcagtgggagtggtgccgcactggatattgttgtttccagtgtgcgagcttacctgagtgccctgaacaagatgtccagttttgttggggctatcaaggctagtagtgaagtatctgaaagccaaagagttcaaaccacagaatgagtcttgacttccttttgggttttcatatccgatggttctatgtttcacattcccagcaaggagtatgtgcttgttgaaacatggtttttccgtccagaaaaaacatggttccgtttagtgcatctggaggatgttctgggtttcttggtggagcctgacttaaggttgaacatccaggacgttttgggatatgcagtgtataattcatatttgaaaaccgtatttacaataagacaataataaataattgtttgacatatgagtattgcaaaactattactgtaagaaattaatcgtgagaccaacctacggttgtacagtaccgagaacttctgaattgaaggtcagcatttcgagttgaactaaaagagtgatcagcagcagggacgcagcgccaagtggccagaatagaagccagaaggaacgaatccgagggggatcccaaccagaaggtgcaaacggcgatacccaccaagataacatccatcttgaatcggaatcggattaatcctactccacttcgccaccccc

SEQ ID NO: 27388 - DNA, 1501 bp, Oryza sativa; identical to SEQ ID NO: 27362

SEQ ID NO: 27389 - DNA, 1501 bp, Oryza sativa
atagagtgaaggaggaggacagacctagatatcaatcatggattgacaacattttttaatctttccccctttgtaaatattttttgtaattttgttgtaactcctatttatatttaatataattaccacagtaggagcctctcctactgtttacagtcaaaaaaaaaagtacaacatgtctacccttttagttgacatcgacgtgcgaattcaggtagtggcggagggtggccatatatgtcttgggctgtcggttcctctctgttgtttatatcattccttacctccccaatggctttctgcagcctgtttctctattgacataacttatttgttacaaacatagcaaatatgagttggctttaactgttgtacttagctagtgctggctgtggaagcattgtgttgtttgcctaggatcggaatgggcatcattagagagaagacaagcatactgttctttgtcatgaccatttcgatacatcggctcgatcgtggatagtgcctgtgttgatctcacacacaatgcttcagaacaagtctcgttgaacttttgtcatgatttgagaataacatagatacagatgtcctaattggcgaaaaaaaaaactcgaagtggcatttgatttgtgcacatacctacgtgaagctatattgtgtcgaaaaaaagctacattaagctatacccactaaacaaataacaatatgacaaacaagtgctagcttaacaacgtgaatgcataagccctagtacatatagcctcctccccccttagatcatcagcaatacgtgaacaaaaagagttggatcttacaggatctcagccagagaagcaataaccagccatgatcttttgtctcaaccaatcggcacgtgataggaaaaacttcgataggagatgagagcaccatcggccacggcattgtggaagagaaaaaaaaaaggacatatgtcacacaaatgtctagacaagtaaaaaaagaacccaattaaataataaggacatatattgttccaacgaagaatatcttgataattaaaatatacatatccagaaattggaatggattaaaaaaaaccatatatgcacagcatccctcatttggatgggtctaaaacatagcatatacacatgtgtataggcctatagggcaggcattgaaaaaaattccaataaatatggattgacatgtatggccttgtttggatccttcgggctattaaatagccctatggaattttgctatttagaattattaaacgtagattaccgacaaaaccgattccataacccataggctattttgcgagacgaatctaatgatgtatattaatccataattagcagctgattactgtagcatcactgtagcaaatcatggattaatatacctcgttagattcgtctcgcaaaataggctaggggttatggaatgggttttgtcagtaatctacgtttaatactcttaaatagcaaatagccctccggatccaaacagg

SEQ ID NO: 27390 - DNA, 346 bp, Oryza sativa
gatatttttcgaaagagaatttaataccattttaaagaaatttgtaaaacaccattcccgtgaaaccttgaaaaaaaaaagttttatatataagaacttagaaatgtaaaatttatataaaataaaggcctatgaaaatgtaaatcatagaaaaaattacgtgtgtagttaaaaaattagggcatataattttccttagaattaataaaatgaagacggaatttttttaaatgtataataaccggggagaatttctaagtcagacttcctattagagagactttatatatgtaagctctatatacaaaaaaattaggagtaagaagacgcaccccgtcatccccga

SEQ ID NO: 27391 - DNA, 450 bp, Oryza sativa
atagtaagccggccggctcgaacatttgatcgctattaaacaatataaaaacagctaatgccccatattagttttgaaatcagtctataaagtattgattcaaaaccatagaaattcaaggagaaagtgtgaggattttcctttaggtgcatatagttagcgtcaaggtagataacccgtgtcaaaaaaagtaaaagaagtttacggtaaatcccgttcaaatagaaggtattagtatgttgcaatatttattgtttaagagaagaatcttctagaccagcacagcgtccagtagtatttcattaactcattagtctattcaatcgttgatattcgacgacatcgacattgaaagcgagcccatgtgcaaagatggaatgtcctcctcccatcctccgtcaccaccttatctctattttctacctcctcttcccctcctccatcaccagg

SEQ ID NO: 27392 - DNA, 994 bp, Oryza sativa
  unsure (1)..(994): unsure at all n locations
gcgataatgcagtctattggacaccccnccaaatggaatgntgaacgcctccccgtcgactctagaggatcccctcttgtaacatgtcgcggatgcttcgtttttcgctattggggtcgattccgtgggggttggagcgtgcggtggaatctcactggaactcgtgctgctgccgctgccggatccatccatctcccggcgctacggactatggtgtggatactagggtcgactcccaattctcggagtaggtcttcaaatgtttctgccgagtatggatcaggaagtggcgccgccaactgcgccgcccgagaatccatcaatctgcgagccggcggatccatcgcctgcagcagtcagaccagcttttgcgttgttgcaacaactggatgagtaccagatttttattatagtcgacgatgtgagggacaacgagattgattaggactcggattcgatcggagtcggagtaatccacgcaatcttgatcactgtctacgtatacctgcttcatctgaacgtatatacgtccggttcctagtactcgtagtaggtatttttgtctcccgtacaactaagacccatcgcacgtatgcacggttgaattcctggcagcccaacaaatcaagcattgcatgcctcaacggattgacacgtacacacttcaaatgttaatcgcaagacagctgagccagtgacatacgggaaactatctcgatccctcgagagaatgtccgctcgtctttcttctatgagatgtagaagttgaatttaaaaaaaataagaagatgtgttattatgtgatgtatcaagatagtttccctcgagagaatatttgtagagtgatgtatcacataataacacatcttcttatttttttaaaacttttttataaccatttgagtaatacgcaaataacgagggcccctcgagcaatcaaaatccactcctagtgacatactctatacaatacatgtacacaagcggcaccggc

SEQ ID NO: 27393 - DNA, 1501 bp, Oryza sativa; identical to SEQ ID NO: 27348

SEQ ID NO: 27394 - DNA, 731 bp, Oryza sativa
caggaattcaaccgtgcatacgtgcgatgggtcttagttgtacgggagacaaaaatacctactacgagtactaggaaccggacgtatatacgttcagatgaagcaggtatacgtagacagtgatcaagattgcgtggattactccgactccgatcgaatccgagtcctaatcaatctcgttgtccctcacatcgtcgactataataaaaatctggtactcatccagttgttgcaacaacgcaaaagctggtctgactgctgcaggcgatggatccgccggctcgcagattgatggattctcgggcggcgcagttggcggcgccacttcctgatccatactcggcagaaacatttgaagacctactccgagaattgggagtcgaccctagtatccacaccatagtccgtagcgccgggagatggatggatccggcagcggcagcagcacgagttccagtgagattccaccgcacgctccaacgcctaggaatcgaccccaatagcgatgcccggagcatccgcgacatgctacaagagttctatcgagtggtgtaccatggagaggtgtactgggctggccgagtcatcaggcctcgtccttcgtccatgccaacgcccgtgataggacgacgtcgccgcgccgccgacggggatgccccgatgcagccgccgagcaagtacgctcgagtacacgccgtgtcgcgcgatgtcctcctgggcctcgcgctgac

SEQ ID NO: 27395 - DNA, 1413 bp, Oryza sativa
caggaattcaaccgtgcatacgtgcgatgggtcttagttgtacgggagacaaaaatacctactacgagtactaggaaccggacgtatatacgttcagatgaagcaggtatacgtagacagtgatcaagattgcgtggattactccgactccgatcgaatccgagtcctaatcaatctcgttgtccctcacatcgtcgactataataaaaatctggtactcatccagttgttgcaacaacgcaaaagctggtctgactgctgcaggcgatggatccgccggctcgcagattgatggattctcgggcggcgcagttggcggcgccacttcctgatccatactcggcagaaacatttgaagacctactccgagaattgggagtcgaccctagtatccacaccatagtccgtagcgccgggagatggatggatccggcagcggcagcagcacgagttccagtgagattccaccgcacgctccaacgcctaggaatcgaccccaatagcgatgcccggagcatccgcgacatgctacaagagttctatcgagtggtgtaccatggagaggtgtactgggctggccgagtcatcaggcctcgtccttcgtccatgccaacgcccgtgataggacgacgtcgccgcgccgccgacggggatgccccgatgcagccgccgagcaagtacgctcgagtacacgccgtgtcgcgcgatgtcctcctgggcctcgcgctgacgaaggcgtgcgacgcgaggcaggaggagtgcgccgtgtgcctcagcgacttcgaggagaaagacaggctgaggacgatgccgtgtaaccactccttccacgagaactgcctcttccgttggctcagggatagctgcctctgccctctctgccgctacgcgctgcccaagcagcagcaggttcaaagctgctgatgatgctatttatgtttcggttcaccaacagatccgtttgtaacttgtaagcatattgccatcgatgtagaagtagaatcatgttctcatcgatgtatagcagggcagttcatcatcagaaggttcctaattaaaacatttcttatcctccactggatttaactagtattgcctgcaacgcaaggccctgtcttggctaacaagccgaaacaacttgccactcatgtgcctagctatccctatcatggccaggcacacggttcttcacaatatataatttaagaattgccttgatcttcaaagtaattaattagtggattgatagaagttcaatcgacttgacattgcaattataaattgctttggagatccagtgtcccagtatataatgccagatgaacactcctcttgcctccatccacaggtcaacctgcaggcaacccagcttgctaccaagtcgatcaatggcaatggacacttactactatt

SEQ ID NO: 27396 - DNA, 1501 bp, Oryza sativa
gcgccctctagtcgtggatctccattttggttcaaaaccattgcgtgttacctcagagtcggagaatgaactgccacccaccactcgatccttcccaatggcgctaccgccatcggtgttcaaggccttccttctccctgcgggacgtttccctctactcccactatttctctcttgccagctttgaccaagatgatattcacttgtgccttctggttccaaagagaagccattgccacgctgatccctaacaccatcgctaccgatggctacagatgttgtagcttcccaccttgccacattatctttccttctatctctcccaaccattgctctttgctcgggtcgcaaatcgacatcccccatgtcctccaagtccgaggtaacaatgtcatcgttccatccaccgtcgctagaatcgtcgtcgtcgccaccatccaagttactcactggctcccacactccacccctttcgatgtactcaaccgcaggctacgatcaccaccaacaccacgcatttccttcttggccgcattctcacgaacaccttgcaggcggtggcggtgactccggtccgtcgcatcggaagggttaccgcgagcagccagtgtgctctcaaggccaccattgacaagaccgtagggctgaacgctatggacggatcccttggggaagaagcgcgcggaggccctgccggtgtccggggccgcgaagacccgcggcccgtcgcggtcgttccagaggtcgacgccgccggggcggtggaagcggtcggcgagcgccttcatctggtcgtccgccgcgacggagagcaggttgggcgccgccgccgcggcggcggcggagtcggaggcgtcggggtcccaggggcgctcgaggtgcgcggcggcgtcgcggagctcggcgcgcttgcgcatctcgtagagctggcgctcccgggcgaggcgcgccttgagcagctgcttggccttcctcgcctgcatccgcttccactgccacttggagacgccgccggggaacgtgcgcgggccgccgcccatgcggatggcgaggtccccgcgccggagcggcgcgcgcgggcgggcctcgcagggggaggggacccggagtccgcgtgaggagagggagagcgagtggaaggaagacaacggcggcgccaccgccgcggcggcggcgaggagcggcatggtggcgcggcgcgaggcggggatagcggcagcggagaggtggagtcctctcgaccacctgaggctgaggaggagggagagaaatgggaggatttttttttattttttttttgcttgctatctgacgcgcgcgcgtcacgacctcaagcagcaggtgaaagccttccgctcaccaaaaaaaaaaaaaccagcctcttttcccctccattttttttttgccctgtttagtttccaaaaactttttcccaaaaacatcacattgaatctttgaacgttttcccaaaaacatcacattgaatctttgaacgtatgca

SEQ ID NO: 27397 - DNA, 352 bp, Oryza sativa
  unsure (1)..(352): unsure at all n locations
atacaacactgttcgatcgtcatccttctgtaatatgcctctcttcaccctatcatacttcaccttatccnccttacgtatttattattctattncattacnnnncnnnnnnnnnnccgttgaaaccttttgaancnacctggnaccgcgactacaacttatgcagaccactgccacctgttagatccgaatctaacggtccacatgcacccggatactgtagatcactgaancaaaaatattgggtattgggcggtgacactggagctgatgatctggtccattcatcaccaaaatgaacgggtgtaatcgcgtgcagtagttaacttgcagtcgctgttcatactgcagg

SEQ ID NO: 27398 - DNA, 1501 bp, Oryza sativa
agcacttgtatatcaaatggaatgtttaattgaggtcatcatcctgcgcatagcagtgcagaatctatcattacctggagattcaaggccttcattttaaggtcttgaggtaaaagagggtgctcagggtacttgtcctccaaatactgcaatcacatagaaacaagtcaagaagcggccaattttgatgctataaactactgcatctcaaaattctgaatgcttactaatgctatcgcgtaagaatcaccaattacagcatctccatcgaccaatgccgggacgaacttcataggattaaccttcatgaattcttccacccacaaacaaaaaagaaaatagttgaggctaccacacatgtgttctatctttcggtttgagtttcctgttttttggttcctcccctacgattctgagctagttgtgcatgggtgcgtgccacgaatgggtggacatcatggcgcatcgtgtgcgtatcatgcgtccagttacaagggtactaaggccatgatctgcatatatcactttgctttatattgcatcaagaaaatcccgaaaagaggcgcttccacatgctgcaccgaaacctctcatgttcatctcaattttctcagttgtgcatttcatcgaacaccttcctattcatcttcccccacagagcctagccttgtggatttcgggccgatcgcctgctagaatcttacctctcaacatccaagcacaaatttgcggcggtaattgcacgaacagtctctagacgcagcacaaaaccgtacacaagtatagatagggggaggaaagcagtttgacagacaggtggcgtagcacctaacctggatcagagtgctcccccttgagcaggttcaccgccttgtactcgtactccaatcctgcaggagacagacatcaaaatcacccgcacgcacgcacgcaccaggttcactcactctgcccggccatgagccaaccacgcatagaagatgacgacgagaggaaggcaatcgcgcggcgcgggcacaacgtacctttgaggttgagggcgatgcggacgcggtgcgagcacgagctccgccagtacgagtacagacccagcttcgccggcgccaccgccgcccccgccgcctccgccatcggaagccgccgccgccgcctccgccgcgaagcgtacacgtcagcgagcgagcgagcgagcggaaggaagaagacgagtggtctctgactcttctccgtgggccacgagacaaaactctagaagagcccatcaaccgccccgacaggtgggccccaccccacccagggtggaaactgggatttcgttttcgtgctagccccctgtaattttgtttatttgcgtttaggtcctcgtctggacctggctgcgattttgcccctcctctctaatcctctctcgctctccactacgaggccaccaccaccaccactctcgctcgctccccccactcccactcgcctgaaaccctagcaaggagctcccggcgga

SEQ ID NO: 27399 - DNA, 193 bp, Oryza sativa
caaccaccctttcagttatttggtacatgtttgtttgaaaagatgacatcatttagcaccgcgcgtgggtgagaaagacatacctgtagcgcgagtctgactcgggatgggcaccaggaaggcgaatacaagaacgtcgtaggcggaaggcatacgcaccggaccacagttccaagcttctgcgcgaattagg

SEQ ID NO: 27400 - DNA, 1501 bp, Oryza sativa
ctcctggaaaaaaatcaccgatagaattagttatttctctcctggaaaaattcaacgaatacgccgtggttaagcatgtgaaaacattagcaaaagctttaataaatcactagtaaacatgcacgtgcaacgcacgtttcccacatcatatcacactaatcatgttcaatcacccaaagattatagcatctttccacattatatattacactgaacatgcaaacaaactaagttcaagaattacatatattgtagtgtaaattgcaatatcttaataactcttttgtagacactttttatataaaaaaaatgcaaagcagagaacgatatgaaatgtacaatgttgtcacagctttgatatacactaagctcaactctatctatagcatctaatcatgcacttacatcccaccactgatgtaaatcacatgcgagacacacacaagcaacttaaagtaagcaaactaacacaacgatctaaaacaacgacttaacaagtcactctaattcttccgagcatcggaggtcgattgaaggttctttcggctcgtcttcatcatcttgagttgctacccactcaatcttggaatggttgcgtttggattcttcttcttcatcatcacttatgatgatgaccggaggatctgcttgagttagggcaacttctttctccaccacacgaacctttggcgccaattgatagcgagggacaaatagagctctcttccttgcggtaagacgaattctggccttctgcggtggcgcttctcccttcaatgcggctagttccttctccaaacgatccactttgtcttctagcttgcaaatcttaccacgattccggtcttcacgatcttgagctgccaacacaatctccgcacgactttcatccatagcccacagcatctcaaccaaatgccttgtggtagcatcattctcaattccttcagtctcaaggtaactgccacggtcacttccctggggttgacgaggatgatagcgatactcagtatcggccaactgatcactataacgatcgcggagctctcctatggcgatccttgccacctcctgacttgcatggatgtagtttcttcctccagcttcgaacatcactgaggggatatcttcactattactgttcaaggtgactttgactcggcacttctcttcatgacgatcatgaggaatctgggcataaaaaggggcagtcccgaatccaatgacaaaggacattgtacgcaactcctggacaaaaccctcaacaccaaacaagtactcaggcttgtagcgcggcatctaaagacaagtgaaaggagggagttaagacatttatccaattaatagcacaagttttgggattaatttgaataaagtttagaagatcaaggtaaaaggtaattaaataaagtaaaccaaacttgcaagataagttgaaacagttggaaacaaggccacaagttttgtacttttgaacaacaggttttaaaagaaataaaag

SEQ ID NO: 27401 - DNA, 355 bp, Oryza sativa
ccgagatccccactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaataga

SEQ ID NO: 27402 - DNA, 152 bp, Oryza sativa
aatattaaatagtactgattaacactataaacaaatcatgtctactttataccacaaatctactcaaaacgtaaataaaactatttctgtgagaaaaactatttttatcatctccatcatctctcttgtccttagttgaaggacatcaaaca

SEQ ID NO: 27403 - DNA, 520 bp, Oryza sativa
gcttaacattcagtcaaacttttaaaactacagcattgattttattttatagcaagtttataaaaactattaagtttataatactttggaagtgcttttaaaggcaactctacacataccatatttgtttttttttataatgaaccatttaagaaattaccaatggtcacaatttcaccacatcttgtcattaatacgaacatagacaaatgaattactcgatttcaattttgttcctctccaccaatgaaatcatagggaaattacatataaattgaatgattagattaggatagcatggatatgttaatatatctctactactatatgttttattataactgtatagaatattttttatttgcatttttttctcctttgtcttgggagttctcttcttacgatgattaatttcatagcatcctttctatagaaaaatatggtgcacacattattttgaattttttttcagtaaagttgttttttcaacctttgatgataattgaaatcaaattttaga

SEQ ID NO: 27404 - DNA, 222 bp, Oryza sativa
aattgagatgcatgcatcctctcgtttgccgcttccttcgatctactccctctgtcctataatgtaagggattttaggtggatgtaacatattatagtatagtgaatctgggcatacactttaggatgtgtcacatcaaaccaaaatctattgtattatgaaacggagggagtatatatattaaccatccagctttgcctccacggcggttaaacaatgcaa

SEQ ID NO: 27405 - DNA, 392 bp, Oryza sativa
cgacggaacggagctcggcggcgacggcggagagagaggagcacggcgcgagcacgattccgacggcgagagcgagcggcgagcggcggaaacggaagagcggagctcggggagcaattatatagcaacgggagggagagagagcggccggagagagaggaaacgggcgcggagatctcggctccattgaatacgccggcgaggtttgcgggattgattccgagcgaatccgagggagagagagaggggaaagagggggaaacgggggaggggatcgcggggattaattcccccctcttgattgcatgcggggcggacgggagcggcgggattcgcggcggcggcggcgctagggcacggacgcggcggcgggcgcggcgggaggagggcga

SEQ ID NO: 27406 - DNA, 1501 bp, Oryza sativa
aatatttttacagaagttagttaacattatgatgatgccagcggatttcctgtttttgcaattgtcattggttctggaaccactaacttctaaaacgtttgtttacttgattgaagattcttatagaggttgatagtctacaaggtgagacaaatccgtatcttcagattaaaggaacgaacaaggaaatagtttcctctgctgcatctgcactcagcttagatgattcatacacgacaaaggtctcctagaaaatcctagctagttaaattgattaatttgcacacacattattgcatatcagtttcatgattttattctgctctgcagagctatcttcaaattattctggagagtttgccagcggatgaaaatgttcatactggtattcataaccaacaagctgctaggctacaagaacttgttgagtttatccagtcacaagtatgttaattcaaaccaactagttgtaaatactactgttacattatgggatattttttatggctatgatttagggtagtcagaacataagtatttgttctttacaactgtttgtgggagaacatactagcaaattgccttttgtgttggacgcggttatgtttcgtagtgtggtcacctggtcggtggtttaaaataggccattgagcatggttgcttgattggttcaagtccatgtagcatgcttatccatacattatttaccaaacatcagacagttaacagatgattttccaaaggctgtatcatgtttaactgtagctattttcatctaaaaaaaatgtctattggtcctttaaaagaagttagtgtcagtggtagtatcttcctctccacatcttatacacttatttttatgaattcaatgttacttttattgtatgttgtaaatgtctccatcagctatatgtatgagtatgtgcatgtatgctatgacgtgcaccttcctatatcaaaaagttatgttacttttaatcatttaatgtatgctgtaaatgattccatcagctgtgtgactgcatgtcatgcgctagttttgatttgaggattctagttacttcgttttgtttagtttacaacttgtagtatacttattcgagattttcctcgacggaactgtaatagcagatgtgtttgtatgatcagattctatggctaattagctattgttctttcttaactttattctcatatattgaataattctgtggtgcagggaggtagcttcaattcagatttatcttcacctacaagagaagtttcttctacagatagtgtgcttgatgatgtgcaatctaggttaaggaggcttgagagatggaatacaattaatatggtaatttctctttattttcagatgctgttcaagacccatattctttctcaactgccttaagatttaattcagtttgcatgcgttggcattatgttcgattaaacaattaaatattgcatatcatggttcatcagttaaaaccccttgtgttctgcaggtttt

SEQ ID NO: 27407 - DNA, 288 bp, Oryza sativa
tctaagtcaaactttattaaatttgatcaagtttataaaaaaattagcaacatctaaaatattaaattaattttattaaatctagaattgaatatattttgataatatgtttgctttgttttagaaatactactatatattttctataaatttgattaaactaaaaaaagtcaaatgacctataatataaaatgaagggagtaatagactagttcataccagttttgccttcacactaacagtactgggcattcagttcactgatatccctgctctcattgcaccaga

SEQ ID NO: 27408 - DNA, 1501 bp, Oryza sativa; identical to SEQ ID NO: 21266

SEQ ID NO: 27409 - DNA, 278 bp, Oryza sativa
tttttaatgttactttaattacccaacagttttactgttttgctcaataaaatgttttacaactgcctttatgcaaatagccacaaacccctccttgtatccctttgcacgtctgcatcgttggtgtggcttgctgagtacggtggttgtactcagtcttgctattattccccctttttcagaagtgtagtgcttctgagctgaagatggagttagaggaccaaggctcagaccccagttgagttttgactgtggagtggagctgaaaccccgctagg

SEQ ID NO: 27410 - DNA, 1501 bp, Oryza sativa; identical to SEQ ID NO: 21248

SEQ ID NO: 27411 - DNA, 535 bp, Oryza sativa
agagaggaagtggaattttaattgtttttttttattttaattgatgcaatgatctttgtgctattaaaactatttctcgagctccgaaaattcacggaaaattctggagagtacattagggcgcaaagaatattacaaaatattcccgaccaatgatttttaaaggaaaatttcaaatttcctctataattccacttgattaaattggtttaacttttatttaatttctagaaaatgtattattaattgatttttattcccgaacgaaaatcggggcgttacaacatgtctcatcgaacaccacatgtcgcgaggtgatgaccttgttggtggtaaggtctagacaccgataccctttatggtggagggatagcctaggaacacacatggggtggatcgtggggctagtttatggggagcggtggcgaagaggttaggataacacttatagccgaacacgcggaggtgggagtaggacgggtgagcaccatatagggcaaaaaagggggtgtggtgttgaagagttttggtggga

SEQ ID NO: 27412 - DNA, 1501 bp, Oryza sativa; identical to SEQ ID NO: 21232

SEQ ID NO: 27413 - DNA, 1501 bp, Oryza sativa
agagatagacagcactaacattgtcacagtaaaccaatgtggatcggctcggaggggtatggagctcatgaagaagctgtcgaagccaccaccgcgttggccacgacacgatattctgcctcggcactggagcgcgatacaataagctgacgtttggaggaccaggagaccaagttgtcgccaaggaacacagcataacccgaggtggatttcctggtgtccggacaacctgcccaatcagcatcagagtatgcactcaagtcaacagtggaggagcggcggatgtgaagaccataatcaaccgtgccatggacataacgcaagatgcgtttgagagcagcaagatgaggctcccgtggatcgtgcatgtgaagacagacctgctggacagcataagagatatctggcctggtgaaaatcaggtactggagggcgccagcaagactccgatagttcgtgggatcatgaactggggcaccatcagcggcagagagcttggcgttggtgtcaacaggggtagcacatggcttgcaatctgtcatgccagcacgctccagaaccttgaggcagtactggcgttgactgagatgaaggccagaggactgccgagaaacagagatgcccaagaaatgatgcaagctgccaagatccttcatcgagaactccgactggagagcacggatggtccatcgaagaagtgcatcagaggaggctgtcagaacaatgtcatcaacatagaggagcaaataaaccgtgtctgatcctcgatggtagatgaacaaagatgtatctgattttgcctcaacaaagctgagtgtaaggagaaagctggcaaaccggctggaccatgcccgtggggcctgcttgagaccatagagccgcataggccggcgggaggaaggcttgctgctgggccggcgcgggcgtggtggtgaaggctgtcccgacgaagttgggccgcacgccaaggaggcctagaccggcctggcccggccacatgtggattctccctgtccatgggttgtaggccgtgggccaggcctggttggcccgtggtgcagtctatgcgccagggttgccctgggcgccgccgctgtgtgcttgtccgccgccgccacttgcgccgccgctgccattgctcccgccgccaccaccaccggagccatgaccacggcgtcggttgttgttgcgggagttgttgttggaggtgttggtggaggtcgccgagcgagcggtggtcgaggaagcagcgaggaaggccgtggcagtaacgggcggccggtggcctttcgtcagctcatcgaggagaagctgtgcgcgagccttggcgaacgtcgggaacaggacttgcagaggcaagagggacttgaggttgtcgaatttgtcgttgaggccgccgatgagggtgaggatgagagaccgatccttgacaggttcaccgacgtcggcgaggttgtcggcgaggaccttgagtcaccggcagtagtcgccgatggagagg

SEQ ID NO: 27414 - DNA, 1008 bp, Oryza sativa
ataatgaaacattataagtacactaggtgaaatattttttgtggaaaaaaatgaaatgaattcggtttccataatatgtgggtgatttgttgcaaaagaatgtttcaatccactgcagcattagatctatacatagtgaaacattgtagtacactagatgaaacattttttgtggaaacaaactgaaacgaattctcttaatagatggtttctaaaatatgtgggtgatatattgcaacggcgtgtgtgctagggtgtgtggtgggggcggcacctgagctagaggcttgcagcgcgcgagctggaggcgcgatagaggcgcccgatttttcctgctgattctccaataaaattgcaataactacttataatttgcagcgcactatataggaaagaccactcttttgagtattaaatcaatatttattaatctgaaccatgagcagttaaactatctgattacatgttgttattactagtagaatgcatgtgcgttgtaacatgcgaaaataatttttacgatcgataaaaactctgctaatttaaacgataaactgaaacaagagaaacaaaataaagacaaaacaaaatcagaaattatatatagtattgaactaggttgtgttcgctgcatgcgtcattgtgtacacgtttctatagcctcacaaatcgatcggatgactatttcaaaagttgacgtatgtgtattccgttatacgtcattgatcaaatattaaaattttgattattcaattagtaaatgtttttacatgtaggtgaaaaacatttgcaaagaaacaaactttcccacatacacatccgtgtcagctctttgctgctgtggtcgatgaataagatggagaaaaggagccgctgtcgtcatcccttccttccttgaccggcgacgtggtcgggtccagtggcggcggagcaggaggcttgatgatgaagagtcatgtccacagatccaacacatcgtctcaacgcccaacgttgcatcctctcagg

SEQ ID NO: 27415 - DNA, 1501 bp, Oryza sativa; identical to SEQ ID NO: 21226

SEQ ID NO: 27416 - DNA, 1220 bp, Oryza sativa
gatggtacaacaaccttttgcatagctccctatgatattctttcatgtagtcctgcatggatgacaagaatgagcagtgtgagatttgtcaagtgggggttaagctgagcccttgttcaaccttgaagagcaccttttcttctttgaaacatgcatgaaatcggattcgcttgaagcaggtggcaatgctatttcaactctgtgcacatgtgtgaaaggacaaagaaaatatcatttcaatggtgattcttcttagattgaaccaaagtatcaaatcattttaaaacagaaaactcccagccagccactgagatctacaaacatcaacaggaaaaaaaaatccaaatcatctgcatctatgactcagctgcatctgccatctctgtcgccacgcgctgccctctatgacaaaaaggataacaattgacaagcaaagcatacccggaactagaagccagcaaccgactgatgcggatttctctgattttgtttacacttcagttcacctaaaaaagtcctaagcagtaagctactagttgaatggagatttctctgtttcaagacagtgtgtacttgttaacgacaaaattgctccaagcaatatttgccttcccatcaatatacaactagaagcatttttagcgatctattccaattcgaacattttgctgcaagtatcatatcaagtatcatatgattcagcacacacacacccctcacctctggtacaaacatccccagtgaatgaacaaaaatgcatagaaaaaagagagagtattagcttactttgatttcaatttggatgtgatatgacgagccccatccacaggttggggattcaacaaaccctagaaaatacaaaaatgaagagatgttaaaatcgaaatcaggaaatcgatgaaaaaggagtgataacaatccggcccaggtggggttggccgaggcccaataacttaagattggctggaccccaacagttcataggcacacccactcggggaaaggcccaatctccctaaaagactagtccaataggggaagggtgactctcccttttaaggtggcttcctcctctcaagctaagcaaggtgggattattctggccggaccccaacagttcataagcacacccactcggggaaaggcccaatctccctaaaagactagtccaataggggaagggtgactctctcttttaaggtggcttcttcctcccaagc

SEQ ID NO: 27417 - DNA, 1173 bp, Oryza sativa
ggtagaccttttctgtggactaaatatagtttgagtacgttgtacacaatgaaactgagttcagtatcatatgaaacctaaggaaatgatactgaggaggatcatgatacctcccagggttcacatgatcctactcaagtatcatatgtgaaacccataggaaaccactttacaaggcatgatactggataggatcatgtgatacttcacaggtatcaatcataatgaaacacgattctcctcaaagtttcattatgtatgatacttgtaaagtatcacatgatcctacctacccaggtatcatgatcgacgattttcctaggtaggatcatgtgtgatacttcacaagtatcacaccatcctactaaagtatcatctctgaaacctcacaaggatcatgttaccagagatgatacccaagtagaatcatgtgtgatacctgtaaagtatcacatcatcctactaagtatcatctgtgaaacccatagggattatgttagaaaacatgatacctaagtgggatcatgtgtgatacctcacatgtatcacacatgatacctaagtaggatcatgttagaagacatgatatctaagtaggatcatgtgtgatacctcacatgtattacacttaatgatactttttttattaggatcatatgtgatacctgtaaagtatcacaccattaagtagcattcgtgaaactcatagggatcatgttagaagacatgatacctaagtaggatcatgttagaagacatgatccctaagtaggatacatgatacccaagtaggattatgttagaagacaagatccctaagtaggatcatgtgtgatacctcacatgtatcacacttaatgatactttttgagtaggatcatgtgtgatacctgtaaagtatcacaccattaagtaccatctgtgaaacccatagggatcatgttagaagacatgatacctaagtaggatcatatgtgatacctcacatgtatcacttaatgatacttttttgaggagaaccatgtgatgctacaaagatatcacatgatcctacaagagtaccatgtgatcctcaagagtatcatgtgatcctactagcgtatcacatgatcctaacagagtatcatctgtgaaaaccacatgaatcatgtgctacttgtgtgaaaattttta

SEQ ID NO: 27418 - DNA, 1356 bp, Oryza sativa
taggctcaccgattgcaacccagctctcactccaatggaggagagactgaagctgagccgtgatagcacgacggaggaagtggatgctacacagtaccggcgtcttgtgggaagccttcgctacctcacccacacggctggacttggccttctccgtcggctacgtcagtcggttcatgcaacgaccgacaatggagcactagcaggctgtgaagaggatcatccgctacgttgcggggactctcgaccacggtctctactacccgaggtgtcctggcaaggcacacttcgtcgagtacagcaacagcaaccacgccggtgacatcgacaccagcaagagcacgagcgggattctcttcttcctcggcgagtgcctcgttagctggcagtcagtcaagcagcaggtggtggccctgtccagctgcgaggccgagtacatggcggcctccgccgcttcgacccaggcgctctggcttgctcgactgcttagtgatctcctcggcagagatactggagcggtggagctcagggtggatagcaagtccgctctggccctggcaaagaaccccgtttttcacgaatggagcaagcacatctgggtgaggtaccacttcatccgaagctacttggaggaagggagcatcaaggcgagctacatcaacaccaaggaccagcttgcggacctgctcaccaagcctcttgggaggattaagttcctcgagctctgcttcaggatcgggatggctcaacttccccacaagacgacgcacaagacttagagggagaatgatggataagtctttgtggtccttggtgatggaataagccttgtggtttttggtccttgtggtccctctcttgcttttaggttgtttttcccttttaggacagtatcctttcagttttgcttttagcatctttcggttttgcttttagcatctctaggacagcatctaggaccatcacctttctgctttattcagtttggatgctctctaggacagcatcacgttcaaattttagactagtgtgggcagcaattagcttgcagccatccagccagctatggctatatatatgtattcaacctctctcgggaaggtatggcttttgtgttttgtgaatgaagaaaccagaaaattgccccatctcgagtgccatcctcttctcaatgagagtaaccattgaaattctaacatctggtatcagagccacactttcctgtaggctaaatatctcctgctccactgcttcccaagctcggttgagctcttagccagcagcagcagcaccggctgctcctccttccccttctccttccccttctccacgcagcagcctcccggaggcgcgcca

SEQ ID NO: 27419 - DNA, 1501 bp, Oryza sativa
aatatgaagactgtggagggctgaaaaataaagtcaggtgcatcgactagatgcacctaataggtgtagcccccgactatatggttaattgaacaaaccaagcatatagtcaaggaataaataatccaaccaaccgagtggttttaataattatagtcaaccaagcgacctgatattaatatgtagcatatgcggtgtgaatccctgaataacatgatccgagtgatataccgactgctttgtaaaatatgatgagtgtaacctaaagttggttacatcattgaaaattcacatagcaaaacagctataaagaagcttatatattgtgaataaagaaatttccaaagtattgggcatacgccatgcgcacaccgctttaacagatgtgcttaagtccctaaaagacacatggtttcaccacacccggaaatatatggcatatgtggtataaaatccaagtaaataaactcataaaggatttaccaaccgcctgaaaaatgaccacaatatataatcagcctaagccataatattggtcaataaaaatacacacttacgtggcgaaaagcaatgatattgtatctaatcaattgcttaaaaacccaaacagcaccttgacttatatataaaaaagtcagcgggccagctatataaagctttactgtttgacaccttttaagatgcatcgtaccaactcctaaaaagttgagtaactgcggtataaaaggattttaaggtattgggcacttgatcacgcgcactttggcctaagcaaaatgtgcctaagtccctaaaagaacgtgacaggccacacctgaaaatatgggctgcagacatattaggcctaggccaaaaaatatgccttcgacaccctttaaaggatgacgcgtgtaacatgctcccgagtaataaatcttccgggtaatatagaccaagtgtagctcatatgaatagcttatgatctgaatgattatcccttatgggattctccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataattctcacgcttgagttgatgagcccctgagcatatagcttgtccttctgtcgtagtcacaatcgtccattgatggtagctgacgcagttggcatatagacaagacgaccaatatagagataatattgcccaccagaggtggtaacaatactggtggtagtgaagatagtgataccaatctaaagtaatgaagtcgcatagccatggaggcgaagaaaccagtcggcggcagacagatcaactaacaatgaagatgaaggaacccagcgataaaattgtgtagccatggcagcaaaataatcagtcggtgacagacgaggtagatcaaaggtgatgacaaaatccaccaatca

SEQ ID NO: 27420 - DNA, 1501 bp, Oryza sativa
ttgtagggcaaactgaggtccgccacatcgaagttcacccgctccgtgcggaagttggcagaaccactgaaggtgaccgggaggtcgatatgacctagcggccaggtgtgccccggcgttacaccgatgatcggctgggacggccggagcaccatccccggggccttgatggcgtcaaaggcagcaggggaaaggatgttgagggctgcacccccatctatgaggacacgccccaacttcacgttgcaaacggtgggggaaaccaccatcgcgatctgtcctccctgggcaacgcacggcgggtggtcggtctggtcgaaggtgagggcaacctccgaccaccgcgcccgccgcgtcgcctcatgggtaggggccgcggccagaagctctcgcttcatggccttgaggctccgacgagaagcgtgagcgcatgctcccccatcgacggtggcgatggtggccccaggctcctggaaccctaggtcatcgtcgccatcgtcaatgtcctcggcgggggccttctgcttggcctcacttcgccggttgccggagggagccgctggggccttgccctcaaggcgctcctgcctcctctcctcctcccacgtcctcgtccgctcagccaaacttttgaccgcgcggcagtccgcgaggtcgtggagggaggtgttgtgcacggtgcaccacttgccggtcgggcgctccctgctgggagcgccggcctccttctttttgtcgctcgtaggcctcccctttcgggtggcccgcgaagcaccctcgacggcaaggacgtgaccctcgtcgtcggaatgggccgacctcttcttcctcctcctgtcccgccgccctgaccgagcggcggatccgggggcggccgaagctgccacaccggaaccggtggagttccaggtccatgcctcctccttgcgagccacacggtccgcgagttgaaaaagctccgcagtggtctggggctccttggaggcgatcttctcgagcatgcggttgtgccgcacgccccccctgaacgcgtagatcaccgcgtgtgcagggatgcatggtatggtgttgcggacttgacaaaaccgctgaatgtacgagcgaagagactcatcgtcccctcgttgtaccgcgtgcaagtccgcttcttcacctgggcgcggatatgtgccctggaagttcatggtgaactgctggcacaaatcctcccaagagtggaccgacgcgggtggcaagttcattagccaaccccgcgcctgtcctttcagggccatggggaagaaattcgccatgaccctgtcgtcacccccggcggcctcgatcccagtcgtgtagatctggagaaactcggcggggttgacgcttccgtcgtatttttcggtgatggtgggccggaaccttgggtgccaacggacgttccgaaggctcgccacaaaggcttgacagccggcaccgccaaccggggacacggggggctggcccccgtgccccgaccgaagtg

SEQ ID NO: 27421 - DNA, 1144 bp, Oryza sativa
ttgttagtttggttatttactgaagactaatatgctctttaatccataatataaccttgagttttacaaagttgaatggccttgctttgctttgaataaataaataaacaaattcatatacacatgcacattgaatcggcaacttatttgttgtggtgcttggttttctccgtgacctcattctgttgttatccttagaagagctgcatgttagttgccatcgctccttcaccatgctcaacgctagttacatgctagcttcaccactttgccctgaaccataatttggtctaaagttattttgtttattgggatacattttattatatttttgattttttttgttaagatatactccccctgttgtcttttaaccgttgttaggacaaggacattgtctccagggcattacttttcctattttatattcataaaaatattaaagatataaactgcatggaagggattcgaatgaggtcattatcagataccaaatcttaatgttgttacacatgttaatgagttaagatttcgaggttttactgcaccacgttctagggcatcatctatttgagaacacagggaggtggaagggggaggtcagagggatgaacgaaccattatcaccaacacaaatatttatagtaacataattgataataggtatacattcttgctcttcttgagtacttgttgagggtctcagtatagtttcgcctttctcctgaacatgttggtgattttacatctagggatagcatattccaaattgcttagggttacttactaatagttaaaattacatggtaatatcaattgccatgtggctatctgatcttggttgaagagagcataacacacacagatgtcagcttacattcacttagctgaagcagattattgatgcaaggacaatggtggggaaaaagagggagttgatgaggaggattaggatctagtaccatgatatgttttgccacccacaactactcttcattctgtttgcgctaatcacactcaagttaaatgggccaggtgtagacagggctatgtatatgtcaatactattaacaccgcaaacaattaatactaggctggatggagccaaatattttaataaattgttactcccaaattttgcagg

SEQ ID NO: 27422 - DNA, 1501 bp, Oryza sativa
atatgcaataacaatgcatatcagttgacagttactgatccgactagaaaataacttgtctttgcttatatgtaaaaaaatatatttaactacagtagcaaggaaattccatttattactatataatatgtctgttttaattgcatctgtagatagaaggacgtgttatggggattggtcatccagagtatgcaagcacaatgtaccttcttggcaaggtactgttgctccttttatatttatattgctgctgtatatcgtgctctacattatagactcattaccttttgtcagtaatcttgcttgtgttaccttagtcctgttcctttcaatcagggtggtactagcagtattttgctgtttaagctattgttgtagtgtttttatattttcattattttgtgactgcaatcctgcggcatattgcctttccaaacctgcacattccagctgaggatacttctgttttgctgtttaacctatagatataactttttacttttttttttcttgtcaatgtatcagctcacattatcttcctttcttttgctacatttttctgtaagtaatcattgccttttgtcgagaaccaatcagactcctagtgaagacctgaattgtactccctccgtccaggaatatgggggattattcccaatctagcacaaattaaggaagatgaaagattgcatctaagacatccagcaatacacatcggcacattgaatgaactgcacaatgtacacctttggggattaaactattaaactttggcaggttgaatggtgtggagtagcactagtacattctctgtatttcttttattctgacgggaactggtggagtacttaatttctagtggatggcatcgattgctcctgtccttgctagcctcgggtaaacaactcttatattcctggaaataccaaggggcaaaataccctatattcctggacagagggagtagtatcatttgaacttattctgctctctaattgataccaccatcatttatgttgatttgatcataaaatttcttctactctgattttccttgtcatgtaaggttgcgagggagtagaaaaaaaagaaatatagaatagtaaaagtatatctggcctcatggtactgtttggcaaaaactacttatattagtatcctcttgtctcctagagtcatttatttgtagcgacccacctatacaaaagaactcaatcccacaattctatgctaattatgaagttggtcattatggaaagaaggaagctgtcatgaacattttcctcctgctgtcactttcttgtcagataaaataattacttcctttgttccaaaatataatcatttctaggttgtttagcaaatgctagggttaaggggaaaaattttcccttttcgtcacttcagttcaatggccaaaattttgaattatttagattccccacccaagcacctgattggctgaaaatgcatggatttctgtgtattgattcagtgtccc

SEQ ID NO: 27423 - DNA, 1501 bp, Oryza sativa
cgacgaagtgtgccttgccaggacacctcgggtagtagagaccgtggtcgagagtccccgtaacgtagcggatgatcctcttcacagcatgctgctgctccgtcgtcggtcactgcatgaaccgactgacgtagccgacggagaaggccaagtccggccgtgtgtgggtgaggtagcgaaggctccccacaagacgccggtactgtgtagcatccacctcctccgccgtgctgtcgcggctcagcttcagtctctcctccatcggagtgagagctgggttgcaatcggtgagcccagccagctcaacgacgcgcttggcgtaggcggtctgtcgaagcgtgatcccggagtcgtcctggtgcacttcgatccccaggtagaaggagagaggccccagatcactcatttggaaggtggccttcatctcctccttgaacgccgcaacctccgcatccttggtgccgatgatcaccaagtcgttgatgtagacacccaccagcaaggcatttcctccattgccccgccggtagatggccgcctcgtgcaggctttgctcgtagcccatccccttgagcgtggaatccaacttggcattccacgccctcggtgcctgccgcaagccgtagagggccttgtgcaagcgtagcaccttgccctccttgccgggaatcacaaatcccggcggctggtgcacgtagacctcctccttcaagtcgacattcagaaacaccgacttgacgtccatgtgatggacgccccagccttcatgagcaaccagcgcaagaaggagtcgcacggactccatccatgccacgggagcgcaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctctaggtcgcgaggcaccagtcccggcaccggctggtcgccgagaagatcctccatcgtacggtaccgtagctgctcgccgtcgtggtacgcgtcgatgcgctccccgtcgtgggagagcggagtagcgaactccaccgggctgcgctcaacacgagctggcgtcggagtagacgtgcttggagtggctgttggtgctggagcatgtggagtcactggctgaggtggtgtcgacgaagagctcgtcgtagtcgaagtcgtggcccgagggtgtgttggtgtcggagtcggtggagattcgggggctggggtagacacgctcggtgaagaagagctgcctactcccccagctccctcgaagtggacgtactcgacggtgaagtccaaccatcgtccaccgcc

SEQ ID NO: 27424 - DNA, 1501 bp, Oryza sativa
agcggcgccacagccgacgacgggtggcagctggagatgaggggtgggttgcggccggagacgagcggcgccgcaaccgacgaagggcagcggcaggagacgagcggacgacggtagccgacgacgagtgattgccggcggtgagcgacgggcagcagaacgaactggagctggtgacggggacgacaagcggtggccggcgagcatagatgagcggtcgccggcgcagagacaagcagcaccggcgaccacgacgagttcgatgaccaccgcgaaaaaatcgaccacaaaaaccaggtaacgtgtgtggaaaaatctttggatcatctaggacaagaagaaaagtctaaccctagtttaggctctgataccatgttatgaacagcacttttattcaccttagggcaaaaggcccaaatatatacaggtacaggaatacacaaatatacagaaaaaccctttacaaataaaggaatataaaatctaaatatacatctaacagaaagaagctcaaatataattggtaaccagaattttggtattaattggagccggttgggaacaattaccataggcaaaatgattgcccagctttacatttaggtgcaaatcagacagcgaattatttttatgaaaatgacttacagaattggtagctactttggctaagcttggcaccattagtagccctactaggctattatgccccaaaaagaacatcttaagtcatttggagcaagtaaactagtctaaaaggatatgcctactttgcactttattttatggtatctggccagaagcattgctacttaattagacttcactctaggccagatatgattacctcaaaatgcagaaccaaggcagactaggcaaggttaaccacttaattaggcttctcgaaatgcagaactaacataatcaaacttctatatcttgtaaagtaggggctatatgaagttcacccaaactgtaacgctatccagttttcttgtctccagtgccgtcaatggggacacaacagcaatgaaatattaaaatgtggacactgaccagttctcgaatgtaatttatgtaagtatggagatcaagatcttggattgttaaaaaggacatagacctctgttagaatttcaatggttactctcattgagaagaggatggcactcgagatgggacaattttctggttttcttcattcacaaaacacaaaagccatacctacccgagggaggttggatacatatatatagccatagctggctgctagcctattgctgcaccctcctagtctaaaattcgaaatttaaatgggatgctgtcctagagggcatccaaactgaataaagcataaaggaggcataaaggagatgctaactgctgctgtcctactaaccacagctgtcctagcaactgaaaaatatgctaaagggtagatgctgtcttgaaaaaggtgaaactacccaaaagcaaaaagaagaatcacgaccaaggaccacaa

SEQ ID NO: 27425 - DNA, 1501 bp, Oryza sativa
atataaataaatacacatgcagcaccttaaagctagacaagttgtggtgaagcaactgtgaagaagttgctgtatttgtgttaaccaaaggatggtgagattgtgcagaaaatattattcgccaggccatgtgcagagaaaaaaaatatagccattcagaaatcatagtactatcggagaagccaactgtttgggttaattctctcttgttctctccagaaaggtttgaattcctagactcatagttactttcagagtagaaattattttgagaacaatcatggattcacggtcaatagcaaaagtaatgaaaaatattagtgttattaagggagtatgtccctgccacttatgatttattaagtagagcaagtgtgatactagaaataaacaagacaagcatttcccttacggttaagagtattggcatacaccacagcataaacataacatatgagattgaaatttcttgaaccatacattaataagatgcatattatacctggcccatatctgcaagaaggagatcaccctccgcttcacgctccagagcaacatctacagaagaaatttaaagcactcagccaaaaaaaaaatccaacaagcaataagccaagatttccttaagagcaagtaacaaagcgaggtgctcaccaagcatggacttcgaaatatcataaccaatccagtgatggccctgctctgtcaatggctcgccactaagtccagaaccgcaccctgcaattcaaaacatagtacaaactaagcaaagtaattgtaccaaaaacaactttttttaatcaaatcaacacatcgtttgagcaggaagaagtaaaagcattaccgatgtcgagaagcaacttggggacgccatcgttgggtagcgcaagcaactcgagcgccctctcggtaatcctcgactgcaacataactaaacatgagaccaagaattcctccacacccagcaccgcgaactggcaagaagctcacctggatttcgatgatgcgagaggaggtggtgtacttgcgggcctccgactcgttgtagaatatctccggcggcgcctgcacctccggccgcggcatcctctctccccgctgcctcctcctcggcttctcccctctcctctcctcgccgccgccgcagaggtcagtggtgtgctcgcgccgcgactccccgagggttcccactacactacgcctttctactgggctcttcatgggcctccggtgtagcgagacacgtgaaatgggccgagaatcccaaaggcccaaaacaatatcccggcccagcaacggatctcctataaattctcccacgcatctagggcttcgtctcatcacaccagccgccgctgccgcctcgtcgtcccaaatcgtccgagcgccgccgccgccgccgccgccatgggtaaccatctcctccgagtcctctctttccctcgtgattccttgcttctgtagctctctaggccgtgcgatttggtgggtgattgatgtg

SEQ ID NO: 27426 - DNA, 1492 bp, Oryza sativa
acagttgagattttgagaacagtaaaaaatattgattagcaaactcacttccaatagcaatcacagcaaccataatgtactggtttcagcactaaaccccgcagacttgcagaagaaagaaactatagataacaatctatacacctctctactactgttaacaaggataaacatgccaatgctgctgtttcatggcatactatgttgatccatcaagtagatacagtcatactaacgaactcacacagatgcttcttaggctttaaccaagagtccaagactaacatgctgttcttgacaccacacttcgatagacaaaaatctactttactaacaaaagaaaaatgatctgtctaggatataaacagacacaaaaacatactcatgagcagcactgcaaaattactagacaatcgatcatgaaccactagaagtgaagctaaatcctaattatagtctccaaaaattcagttggattacaccattatgcatttgtgatttccacgcagcagttacatatatatgctaggactatacatgctctagtaagaaacacattatctgaaaaaagttaagcataaagatgagcatataatgaaattacggtcattgaacaactgcatataacaccataagctgataagcatcacacaatcaatctatatcagacaaaccacatcgtgtaacaagtaaaagatgaacacttgacgataagatcttaacaccatccatagagatatcataggtattacagtgacatcagttcaataccaaaaattgcatacttgaacaaaaaactactagggaacaaacaaaaaaagggatccatgagtattaattaatgagacgggggcaaaggagcgatctctagatctacttctcggaggagtttggcccgcgcttcttgccgaagccgacgacggcggtgacgaaacggcggttgtactgcatccgcttgtgggcgcggccccggggcttcttcttcttgtcctgcttcgccaccttcggcgtctgccccctcaccttcccggcgcgagccagcgagccgtgaaccttacctgcgatcgaggcgggcaaagcacatcaatcacccaccaaatcgcacggcctagagagctacagaagcaaggaatcacgagggaaagagaggactcggaggagatggttacccatggcggcggcggcggcggcggcgctcggacgatttgggacgacgaggcggcagcggcggctggtgtgatgagacgaagccctagatgcgtgggagaatttataggagatccgttgctgggccgggatattgttttgggcctttgggattctcggcccatttcacgtgtctcgctacaccggaggcccatgaagagcccagtagaaaggcgtagtgtagtgggaaccctcggggagtcgcggcgcgagcacaccactgacctctgcggcggcggcgaggagaggagaggggagaagccgaggaggaggcagcggggagaga

SEQ ID NO: 27427 - DNA, 208 bp, Oryza sativa
cgtgcaaaaatccattttcaacctccttgtatcagtataaatgtaaaccaaggactaaaggtaggcagcaccatgctacatgttacattcaatcgtatgaaagcacaaattacacaatcaaattgccctttttgagagaacttctacccctgcagcctcatacgcggaaattcgtgtcaaagactctcaagaacgagtatatcagatg

SEQ ID NO: 27428 - DNA, 335 bp, Oryza sativa
ccatgccattataattgggcaaagtttgagatataccatcggtatctcaatgacatgtagtatccacatgagtcaatgacatgtggatcaggatgtcatatcttaaattttacaaaattataatggcatagttccaattttcccaacaaagaatctatggatgctacgacactgacagttggggcccaatctctgctcacacatcgtcccctctccccatcccaaaccgcagctctgtcttccccaaacgacgcggaccgtataaaactccgccgcgacgccgagcacgcgcgccggctctagaagcttctagaaggcgcagctgcagcgctggc

SEQ ID NO: 27429 - DNA, 1501 bp, Oryza sativa
tacttgtttttatatgtgactgatatatgagttctattgacacgtaggcgccaccatgacatgccacgtcagcacacgaagcgggttggagccttttagacttatatgacacccaagacaagttgaggaaccaaaaatgtatttgtgacatatccgaataagtttagggaccgcccgtgcagttaaaagtaattgtaagaatgaatctagatatgtatatgtctaaatccatttatataagtagttttttttcagagggggtattaattactataaatttgcaaatttttatttgtattattttttaaaaaaattatacttcacaaaacaatatttaacagtttgagaaatgcatacactaaaaacaaggtattaactgagctaaaacactctaccaaacccagccttaatttgtacagcataattttataattagtcggatataaatcaaaattttcagttgcggtgtatgttaggtgtgctcctttagacttctgtgatagaaatctatatatctgatttgttcttattagggcacctttgaaatatgggaccatgttagagaaacagagaaatgaattgtcatgttcttttgaatactacgggattttgaaacacaggaatgtttgagctaaagcctttggatggttcacaggaaatatatcatatgaatgagagaggaagtagagacagaaagagagggtgcattggacttaggaaaagaaaacaaaaacatgagttcttacttcgtcattcctattttcctttggaatgaaggggccaggtaggaagccattcgataggattttgcctaagcctattcctccaatccaaatggccatatagaaacataatcttaagaaattcaatcatctaaaattctcatgaaaatcctccgatctaaaggagaccttaggaagagggtttgtcaaaccgatatcttttgtttttagaggctgaacctattttgaaccgacatataacatttcattattgaaaagaaagatgacaaactagctcgtttgaaacatatgaagatgaagattaaaattaagatgtcacatgtaatacgagaaaagctgtacatgattgattaagttttaattattttatttgcaacgtttgaccattcattttatttgaaaaattagtgcaaatataaaaaaagagaagtcatacttcaagtatttttgataataaagcaagtcacaaacaaaataaataataatttcaaattttttaataagacaaatgataaaaaaattataaacaaaactcaaagcgataaataatatgagacggatgtagtatattctagaatgaagggagtacaaacttcccggatgaatatattttatattttaaaacaacttttatatagaaaattttctgtttagtagtttgaaaagcttgcttatgaaaatcgaggcaagatcgtaatcttaatgaggaaaaaacaccaccgcatcttcttcgactgaaggaaaagctagccaagata

SEQ ID NO: 27430 - DNA, 1501 bp, Oryza sativa
tataacaccaaattagttttattgaatatagtattgaatataatttgataatatatttgttctgcgttcaaaatattgctatatttttctacaatacttagctaaacttaagaaaaaataactagagaaaaagtcaaagtgatttatcatataaatcggagtgagtaccatataccagtgtactcaacacagtgttcaatggaccgtatcactggctaaaagtaaaatacataaatctcaaaaaagaaaaaagaattaccatcacgccaagtgtgtttttggagcatgcatatacgagttcataccccactacacactaacacacattacactcgcacactcacaaatgtatctcctaataatgcaaatcaatagaaattgatagcaaatccctactctaactaatttttttccaggtcactaaaatttgttgaacaccaggctttgaaactttctaatctaattttcaagtttcacattctatttcggaaaccacaacgatagccgatcatattcttttgagcactaccacacaaactaaactttttccttttacagaactcttacaaacaacaatatcaaccatttaatttatcaagataaataagagcaagtttaataatatagtcaagtatcagctctgaatcacctatagtcaatttaatagctaatttatacatatttaccgataaatatatacaatacactagtaatatctgagcccacctgtcttacacacattgctcttctctttccttatttatcttatttatcttctcgatatatgtactccatctgtctcaatatattaaaacttaggaccggatgagacattttctagtactacgaatctggataggctgttagaaaatgtactatctaatcctagattttaatatattaggacggaggaggtatgtgtttacagcaagtttttagtgtgctattgtacctgctgtactaccatactcacatagtcacattacgacacgtcagaggtaagcataggcgttatttcatcggctgcttgatatgctgctgccgcctgcctgggaggcacatcgggcagtttaattaaggcaattaaggccgtgtttagattttttttttttaaaaaagatcacatcaaatgctttgacacatgtatagagtattaaatatgaaaaaaaaatcaattgcacagtttgcatgtaaattgcgagacgattttttttatctaattacaccatgatttaacaatgtgatggtacagtaaacatttactaatgatgaattaattaggcttaataaatttgggcagtatataggcgaaatctataattaatttattttgttattagtttatgtttaatactttaaatatgtgtctgtatatttaaaaattttctggccaagggacttaaacacagcctaatagttgtcctaatccatgcacgtttgcatagtacgcttccacaaggagcggaagcatcgcacggatgattgattgattaccaagatc

SEQ ID NO: 27431 - DNA, 735 bp, Oryza sativa
gtgcacatatgacaccggtctgactcataaagttgtccaccaaagccggcattcagaagcagcagcaggcatatgcgatgccatttcagattttcatatcaggcagatctcgtatttctaccagtatctatccatctcacgtatagtacgtccacacatctccatctcggcagcaatgcaagttgatcatcagtagttcatcaccaccgtcatctccaacaaccatcatcaccgatcgatcaatccaccatttctgaaaccggtagtcatgcgtcgatcgatcggacgatgatgatgaaaaggcaaatatattaagcaccagctgcctgcaaatgctcaatggatcgaatggacactcatggatcatattgtctgcacatgttccaatccatgtactgttttattctctctagctaatgctgcagtgtgctgtgactgtatgagctgatgttgttgttgttgtgtcgatgcatctatcgatcgatcgatccagacagtattcgatctacagtggcagcatcgatcgatcagtggtccatccattcccagagcaactcttcacctgctggccaggatgactagactagcctgcatcatggtgaccacaagttgagacataaatcaatcaatatagacgaaccaaaatgaaaatcaaagatcatgcttaaatcgaagaactacaatgatgactatacaagtaccaacaatcaacaagttgttaccaatgatttgtca

SEQ ID NO: 27432 - DNA, 1501 bp, Oryza sativa
atctttgagcgatactcggtgctctctactagtagtattatatactatcagtaaaaatgatatgaaccatttgttattaagggtaaatcagtaatttactaatacgattgttaggggtaactttgtcgttttgtctttttttggctagatcaatatgtggtaatccattacgctagcatcgctcatattccattgaaaaagctaaaaagaaaaggaaaaaaatgtttattcatggctaaatgatgattataccccttcacacctttttttttttgacaataatgctcctccgcgtttctactatgctaattagaggatagtataattgtataaatagatctgaactcttctatcgaataggatcaacgattcaaactgctttctattagcaatagagaatatcgtagtgggcctacaacgttttacataaacggatgatatatatgaaaacgtaattaagtagggtactgcagttatgtggactaactattcctttgaaagagttaaatttctagttattttgagagctacgtgcaaatgaattgtcatgccacagagagacgggcactaccaaccaaacaagcctcatcactgcatcaattatgttttttgtttttaactggcagcgcactgtcgacaaatggtattcgcggagtatcattgctggtttttaaactacgagtaatacctgatactccctccatttcgaaatatttgacaccgttgactttttagcatatgtttgaccattcgtcttattcaaaaacttttgcgaaatatgtaaaattatatgcctacataaaaatatatttaacgatgaatcaaatgatagaaaaagaattaataattacttaaattttatgaataagacgaacggtcaaacatgtgctaaaaagttaacggtgtcaaatatttcgaaacggagggagtatttaactagaggcaatagtggtgtcctagatttctggatttcgtaggctccaaaaaagtttgaaaaagtatttcgtattttgctaccaaatattatttccacttctaaaagaaccggcagtgatgggccagtttcgattttttttttggtggtagtgactagtgagaggctttcaagcttcctataacaaagaaaatactaccctaaccagatcgatccacttgccaatctcctatccctctctcttctagaagtgttttcttcttttttttttaacatatgcatatgaacatgattttagacaattttcttatgtcacaaataattttaaatattttcatgacatattgcatgctattataaattttgatatttaagttagttgttgtacgcaaaagttccaacctatgtaactgagataccaagattaaaataggacacaaaatttctccttgaaatataacttgtatataaagagaaacataagggggaatgttgtaataaagtgaattaatttcatcagtaatttaattaggtggtaaagtgtgtgctaagaaatagaggagtttg

SEQ ID NO: 27433 - DNA, 1501 bp, Oryza sativa
agtagatttatcatcaaataatctatcataatatataactcttttcatttaaaacatcttatttatatatatattattggtcaaagtacatctcagagaccgtgtcctagtctaaaaatacatatattttgggacgaagggagtaatatttatgtgaatttagatacatatacgaagcacatacatggatgcatgcatgtatctatttaaaacctaaaaactcttataatatgaaatggatgaagtaattaataactttatgaaactacgatgtacttttcaaggtataaatacacatcattttttaaattaaatatttgaaaaggtattgatggtcaaattaagtttctaaagtgtaacgaaatcttgttcaaaccataaaatattttatgagtattagggtgtattcatttgtttcatttcgctcttgcaactctctccatattactataagcacatttcccaaactggtaaacagtgtgtttgttaaaaaaaattttttatatagaagtttcttttaaaaaattaagtaaacatattttaagtttgtaatagttaatacttaattaattataagctaataatatttcttgtttcgcgtacagcacaaaagcaaaatatcttaatgagctttcaaacagagcctaattaagggtatattatatccatgtggagattggttaggctttatccaaacatcacagctagaacaatatgtatatatgttaagtatgtaagaaagggagcattaatttgtactctcttttttcttcaagctacaccaaaaagagaattacacgaattccctttaaaattggacaatatatatcatcgtctgatatggactcaaatcctaaacaataatatctcagtactccattatcttacgaaatccttttgtttctaacccaagaaacagaagatgtcaccatgcatgcatcaattgctagcttttccaaatatatacaatggtgctttgagaagatatgttaatttgtctaattaatcctcgtctttgtcccaccagccttttcaaataattaaacgatgaaaatttaggaaaaacaggatggaatagctcattgatatgccaagagatagagacataacaggttaaaaaaaatttctcatcagtcaaatactaactccaaattccttattgaaatgtttggccgtacgcatgactgcgactcaattagcatccgggtgtatatttaatgcttcaagttcgtttcgtctagagctaagcaagcttatctaggaaagttgtcagggacatgaaatggatggttagctttcgattcaagctaaacattatattgtactccgcgtgaggttttgcatttctggatcatgcatctcgttttctatttttgtgtgcggctacaagaaaacacatgatatttatgttatcgtatttattaaaatacataaaagaatcatacatgtatctattactccccgattctataattcttaacattttagacaaaattgatgt

SEQ ID NO: 27434 - DNA, 1501 bp, Oryza sativa
catatcccacatgtcttcgaaccagagattataggtttgctcttcctcaacccgtcctaaccctctatttccaaccaaacacatagggatgaggtaggatggttggactcattctatttttttaataggatgattcggtctgtccgtttgacatgagagatgggatgtgatggttcagtttttagaggatgtctcacatgtcagcgagactgaaaagtgggctggattggtccgccactttttaaggaaccagcccggatcttagggaaatatttcttttcagggatcatctcatcccacctatttttagaccaagcaccttaaaaagtgggttcgacccaacccaacctatttcatcccttaaaccaaacaaatgcacgcacatgctacagctaccatcgacgatataggcacgtttcacatggagagggctcctctaagacttgggtcgctgacatatggtcccacaagctatggggtccaaatgttagcccccaaaatcagagggcagtaagttagaggatcactttcctgtttcacacatacgtttggtacatgatcatggacaccttattaattaaatagttagcatgttcttcccgtgtattgcttgctaccatcaaaaattatgaatttaattagaaaataccatcgtatatattattgaaatgtggatgtatatgccccacatgtcattcttgtatgtcatggtattttacgtatccatatgatgttatttcttaaacttttcgatctctcataaatactcccttcatcctaaaatgtttgacgccgttgactttttttttaaatgtttgaccattcgtctaatttaaaaaatttaagtaattattaattcttttcctatcatttgatttattgttaaatatatttttatgtatatatatagtttaacacattccacaaaaatttttgaataatatgaaaggtcaaatatttaaaaaaagttaacggcgtttaaacatttagagaagagggagcatatgtcaacgtacatctcttttaagccaaaatctgcagatcatcaactggtgcgttattgctagctcatatttcgttttaaaaaaatctggatgcagatttcacgtgctcgttttagtatttcttttcaaaaataaaaatttttattaattcaaatggtttccccgtaaccattgtgattaattcgtgattagttcgccggagtactagttttgcacatgcgcattattattgttcattactaaggcccggtttagttttttttttcacatcggatatacggatacacattttaagtattaaacgtagtctaataattaaataaattacagatcgattcagccaggaaactgcgagacgaatttattaatcttaattaacccgtcattagtaaatgtttactgtagcaccacgttatcaaatcatgacataattaggcttaaaaagattcgtctcgcaatttccatcagaactgtgtaattggttttttttcgtccac

SEQ ID NO: 27435 - DNA, 218 bp, Oryza sativa
ggaggaatgtagagtagatagtccctaataatagcatttaatttatcgttgtaatagagtggatcatacatcacttttcacttgtcaatattggaacgtaaatacaacatcacctttcttgtagtgaatcacagctaaaaagagtaccacctttctcctccgcttccttgaaaggaaacaagtgagagaaagaaaaattgaacttatagcaagcaaga

SEQ ID NO: 27436 - DNA, 1501 bp, Oryza sativa
cagagccaaactcagcttctccttccacgagcaggctctgctctgtttcgcttcctatcttgaagaagagatcagcacctgcggcctgagggcagcaaccatggccggggacgcttccgcgaaaattaatcgatctgcggctgcgccgtacgttttcaccaggtgggatctttgacttccttcccacctgagctgagctttgaatccaagaaacgggctacacaggataagcccaagaacaaccaatcccaaccaaatcaagaaacgcaaccaagcagagcagcagatcaagaaacgctagaaacttgagccaaaaataaaaaatagaaacactagaacaaggaatcgatggagcgagcgtggtgaaagctccagcgcgagcgcgagagcttataaaggaggaggaggaagaggcgtgggggggagtcagccatggcggggggccgtcgcttgcactgagagcaacattcgccccgcgtccgtggcgtgcgtcgcggtgcgcttggcctttttcgcggatagccccttggggaccccggatattccacaagggagcttttttttctttcttttgttgacgtggaggactggataaggaggggtagtactgaatatactatgctctattaattgcccttcttcaatgtgctggggggtatgtcaggttaggtgtggcatttcactcgtaatatgtctctgaatctaatatgggcaatggatttatttaggtatgggtcttgataaaaactggctaattggaaattctgatatatctttagataattagatctagattaataaatatagatcaattgtatattgcggtcaatctgtaaatactttggagtctaggtaaacacataaacaacagcgatcatatacgtgcccgctagcgatcccgggtaagccgggccttggaccactcttttcacacaaataagtgagatgtagaatctccatcgtttatcgattaagagtgtagtacggaactcatatatgcgttatgaatctattccctcaaaaaaatatggattaggaattaagatgtatatattttaaaggtgaatttgttgcatacttatttatttatttagttatttgtgatacaaaactttatttttggtatttggtagattttgtgccataaaatttgtatataattttttaatcacctaaaatttattgctaaataggcctaaaattgcagtgctatgtaagtatgatttgtgctgcaattttcttgttgtgtatggttttaattttttattagtcacgtttattatctaaattttatgaatttagattagaataatttgttgttcaatattttaacaaaaaaagggttttgtttaaataagtaatagggagactgatgagacctattagattgtcatccaggtgataagaaagtgaatgtattttcattcttctgaaatctagacactcccttattttgtcatatttatactttttttatgtataattcattgtttttgttgaa

SEQ ID NO: 27437 - DNA, 743 bp, Oryza sativa
ctgcagcccttcttccctgcgcctctgtgcagcgtttgcgtttctgttttttttttcttttttgattgctgtcatgtgattgtgatcctgtgggctgctagtatgtgaaattcagagcttcaggttgccgcccactgtcagactgacagtcagaaacgttgcaccgttgggcgttgacgtgcatttggaatgaaaacggccgggaaataccattttcgtaactatatttttctccgtcatcgaaaatgtaaagctggaaacaaaaaccgtatcatataactacacgaacaaaaaaaacatgctggtatcaactgggaacaggtaattgttaatgtataacatatttaattcaatgttacactatataaattattagtacaaactatgtatatatgtctattttatgtccttaaattagatatttagttagaagttaatacatcactaaactatgagctaaatagagacatgttaaaaaattataagaatatttagaaatacggttcccactagaataccataacgataacgatcagtacaacatgaaaaccatttatttccatagtttttactatcttagttaaacttttttttaaacgaaccgtagcgagatctcatactaatcaggttgaaaatcagaaacgagggtcgaccggttcggcctgggagacgcgttggcgctaggcatgcatgagatgcggcagccaggatttgtcagccgcccagccggccggcgcgcgcga

SEQ ID NO: 27438 - DNA, 1501 bp, Oryza sativa
gggagtgtctagatttcagaagaatgaaaatacattcactttcttatcacctggatgacaatctaataggtctcatcagtctccctattacttatttaaacaaaaccctttttttgttaaaatattgaacaacaaattattctaatctaaattcataaaatttagataataaacgtgactaataaaaaattaaaaccatacacaacaagaaaattgcagcacaaatcatacttacatagcactgcaattttaggcctatttagcaataaattttaggtgattaaaaaattatatacaaattttatggcacaaaatctaccaaataccaaaaataaagttttgtatcacaaataactaaataaataaataagtatgcaacaaattcacctttaaaatatatacatcttaattcctaatccatatttttttgagggaatagattcataacgcatatatgagttccgtactacactcttaatcgataaacgatggagattctacatctcacttatttgtgtgaaaagagtggtccaaggcccggcttacccgggatcgctagcgggcacgtatatgatcgctgttgtttatgtgtttacctagactccaaagtatttacagattgaccgcaatatacaattgatctatatttattaatctagatctaattatctaaagatatatcagaatttccaattagccagtttttatcaagacccatacctaaataaatccattgcccatattagattcagagacatattacgagtgaaatgccacacctaacctgacataccccccagcacattgaagaagggcaattaatagagcatagtatattcagtactacccctccttatccagtcctccacgtcaacaaaagaaagaaaaaaaagctcccttgtggaatatccggggtccccaaggggctatccgcgaaaaaggccaagcgcaccgcgacgcacgccacggacgcggggcgaatgttgctctcagtgcaagcgacggccccccgccatggctgactcccccccacgcctcttcctcctcctcctttataagctctcgcgctcgcgctggagctttcaccacgctcgctccatcgattccttgttctagtgtttctattttttatttttggctcaagtttctagcgtttcttgatctgctgctctgcttggttgcgtttcttgatttggttgggattggttgttcttgggcttatcctgtgtagcccgtttcttggattcaaagctcagctcaggtgggaaggaagtcaaagatcccacctggtgaaaacgtacggcgcagccgcagatcgattaattttcgcggaagcgtccccggccatggttgctgccctcaggccgcaggtgctgatctcttcttcaagataggaagcgaaacagagcagagcctgctcgtggaaggagaagctgagtttggctctgcagctgagactatccatctgcgacgaggaggaagaagaaggagctagcgagga

SEQ ID NO: 27439 - DNA, 415 bp, Oryza sativa
cctggtattcactcttcagaattaagtttaacaattagattgtgtaatcataattgccatgtatcaacaattcaatattagttggaagttggttttactgtgatttggaaatcccatgaattgaataggcctgaagttattggccgtgtttagtttcccccctattcctaactttccatcacatcatatctcatcaaaaacttttctacacacataaacttttaattttttttacaaactcccaactttcttcaaacttctaacttttttcaagaattaaatacacccatcataaggtaggaagcgagaacaaaataaatactgtagtaagtatacgtgttatgctcacttttgtagcagtacctttttttcccttttggcacttgaaagcaaccttttcaatactaaaaagata

SEQ ID NO: 27440 - DNA, 1041 bp, Oryza sativa
ttctcatttctgaccacacaagaaagcaaacaaacttcctgttcttatgtactttctattgacttctctctcgattgttcacctaatcttgtgttttagttcgctttgttctcttcatgacaattaacactatttttattattagtccattaactaactagaccagtgattgattaacgacagggtcaatttcagggtcagttaatacatagtttttgaggcatgttgttttaccaagttcttggatctggtgtttgtttttggcttctaggggttttctgatctgtgccaaaagggtcactgattacgtgtcatttatttgctgaagaaacaaggtgttttgggttctttggtatatctcacctttttcagtttgttggtgtctgggattctaaagctgcttttggttagttaaactctgtggctaaggtggatgcatggaaagtagatcacatcaacacattcttgagagttcttcctagatatgatttttggatataatagtttgttatcatcataaaaaggagagagaagagagagaaggaccttcaattagaggatatgtttttcttttcttaatatttacagcagtcattatgtaatgttcacaagcctttcttttttctttataatattgtaaaccagtaagaggtatcatagaataaacagcactggacaaatttggaaggacaggctgcaattagaaaaaatgatcgctcttttctattttatttatttatttattttgcaaccaaaggagtaaggacaaccatgacctaccagctctcaaaagctggcttggttcagttggttcaccatgatgtcacaatggaatctttaattttttgcattaacatgcatgattgtaccctagaacgttaaacaaatactcagagcagaaccacacacgtaatgtcaaaacaccgcaaaacaaaaacgaaaaaaaaaatcaacaagaacaatgtacaatttgatcatattggcttcgtactattccatccatttcttattacaagacgttttattttttttcctaaagct

SEQ ID NO: 27441 - DNA, 712 bp, Oryza sativa
gcgagggatctcgtttacgctggttttgtaagttgagggatgtgttgtatccggttttgtggttcaaggacgattttgtaaggtgacaagatgagggacctccagtgtaccttttcattttggtgcacatatgtgattcgggcctgtttgtttttaacttattcaccgagttattgaaatgatttatttgtttcgtgcataaaatctatagcaataattcacttaataatgtaaattaagcgggcctcaattgtttggcttcgtcgtttgtcaaaatagagaaccatgcgaaaacacccaagattgaactaaaattgacgaaaaaaatgcaagatcggaaaactgtttggttaagtcgatagatcggttttccataattaattttacgcccacccctatgaactagtggcgattttttttagaaagagtgtgctttactcacaagaaacatggctattacaatctttgagaataaggccttgtatgcaagtggaaacatactcccatcatgccgcacaatgttttcttctactagccagccgtgctaactcatgagctatcctattgcaacatctttctaacatgacgaatcttcacctctactagcaactcctctgtactttgcatctcggcgatagtataacaccattaggattgattctcttagtgcggctttagtgcattaactacaaacatgcaatttgtttctagc

SEQ ID NO: 27442 - DNA, 469 bp, Oryza sativa
tgtgtgcttctgcaatatggcatgcatgaagattgcaattaacatttgtgacgatgaccgcctcgcaaattgttaactgtttatttgttttcttatgatattattcccccaaaaagattgtttccgaatcatgtattgctgcaatatgtcacttctatagaatcgcaccaataggttgttcttcaacatttatttactaacattttattcacgtgtattgccgtgactctttgtttacttctgttcttttggatccattatgatgcttatgttgcccgtcatttggtttgaaattcatatttgatgatctgatatttgtttagctttattggctttgttggagttcttgaaattttcttatatcaatgctgcttttttgcgttgttcaatttcttgtgtggatatatttcttcaggtgcttcaattttttattatatgtatattgtgccaatgtgacttgataatttct

SEQ ID NO: 27443 - DNA, 1501 bp, Oryza sativa
tgaaaaatgtgtcactcaaggaacatttgcattagagatttccaacggatacacgaagtgtatacacacggacagccaacaaaaacagtttctagtgcaaacaagtatcttcattcattagatgaaaaaataggaaatatacttgggtctaacctgtcttcgggtgtatgcaaaagggtgctttcagcaaatgattcatgtgcttagaaacctgatatgcaccagaatgtcgaataggaatcagaaaatgaatttatgacttgctgcaaacatgtgctgttgatcgttttgcttttacctccatatcaagtctaggatatgtgtatgagaagacaatctcttctatacatcttcgaagcccctgtggaagaaacatgaaaaaaaaaacatcattgtgcattcaacaaaatagaatgaaaattagcaaccaatcccacatgtaacattgtgatgaaacctcgagaatacaatactcgatatgattaaaactgatacaccagtaaatgtgcaaataaaattaagtaggattgcgagagattatgcatggaccttgtgttttcctgactgcaaggttgactttagttgctcccacctggtagcatttacatcttcctttgaaatagaagatcgtctgtttccttgccacttatcatggagctcactagcaacatctagaaatgacacacactttacaatgattgaagacattcaagacttgacaaatgagaaatggtttgatagcaggatgatactaaaatatattgttctagttaaggtttgcattcttactttcatcagggataagatcaagtattttctgatatctctcctcagatgcaaatagttgttggctaagtagtagcttatcttcaaagaagcctttcagaacatcagtgtatgaccgtctgtaggaaaatagagtttcattacagcctatttggctatatttcaatttgtactgataaaacatatacaatttcaacttatgattgaaaaacaaggaactgagatcattcagacatacgcaaggaaaggatggagaacagctccagtcaatgaaactttcttcatcgtattttcaccaccctgcaaaagatccatacaggaagatttcagcaacaaaacgacatctaggatcatgaataaaggaataccaccttgtagacgcgaaaataatcagcaattgcagccctttgttcgttgttgagcctaacaggaaagtaccagagcattttaggatcaccaaactaaatggagaaatgaaaaagggaaaaacatcatgcatactttcttgctctactatcacaaacccagcaatggacaccacgacgaccactatatacccacaatatgtgattgaaaccaaaatcatctgtaaacacatactttcaattgttacaagtcaaactaaccaagaaaatagttgactaaagatctgcaattcaagtcaattaaactgaaataaaagcgagtgtttgcatgtgtgtttaattaattgcat

SEQ ID NO: 27444 - DNA, 1501 bp, Oryza sativa
cgacgccgcccaaggcaccatgcccactggatttgtgcgtgacgaggccaagggaggcaaatctggtggcgtcgcgcccctccgccgcccggcggcacatgtcccgtgctccttcaccgctaggagtgcttcgagcaagaataggggtggaggagtgctcgcgacaagaagtctacgaaaaggcaccgacaccggcgagaggtggcaagaagtgctgtaacgcatgtctttcaggctctcatcactcacctctcgtctcgctagcaatgtcacaccaaatcctcaacacctcagcacacattcaccaccgcgccctgcatcggcgacttgccagtcacggccaagccttccaggatgttagcagggaaaatcaccattggcctcttcggcgacgaggtccccgccggtgcgtcccggctcctgtcgcttggtgtcggctagttaagatagtgtggggctacatgcaagcaggacggtgtggtgtcacacccggccatcccggcgctgaccgaccggctagcggcgaagatggacgccgcacgcgcgcgcaatgcgatggggacaggagtggcgtccacccaactcccacggcatatggtgacggccggcgaggcagcggcggctgaacaactgagcttctagcttccgtcgaggaagaagcgaccgaacgggagagggagagagagaggaggaagagagaagcgaggaaaaagaaaaaaaaacaaataagtgccacgtaggacatgtggggttattgttttttcttttcactgacatgcgggtcccctaagtgccacataggatgaaaccgctatcaaacagccgagggactcaatctgctctggttttcaaagatggaggagacgttatacccggtattgcgattgagggaggttatttaatcaggggcaagagttgagggaggcaatttatacttattccttacaaggcagggtccgacatttccagcccaaaagaatcggacccatttattcggcccaatctggcccatgctcggggcctagtttttccaggtaaagttgaccaaaagtcttcacctagtcgtcgtcttccctcggccggcctgaccatgaaaataaacgctacccaacgactccgcagtcacctcaccacacgtcgatggacacggcgcaccagtgaaccccctcggccccaccaaccaccaccaccatcaacatcctaccttacctctctctggcaaccgggtcccacctaaggtccacgctacacccggtccaccaacacccgtgggccccaccgctctctcgtcgtcgcaccgaccccaaccgaagcggtaacaaagccaacgtcccaccaccaccacacgcgcgcgctcgcacagacacacacacagcacagcggagaaagagagagagagagagagaaaggaaaaatcggcaccaccgcgaaagggggaaaaggggggaaggaagcgaggcgaggctagggtttcgattcgatcccgccgctgccatggacg

SEQ ID NO: 27445 - DNA, 1133 bp, Oryza sativa
cttctttcactataaaatataagaatctaatactctcactattataaatctaaatagagattctatctaaatttataatattaaaatgtgtaagttatattatattaagatggagaaaatagagtccacacaagtaccaagcctacacacaactacttccttttgagtttttacttgcactgtttgatcactcgtattattcttaaaaaaaagttaaaattattattaattttttttgacttactttattatctaaagtaattaaagtacaacttttcgttttttatatttacataaaaaaatttaataagacgagacggagggagtaaacgagtacacgacacagcatatatccatgtccatgtcttcccacggaaactggcactgttgagctctgaaagccgagctcaacacgccacgccattaacaccacacccccccgctcataaatgaaaaccgcgcgaaccagaaccacccctccctccctcctccatcaatgaacctctccaccccaccccgcgacgcgacgcgacgagccgtacaccgaccgccccgcgccgctgctgccggagccggagagagaagctgaagccgaagcagaggcagccgcagcggcaaaactcaaaagacgtcgtcaaaagctctgccgcgcttgcagctttctcgggctcaaggaaaagccatcacaaaaccagagacacagagagagagagagagaaactgaagaaaggtggcaactcctgcagcagctgcagcagcaaggtatgggcagctcatgaccagcaacagcagcagcagcgtccaatttctcgtggcgctcgctcgccatttctggagtacttaaggagttcttggttttgttcgttcgtccggtagcgctagtgtttgtggtttgctggtgctgtggcgaggcgatgatggatgggcgaggaagccaggaggaggagcacctggatttgatcatgcgacaccacgccagcatggggctggatcgctgcgagagcgaggttggcgtgcggtgtccgcgtttgattcgatcggatgctggtggtgatttggcggtttgatttggtgtttggttctttttaggaggcgctggggtcgtcggagtcggagcagcccaccaggccggc

SEQ ID NO: 27446 - DNA, 1501 bp, Oryza sativa
gattagctataagtgctacagtaacccacatgtgctaatgacggattaattaggctcaaaagattcgtctcgcggtttccaggcgagttatgaaattagttttttcattcgtgttcgaaaagcccttccgacatccggtcaaacatccgatgtgacacccaaaaattttctttttacgaactaaacaaaccctcactattcatttctaacaaaggaaataaactcctagtgaaaccatacaacaacaaaagatgtgattgatatgaaactgaggcattaccatgacgattatattctagggcctctattgacgtgcataccgcttgatagaccggttatcctcttcaactgccacaatgaaaacacaaagttgagaggtttattgctgagccgtagattttgatgtgagcttcatccgacttagcaaataatttctatagaatttactgttaaatatgagaaacactaacttcaatcatgttaacccaaacgacaaaccctctactttaatcgtaaaagaagtaggatagtgacaattgagctgttgtttatgagtgcgtatcctctaccataatatcaactaccattacggttactagtatatgggtctcacccttctattaccccacacataagggcatccacaatgtgccataagaatgaaccataagaccttatgactagtcatatacattatgtgctttagtcataagacataaatgctaaaaataaccataagcttatggctcaaccttaagaaataaaataatgagataaaacacagatacacattaaagaggatgagaatagattatggtatggtgggacctaccttgaagtagaatttgtttacataaatgtgggacccacttaacatatattcttgcctttcttgccttgaacattgtggacatagggtatggagacataccttatttccaccatggtaatggtagtgccattatggtccatcttgataacggtagtgacattatggaagaggatatgaacccattacttactagtcctaaccaattcataccagaggggattgaggaagagatggcatgtgcacgcttcaggagaggtagcagtgaagctggaggcaaagaactcgtctagccttccagccgtaacagttgtgtgcattcgctagctttttttttctctagctctcttggcatgtagtactagatcaattggccacactggctattcaataaatacaaaacaaagcagtatcacataccattgggattacaatacagttgtacaacacttcctattattacattacattgatcaaataaaatagagagaacctaatacattgcgagtagctctcctctcttcatatatgcacaaagccactcaaggaacacaatgtcctcatttattcgacgtggaaggttgggacacaaacacctttctcctctactcagctggttcctgttgccctctcggcaaatgcaggaaggcagacatacattatacgtacgtg

SEQ ID NO: 27447 - DNA, 640 bp, Oryza sativa
tcttcttctcgaatgaaccaggaactggtgctccatctctgtttttgtactcacccaagccaggctaggtcaagattgttcttagattcagtgctgcataagagaagatcctttgataaccagtttttgtcagttcttgatggaattgctgttcattattcagatttcagaacccatggtatgaacaacttaagacaaaaatgtgtctgtgtgaccatatccacttcttgggaaaaagcattggtatttaccgtgggttaccctccacacaaacatataaccacatgtcctcatggattagctgctttttagcttggatacttaattttagccaacactggctgcctcaagaaactactatgctaattataaacctcttccatttccatctttctgtttctgattcattaaatcttagccattttccatcagatgctttgatcccttctccctttctctgcatatatcattgtagattgtccttgtaccgatggggccatcctctttctctgaggatcatcatgccttgaggagaagcattgctgaatcctcttggcggcccccttgcttatcacacacaaaattcggccacaccaacaaaatcggcctaaagcatgacaatttgcacctcataaccaga

SEQ ID NO: 27448 - DNA, 585 bp, Oryza sativa
gaaaattgtcagaaactaatgaatataaagctaactaggcgctttaagatatttaatataacatcctgcacaatctgcacggctgagtgagttcccattgtgtccatgctttttattgagatctctgaaccatcaaaagaacaaattccattgctgacaattggttgattgcattgtcacttagcacctcacatggtttaaggagaatgcaaattcttagatgtgccatgagaattttagttgaaccttcagaaatgatttttttttgctgcagcttaatgtcctattagatagccatagatgattattcactgtcaaatgttgattaaatatctgtgataatttttcagagctgaaccatctctgtcggagaaggatcagaaggagagggctcaaaggagtaaatttgtccgtgggcttgtgctctcgacgatatttgaggatgataacttgtaagggaggttatcaaccttaatatagcgacggcatggcatggtcaaggaacagaaaatacaggagaacaatctatgcaatgcagcaaccttgttcatgccgtcgctaatgctgcttccagccttcaaggcc

SEQ ID NO: 27449 - DNA, 373 bp, Oryza sativa
aaacaactaagtgagtgcttctcaaacgacacggatgagacagtgcgtctcgtccggtcggagtatgtgcaatgtatcagtctttagaatttaaacaaggttggcacccggccaacagctttttcaacggccacccgggccaacaactttcaaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctattcgaacagtttgttaacctctgcagagggggtacactttacccaca

SEQ ID NO: 27450 - DNA, 1501 bp, Oryza sativa
ggtttactttcatcacacttaaaaacatcaaaattaactcttaaggtggtgtttctatcaataattgaaatggtgctaaatctatgacctaaaaacttccaggagaaggaggacggcggtcgaggccgcttcaagtcgcacacaaacgcgcccgctcgcatatccgacagggagaagaaagctcctctgaagacctgaatgtggacatgaaaccgcagttttgtcggctgtgccaacatcaaaatagagctacttttttgcctggagctggttgagctgtgcgctacttttttcaatgtggagccctgttttgtgccttcagaagggccatacttgagtactcgcctggttccgttcctcctgtatctctctgcagaacacacctttgcagtgcaactatgaacatcattgtgtatctgtgcaccattgcaaatacgggcggcaaatggatgtgctgcgcttgtgttagaatgtggtgataatgtccaatatccaatgtggacgaagatgctcactgcagtgcaaccatgaactaataaatgcatatatgaggagcatggcacaagctcaaatctggaccgttaattcaaaacggatgatgcgtcttataaagtgagtataaggcttgtactgaacatgaaagatagaaaaacagttcaaatttagatggtattgccaccgtcctttggtcggctccgattggtggcaatatgttgaattgaaacgaccggaaatgaagctactttgcaagctgcaacattattcactgaaaaacagtgatatggccaaagacagatagtaattggattataaaatgttacggcccgttcttttctccaacaagagttggatgaagattaagattttttggcacgcttttcaaactactaaacggtgtgtttcgtgcgaaaaaattctatatgaaagttgctctaaaatatcatattaatttattttttaagtatgtaataattaaaactcaatcaatcaaatgttaataccacatcgttttacgtaaaaaaacttaatattcatcttcaggagaaaagaaaaaaaaaagaacaccgtagaaagtgatatgccaaaatgtagcgagtaatactcccttcatttcatatcgtaaactttttgacggttcatccattgatcaatgtatacgtttcctatatgtgtttatattcattaacatatttataaatttgtgtaatgctagaaaatcttgcacagtagaacggaggaagcatatcggatcataataaactgtgtacgcaatcgcaccacttagccatctgatcatagggtagctaatcttcccaattgtctacttatattataaagtaattgtataagaggggagtttaagcactttaaaatttaataaaaaaaattctctaagccttatcatttgctatatagtaaacaatgtaaaaatgtttatattatactccaaattataaaagcagtttttacattgttttatgttgagaagtatagacacgag

SEQ ID NO: 27451 - DNA, 478 bp, Oryza sativa
ataagacctgcagcgggtttggtggcgaaggacgggcagcggtggtgccggacggcgactgcggcggatcggcggacggggtagagaggaaagcggaggcggactacgtctgagagcgagccaagcttatcgccggcggcatcatggcctccctccccccgcctcggctcctccgctccttcgctgtctctctcctccgatttttaatctactactgtttgcccccacactttccgccttccaaactcgtttacgtaaaataaaattacgccttattagggtgtagcccacggcccacctttccgtcttcgaaaagagtttacgttaaattaaagtgcgccttgtgaactgggccgcaacctaacaagcaatggattcccgagggcaaccaaaaaagggaaagaaggggtgggagaccgggcgccgccccggcggcggtggatatcgatagcgcgcgccggggggctctaccggtcgt

SEQ ID NO: 27452 - DNA, 819 bp, Oryza sativa
ttatcacaaattttacttttagataatgaaataaaaaatatatttatttttttaaaaaaagtcataaaaattgaggagcatttatacaaaaataggactaccaacgctcacaatatttttcttatgaatgttcccgatcaaaaaattccattgtcatattaaaatttcaaataaatattttaatttattacattttttttatttttaaacttatgtcaaaattttctgcagtaatcatttagtcacattagtttcataaaatgcacatattgtgcactcaaacaaaattttcaatcgtttttcaagtttatattcaaacttaaagcatcaagggcaaaaaagacatttgcaaccaaacataataatgaaatgaaggaaaatgtaatggtaggggcatggaagggatcaaattgaaatttgaagggtatagaagggatcttataaattttaggggtatgaaatggattgagtgagttttcagggtacacagggaatttactcttattactacctccgataagaataagttaatctagtacatgatgtgacatatcctacttacatatcatgttgtacacgtatgaataaaaactcttattaggttgcatgccttgaagaagtagggatgtgaaaattagagtttaatcctattgaatttagtggattgtaggttgcatttagacatttcttgttaattcggtctattcggttaactgaggagactaaccgaattgaccaaacaaaattcggtctcagtctcgatcttttcggttcagtcttttttttacccacccctaggaacaatggtggctcatgaag

SEQ ID NO: 27453 - DNA, 1030 bp, Oryza sativa
acgatactattgtgtgctgatgtgagtcaagttggtgcaaacttatactagaatatggagtttctttgttgctcatgggcaggtgttgcttgaggctatgggaatatagctggtgatggatcaggactaggcttaggagaagttaaggttcagacggtcaaggatatcatgtgggatgctcaggctagagaacaatgcacgtggaggtgaaggttggagtctaagtttggaaagattggcaatgtggagttgtacggggatgttgtttcccaagtcttataggttcctacgtgattagagtcctagttttcgttggattcgtggctaggggaaaccacgtttgtgggtgtaaatatatgatggattaaagctagaagatatcgactttttggaagagaaaaattaagattttctttgaggtttcaatcatagttcatgagttgagagaggagtgctttagatgcactttgtaaacacatatcgatgcaataaagttgatctactttcaagagtttcatcgatacatgtttttctagatcagacggtttgaccggagttcataggacggtctaaccggaggcatggcgatggtctaaccggtggcgaggaaccggtcagaccggtggcgaggaaccggtcagaccggtggcggcgagaaggtagcagagggaggctgcggtccgattggccggataacatcggtcagactgacggcttaggggaggtcagacctgtgtgcacatggaggtcagatcgcctacgcctacgacttcgtcaagtttgaaggtaacttttatttccatagaaagtttttggtattcctaccattcaccctcttatggtaggtttgttcggtcttgttcgatctttgaagtacatgatacaatatgatatgtaagttgatatgcatgcatgatatctaactttgtcaaatttttcaatcaatcttctatatataagaaacaagggcacattacaaaatgaaaaacaatgtgtcaaatatcactgttggagaaagggtttttaaccc

SEQ ID NO: 27454 - DNA, 1501 bp, Oryza sativa
agtaagttgaatattagaatcctaagagaacttcggcgaggaaggaaaataaccaaagagtctcttattaataggaaaatatatagtattggtggttaagtaggtaaagtattgaaggataaaattaaacttcttgatttatggaccaagcatggtagaagaatactatgtataaattaaagatacaataaatttcattaaacacacctattatagtccaagttgcacaaaaccacaggtatcttgacatgtggcacaaactataggtattatatactcctaaagtttcacaaaccacaccgttaactattttgacatactattgtattgaaataaaaaaatgaatgtaacatttatataatgaataaaatgctcataaatttgagatgtgattgtagaactgaaaagtgtacatggtataccaaactcaaaattattagtaatgtggttttgtaaaacgttataaccataatacttgaggttatgtgtcatcggccaaagtttatacggctttaagaaacttggaccatataatagtttggattctataaaatttactcttaggccttgttcggttacacaaggattcaatccgggccgagaatgacaagtatagtaagaaatttaggatatatacaacgatttaccgagatttattccgggccgggaaccaatttactcatgatagggacaataatagaccggaatcaatccactagtcaagaggtgtggaactaatccggatgttttgttatacctaatataagtaaattagttcctgacccggaataaatattcctggtctcttgttgtatctattataaatttcttgttatatttatcataaccggcccggaatgaatccctgtgtaaccgaacaagggcctgaaggttgttttgggacaaaagtttaaactctaattgggaattaagtttagttacacactgaacatggtaacaagctgagatggagtgaagtggtagccggttgcattccacacgcacttccagttccactgatggacaggtggagttgaagttgaccggacgatgggagaatgcatgccgcatgcacacactgatactgatataccgccacgtcaattccagccaccaacccatctatccctaccttcgtccgtttctgcgccccatatatcatctctctctctctcgatctctccccccgctatttataccaccgcaagctcaatcaatcgctcgcctctcgcacactcccatcctcgatcgactcgtcgcgtctcacttttcttcttaatttccatttcgtatcgcgtcgatcgatcgatcgatcgtgcccctagctctagctatagctagcaaagcaaaatatacatggcgtcgccggcgaggacgggagaggccgccgtcgtggtggtcggcgtggccgagcaggaggcggcggtagtagagcagcagcgggaggaggaggagcaggcggcggcggtgggcgcggcggcggtgctgctgccggtgggga

SEQ ID NO: 27455 - DNA, 289 bp, Oryza sativa
tgcgttgacatcaagtggtgcagtaatatattcaaatgtctgaagtaacattatgaaaacatcatgcatcatcatttgatgctaatcatgtttcttaaacatctactagctgcaccatcatgacatcaagttgtgcatacatatattcaaatttctgaagtagcaatatagatccatccaaaaaaaaagtacttgcattatataaacatcatgcatcatcatttggtgctaatcatgccttttaaaaatctactctagtgtcatcatcatgaataacaccaatgccagg

SEQ ID NO: 27456 - DNA, 1501 bp, Oryza sativa
cgcctggccctccgcggcgcccctccttgtgcgcccggcggccgcccggccctccgcggcgcccctccttgtgcacccggcctcctcctcgcgcgcccggccgccacccggccggccggccctccgccgccggttgcccgacgtcctcatcgtgtgctcgctcccagccactgctacgctgagaaacatataggggaaagagataaggagttagagtaaggaaagcgataaggatagttagaggaaaaagagatagaggagagaggagtttgcgaggacgatagaagaggataagtattagggattatatagagcgttttgatttttattcccggttagtaataccaattgggactaaagttaggggaataaaaatctcgggcgccctgacacggcttgacatggaatcaaccgggactaaaaatcacatagtcccattatgcttttaaaccgggactaaaaatgctttctagtcccagatttttaagtaaccgggattgttgtggtttttgggcaaccgaccaaagatggtttctccagtagtgtatgaaacataaattggttaagagtagtgcataaaaaagtgaaggcgcaaagatcacatgatgaatggatgcaagctattccaagatagcagcgcttaaagcaatggctggtatgcaaattaatcaatttacacccatctaattcacactaacatgagcgtgcatgtaatgatcgaagaaactgatcaaattatagtatgttgggaatgataatttgaatattcgactgatggatcaatgtatgatatacactaagtaatgcatccgcacttcatcgtcatcaaatgataaatacaacagagcaaaaatgacccattttagttttgttctgtcccgggccaccaaaacctcaggacggccctatgcatatagatgcacgaatgcgagtgagttcttattccttcagtaacctaagctagctactagttcacttgatgatattgaaatcatggtacctagctagtaactcgttattactagctcctataataatgtataagtatgtatattaattatttctctatgccatttcattaattaattttgttgtccgtctatatctccggatcatcgtcgccggcggccttgtgcctctcctgcttcactcctgccgccttcagctgcagctcctgtccttttccccacaggaacgcgtagagccccacaatgatcagcagtgccccgatcacgctacacaaaaatagttaagaaaaaaaaagtctcagattaaacacgggtattcatatattttccgtatttcctaccctacacttagtaacaagtaatatacatgacatatatatagctagcagcgagagtaatatatatgctacgtagtatagggaatcgaggtacactcagtgtttaggtgttacttttgtaataattggctgtaactccgatgagcaaaggccgggatgttttattccattatctaaaaaaatagggaattgagc

SEQ ID NO: 27457 - DNA, 1501 bp, Oryza sativa; identical to SEQ ID NO: 19116

SEQ ID NO: 27458 - DNA, 1501 bp, Oryza sativa; identical to SEQ ID NO: 19124

SEQ ID NO: 27459 - DNA, 1501 bp, Oryza sativa
ttcaggtatggaaaaagaaaaacatagcatgcttgcttagaatggttgcaatatcaagatccatagtacatgagatgtactattattattattcagctttggaacatcaattcttaaacaaactggttgccaaacttttgacttgaaattgtcgagatgaaagtgcattaagattccaaattatcatggtaccttattggaactgaagccttagcttattattctaattttcattttggtaaccaaatggaaatcatttttttagaattgctggtccatttagttattcacgtgaactagtaattccatgcatatttattaacatcaacattttgttgcagatgaacaaaggtggcggggagagcggaccgtcggttccaaagattgctgacagaagtcgtgaaggggacattttccctgctgcatcccttgacgaatatgctgaacaagctagacagcaagatgattcagatgaagaagaggccagggattttgtagaagattaattttagaactcagaaaccttttcttttgcaaaaggatttatatagccttatgtggtgatttacattacatggtgggtaatcccacccactgcggaaaacaagtgtattagttttggcagatatatttccgtctatcagatgtttatcagtgtgtgctcccattccgtctgtgcttgttcaaactgaagaattggaaagtagcatatattgcggtttttccggtttacatgtcttttccccataatgcagcttatcggtgtgtccggaactccggatcagcttttttttattattattccgaggaaaagctcttctattattctcttttttaccaacttattgcgtgcatgatgcccttgaagatgttctctgttctgttcttccctccatgtcaagcgaggttgttttcttcatgtttacggttttatttagcgggctgccaaatttttcgtatacattgaaacgttaaaaagtatactattgttactaaggctgtgtttagttcacgctgaagtttggaagtttggttgaaattggtacaatgtgatagaaaagttgtgtgtgtatgaaaggttgatgtgatggaaggttgaaagtttggaaaaaaaaactttggaactaaacagggcctaagagcacccgctatggtaaagtagggtgctctctataaaacatgtacatctcagcaatagactagattaatagtaaatcacctcaatagtatgtctacataggtatctatagctctctcatgcattgcctcgtttttctctatagactatctctaatctagtagatagctttgctctctctcttcatttaatatcttccaagtaggaaaatatgctgacattgatctcttatagatagcttatagataaccattgtgggtgccctaagagcatgtccaatagcaggctataagccagctgcaaacatattttaaggagataaataaagagaaagaagagcagcaagctacagatttgtatttt

SEQ ID NO: 27460 - DNA, 1501 bp, Oryza sativa
accaaacaaaacaagatgaggtatagtaactagtcatactaaaagcaaaacaagattaggtatagtagttcgttacactaaaatacaattaaaattgacaacctcataaatatgcatggaatatcattaagtagccatcaatccatgtgttgcacgagtttgtaactttatatcatcactagagaattatccagtctttttttttctttttttgggatgtttgcacggagtacaagcaaaatttgatgatttaacactctattcgttgccactcgagacgatgactgaatatgttagttgttgtacatattggttacatcatgcaagtctttaatttgaaattaaaataaaaagttaaaactaaattgagagcataggatgtatagacttcgtattcataattctaacattaaaattattaaaataataaaatacaattaataagtccatagtttttataaattgcattattattgacacacaaactttaaactactatttacggtaggtcatatcaacctgatgtatgaacatttttctggtgaatgtaagagttaattagggcagatacaaagacaattaataaacagacttttaagttgctgacatataagagaaatgaaaaaaaaagagagaaatatacttgttaaatgtgacaatggtcgtcgactctaggcgtttatagaggaaaactttagtatatatggatagagaaaaaaaaagaaagacatgtggtagaaaaaaaattgtgcattaattagtatagtcatttgtcctctcaaatgttgtaagagaatagcattttaatggaagtctatatcaggccatacctcagaaggtatccgttttagtacaagtatgatccaccaaattaatgattatatctttttaattaatgtgagagtattctccaaatgttcaattacacagatatatagactttctattctccagtcaataccaactcgccccgaatcgattcattttcaaaatatatagacaatgtagcaaacaacgtttataccgtattactcccttcttttcattcatattatttattatttagttgtttgactttttttcatagttaaaccttttaaagtataattaaatttatataaaaatatagtagtattttcaacacaaaacaaacaaatatcaaaatatattcaatgttagattcaataaaacttattttaactatgttagtagatatttttctataaacttgatcaatcaaaacaaagtttgaatgaaaaaaagttaaacggcttaaaatatgaaacggaaggactagcacttaggaagtacttatctttttttagaaggctggaccagatttcagctatctgggccaattttactcaaccaggcccaaggcccatctcaatatccagtcgacgagtcacagcagagacgcagagtgtcagcgcgtgcgtggactcatcgagaggagcaaagcaaggcgagcagctgagccccgacgaggtagggggagaga

SEQ ID NO: 27461 - DNA, 278 bp, Oryza sativa
gggcggccacatcatttttgggcccgacccccccccagggggtcaggccacatgggtgattgcagctgccccaaacctctagtcaagatacccccggtcccatgtcaccgacagtagcccccggcgttacgccagggcgatcgcccccctcgagggaagcgctcgggcgtgacgccactccttagacctggtgacagatggggccggtctctacaggcggcagaaacccagcggtcgcaaatcgcgcacatcggcaaggaaaaaccgaccgacaataa

SEQ ID NO: 27462 - DNA, 428 bp, Oryza sativa
ttctagtttcaaatgattcttggaatgcctgtgcaccattttgccgtttgtcatactagtagctcattattagtagtacgagaaaggttcagttgaagagttgggtgaatgcgctctctctctctacaccatagagccgttcatgttctgtaacctctagcaattctgagttttgacaaatgctgtgcaaatctatgtcctacttttgaaggatccagtattgtatgtttgttgcttaaaattttacatgggttttggcaaaaaaaaaatgcacggtttgatttgacgaaatggtgtacaaattccagcacatctcgttggtagtggtaaggactagagacgcatatgcgttcgctcggttctggataacgtgcacagaacgcgagctctcggtggttggttgagctgcgcgggagagcggcggtcga

SEQ ID NO: 27463 - DNA, 496 bp, Oryza sativa
aatgtgggaaatgatagaatgacttacattgtgaaatggagggagcaatacatatgcagtatgatgctgaatatcaattatttgcctttgttagttatactttataagacttgttagtttctactttatgagattattactgttttagttgttttagctggctgattacaagatataagtatcatcaacagaacaatacacgcaaaatccacacgataccctcgtgtcgtgcctaccttggatctaatctaaagcccggatcaaaaccaagccaaaagcctagtgagcccagctcgctcccgttgatccggtgagcgagccctaatacttccagaagctcctcttcttcgccgtgccgaacactcgaatcgcatcgcatcgcaccacaaaccctcccccccgaccagaaagccaagaaagaaacctttcttcgtcggtctctctctctctctgcccatggacttctcggagcaggacgtcgaaatcttcggcgagg

SEQ ID NO: 27464 - DNA, 743 bp, Oryza sativa
ggttagtgtgaatgaatacctaaaagcaactttgttatgttctctttttattttcttttttttggcgagctaacttgccacaccgatcaagaaagggctgagctgacggatagaccggtttggagcttgcttgtcctagatgtgcttccccgcaacgtgcccgtacacgctatatgtagtttcagtgatatgctaacttttttttttaccgatcgtttggtccacggagtgatatgattctctttgttggttagataggtataatggtcaaataggcaagatgttgttttgataattattttttccaatgtatggcctcatcctttgccctacggcttataagctaaagccaaaatttaaattttaaaacttgattttgaatttgattttgattctattttaacatagtttttttcaactttggcttttcaatcggtaagaacaatatataaaacttttactcgcatattatttcttaatcgttaagagcaagcttaatagtatagctaactactagctccaaatcttctatagccaatgtaatagacaattcatacaatagctgcttactacactattaatacttagtcccacctgtcatacacatattacgtcttggagtccgtgttgcagctggctacagatctgtagcccgcttcccttatctctcttcttttatatttttaaaatatgtttatagctagcttatagtctgctattgtacctgctctaataagccgtta

SEQ ID NO: 27465 - DNA, 500 bp, Oryza sativa
taaaattattggtgtggattgtgaatggaagcctaattttgagaaaggtagcaaacctaataaggtaagcgatgtcttaatttaaatttctgtcagtttccatgtttaacttagttttctggtacaattataatcatttttcctaatgtatggtaatcatatgttgcattattgtggcgatacagcaggctgaatgaaaatctccccctgttcttcctcaaaaggcatcactggataaaataggataaataaattgtattaggtatcatttaagcaatttagtagttctagtattcagttatccatatcactccctgtgtagtaagctatggccttgtgatcatctcagtgatattttctttacagtgtttattgttttggaacgactatcttatccttaagttcccatgatattttttacttgttcctctttcagaaattctgcattttatctatctatgtcagttcttgcattaattgaattttgctctatggttagg

SEQ ID NO: 27466 - DNA, 547 bp, Oryza sativa
tgagtggcccacactattccactgcacagaagtattcaacagatctttggaaactaaagtttgagttgagaggaacagaattaatgcagcagtgaacaaccatctttgctccaatccctccattctaacagccatatgagttatatcttttatggagaaatgtccagggtgccaaatattacagatatgaaccagaaagtgttggcatttcattcgtcgccgtcacgaacctcacaatattctaggaattataattttgggaataaacgattgcacattgtatagtacaaattcatagcacatacaagtgatcattttgttcacaaattaaagagaactcaagctccacatgtagaatgattgatgtgtgttaaatcaacaaaccaattgcaaaacaaaactatgttattcactggacactgacttcctgagcagcctggcttgaattttaatcgtagtacaaagagtgatctttcattcctccaagcactaagtgtgataattgttaataatagacctaagcactatgtcacaacacaacaaaaga

SEQ ID NO: 27467 - DNA, 287 bp, Oryza sativa
cgaggatgcatagttatttttcatattttgtactacatccgcccaaaatataatttttttaagtatgaatttaaacgaacagttatctaaatttataattagaaatacttatattatattatattttaggatattggaatattctgaatactataataagacaagcgtcactcaacaccaaatatacaatgtgaaaggcagtggtaattaagtggagtcggcactcaacaacagtacgcatgtcaatgttcaacttcggcataggtacacgtcatctcgccgacaga

SEQ ID NO: 27468 - DNA, 656 bp, Oryza sativa
ctagtccaactgataggtcagagcaagatgctgcacttgatatgctatgggctgatttagacttcactttagagtcagagaacattgggacttattatgatgatgaggtacttttgctgcatgaatttatctgacattgctgacgtcctattattttccttaatggggttgatttgattatggaacatggcaaccctatctatattacatgattgttgcacttatctttgcagagaaaataagctgggtatagacataggttcttgttaatcattcatcaccattgctgcccaatttgttacattctattttaccactatttgtggtaccaatatttgggaacagcagtcttaacttggcgcagccaattctaagtagtgtatgtatgcgtattttgtgccactaccatattgcactctttaacaatgaacatatatttatttgtttggagaataaatattcctttatgttatctctgtataacagcagaacaccttttgatggttgacaacaggagattctggtcaattttaactatattatattatgtaattctccaaaattttccagtgtgacaaatttgatgctttcatttttttggtgtcatctagtcaaggctaccatgttgaaatgattagcttctgttgttttgtagg

SEQ ID NO: 27469 - DNA, 156 bp, Oryza sativa
ccttcgtatttaaggacggagatagtatataaaaggaaggagggaataactggtaacagccacatttacaaacaaatctatcatccatcagtcttcatccgaaaatattcacaaatgacaaacaaatctattatgccacttcactcttcactcagc

SEQ ID NO: 27470 - DNA, 1501 bp, Oryza sativa; identical to SEQ ID NO: 19125

SEQ ID NO: 27471 - DNA, 1501 bp, Oryza sativa
gatccaaagatcctacagggcacaggctgctacctgcaacgttaaaatgctagtagtagcagcagtttttttttttctgttacttggatgggttgcatataagtagtgataaaaacggtgacagaaattttctaccgaccgaacatcgttttggtaaaagtagtatggttcgattctactgtagtaaatataaaatttgacttttctaatttcttttaacccttgttcggttaatcctcatgagggaggcaatggagggtatttattccacacctatttgtggtgtggaattattcccccttaatcccctccaaaccgaacaagaccttaatgtgatattacaatggtggcaagtatagctaatgtttttcacttgtaaagtttactcctcctctattcaatgaaattggcagcttgccgattcgttcaaaaaaaaaagtatagctaattctcgactgaccgataatcgtttacatagagatacttccattttcgatcctccgtagagacctactcgtcagcagtcgtcagcattcgccagcatcaaacggacatgataagatgatcaccgcttctcttgcagccttcagcattaatgctgcttgagtgcttgttgctggcgccaaaatgctgatgaaccaacagacaagatagctcccgctaaaaccagttacgcactgcaatcaatatgcagttttgctcgacgtagcgcatggatcattcagtggttgaatacgatgtagacaaaattcaacgaggcctccttgtttcccaattctcatcatggtcttcatcagtccaactgttgctgaccatcataggcattaaacacttaaatgctggcgttacattttgtttgcttgccactatttctgccgatttcccgataagaaagccataaccttggagacttcggatataaatctcttctccctcaggtgctatagcaaattgttgcttctctgtgtgctccgggtaaactaaggtaactgctcgattccctatccttttccttagcttatcttctcttctcttcctcttagcgctatcttgtgtcacgccaactgcaatagtagtatagtactccaccatttgcatcggtagatgattttatagcttgttcttaatttcaagaatacgttttccttgatctctatgggaaaaccatgtgttgagctcggtggttggggtcacgagtttgatcactatctcctaccttggatcaaagaggtgcagtggtttctctgttgcaagatcctttatgcaattttcctggaaaaaaacaggtcccagaaagagtgccctttttctttgctgttcctcaaagttacattttcctgctaggcaacagacataacttgtacattatagcctctaaggtaaacattaacggaaacaaacacataagaaatactgttcactgatagatgcatctgtataaagcgttgcccatggttaatcacctccacccacttaccagctactgcccttttagctttgc

SEQ ID NO: 27472 - DNA, 1501 bp, Oryza sativa
cggagaagaaaagatccggcccactttaacgatcgaccagacgttcgatcgatccacttacacgtcgtacgtttttgctgcgtgatttgtcgtcgatagcgttcgttggagcaaaacactgcttaaatagctgatttgaggcattcacaatcgttgagacatttggaatgatgtctaattttacttagacggcgcaccgcgcactggagcagttgggataaaatagacatctgcctaaaaataatccagtagtactgtaacatatgttgtcgtttctgtgctatcagatcaactgagatcgatgctatcgtgtgtctttagagcattcccagcagcagctcatctatcacgtcctctatcaacaaaatagtgtaggggggtagggggggagagaaaaaaccggctcgagcacatataccatccggtcctccaaattagtgcgtctgctatatcctggagaaagaagcgacaaatttagcatttctaattctctcctcacgccatattgcaaccctttttttctgcaccgagctcatgcccatatccggattgaccaaacgacgccttgtctattgttgttgtcatcactactcggtgcagctgagcccccctcccccccctctacttttttttggcggcaatggcaacaatggggcaccggcgagtggaaccacagaggagtgaaggtggagaggaaggagcatactaaatctgtaggtagggatggattgtagggtggtggatgtggtcggcggcggcatacccactctgcctgcagcacctccggccatgcaccgcccacacggaccccagttgcgccatccttgccctaggtgtctgcggttgaggtggagatgcctaggtggctgtggctgaggtggggctggattacttgtgtttgtaaattgtatacataatttagattccttacataattaagattgcatatataattgagattagatacataattaagattgcatatataattgagactgcatacataattgagagccattaaaaaaatatccattccaaaatattccgttcaaatataggtgtgttacaagtatagccgttaaaatttagtcgttgaattatagtgttaacgaccaaatttggtaatatcagcatcagaaaaggagattagattaaggtggagtcgaaggcggagattgatccgagaacagagcaagaatcggctgaagtccagatcggctataattaggatcggctgggtcagagtcggactaggtgagccgatgcagccgattctgacagtataatttggtgtatgacattgggttgaattgaggtgcttcaagatgattaccgcacatggatagagtcctgagaaggcaattgtatctattaattaggatgttttatgtaactttcttagagatatgtttgggcaaaagtctgccgcaaagacttatggtatcttagagtttgttagagatagtggtcgtgtccggtatggacatatcttgtaattctc

SEQ ID NO: 27473 - DNA, 1501 bp, Oryza sativa
caaagaattcgtggttaaatctataaatgatagccgatcggctaggtgccgatgacatatcatttatctttgagccgatgtcatatatgaatcgatcgacggttataaataaatagtaaggaactaaatctattcgatcggcagtagatattaacgatatatagttcttatattaatatatacttaaatcaaatgattgggatagatcggtcaccatgccgagacagtataaatcacttagattgaaatatatattaataacaggattatatatgtttatagcatagccgatcagatagatctagcatgtatcggctaatactccgatactactttatataaagatatcaaaacaaatataatataccaaacaaaagcttaatatacttaaatgcaataagatcttgacataaagggcggatttaacatgtcattgaaacacatagaccggatatggttaaatcagataaggtcggctgaaactccgatactaccctaatcggcaaccagagaacaggctacagattgatattctaagcacgacttaatagatcaaactcaaatgatgcagcattaagtatgaaaagaagaacaatatctagacaatcaagccgatgggtgtttcataaagtggtagatatcttatataatctaagacaacgtcgctatttaacctaatcggctgtcttctatcaacatatgttagccgattgtaggttagatgacgatgttgccaaagattatgtaagatatatgataacttgatgaattatatagacaagattagagtgtcataaagatggaagcactaatcccgagaacacaagccgtcataacaagttttacctcttgttgaagatcgaaaccgatgcagctcaacccgaaagcaagaactcgtcgaaataaaactaaagcaaaaaggtgacgatgcgccgagattgtattgaacatgtgtgttaaaaattacatagggctcggggtctatttatacccgagaattacaagatatgtccataccggacacgaccactatctctaacaaactctaagataccataagtctttgcggcagacttttgcccaaacatatctctaagaaagttacataaaacatcctaattaatagatacaattgccttctcaggactctatccatgtgcggtaatcatcttgaagcacctcaattcaacccaatgtcatacaccaaattatactgtcagaatcggctgcatcggctcacctagtccgactctgacccagccgatcctaattatagccgatctggacttcagccgattcttgctctgttctcggatcaatctccgccttcgactccaccttaatctaatctccttttctgatgctgatattaccaaatttggtcgttaacactataattcaacgactaaattttaacggctatacttgtaacacacctatatttgaacggaatattttggaatggatatttttttaatggctctcaattatgtatgcagtc

SEQ ID NO: 27474 - DNA, 476 bp, Oryza sativa
ggtagcatacgatgatcggtacctaaaatgtattagctggcattataaaagcatataacctagtacaaatgtcgatccaaaatttacaggcgggttaaagtcacaccaacagctagatattcggagatgcaaacagtccacacctcattgaagccccgagcctaatacagtcgatagtatctgtccagatccagaatataattcaccctatggtttacagtatacagtaatgtgcgtcattcagcaacgacgatattaaatttggctatgaccctatccagcaatagatacgtcttgtggtaacaaatactagttcagagtcttactatatgagccacatgtatgaaatgtagagttacattatggtgcagtcatactgacaatttataaatgggtcagtgagagacgatactaatgcttatagctcgagaatcatatctatcttatgatgcgtagggacatactcttcagtcaca

SEQ ID NO: 27475 - DNA, 207 bp, Oryza sativa
aacaataagtatattaattatttatatgacaattatcattttgccaccatagtctagcctgtcgtgctttatctgcctagttgtacagtcggattggaaagagcacccccgaatgtgtgcttcactagttagctatctagatttactgaatctgaaatctgcttccaaattttggagacacttatgtttagctgtgtgatttgcagg

SEQ ID NO: 27476 - DNA, 190 bp, Oryza sativa
gtatgtgactactaaaaggttaactccaggctcacacattaaagttctgttaacataatagctgaaagagttttttattaggtagggtcatcagagttgagttttcctataaacagcagttttttttttttattaagccacttatgaaatatttcatttcttaatacattgctgctctactttcataagc

SEQ ID NO: 27477 - DNA, 1501 bp, Oryza sativa
ttcttaaggaactactaagagatatcataatttttaatgtaaaatttggtactcacatataattaaatatctcgaggtattttctcagggattgcttattctcatataagtaatcggtgattattattcgcttaaaatttaaatcaactgggccctaacctctctttttttttttcttacagtaggattttaagacggctcattaatctatcttgcttgtgcttttaggactttgggggtgagtgagtgagtggtgactcactaatcttttgctggttaatgcttaagactaccaactaatataatctcggtgttgcttcggcatttggggtgagtggtagctgctggtacagcgtgcattggcgacgttctctcgtggcccggacccaaaaatattatccacagggctagcttggaaaaaatctgaatgggaaaaattaatcctgataattcactttactgatttctaaagaagtatctggaaattcgtagggagaaggattttactggattttttttgtcagataagtgcagttactcaacaaaggctacccaagcaaactcatatgcttgtactatacgatacatccatttaaaacatgattttttttgggatctttatgtgttaaaatcacatgttctatgatgtatgcgtaaaaatttcttcttcttctttttttcatgtccaaattgtcaacctcttatgtaaggcttctaaattattctggttttctttccttcgggaaaaaataaactattctggtatgtccaaattgtccttttatgtagagtggtttccttttcttcaatttccttttttctggtgatagccaaactttagatttcaccagccactgttatttagctgcactgcaaacgattgtgttcactaaccggtgccgagtagcaataaccatgcaatcaccactgatcaatcaaatggtttccagtctacagccggcagtttcggtaatggggataaactatgttgctactatcagcattatctaatctgtaatgtccaaagcttaccttgaactaatacatcttaaaatctctattagagtggggctaaccaattaagcttactttgatgggctggttaatctcactgtggggttcaccaatcttgagagctagcaataaagctagagccaagaaattgtaatcatagctgctacaatcgagggctttgtgcttaggtcacatgtatcattaacaagggcatgagaaataaactataaagaacagttccatgagcaaactcaaggtacacatggaaaattactgtgtgattactgaaaagagttgtaaaactcatgctttagggttcatctttttttgcaagattgaaacagtgatattttttcttgaaactgttggtgtttcttggccaactggtgccggttgcaaccatcatctgaccaaaattttcatatctagctaagcagtcagtgagcaaggcaggcagacttagctatcaaccaggaatttggtgaat

SEQ ID NO: 27478 - DNA, 176 bp, Oryza sativa
aaatcccttatatttagggatggagagaataaatataatggatttctcttctcgcaagacaagcaaggattgttagtcattcaaaaacaagtacccctccgtccaaaaataattcaatagctaagagttatctttttttttttttttgacagagtagtaatcaacagatacaacca

SEQ ID NO: 27479 - DNA, 1501 bp, Oryza sativa
gacggactttaccggtcacctacatacaactacaagtctaaagataagcagtcgaattaggataagccagggaagaaaaagcacaagacctgcaaagcatgacacgcaccagcaacttaactgatgtgcagagaaactaacaccatggaggcagacagaatgaaagaaagagattgttcagatgaatccaagaaggcaggagagatgttggcatgcagttgcaagatgatcaaaagcaatgatcaaaagcaatctggtaggttttggcaggcaagagagcttcagttcagctgatcaggagatgcagcagcatcagcaaattcagtaatgcatccaagcatggatgaagcgagagcacgacgcaatggacagcgacatggcgtgtgatgtgatgtgatcctggtgtgctgatacgcagcacatgccggcgccaaagttgcaggcttcttgcagccgcatgcaggttgtttaattttcttcccccccttgcttttctgaaagaagaagaagaaaagttcagacataaatctccatttgttggttacagatttgatgccgagaaaaaaggttgcaggtgtgaaaggaaatcccacttacaaaaagaaatttcatgcgggggaaaaaaaaggcaagaagtaatcaatggaggctgtacaggagaaggccaaattggcatttgtttttagttccaacacacaagactgaaaccagaaattgtgaagaattttggctgacaattggttggttttgctttggataaaaatgaaaaggaggatacaatccaactccaatactccatcgaatgaattttacctaaattccagtgtatatgcattgaatgattccaaatcaaagaagataaaaggttcagaaataatatacaggctctaaagagaacaaaagaaacaagaaatagagatcgtataactgggcctgaatcaaattgccaaaatgaacctagatcaaattaacaagacgggcccaaatgggcctacacgaatttatcaaaatgggcctaaactaatttatcaaaataagtctaagggtacgtttaagagatgaagattgaagaaaattgacaatatacacaaaactaggtaagtattagtacatgattaactgagtattaattattttaaacttaaaaataaattagtatgtttttaaagtaattttacttcattttttttaaaagaaaatacattaataattattttaaacataaaaatggattaaaatattttttaaagtaactttactattttttaaaagaaaatatatcgttcagctattcagaaagcgtgtgcgtggaaaacgtagaattttctcacactatcttcctctctctcaaacactgctctaaaccaattttactaaatgggcctaaccaaactgcctgtatgggcctaggagtacatgggcctaaatccataggctcccgtctaaccagtgggctaacccacttcccattctcgagggctcgtgtcttgtccgagtcgcc

SEQ ID NO: 27480 - DNA, 831 bp, Oryza sativa
aaagaaaggggattccttgcttccacagccaccaaaagtaaaaccacccggtgcatggtgttggtggccggccgcccatgccatggctccctgacctttccgcggctcaactctcccccatccatctcccacacacacatccactgacagctctgcacgagaaacgcttggccccaactgtcatcgcacgttggcgctgaactggtgcgcctaggtttggtaccaatcgggtaacccatcccagcctcctcgacacctgtatcgtcaaccccgggacgagacgcgagcgcaaaagcgactacaaagatacacaccgcaccaccaccaccacgcacgcaagcacgcctctcgtcgcgttccgtttcgttgcgacgccacgcgagccatgctgccgctgccgcgtcgtgtacgtgtgtatatacgccgcgccgggttgtagcgtagcgcagcgtgggagtactacactgcactgcatcgcgcaaccaaccaaccacccaccacaacacaaccctcctctcctcatcatcactcgctcgctcgctctcgcgctttgcggcaactggcggtgtctcctagcccttgcctgccatggtgtcgctagccggctcccagatcccgtcgccggggcagagtccgtgcgcggcggcgcggtcgcagcgccgcggcgcggggtactccatgcggaccatccggtcggcgctgctgcagccggactcctgcccgggctcgccgcatgtggcggccgcgtacgacgcggcgggggcggactcggacatggagaacttgacggactccgtgattgatttccatctcagcgagctggcggccacc

SEQ ID NO: 27481 - DNA, 1501 bp, Oryza sativa
taacatttgtaaatgtgagtgattcaaaaccagtgctaaacatgaacatgctaacaaagataataaaatcattcagtaacatgattaacattgaaataaaagacatagttagagaacactccaagatccagtagcgaagttggtgttcctgataccgatgttgccgttcccaatgccaatgttcacgttcctagtgttgacggtcgacgtgatcacaaactccacccaaaaaaaaggcaatgctgatgtacaggaagacgaagaagagagcaatcatgcgaagaacacgctataaaaaaaattaatcgcccgcttacccgtatagttactaaggtggatagagttttggatgcctactcatccaggagatccgtacgggcagatcacaaggatcaggaatatctaaagcaccacatatgagcatggccgtcagtttcgttctacaaaaacaataacagtccgaagatcacccgacggagaagtctccgtcgctcgctcgtacgccattcctcgcctccacccgggtcggctcggcgcatgcgcatgtggcattccatccaccagtttaaccggtcaaacggtgcattcaatttgtagcatatttaagttgaaattttttccgttggtttttcatatagtattaatctctaatgttaatgtgtgctcttaaattttaagatgattaatttaggtctggcccgtttaattctaagagcacccgcaatggtaaagtagggtgctctctataaaacatatacatctcagcaatagactagattaatagtaaaccacctcaatagtatgtctacataggtatctatagttctctcatgcattgcctcgtttttctctatagactatctctaatctagtagatagctttgctctctctcttcatttaatatcttccaagtaggaaaatatgctgacatggatctcttgtagatagcttatagataatcattgtgggtgccctaatataggtgacatgatttaagaccaattgtgtacttttactattttcgaaaaaaaagttttttggactttcgatctaaactaccattagtcaaactgtgttgggcacaatctaaacatgtcaaagggcctcaattctggcacattctgtttgggctttcgatgggctgtaatcgaagccccaccaaacaaggccctacaagtctacaacaacaggcggggggcgttgcgccggtcggaacgggatccacacgatatgacgtcaggtcaaatcccacccgtgcactcgagccccgccacgtccttcccccctcgacgacgaaccatctcgcgcgtggggcccacccgtcatacgcaccgcaccacccgctcgttagctctgaacccgagacgcctccagaaatccgaacccaatcacaccggattagttgagctcgttttgcgttttgccccctttcccacctcctcctctccctcgcgctctctcccctctcttctagatccagccctcccctcctagggtttg

SEQ ID NO: 27482 - DNA, 441 bp, Oryza sativa
acatttcttcacaaaatgctgcgcgatttttttaaatttctgccccttctgggactgaatgcaaaatctttttctatggtttcttttgtgcaaccaaacataagtgtgccttatactacatggcatctgcattataccaaaagtggccttaccatatggactctatgcaaaatataacttccaacttctaagaagcagcttttatggactgtaaagaaaaaaacaatgtagcgggctttattatttctatttgcgcgttgggaagttgttctgttatcctatccactataagaatacatcatgtcattaacatccattttccattagtttgtgcctgatagaattaaaatttacattccaaatgcatattttaggatcagaaaaattattttgcttgatatacaatagtaatgaatggtaacgttcttatttcaatagaga

SEQ ID NO: 27483 - DNA, 706 bp, Oryza sativa
acgtgatcactgaatggcataagcttttgtctgcattacatatgaccatattatgcgtaatatctagaagtaaaattttcaaacattttctcacaccatacagttttcataaaagaatgtgatgtagcccaagtgcccaactgtctagtatcatctttaaaacagtctaatctgaaaataggttgttacgtgtacatcatcttttctaagcccattccagtttagttagtctgtccttttgtcatccatagtggattcatttgttggactgcactgaacaaatgaatttttgatatgctgatttgaggttctaactacactactgcatggcattcaatgtggatgctcctttggattcaacaaatacaggtgcaagcatggaattggtctctatttgtgtatttttacttgattagaaagatatgttcccaccactgtgtattagtgctgttcagaagattcttgtgtgtttgtccttgtctttaacttcaattggcagactataaaaaagaagaaaaaagaacattgctctttgcattttaatttatctttgttgtagtgctatatgggaatatcaagcctgattattctgaagtgcatattattcctgttcttgccgtaatataaattgctaagtatgcagtgtaacatcatgtggaaccaacattgtgtgcgtgtgttctcacttgataacattttttattat

SEQ ID NO: 27484 - DNA, 1501 bp, Oryza sativa
cagtaaacagttgacagttgcaagctgattcgctaaccaaaaggcatgtgcaaaaaagatgccgccgcgaattgccgatacccctacactaaacatagcccatccagatacattactcaggcgacatccgccgccgctttgagtggtcaacctcccttgatctgctacgcctcccagatgatcttcccctatcccagtcttcattacgatccgactcacgcttcccgtgcctatgataatcgccatggcgatctctatcatcccggtaccgttccctctccctgtctcgatctctttccctttcccgttccctgtctcggtctctttccctttccctgtccctgtctctctccctctccctctcccgacctgcgtcccgttcatcacggtgcctcctctctggccagtctggtggaggaggcaaatctttctccctctcccgcctcctatcagatgcccctgaccattccctctctggtggcctcttcttaccatggctcccaccttcaccatattggtgatctgatgctgcatcgtcgccatagcttgattgctcttccccaccccaaccacccatgctcgggtctggccacatcccgaccccaccagcacccataccaccttcttttccaaagaacgctgggtttacatgaggtgcaacaacaggtgggaatggctgcattaagcctgggaatggagcagccccaggtcctccagggaagccaccaaacccaccacccatcctccccattgctgcaccatagccagttggatcaaaaccctgccctaacatgcctccaggatgaagcataggtggtggtggagctaccatccctccgttccccattaatccacgtccaccaaccggacccatccgattcctcatattcccagcttggcctctaccccccatacccccgccaccccttccccaatttccaccgccgcctccacctccgccaccacccggtccacctcctccgcctccacgaccaccaccataattcccacccacctgagctccacccggacctccagctgcaccaccacctctaccacccttctgcacacccgagttttgctgagccatcgattgttggttcttcacctgagcttcacccatgcggcgcacggtgtgaggcgaggcgaaggccacgacacaggggcgtccattgaacaagtggccgttcatgccctctttgcaagaggcagcagcgccagggtcatagaaatcaacctggcagtatcccttggacttgccgctcgccttctcgtcgaagaatctcacctccttgacctgcccgtacttgcttagctctgcctctagatcggcgtccgtggtccaccagtggagctcccctacgaagagggtcgtaccaccggggccatcaccacccccgccgttgccgaccacaatcgggcccccaccgtagtttcccccaccctggcggtggaagccgtcgcctcctcccggctggatctggttatgcggaggcggcgg

SEQ ID NO: 27485 - DNA, 1501 bp, Oryza sativa
tttgtgcttactttcgtggaagaactagtggagtgcttaaatattttgttagtgctttcctagattttcgtttttttgtttgtgcctgctgttgctacttgttaattgttaattagcattagtagatcatgagatgttgatatcttatcagcattttggttttgacttgatgagtgcagttaagttgctgagattttgctacatgaaccgtgcattttaaaatttaaacccattttgcagcttttccattatttttttgacagagagatttgtcacttaaattgttggaatgtttttctgtacatctcctcgagcaaatctcagatatgaaacttatcatggtgcccgttttactgacaaattggcaaggatcttttcgttgcatcaagtgcaacttctgcagctcatttcttgttatttcagttgtcggtggagccataaggccatttgcttcagaggtcaaaacaacccaacccacacatcaaaagcaacagtaaaaaattccttaaaaagcacacagtaaaaataaagaaaggtggaagtaactgttactagaaggagaggaggagatcgagacagagatatttgacgtgatcgagccggagagatttaaggtgagcttgaaagaggggttgagattgtgccttgacacagaaaacaaacgagacattagcacataattatttatatgcattagctatcgcaaaattaaaattttgatttacataagacttatatatataaaaggtttttaaatgtaaaaaaacgtaatgttgagcagttttgaaagcgtgttaaacgttctttttttttctttagaactcagccataattttagttgcattgtgtcttttttaccgagaaaacaggacacgagaccgattccgattcgggccaatttccccctaggaggggatgaaaacgagcctttattggtagcaccgacagggctgtggatccattcggacactgccgccactcgcagctgagcgacctcgcagtgttgccatcctagcccagcatcttttggcacgagaaagcgcttcggaactgtgcccgtttccgacaagacagtgggcagcaaatcttgtttcagtcattcctcttctttggtggtcagtgatgccgcttctctgatcacttggttgttggttgtttcagtcacggcctctctaaagcttcacaatccggtcacgaacggtatcatctaatttcgtggaatccgttgataaaccgataaagactgataaaatttgaataatttttgctgaaaaaataaattttagtttggttgttttttaactttacgtgaaaaatcgagtggtttttatttttggcctagtccggaaaatccgcattttgctaaattcgaatcgaattctactagaagttgtgtactctgtcactctcttctttcactccttgcacttctttttaaaaagaaaaaagtacgaattaaccccttttatcgcggtcgtccgaaatacccccctgaaccaca

SEQ ID NO: 27486 - DNA, 1501 bp, Oryza sativa
cggcgccctccccaacatcagctcaatattggtgtttttagtgttcttagtgttcttggatgttcttaattagtcgggggtgaaggggagcttatcgatggatcgggtcgaggttttgttttattcatggaaccttaaaggtgccagtttcactagaaccgacacatatttcccctccacatcagtgtcgtcttttaggtgtcgattggaaaatccgatatctttgtagggttctcaaccggtatcaattaaggttttcgtggttgtgatgctttgtagctaccaaagttatgcttttggcgagtctattgagctatgatataatataccaatggcgtacgatcaaatcatgttatcattaagctaggttcttaattacttaaggtctggcttatacggctgcttcgtatgtagattccaaatggagacagggctttcatgctgaattaagaaaggtttcttaagactaactatagattctgttgatttaattaatcttgtctatatatgcagaagatcttttcttagaacttccccataaagccatgacctgttcatacttcatacacatcaacgcgcgcactgtaccacacacgtgcccacaacacaagtgttcccactaccactaacatacactccacccatcccagctaaagccttaaaagcttcatcgtcatcacattcgtcccagtctcgaaaagacgcctccggccgagcccagactccgccggagacggggagccggtgcacctaacaaaagatcgatcggcgcgcgatacccctcctgctacactgtgctacttcgtacgttcgcgcagtaactggtccatgtcgatatcccctgtacgtgctgttaacgttgatcgtttgccgcgaacaccctgccagaatttaggatcttgtcaagctccgatcgagcggccaccgtcgcgtctttgtttgcttttagctacgtctttgtttgtttctagctacggagagtctcggaaaagtgtcttgaagaagatattctcttgtttcttaccatgtctaaaatatttatattttttataaaaataataattaacaatatagattattttaaaaatatcacttcacaaatatgcaaattcaaatttaatttctacgagttatattaaaataaaaaatttaaatttaaatatgcgttaactatttttttaatgagttccttttgttaccatttgtacagtttgaccactcatgtttgtaaagtgttatatatcatattaattaatcttatcaatttttttaaaaaatactaattatttagatggtccaagagaaacgagatgtgtcacatctcttaggatgaaaatccttctccaaatgtatctgagagtttcagtagcctcgccgatcgacttgccacaccgccgtactacatgctttgtcgtctgttcgtggcagtatatatattatccccttgctgtgtccgtcgacataagtggagtgtactaggtagacacactagctagctaga

SEQ ID NO: 27487 - DNA, 1501 bp, Oryza sativa
ggaatttcaaatgatagcaattcatatgaattatcgctatatatgttctttttaacaaaggattgcagcattccaaattcttttttttaactcataaagttttattgcatattaaacagagtacatgggagggaacgacattccctgaaacatcgttttgcaagaaattgacaacaacaaacgttaaggaccatcttcctgaaagaaggtaaagattgaatgattaatgattgaatgaaggagcattcaaaattcctttgagatcaataggaaaaaagcacatgaactcaatcatctttttatcatttctttgagaagtccaatgcaacttttcccgtctctcttctctattaaagcacatccaaaatcctttgttatttttatgtgaaccatccaaacacgttactttttgaattcatgtgttttacgtttctatagaactagttgataccccgtgtttttgtcgcggaatatgtgaataaatgcatgttatacattataaaaataatatacgtatgaaaaatgatgtggggataatgatttgacattgattgcggtctcgttattttctccaacaagagttggatgaagattaagattttcgtggcacgttttccaaactgctaaacagtgcgtttcaagcgaaaactttctatatgaaagttgctctaaaatatcatattaatttatttttcaagtttataataattacgaagtaaaactcaataattatacgttaatatcacatcgttttgcctaaaaaaacttaatattcatctccatcttcaggagaaaaagaacaccacctgcatattgagttctaaaaacacaataagattgtaaatgttatgtcatatttgtatgatatttaaaatactcataataattgctagtgaatgatgatgtggcacacttgcatgtgatttaaaatactctagtgaagtgggtgatgatgtgacacacttgcatgttgagcgttagtggacatcaactttatagtaaaatataattcgcacctacgtgatatcctaacttcttctcattcttatggatcaatattttcgctttatgcttatgcttactagtcaaaatttgaattttcaatattaaatttagagttgatttgtttttttatcgaagtttattttttagcctttgcttttaaatcgctaagaacatatatataaaagttttatttacaaactatttttagtttgcaaatatgcagtttcgcttatccccaaataagcgaaatgttggggcctttatatttttgcaaaaaaaaacgcgagtgaatttcatgaacgattatgctttttcttcttgagcctttctacatcgatcagacggtccagaacgcgccacgtagcgcatcgaagagatccagcatcttctccacctcgctgtatccatcggccgcgttcttcgcatcggtcgatctccctcctctcctcctccgtcgcgccgcagacgccaaccccgatcccgatggccgcctccg

SEQ ID NO: 27488 - DNA, 1119 bp, Oryza sativa
tggagactacatcagtgtcgcggacctaagccatgtggctggcactgtatgcttgggggctactccccacgcatccgtgttggacgcatacccgcatgtgaaggcctggtggactgacctgatggcaaggccgtcttcccagaaggtggcttcactgatgaagcctcctgcttaaggtagttgttctaggcacaggtttgtcgtccatggtccacagaataagctgaggtgtgcccagttggttgctcgtttaaggatttgtgttattatgtgtgtcctggatgttgaatgttcaagcaatcaggattgtgttgttatgctgcatatgatccaacctaagtcttgtactgctatgagcattcttgtgctctggccttcgctcttgagaaccttataataaattctgcttttagtcacctagcccttggtaatttttcattcgtcgattcgttgatcatgtttatgaagttaaaattgatacaattctggagtttacagaatatcatcgggctttaacttaacaaagtgaaagtgcaagcaattgtgtgcgtttgtttgttgtggaattagataatctagaacaagggggaagagatttttcatgtgttacaatatactactccctccgtcccataatgttgcaacctagaatgggatgagactcatcccatcctaggttgcaacattatggagacatgtccagattcgtagttctaggatgggtctcatcccatcttaggttgcaacattatgggacgaaggaagtacatgattcttatgttggagatatttgccacatgaacaggcctggtgacttctgagttctgacttggttgagaactgataaaccaattagtgttcctccatcaatttctcgatcttggttttgtcactttgtgcatctgctggaaattagcagtccccgaatgtagtagtgcaaagcagcctgagctgaaaatacagatagaacagctgatgagtgatgattgacagacatcacacgcggacgttcaatttatcccagcatgtgcaggatacatgttaactccctaaccttttcctttttcttcaaaagaatgtgctactatataccatactgtgtgtatacataactttgct

SEQ ID NO: 27489 - DNA, 1501 bp, Oryza sativa
  unsure (1)..(1501): unsure at all n locations
gaatccattcatcgatagtttggttttgtgaaactacacgaccaaaatatatataattaaatgctaagtgtcaaaatgtatgtgatttttttgcaacttagaccacaaaacatgtagttttatgaaatttactcataaaacaaactcaaattgctttcgttgagagtcgaactcaagacctcccgcttactaaacgggtgctctaaccaactgactacnnaaagctcttggcttaactgaaaattagaactaaaatttcctagaattgaaaattagaactaaacttgaggtccaattcacctcaaagacaaaaactataactaaagtttagctttaaatagcaaacttacatgctcaggttcaactgaaagcctcatatggttaactttggcatatgaacagacgcatcagacattgggcacacaagaacctgcgttagaaacaggcgtgtcacaggtggcgccgcccagcacgtcagcatctgctggtggtgatctgctactactgaggaggtcatcgaaaatagacttgagcgatctcaacgggatgagcaccgcctcgaagaggcgccgcacctggcggaggcgctccaccatgcgcgggatggaggcggccgacgcgtccccgccgcgcgacgccgcgaggtcctcggccagggtgacgtgggccagggtccacagctccgcgtcccgttccacgaacgcggcgtggagcgcgcggatccgcgccgcctcgcccgcggagacgggcaccttctcccccctgctggggaggccgccgcggaaggcgatgagctgcctgtcgaaggacttgaggagctcctcctcgaagctcctgccgatcccctccatcccgtagaaggtgacgccggagtccacggcgtggcaccggaccacgcccacgagcccgtcggcggtggcatgcgccgccgcctcgggcgacagcatccgctgctcgaggctccaggacagcaggttgatgaggaccgactccctgatcgccttgtcgatcgacttggagtagcgcgccaagcggtgaaccgggaaaggcaccggctccggctccgacgacgacgacgacgacgacgactgatttgcgacgctgttgggcgaggtagaggcggcgccggtgtcatcaccgtcgtctcgtcctccctctctggccatgatcgatcgatcgatctatctatctctgcaggaaaaacccggtcgtttcccgtattgttggcatatatgtacacggagcacaggaggccaggacggacacggtccaggaacaagttcttgatgggccggcctcaacgagcccatacacaaaatcaacggggcccaccttgaaagatcacgtgtcacccgcgccatctagtgagtggacaagtggactgcgtgagccgcccccacgtcacgatcacgtcataaagctccccttccgtccgcgccggcacgcacgccgccacctccgacgagaacgagctcaccgctgtccactgctcctccccacc

SEQ ID NO: 27490 - DNA, 242 bp, Oryza sativa
ccccacgacctcacctcctcatcaaacacccccacacgcacgcggctgcggcggcggcggcggcgagcagaagaggaaacaaacagctcaccacgtcgtcgcgatccaatccaatcccaactctcctcagctccagacaagcccggtctttatacactcccctatgattaccaccacctcacccaaaaaaaaaaattaaaaaattaaaattccaacctttccttttcctcctctcctccagc

SEQ ID NO: 27491 - DNA, 1501 bp, Oryza sativa
tatgtgacatataatgttaggtattatgatctaaagtttcataaatcacattattaactattttgacatactcctaaatcaaaagagaaaaacggatgcaccatttatatgatggataaaattctcataaatttaagatgtgactgtacaacttaaaaatgtgataggccaaagtcaaagtgataagtaatgtgattctgtaaaaacgttaggatcgtaatagtctaagggtaggtaccatgtgtgtcagggttattgataccacatatctaatagtagttgactaaatctcggcaggacccaccacataccatgtcttatacgggaacaaccttcggatatagtaggagtttcacgtaagaaaggatgaatagagttctacatggaaacgacaaggactagtcggattgtatccatattggtttccctagttctacttggaaaggggacacctatgggtataaatacaaggccccctaggaggagaggggacacaggcaacatggacgccacaaagccacaagccaatacaagcctacatacgccaagacaagctgccagatatcgacatcagagataagcctaggaaaacccaatatggtacctacgggaaccgaagagaggaatctagtgctatctctgacctcgccgggtacggattcgaggaggaaggctaccatgttgtcgactacgagtcagcactttagaccgccaagtcgacaacagatagataggctacctcaaatattatactggtgtgattatggtgaataagagcaatgaccggcttcggccaacaggagtagggttattacctgacaattcaggggcccgaacctgtataaaaatccctgtctccatcttttttatctcaatctcgcatataccctagtaccaacgatccccatactatgcaaatactggaatcgcgacatcaaacgtcgacaatgtgtacaggttcttgtggtttcatgaaacttggaccataataggtggggttttactctttataaaatttaggaaaaagtatgaattacctctcgaactatcgcggtcgaccgaattatcccctgaacccgaaaaccagacattgctcgccctaaactttcagtacctaatgaattaccctctcgatccaatccagagcggttttgtcctacgtggcataccattcagcatttgaaaaaattggtgggacccaccggtcatacctcctcttcacctcttcctaatctctctctctctctctctctctctctctcgcgtgcaagggcgcgggtgcgcacggcggcatggaggggcaggcggcagacggcggcacgtgggggtgagcagtggactgaggcggcggccgcaaggcgagggttgaggtaggcgttggtcgcgccgacacgcgggagtggggatggcaacagggagagcgggccgggcgcggttgttggggtggaggatgcggcggcgacggtggagggggacggcgagggggcgaagagtgtttgct

SEQ ID NO: 27492 - DNA, 440 bp, Oryza sativa
ctgcagcccctctctcgctctctatctctcaccgccgcatgctacgccgcccacagctcacaaacctcaccggcagggccacaaatcgagctgccggatagatatatacaccgcgagtgcgcgcgaggctaggcgggtgaatggcggaggagtgggggaggagggattcgagcaatcgagctagtagtagtaatggctcgtcacgatcagaggtgcaggagaagggggagagttgaggaggggaggtgggaagaagaagaagaggaaaatgaatgaggaggagaagggacaaggccgggctcggtcgggaggaatcacatggaggacaaagggaaacgggggcgaatttgatgacgctcactgctactgtactaattatgtgcgcgcccgcccgcgggtgctaatcgcgattctcccactgatcccctcttttcttcagt

SEQ ID NO: 27493 - DNA, 1501 bp, Oryza sativa
tagcaatataagtttctttgagagatttgtgaggaagtatgaggaagatgtgccagatgttgtaaaagcgtacgaggggaagattaagttcacgggattcatggattaggatgtcaatgtttgattatgctgaggccaaggcgccagctttctagggtgtattctctgtagcctgtaggtaaggctaaaattgtcgtcaaattaatgcatattgcttcctccttttttttgaactaactaacatcatataaatgaaaatggaggtaatacatttttacattgtcttgccatgcaatcttatcatatcctatatgttggattacttttgctaccgtagtacaagtaactaatagcatcatgagaataacgaagttgtgacatgttatttagcctttgtattttgtagttttgtggtttatatgcacttagagacacaattgctcttaccctaatcttcactaaagggacagtacatttatcttttatggatagccaactcattcaactgtctgtgctgaataagctaatttcccccctcctaataatggtgtgagcagagtattttcactggcacttgacaaattccacttctaagttatgctgctcaaacagtatatattgttctgtgaaatattatgacactgacaactcctttttagagttaagaccctgtcttgtttgaaattcctttttttttttcatttgtgaagcatgtcctccccatacagaatttgtttcacccaatggaattgacaaacttttcttaagagttagacctgtcatgtctgaaattcttatttataaaatatcatcctcctgtaaaatttcttcaccctcttgacttttgtaagtcttcagaaaacatgaaataactgcaggtccattgtcctgctatcttatccccttttatccttgttggtaggctaggactccattaatttattttatagaaaaacaagtttttttttaatcaaaggagccctttgtaatgttctcatgaggcattagaacttataaagttctgtggcgaacttatttgaagtttgtaagtgtccataatgatgctcagtggaagttttaggtcctgaaatgagtatccatttggttagagttgatggcataccattggtacttggtatatcaatagtctgaactgttacatgccatctgagtattcgaagctttattgatctccaaaccacatgtaagtttagcttcaatatggatcttatacatattgcttttccgttaacttgggaggaaagttagtcttgtttcttcacgcttgtagtattgctgtaatgattgttgaaacttatattcctaaaagtaagataactgttaaagtttctagcctcattttcaacggtggttcttaactttttcttataagcagtgatacatgttatgcgtgcgttttcactggatatttgagtggtaaatgcattattcacttattcacacagtagtaattcatgttttgaaatgtgctttttttttt

SEQ ID NO: 27494 - DNA, 1501 bp, Oryza sativa
catcggcgaaggggaaaccaatggcctcggcgttggtacttgcatctcaggaggttggagaaggcagtcgggatagggattcccatggtaccctggagggtgatgctgaaggtttctacactgaaggtccaggaaccttcacggagggagaagtctatgaggaagaagaagatgcaattgaggtgaatcttgaagatgaacaagtcaagcttgcgggtcaatggacaatcctatcaaggtattactcaatgcgcacaccaatccccacagctctttttgatgatatgcgcagagcatggaggctgaaatctggtatgagttataagtcgctcagagataatctgttcatcgttacctttacatctgagggtgactatcagtttgtagttcaagggggtccatggctgcataggggggacgccttattggtggcccaatttgatgggattataagcccgtcgcaggtaccttttgaggtggtacccatctgggttagaatctatgatctgcccttggtgttgatgacgagggaaagaggaaatctctatggtagtaagcttggtcacgttcgggaggtggatgtggagaatgacggccgtaataaacatgattttttccgcatccgtgtggatctccctgttaagcgccccctccggaaaaagcttgccattaagatcaaggagcaaggtagtgaggttgtcagacattttgacttacggtatgagagggtgccccacttctgcttcatctgtgggtttatcggtcactcagacaaggactgcgaaaagaaactactcacaggtggacaacccttccaattctctgcagacctgcgttgctcccctttgaaaccgtttgagaggaagatcagtaaaatacaaccagtgcagtcttcaggtgtggcacacaagctgtccttcaggagtgctggtagtgcaagctctacatcgtccagacagaagaagggtgagcaatgggatgaggcgatcccaccgagggtggatgcacatgatggatttgagtccaaggagaaagcaggagatgggaagatagatcaactgcttgcagagaaggcccgtaatttgtaggtttcggcacagacaggtccagaacagtacggtgagttgtctcgggaggttatcactgatatagttgttgatcagctaccttcggaggagatgattccggcgatgaagaacctgcaccagcaagcttcctttggagagggctcaatggatgaaactaatagtcaacacaaaagaagaacaacagagcagggagatggcaagcattctggcagagtcaagcaagcactcttggagtatggcaaggcagcggaggagagtaaacagcttcagctagctcctagcagcactccacgagcgttgaagaggtttaaaaaggagaaaggggagagcataaaggtggaagacagggaagcaaccagctcgggggctgctggtaaactgacgggatctgtgattggatcccgtcaggagaa

SEQ ID NO: 27495 - DNA, 1501 bp, Oryza sativa
gtttaatgcaggcttcaaagaaaggccgttgtttttgcgattgattttatttaaactcttttttgaaacaactaagggagtgcttctcaaacgacacggatgagacagtgcgtctcgtccggtcggagtatgtgcaatgtttcagtcttttgaattgatcaagattggcacccggccaacagctttcaaacggccacccgggcctggctgatcccatcagccgcagattttccaaacatcaaacccattccacaacagcaaatttcacaaggcagtagtcaaacaaaactatgctaggaatcacctcacatccgcccatgaccgtgggcacggctgctcgaacagttttaataacctctgcagagggggcacactttacccacacgacattactaacccggatcatccagcccgtgcagaacggccacgactagagaccttaaggctttcatgacaaagaatttcaaaagccgacacaggttcaccatatgccaacgagaggggtcccagaccaacaccagattaggtcccagaccatactgtgccaggaagccaaggggtcctccccgacaccaccccggcgaatccacatgtctcttagcatcatggctcccccgataagctagttactcagccagaggtgtcccattccacccatgtggtcgtacttgtcttatattcggatgaaattccaaggaaacggtccttaagtgcaagagcgggaaaccgtacacccggtacgttcctcggtccgcggttttggaaattcatttagttcgcaagcaccgacccaggtgtcgggttttccaagtcttttgtaaaacccaagttttacccaagatgtttctcagattttaagtttgaaggcgaccgtcgatacccgtgcagagtgcacgattaccgaggcgcaactaggtgggtacaagggaacatggtataacaattacaatggaagggtcaaatgcaacaaattaggtaggtccgccaatctgccttgcagacgggacaagcagattaagtgcgatcctatcaatgcataatatttttcaagcaacataattaagttcaaatataggctcaagatgttcaaatgtggcttgccttgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgagaattttggaagttgaacggagtcaatcggacttacggttgggaagatattgaatttctaagattattggatttttggtctaaaggaaaaggatttatttaaatcctttttgaaaaagaaaagaaaagaaaagaaggaggcagggaaattagactttcctcgggcggctagggcgcggcccgagagaatggggcggctcggccgagcttaatgggccggtcggcccaagaaggcggcccaaagcg

SEQ ID NO: 27496 - DNA, 1501 bp, Oryza sativa
aagctgcagaaaaattgaaattttcttgcacaccttaagacaatgttttagccttgatacctgcaagttatgaatttagcccatctttgtagtttatcatggttgactctctaatacttcgtgatggtgaaagctcttccaatatatatgcatggtcttaaaaaaatcataatgacgtatttcacgaaaaataagaagagatggcaaaaatgtatataagactaatatattgcagttgttctattgaaataagaagatctatcaaagctatgaagaaaatttttgtattaacgtttctgcttaaaaaaactttacaatctacttggtctaataaaagttgttatacatccatcctaaaatataataatttttagcattcatttttttttcaaaaacatatcaattccaagttgttgggttctgtatttgagaaaacaaaatcaaaacttaactatttgatgggaaacaccatatgaaatcttgcaaatttcggattggatcactttgaaattcatgcaataccccataaccataacacctcctctcctccctcctcactcctaccgctgccatgacttggtcaagtgagcgctcgatgccccacctcctgtgtcgttgtcgtccaccacactaccacccggctaaactggtggtcgaaaggtgccgacaaggcacccctagcaagcctcttctccctttcctagccctccttctacttaagggcccctttgattcgcagcatagaaaaaacgcaggaataggaaaaacacaggatttgaagtggtaggattttgaaatcctatgggaagagaaaacagaggaaaacataagaagatccctttgatagaggcatagggaaaaacaaatgaatctgcacatcacttcatttccaagaggtctgacctcttttttagtttcctttgaaatccactgataggagtgcaatcctatggaatttatacttgccttttctatgaatcaaagaggcttgaagaaaaaaaatcctttggaatcccattcctccaaaaatcttttagcattcctttaaatcaaagaggccttaagccagattcaccaataccacccgccattaacgttggcccgctatcttccttcatccacgcggctctctagcattgttgcctacccatgtccattatttctcattcatagtcgtatcactgtttccacaacaatccatttaaacccgttgataccctctatccctaaaccctaactttgtcagggcattgcatgttattaaagcttcgttggagtttaaggagaaggagctgagattgtgggagcgcgaatcaccgaagcaaattgtgaagtaagaaatttataaggttttaggcccaagtctaggataacaaccatttatccattaaaagaagtactcagaataaatccccttaatcccaaggggtaccgtgaaaaaaaggagtacggctaaaccctcgcgagtccccactcttcctctccccgttctgcatcacca

SEQ ID NO: 27497 - DNA, 1501 bp, Oryza sativa
gggacgaggccgatgcggggaagtgatcggacggcagaggctggaggttcggctgtcccgtgggacccacctgtcagtgagataagctcgactcgcccgagatggaccgtctcctctccgtgataggcggcccatctcggtgccccgcgaacggctccggtttttctacgcgagacaattgtccggcccatatttgaatgtctaccactggtttcaggaaggaaaaggtttacttttgaggtcctcatcgtttcgtcgagtttcaaaattcgttcgttaacccggaatacccatatataatgcatccctaatcttgcaaaatcgaatcatattgggtcgtacccaatataaaaaaaaccaggagcaataatgcttacaacctaatatgacccaagaccagagatgttttatatggtatttcggtttaaagacaagttttgaaacccaaccacactatgagtaacctcaagtggactttttcctactagcaaattcaacacatctcgatggagatggatggagctagcagtcgtgtgcaccgacgtatctcgggcaagaaggcacaacactggagttgttcttcatcgtgtcgtctctccggtgagacctggaatagtacctgcttcttgttatctgggacaacactggtaataaatttcagatgtcactgtagaagaattcaggaatcacacacagggtcactgcatgccgggtagagttaacccctttgatttggagaaaaaacatataaattttggaggattttaatcctacaaatgtctttgaaataaagtatcaaatactattctatcatttgaaaagacttaccgagcagggtttcaaggctaatgtaatctatcaagaatccattactgagacacaaatgcataagatttatctatccaggttgaagtttacctctagccaagaacaatcaatttcaataacataaggtgaactatgtgtgcataccacgcggtacaacattgcattgttagatatcagggttcactagcataacctgataaaactatttatggttgagaaactgggacttcttggaaatttgtagtcaggttatatcatacaattagtaaaacaaacatgtgagtttcagatactattctatcatttgaaaatcctataactaactttttttccccgcgtcgcctccccgtgagggcggcacgggcggcgacagcccaagccgccgccgcaacccaccaccctcgcctcttgcctcgccgccgctcgagcgaggtgccggcaaagccagcgtctcgccaggacggcggcagcggggctcgcagctctcgctcctccggtttccgacgcgggcggacccgagggcggaggtcggcggcgccgtttcctgcagcgggcggaggccatggcggctcgcggcgttgggcggaggaggcgtcgccggcggggcagagggagtggcgcatgggagagggagcagcggcggttggtagagatggtggcggtggaagtgccg

SEQ ID NO: 27498 - DNA, 1501 bp, Oryza sativa
gttttaaaaaatcatattaatttattttttaaaaaatacaaatacttaattaattatgcgttaataaatcacctagttttacaagcccgaggattatttgctaacctcgtgtgccgaacacagctttacacacgactctacctaccactacacctatttgagattttgttagggcatcagcaatgtgctcgcaaaccgggtagtaagcaataaatacactcttactacctggtattaagcattgtggggctagtacataactacaaccgggtcatacccctactaccggaagcaaggaaatagaatatgcatgtacacagtgttttctgacagcaaaagcattgcttctcccaaccgttgtatgcatgctctgtccttgctacaatttttattaccccatggaccccaccttactgccaacttacagatataagcaatgtggagcacgtctccctctattaccgcctgtcatctgggcccacgctaataccgatgtggatagcaaacattgctgatgcccttagcacttagagtacttgtataattatttccctacatatcgtgttgactttataatgcattaagaattgaattcgattacaaacatgtttgatgcaactttttttttcagagtttgaggtatctcgttaactaattactttatctgttgcatgatatagtaacgtagtatcagataagacgtttgagatatctcgttaactaattatttcctcagttccataatatataatatagcaacacagtattagataaggcattgtattagggatggtaatttaacccgtttgcccgtttacccgtgggtaaaaaccctaatagagttgggtttgttctccatttagtacccatgggttttttattaggtcaaaacctatacccaacgggtatacgggcacgggcaaaaaccaattgacatgtggtcactcagttaaattagtataaatgccaccatctagtactgataaacttgtaatgcttgtattgttgaacttggtacaactgtaccctttctttaaattgcgataatgtctctctgcttgtagagatttgtggttgaaatgttgaaatgtgagtttgtgacaggtaaacgcgcatgcccgcgagcacatggcgcctgcggacaacgggcatgggtagtgttccttgcccgtcatgtagtaacggatatgcccgcgggcatgaattacctcgcgggcacgggtatgggtagtcactatccgtgcccgtcgtgcccgactgccatccctatattgcatagtataacgaatataaacagatacacgtctagattcattttactatgaaatttctcgtccggtactaaattattatattataggatggagggattagctattaatctaagctgcatatggatgaggatattattgcatttcagaaaatgttactactgtcaagtcagttgtagtttgaaatagagtaaattttaggaaaaggtatgaattaccccactgaacta

SEQ ID NO: 27499 - DNA, 1501 bp, Oryza sativa
caagctttttccggagggggcgcttaacagggagatccacacggatgcggaaaaaatcatgtttattacggccgtcattctccacatccacctcccgaacgtgaccaagcttactaccatagagatttcctctttccctcgtcatcaacaccaagggcagatcatagattctaacccagatgggtaccacctcaaaaggtacctgcgacgggcttataatcccatcaaattgggccaccaataaggcgtcccccctatgcagccatggacccccttgaactacaaactgatagtcaccctcagatgtaaaggtaacgatgaacagattatctctgagcgacttataactcataccagatttcagcctccatgctctgcgcatatcatcaaaaagagctgtggggattggtgtgcgcattgagtaataccttgataggattgtccattgacccgcaagcttgacttgttcatcttcaagattcacctcaattgcatcttcttcttcctcatagacttctccctccgtgaaggttcctggaccttcagtgtagaaaccttcagcatcaccctccagggtaccatgggaatccctatcccgactgccttctccaacctcctgagatgcaagtaccaacgccgaggccattggtttccccttcgccgatggatcccccggcggctgttgagaactttcgatcacaacttatgttgttggcttcggacgggtaatcatcttatcgaggatccttttatcacccccaccgccaacagacgccatgattgtacttttacagcctttccaagcaaaccctaggaaccgaatatggggagatatcttcttggaagacaggaggattgaccgccccccggacgaccctcctcctgttttatatgatagaacctccgagtccggatctttgacgaacttccaccatgggtaccaaccaaaaccatatcttctttgtattccatatccaattactgcaggtttgttgcagatatcccataatcgaacccaccctatagatgtatccttatctgttctggacaggaatttcagcgtttggagattgaatgctgatccgatcaccaggaacaaagttgatttctccgtagaaaagcagaaacaagaacaatccgaaagcacgagcgaaagcccggccaaacttaccatcagatcggagtagaactccatccaaatccatcgctctccacgaacaatggccgccgccgtccgatcactcgggcgtcgccaaaaccctaacatccgggaaatcaggatatatcaactaatgaatagttttttgttcgtgatatcttgttatatagatttaattacaacgaatgcaacagtgcaatcagattgtaaattggataaatggttttcgagaaaaaatagtttgaagcttgtcactatccatgtacctctctcatttggtacataaacttttcttgttgtcgctcttctctacatgcgtatgtaatagtttttttaatcaga

SEQ ID NO: 27500 - DNA, 282 bp, Oryza sativa
ctgcagccctacattgttcaaaaacactatttattcggctgattactattcagtttactgtttattcggctgattactattcagtttactgtttgttcggctgattactattcagtttactgttcaaattactgttcaatattgttcacttcgagagatattttaactttaggatctttgcagggtggcgaatcctacttagacagcctcagaagcttgtttcagatgatgtaaagtcctactcggtactcaccgtatgcctcacctatctgtctttttaga

SEQ ID NO: 27501 - DNA, 1501 bp, Oryza sativa
ccaaaaacagaagataattcagatgacgaactacctcaactctgaataaaatttggccgccttccttctttagcccggcgagaaaaaggatggaaagggcctgaatgacaggctatggaaggtaagcagttttcagagacctggtatttgagtcattgtccgtgaaaattggtcttgatcattgacaggattgtgcgttttatgacagagaaaaaagttgggaagtaggataagtcggaggaacagtgcagattgcactgcaagtctttgagatgagaatgacccaagagacaggccactgaaaagtatgatgttcatctgacctgaatacctgatggttttgaatcgattgacctggaatgatttctgctaacttttggaaccgtgcatatgattatgtttgattgtgcagagatgaagaagcggctttgaagttttgtggatcagtcaaaatgggaattgcgagaacggaactgcaagtcatgcaggagacaagaatccaaaaaaagccacattcaaagtctgatcacgatgagtgaagtgcttatgggcttagccacagatttgagcactccgtttcatgtaagacagcactatctgattccactgcttcttacacattgtattttttgatttgctgctaaagcctcatgcaataccatctcacaatgcaaaccaggacttgatgcatgcgcttccacgggcttcccacaagctgcacaatcacactaaaaacgaagagccatttcacaacatggaagaaggcgattttggtcacaggtatgtcagcacacctgctatcctttatatgttgttactgaacattcctgatctggaattagtttatgctaatgcttggtttctaatcttaaatggaaacctaacatattacatcaaatcaaatctcaaatgattattctggtagcaatacccatgtatagaaatctcaaatagaaacagctctcacatgatagcagctgacccaacttgtattagtactttgttgttgaattttcctatctggaaaatgaggatcaaggaattaccattttgtgccactgacatgtgtgggtcaggtgggtaaatcctagtttcaatctaaagggaggttatatgatcaaatttcacaacgtagaagtatgaaaagtaaacatgtgagatgtaacaaaagagcatgcctataactaaggttagttatggccaacatacccacaacccttctcaaccatctcaaagtttgccaagagttaatacataatgaagaagaaagaaaaggttcagcgcatcataacacacagatcacagagaccgaacagactaagtgcaaatataaacagatttgaccagcccacaaagtagatgagggtagcaccacaacctgagatgagcatcacctaagcataatataaagtcttttgaaagaaattaattgttattgctcaaagcatttatcttgtcctgcttcttagcctttccagacttccacacggagttgtgagaa

SEQ ID NO: 27502 - DNA, 1501 bp, Oryza sativa
gtgtcgtagtatagagtttgtgccgtgaacaggaggtagaggaagaggccacgagactatttttgtccaccaccctcgtcgataacacgtgctcaggttggatccagtggcaagaaggatatcaattgctaccgacaattattagttgataatattaaagtatcggatctgatacctaacaggtattatatcatttggaacatagacgttgtgcaatagcaaccctctaaggtgtttaacatgtgaagtggagagaatagtttcttgtgcattatgacaacaaaagatgataccataccggagcttgctaaatccttctctacgctgcgcagtggctctcactcgcgacgaatgtttccaaaaggccagcttcaattcttactatttactccgatctatttcacaatgtaatactttctagcattatctacatcatatatatattaataaatctaaacacatacatatgtttagattcattaacatctaaataaatataggcaacactagaaagtcttacattgtgaaacggaggaagtatcatgcagagagttaagtcgtcgttgatggaccgatctttagttggcatagtgattaattatgtttgtcacgtgtcgaatgtcgcaactcattttactagctcggtcttgtgagttgtgcgcattctagtaatggtatctatcgtaatgttatcccagagtgtgttcggagacactgtgtaatgatttatcataatcaataaagcacaacttcctctaaaaaaaattaaaagttttatgattaatgatcgtgtcctcgttcgtagcccttgacattctgcacgtgcacagccacatcaaaaatcatgatacatcatacctgccatccacgcatctaatgctggcatatgcctgccatccacagttaattaagttagggttccaaattttttcttcaaaattttaacttttccatcacatcaaaacttttctatacataaacttcagacttttccatcatatcgtttcaatttcaatcaaacttctaattttagcgtgaactaaacacaccctatatgctcatgaatgaaacttttggtttccctattattttttttaactttttgttcagccatactccattaaaaaaaatcaacgtaggtaatgatttaacaccacctaatttattttgaacaagctcatatatccaattcattagacggttgtatcatatcttcacctaaattagtactccctccatatattttaatattttaatgtatgacgtcgttgactttttaaccaacgtttgaccatcgttttattaaaaaaaaattgtgtaaatatgaaaatttttatgtcatacttaaaaaacatttcatgatgaatcaagtcataataaaatatattataattatataaattttttaaataagacgaatagttaaacgttggaaaaaaaatcaatggcgttatacattaaaatatgaaatatagaggtactacctcagtcccaaaataag

SEQ ID NO: 27503 - DNA, 620 bp, Oryza sativa
ttaattacgcacagtcaagctgtctacttacaattgaaaagcaatttgttgcttggggaagttcatcatgcaggacagttgcacacttgcactgcagtgtttagactttttgtggggagccacagcgggtaattccaagggaagagtttaagctgcctgctgttgagctaaactgtgtctgtctatggatttcttctgctgcattgccttacagttcatccttttgcaaaagaaattctatagacatgaagctagcctgaatactcttgtaaatcgaggtgattgggtaataagtgttccttagcttaatcgatcagatccttgtgatctaaataacattgcgtgttcaatcgacccacgttgcatttaggtcctattgtactgaagccttccataaagccatactgcagcagcactattgggcctgcttgcttttgtcccttttccaactattggctttaacgattgtcaaccaccggaactgctcttaatgtatgtggtatttgactcttacaggaacgaggacactgtaacactatactgaataggggtgtagttcttgtgctaaattgctgacacattgaactttttattgcaatgtttcatccgtaggctggaca

SEQ ID NO: 27504 - DNA, 1501 bp, Oryza sativa
atcacttttcaaatacaatctaaatggctatgtaaagtatctcaaaacatttaataacgttgctacaacatacatataccactccacaattttaaatctaaactcaaactcaaatcatgaagagaaaaagaaaaagacatatccacgaatgaacatttatactattcacgcctagatttttccttttctctctcaacatgtagattgatctcaaacttagatttggtggaggaagatatcactatagacttatacttttttaattttcttttttaaaaatactccctctatcctaaaatattactcctgactgtttcattgaatttgagagcaaaaaaataagtccctctctttcaaaatactcccctttgtttgaaaataattattgtttcagagaaggacacaatctctaaaaatataactttggtcactaatttccgttataaatatcaacaagaatatgtttttattgaagtacttttaaaaattaacctttacctatggcctccatatttatatggcaaatattttggaaattgttttagtaaaagttttaaagttggctgttagctagtcttgtccaaaacgtggattattatcaacttgagtgagtataagcatttctgtctatgtatacaaggtcccaaactataagaactactgaagatgtatatggacacatagaattggtgtaatatatcaaaatacatagccataaatgtatattttcagacaatgaagaattcataaccactttcattgaagttgagaggaaaaaaatacatctattctataatataagtatttctagacatgtatttggacaaggcctaaaatataatataaggaatgcttatatatattataacaagagaaatacacgacatccggttggagggattcgaatccatttcccgctcgagacggagatggattctaattgctcggatgaatgtctaccaatttattgtatatcaactaaatgattatgaattttttttagaaaaaaataacaaggtagattgatatataacatatcccttcatagacatacgatttgaaattcaaattatataaattgtagctaaaatattaactttaaccatgaatatacatatactatttactggttatagtttgatttctttttttttctataactcacagaaaccgaatttgaacttgcattttttttcatttgtgaaacaagatattacatacgaatttatcttatcagtttttcttaaaattcttttataactgtttagttgtcatgtaaaatttcttttcgcaaatgcgttgaaataaaataaatgggtggatgttaatgtaagtgatcaaagatgtttacagcccgagaccactcatgcaatctggctccggcacatgcatgcaattgccacgccatgctccgtgaccatcgggtcaccactcaccacttcaccagacacctcgcctcgtcctcgccctcgtcatccgcacatcgctctaccattctcgc

SEQ ID NO: 27505 - DNA, 840 bp, Oryza sativa
cttgtagtaacagttttagttttatcaatatttaacatttccaatgttaaaaattgataaaatatgaggttgtatctatatatcttaacgtctcaagattcaaaattagtaaaattgccctcctaattaaagagggtgtttatttgagtgagtactttgccaaacactgtcaaaccttttaaaacttttaaaactgttgtttgtttcgctgtcacaagtgtatatatcatgccacatttttgcagcggactccacacgtgatactctctatttttcttgtcaccttgacttaatatgtggtcaacatattcttgcgcgtcttttaatgatcgccacaccttagctaacacacattttggcaagttggtgtgacttcttttttgacaagaaaagactgtgtggtatttatttgatatgaacatacaagtaggaatgaaaacgactcaaaaaagacgggaaccatatctatcattttcgtttacatttttttattaaaaaatatgaatagaaaacctcgaatatcaaaacagaatagaatattattgaatgtgaaaacaatgatgaatatttattggaaaccgagtttccaatttctttctaaaacaatagataaaaatttaaaattttagcagctaatagtaccactttccactttgtatcataaggataatatcacggttcataaacactttgtcaagttcaaattttcatctttgagacggtaaacattcttcaaaaaaagttttaaattagtttttcagatattctccaagaaagtttttgacctatttcgctttctgacagatagtgctattactgcatccctttttgttttcaaga

SEQ ID NO: 27506 - DNA, 1501 bp, Oryza sativa
gattaattagacttaataaattcgtctcatagtttacagacggattctgtaatttgttttgttattagactatgtttaatacttcaaatgtgtgtccgtatatccgatgtgacacgacaaaaacttttacccctagatctaaacacagcctcagtcgttttgggagtttgggtaggtggtaccttgtcggcgccatcatttccaaaattccacctttgtaccttattggagtcttcaccatggttcatcaatccctagtactcacgtattattgctagcccctttaggcccttcccagtgcgtgtacatggcatgttaccttcacctgccatattggactcgcttacgtgtcgacgaggctcgcgcctctgcttagccgctcgccccttatctgggagacgagtttcttcgttgcaacgagggcgcgcagcgcaagaaaccccctccgcccctgcaacgtggaggtcgtcgctccgattcgtcgcttcctcgcgccgccccgaaaagtgaatccccaaaatcaccctcccaccccaccgattcttgcctcccgcgcttggatttgggggagaagcggtgcagtggatgggcgaggagaagtggcgcagattgggagaaacggtgcggtggatttgggaggagaagtgtcaaatttggggagagaagcggcagatctgggaggagaagcgcgtggtgtggtgaataagaagaagaagctcggtatttttttaaccgaaggggggtgggtgggacggggaaccggcccgcagatgggaagaagtgacgggatttttttctgtgtagaggataagcatgaaggggcaggtggggaaaattaactctgttttcgttcgactgggagttccgacttgatagcgtattgtgggtcacgagcactgtggggtgtgtggcctactggccttcgggccaattttatcgcacaaatgggctagaagcgcgctatgcgtgccttgcactgttactgcccttacaagtataatgtgtggtactattagagtattgttccataagtatcggagttgatacccacatatatcattgctggtacatatatggttagttttgttgatctaatcaccacgatacaacatatcatggaagaacgtagggagagagagagaaagagaaaagggaattgggtcgttgcgctatcaacatggagaacaacggatgggttattaaggaagggatgaagggaatgtgtaacgccccgattttcgttcgggattaaaaatcattaaataatgcattttctagaaattaaataaaagttaagtcaattcaatcaagtgaaataatgggagaatttgaaattttcctttaaaaatcattggccgagaatattttgtaatattctttgtgccctaaaatactctccggatttttccgcgaattttcggagctcaagaaataattataataatacaaagttcatttaatcaatttaaataaaaagaaaagaaaataatcttccccttcc

SEQ ID NO: 27507 - DNA, 1501 bp, Oryza sativa
ttggtacaaaagttgcactcgttccttaggacaaccatatgttatctgcaaaagaacatcatcgctccataagatcatcccacgcaaaatgattacacactgtattgtttagatttagaggatgtaccaacatgtagatcccaccaggcctaagaatcctgcaaggggaaaaatagttcaacatgaaacatactgaatcattgggaaccaactagtttgaaaagagtgaaaaggataaactttcatgccagacaccttgccacttctgctagcattttggaagcaccaagaggagcatcatcgccacactaaaatagtaagatcaaatgcaacaacaataatggtcagatgatttttcatttcatgcctgatcagaaagctaaaatgttgtttgtgcaacaagtaaagcttaccatcatagcgtccaatgtaccttcagaaatttccataattccgtcataacaaggtaagtgtagtggtgaaaaataaacaaataccataaatgaatttattcagtaaattccataaaaaagtattccacaagagcattagcaagcttcggtaaataaaattcttaaggtacctttatcaaggacacaatcgaatgttccatcaccaaacaaactcatgtccctaacatccatctggaaatcttaaaacacaagacaccaagtaaatagaccttgcatagaaaccataattcacaaactatgagtttgaaattatcaatgaaaacactacatgtaagctgtggaatatcaacgtgtttctccctcatctgctcaatgactacggatgaaatgtccacgtttactacctcctcgtacccatccttcaccatgtcctccgacaaaactgccaaaataagatcaaactgcatcatgcaacggataggtgtgaccgtataattagtataacaatgcaacagggtaatctactactccagtgcattcccaaaaatatgtggcgcgcgcgacgaattagcgccgaaatcgttgaatttgagtacgcagatagtttcaagctagtgtgagtgaaggcacgcaggtaaaagaggtagtagaggcgtacgggagttgccgcacccgagcatgaggacccgggaggaggcggggaggcgggcgcggagcagcggccgcagcgccgggtacgcctggtaccagtcgaagaacgcgccgccgccgccgccggtggtgccggtggaggagggggaaggggaggagtagcgggcgtcccagtaggcggcggcgccgtagtcgttgctcctgcactcgccgccgcccatcctttttgctctcctttctctcccgcgcggtgcgctagctcgccgggaagagggaacgggaggcctcgagaagagaccgcggcggcagggtctgatgggcgatggtgtgcggcgagccggcgactggagtactacgctgtactagggatttgtactcctagtgcagctagcactgcaatttgcgacaagggttcccgatataatttagtactgtcc

SEQ ID NO: 27508 - DNA, 731 bp, Oryza sativa
  unsure (1)..(731): unsure at all n locations
cgtatacctagctgatttcaacggtaatggcttctgatgagcgctataactgtgcggttttcacgagtaccgccaaaccgtgggtgacgataaccacaccctagatcaatcagatttcttacagttataaattctacnntacctccattcccaaatataccagattttagttagatgtaatatattataatacaacgaatctggagagaagcatccaaccaaaatctcttatctgtgcgtttagttcacactaaaattagaagtttggttgaaattaaaacgatgtgacagaaaagttgaaagtttgtgtgtatgaaagttttgatgtgatgtaaaagttggaactttgaagaaaaagtttgtaactaaacacggacatatatatatatatatatatatatatatatatatatatatatatatatatatatatatatatatatagggacagtactaaattatatcgggaacccttgtcgcaaattgcagtgctagctgcactaggagtacaaatccctagtacagcgtagtactccagtcgccggctcgccgcacaccatcgcccatcagaccctgccgccgcggtctcttctcgaggcctcccgttccctcttcccggcgagctagcgcaccgcgcgggagagaaaggagagcaaaaaggatgggcggcggcgagtgcaggagcaacgactacggcgccgccgcctactgggacgcccgctactcctccc

SEQ ID NO: 27509 - DNA, 169 bp, Oryza sativa
atgtgcatttttataagcataattcttcgagatttttataatcaacaggtagggccccacattaaagtcaagcttctcacatataactagaaactatatatgtcctattcataacttcatagtgctcaatatttggcatggcaaccgattttttttttggcaaaacctg

SEQ ID NO: 27510 - DNA, 1501 bp, Oryza sativa
tggtttgctcacttcactgacagatccagcgttgagcatctcagagatggcaagaacacacgcatcgcatcgaatcacacaggagggcagcgtcgtcagattcagatgtgctcacgttcaatgctgctgcctgctgtaccttagcttggatgcagcgatgcaggcagcgagggtccagccattattaactcctattgctacaatactactggtagtaccacgcacgagtaggagaatcataagctactacgatgctgcttgttatttaatttaatccgttcttgtgctgccattgccggggaggacgtaaggaatcattccaatctgcatctcgatcgatccatcacccatgccgccttgctctgattgattcctccttttcaatccgtgcaatgcaatagtagcattacttacacgctgcacaagcatgaaaaggctgtagtttttcgtgtggaaatttaccgggagtagttcagttcctacgaaaatactctaaaattcctccaaaagggagtcttaaatttcaggttatcagatctcgatggttttagatgtgccgtataagtaagtctgtcgctgccaacctgatgatatactacaggctgcctgacagccgacattgtcattcagtctgtcaaccagcaaaataattcgctgcacaaccgggcaacggaaacttcactgcaataggagtcctaaattagtatactagccacagtgtgttcatcccaagaatcggggagtgttgttgctgcgccacgaatgactaacagctgattgtttatgtgttaatcgtggcgatttgtaagttggtcgcagacttgcgtatcgtgatgagaggcgagcatgggaaaaaggatggaattaacaaatcgatcgcatcgttgtaacggcaaatccagcaggagctccagcatgatcagcgtacgtgcttttgagttcaggcgcacatctttatgtaaataatttgcattaggtcgctcatcaatgtcattcgtgctagtagtatttgtttgagtttgactaaacttcaggttttgttttagacgcagacgaccactaatgattttccgtcgtggggtgcactaatagaacgtctgaacgttttctgcgtgcttagacgagttcacattgaccatcaatttagtactaaaaaattagcagaatatttagcagggtttgtactacttaactacttattgaaatagagttttatttgctataaatctttcgtattgatctgtaaagacaaaataacatagttgtaacagcgtcctaataaatacttcctaatcaatttacccaaagtaggtgggaatgaaatgggaagcttggcaaagggtaatcaatttcatgaacaatcattttctgatataatgaaacagacatcctcattaatcttcagttgaaacagacatcctgaaacatggacccgacactgagaaatttggcacggccttacttataacataacggtatttaagccaataagacgaatcaa

SEQ ID NO: 27511 - DNA, 1501 bp, Oryza sativa
cgcccggtcgaaccagaagccgctgctctccctccgcatcgaaggtccgacgtcgttgtcctcgactccttccatgtctcccaatgacaggctcaagctcaaacggttggccccaggccaagtggagctctcctcgcgtgcaatccctgctgttacagacgatgatggtgatggatcacacgcagctggattgtggccccttctgtcactgaatgggtcagatggcagcctgcaggggtttgaggagttgctggcctcggttcttggaaagaaggcaggtgagaaggggacgttcaagctgttgaaggcgcgagcttctgcccaaacgtacgtcaagatggggtttgcggtggagaagaggattgctgacggagaggtgaactggtccaacttcccggagtggaagacgaagcccaagaagttgagggcgcactacgaggttcttgctcgtgtggagggtggccaggcgatccctgaaaggatcgcgcaggtgcagccttttgaggccgacgaggccatgtccgagagcgtgctcaccgggaatgtgtcgatgtcgaagacggaggtggttcatccgccgccggtttacttcactctttgagagcagttgaagctccggttttaagtgagctgatcacggtaaatgacaagcggcgaaagtttcttggcggcgagtattattaactgcattagcatgaaaaattgttgtacggggtatgttatactggccagctttgtaaattaccaaactgaataatgaatgaacgaaccattacaggaaaaggattcatccataggcaattgtatatctttttgaaaccaagagtgccaacttttcagttactgcatcttttgtttcatttcagttaaaccgacgacgtccttgtcgccgcttttgaagttcgccgccggtggcatatgtagcgtatgcggtgcgaatattctcccaggctcctggaggatttgattggataagccgctcgtaaggacaccgtgcctccaattgttttaggctgctatttgttgggcggtgcaccgtgcacgcgagtacggcgtcgcatggtcgcggccctagtcgcgcgctcgcacgtgggcacgtggctaggcttggcttcgcttctactacggcctcccctcctcaccgacaggcatggcccacacgtcaggcgtggccgcccgtctgaacctggttttcatgggccgcccgctcgcacgcagcgcgcagccaccgccatctgggcctaggttttccgggagagcgcagcggcggcgcggaagcaacgaagcgaccgcttgcgggaagggccggagccgagccggccgcgccgcctcgcccgacgtcgtagcaaccaagccacccccgctccacgacgaggaggaggaggagggagaaggatggtgaggagagggcggaagggcaaggacgcggcggctggcgccggcggcaccggtggcagaggcggcggtgccggcagaggaggcggcagaggaggaagcggcg

SEQ ID NO: 27512 - DNA, 1501 bp, Oryza sativa
aaaataaagtacaataaaaaaccaaaaaatcgaatccaaaattaagttctaaagtttaaatttagcttataagaataagcataagccaaataatgaggccttcaaatacgagtttgatttgtcatccaattttatctcaagtcgggcagggaccgatgacggacggaatcaacaactttgatcctcctttatttcgattggcatgttctttttgaaagtaaaaatgattcttacagattattgtaatggtattcctggtaatacgtaagagcatgtgtggagactgacttgaactaacaggttgcttgttcattttggttgttttcttttttcctctatttttttcttttctttctttctatatggtttataagggtagaatggtcatttcatttatatagttgcattcgagaatgacttggcatgctaataaggcatattttgtgggtctaaggactatgttaacccaaatgattaatttggagaacttgtttttgaaatctcaataactaaactgagcccgaagtagaaatttaggagtagggacagtgttggctattcagaattatgaaatcgaaaggaacatatactttctaaactcttctcgtaaataggttgtgtttagttccattcaaacttccaaaaattccatcacatcaaatgtctacacatatgcatggagcattaaggtggtgtttgaatctcctgaagatgaagatgaagattaagtgtttcatgcaaaacgaggtggtaataacgtgtgattaattaagttttaattgttataaacttgaaaaatggattaatctgatattttagaacaactttcatataaaaagtttttacacgaaacacaccgtttagccgtttgaaaaacgtgccacgaaaatccaaaatttaatccacttcttgtagtggaaacgaatatgaaattgtacagtttgcatgtaaattgcgagacgaatcttttgagcttaattacaccatgatttgacaatgtggtgatacagtaaacatttactaataacggattaattagtcttaatagattcgtctcgcagtttacgggtggaatttataatttgttttgttattagtccacgtttaataatttaaatatgtaaccgtataattaaaaaaattgaaaaggaactaacacggccatagtcgtcttcccttttctgcaatggcacgtatctcatcaatgctctttggccgaagcttcgggacatcggacggcagctatcaacttatcaagccacttgccattgccccgaggggccgaggggctcccacgcgggacgggacgaccacgcccgtccgaccgtctgtttcgtccccgcagtaggaagaacggagacgggctcgtagccgtccgcttcccaaccgtcgcagtcgcagtcgcagcatccacgccacgccacgccacgccacgcgtttgtgtgtttcactcgaaggctcgctccactcgaagaccgaggcgtccaccaccaccaccacc

SEQ ID NO: 27513 - DNA, 1501 bp, Oryza sativa
gaagcaatgaatcaattggcgtcactgtcggcgacatgcgcctctgagccattggccgccgtttgtcttgctgtcgttgtaccgtactagactagtctgagattaattacgtgacatatactacatgaatatttgccaatctagaaagtatgtttcttttcattttgtctggtcatatgtagagaaggcaaagacaatgtactacaccttctaattgtcaaatggcgtcgtaccgtcgcgtgaacgaagcagaaaaatgagtgctggacttcccgcttggaagatcaaccgaacatttccattaagggtctgttcggtgagctttacattctaagaaataggatctgaaaaagctctgaaacccagcttctccagcttctgttttcttagttcattttttagtatatgtaactatagattctcagaagttgtggactgtttggggcagcttctagcagaagcagcttttgggctggcacaagctcccaacagggcctaaatctcggtcttcacagttaagctagcaacaactcgtctcgactcaaaataaaccaatctaaaaaagaattagataatctaagacaataaatctggacaacctctaaactccatattacaacacttacacctgtttaaacatgattacgatttttgcaaactgctaaagaatgtatttcataacaaaactttatatatagaagtggctttaaagtatcatataaattcatttttcaagtttgaaataactaagactcaattattcatacgaggggatgacccctcgttgtttgcatacactcaaatagtttataaaaaaaattgagaagatgtattatatgtgatatatcacttcacaaacattcaacttctacatatcacaacaaaaaaacaaattaaattatagctagttaacgtatattcacaatcaatttttttgcgacatgtacaagttgaattttaagttgcatgtttatagagtgatatatcacacgttaatacatcttcttattttttttcataactatttaagtgacattgcaatcaatgacggacgtccctcgaaagtttaagattcactccctatatgctaataacttttgttttatgtacccgcacttaatttgctttcggcatgttaaaacgggtccttaatcatgtagatttacaaaatcatacttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcttcacaccgaaacaaaagcagcagcagcggaaaaggcgatcctagcggggcttcagctccactccacagacaaaactcaactggggtctgagccttggtcttctaacttcgtcttcagctcagaagcactacacttctgaaaagggggaataatagcaaggctgagtacaaccac

SEQ ID NO: 27514 - DNA, 1501 bp, Oryza sativa
aaaattttaaggttccattatgggatgaaagtagactccaagtaaaatttccgaattgttctcaatactttaagattaggggatttctctctcaggaatttaagtttgaaacagtcaaattcaactaaaatttattgaatttaccgaggaatatcctaaattctcccgacacagctctgctcaaccttgccatctcgatcaatcgatcctatcccaaaaccgtggacgaaatcgagcaaaaatacacgcgaaacctgaccatttccatgagttaaacccgcgcctgaaaaccgcctcgatcggccccaccgatgagcggagcagattgccaattcaagactttgcaaccaggtggagacgcgatggaacgagatgccgccttcgtctcctcgccgacgtcaccgccacccgttgacattgctctataaaacgggaagcctcgagccccgtagacgaaatcccgaagccgaccaaagcaatcaaagctagtactactagtagtagtaggacagcgagccactcttcctcgtgccagcgcgagaagccaattcgacgcagcgcgcgcggagcggccggagcggagagagatgaagaagaagggcgggagcggcggcggcgggtgcctgggggcgccgttccgggcgctgtcgcgggcgtgcgactcggcctgcgacctctacgtgcgcggcatgtccgggtgcgcgggccgcgtgccggcggcgatggaggccgtcgcggtcggccgcgggttcggcaggccggcgaccgcgacggcgacgatgcgcctgcgggggctgagctcccgcgacgtcgacgacctcgtccgcgccgcgtcgaggcagcggcgcgtcgcggccgagccggcggtgggggcagccaagaaggttgggtattatcgcgaggcgccggcggggaagaaggggcccttcgaggaggcggcggccgccgtcccggcgccgaggaagaagggcgcggcgatggggaccatcgccgaggacgcgccgtgcgagttcgtcgcggacaccacgctgaaggccacgccgccggtgaggcggggcgcctcggcagacggcctagcggcgcgcgccggcgggtttggcgccattaaggtggggaccgaggccttcgcgcgctaagcgaagtgtataatacatgtactgctactgccagtgtataatcagtttttttttttgcgagagtataatcagcttttttttattattatttttggctggagtataatcagcatttgaacgtccatagaatctgaaatttctctctattttcatcttgatgtaacggtgatgaatgtaaatggatatgtatttgtacagtggaaaaaaaaaggaacaaagcgtaaactggaactcataaaactgaagtcaaaactctctagaagttagcttgaagcaactcggctttgaagcacagtacatgcgctatcctgtgatatatcactgacgaatgcttaaaattatacaccgttgtgatagcatgatgc

SEQ ID NO: 27515 - DNA, 264 bp, Oryza sativa
gacagaatacgcgctcgatcgatcgtccactagtatccccaaatttaggaaatctcttttctacgcacgcagcaaaatctaccatgccagacgatttaattaattaattctcggttgcgtgaaacaacatcactctctttttgtctcttctacaagcaatcccgaacaggtaggatcgattcgttcagaaaacactcacccgtagattgaggaacagccacgcaccgtgtaaacgacgcggatctggaccggtcgatcaacagc

SEQ ID NO: 27516 - DNA, 607 bp, Oryza sativa
acatttcctcgggatggtatgtcagtcgctacatatattttttcttccatttgtatcttttttcgtaataggttaaactaaatgactaaatttcgtggcagtattgatcaatacaagctgttgctaaccaaataatcaacttatgtattatgcctttggtggcacttatgtggccaacaaatcatcattatatatgtagcagcaggtcatcaaaatatgttttatggaaatttgttgctgcatatcaggtcatgggactcgcaaaaaaaagggccacagtacatttcactttgtaactctgtgaggtgttaatgttgtagcatcacctatatttagataatggaagtattatttccagcctttgcaccaactaggatccatacatccatatttgtggacaccagaatttgaaccttggtgggtggattcatgcacccatgactccaccaccacaacaatggtgcttccttaagtatctgtattgaactattgactgatttttttggtaatgcaccaagttgcttttacttgattaccacctttgaatagtctgcatatgcatatttttattagattaacgtattaattactccacaatttctgcagc

SEQ ID NO: 27517 - DNA, 246 bp, Oryza sativa
gtgcctcttccctcctccccgggtcgggatttggcctctctagcaagggaggtcgtccccctgtacagtgactcttagtgacaggaaggggtagggagcaatggcgttagcggagacaatgatggcgcagtcggacatatccgtgcatggacagcgagcggtgatggagttcgctgattcggcatggccgtgcccagatctacatccctacccgtttccgaaccccccacgataaatctggccaga

SEQ ID NO: 27518 - DNA, 718 bp, Oryza sativa
cctcaaattctgtgtcacaactcacaaggttgcaagagtgcacgaccaaatgtcactgcattcatcagcgaaaaacctctctcgcagttgtactatcaactagtactatcaagtggatgacaggaatggacaaattaaatttgctgagctgagaattttttcagttttacgttatagtagttgcataaacactaataaataaatacacaacgaggatatggatgatatattactgttaaacgcatgttaaacgtacaccttaaaatgtatgtgctcgttggtatgtaaatataaggtaatgttcgtttctacttaagataaaaataaagaagttagaacaccaaaaataagaaaaccattaacgtataattagttgagttttaattgttataaacttaacgaatagttttattcaatattttacagtaacttctacatatataaaaaaattttccgcgaaatatattatttagctgtttaaaaagcgtgagttgatcaaaccgaggtagcatgaagaagatgcctatatggtcgcaggttttcgtgtatgtctttcgtgatcgataaaaaaaggcgagattttaacgctacaacaaattatctggcggtatcttctcttcctgccagccgtgcgcttccctacgtaactcgcttgtcctgtgactcctgtccgatcgtccgtatggcatctcgaactgatcctccgttcccttcaagc

SEQ ID NO: 27519 - DNA, 1501 bp, Oryza sativa
tatcatagtactataaatttggacatgtctcctgtccagatttgtagtactgggatacgtcccatccgattctaagttgctatattttggaacggagggagtacagtgaacggataggttgccctccgtacgcccatgtggcagtcacgaagcgtacagggtgttactctttcccgttgcaagaacgaaaaattgctgtcaatttttgggaccagcaatccctttctcaaataatatgcacgagcaactctaagcgagatctttcattagcttatgcaggcaaaattgctgcgtccgcataggttagccggtgtgaggttgtgctgattggcaattgaccaacgcagcattcacagattcactatcatcatggcacaccgaacatcacatctcagcgaacgggtgctccaccaatgcaccaactaatgcacgcacaaatgcatagcgcaccaatgcaccaactaatgccggtagtttgatcagatatcccagatgtgatcttgccgatgggttatccccaccagtatagaagtgtttagtcacactgaagtttggatgtttggttgaaattagaatgatgtgactgaaaaattatgtgtatgaaaagtttgatgtgatggaaagttggaagtttgaaaaaaactttagaactaaataggacctatgactacaactatctttcggttgtcacgaagaccccgacgtgttgtcacgaagatcccaacgtgaacgtgacggagaagagtataaaaaaaaacacgatccgcgctgaccgccgcgccgccaaccggcaactctggcactcgcacgccgggcacgcgtttcacgtgtcgaagcgaagcgactgcacctgcacgacgacgacggaccggtctcgcggtctcctccggtcgcgccaccccgttccgactcccgtcctcaccgtccccgaccctccgcccaccactccctcggtcacttcccccaccccacccacccaccacgccgccgcgactcccccaccgttccacgcgcacgcgaccacaccactgctctgcacgcgacccgggattacactacacggtacacagccgcgcgcgcggactactggccagataacgcatcgcagattcgcgggaacacccctcgtggcgcacgacaactattcagtagtcaagtactagcgccagccaaagccaacacgagtttgcacgggcacgactccgcgccgcggcggccgtctcgtcctctctccacatcatccccgttccctcgcacaccacagcgcgcgcccgcccgccagccatcccgctgccgtgccgtctccatcttctatccctcctcctgctgctgctgctgctgctacttaccccgcgatttctcttcctcttattactcttcctctcggctctcgctcgctcgctccccgcgcgatttctccacgccgcacgccgctcgcgagttagggatcgatctcgtcgggggcgggcgggagagggagagggaggagagatggcggggg

SEQ ID NO: 27520 - DNA, 339 bp, Oryza sativa
ccccccccctcccaccccctaaaagaaaactgtttgtaacatcagaaacacatagtctatactagtatatagttaatcagctcttgccatttagtatttaaacatgatccttttcttatcttctcatcgtttagcttccataattataaattagattttaaaacttaatttttaagttgattgagtttcttttatcatacttcatttttcagcattgttttataaacctctaataaacataaatataaaagttttacccctaaactattttttattttttccactgcccaatgtatcgtgaggagttccgccggttcccaactcccttccttaattaga

SEQ ID NO: 27521 - DNA, 456 bp, Oryza sativa
accaccacacggcacatccctctctctccgcagttctatctgaaaaccacgcgcctttctcggtgcgatcgattgatctcatgtttctagctacttcggtctgatctgttggtcgggcaatcatcagtgaccagttttttccgttctgattgcccatttcacgggaaatgatggtctatagatgcgtaggaacgtacgtacaaagtaacagcgattggtgcgggagaatctgtccagagtggagttaattcggcctgtactctgtactgggtggattgtatctgcacgtatgctggtgtcgaaagtggatggtccatatagtagaggcatagagtagtacgtggtggcgccgaccggtcggtcgatcggcccaaggcacatcgcggtcgcgttgcgcgtacgcccaggagatgtggatcacgcggctgactcgttcgcgtcacggtgttttgcctg

SEQ ID NO: 27522 - DNA, 449 bp, Oryza sativa
ctgaaatatcagaaccaccagcatttcaagcaaccaagacatggaaaaggacatgtatcaaaaattatgttacaaaagagaaaatagcttataatgaacagtcgtcgcactggtaggctcaaaagtcagcactgatttaaatcacagcaaaaagaaaatcactgcataacacccccaccaaaaaaaaattgaccacaaatatttcaagatgtttgacagtgtttccggtacatggagctcactcagctcaggacaacaacatgatgtttgcatcagataaccaatacaaatgattatggtggcatcagctacacgccaaataaagcacagattatccctgcttattctttaaacatagttgggacgtttttgctggaaatcttttgatgttcagaaaaaaaaatccttatcaacaaaaaacctaccttttccaaacttcttgtcatcag

SEQ ID NO: 27523 - DNA, 1501 bp, Oryza sativa
aaggtgaaaccccacccacctcgccggagactcactcaccgcccaccgcacctcgccggagactgactgaccaccgccgcatcgcatgcatcctcacagtaaaaaaaaaagatgcaatttttttttacagtaaaagatgcatttttttttgacagtgtaaaggatgcttttttcttcttttgtggttttgttgttcatcaggcgatgtatatagatagatgttgctgtagttgatgtgcagcgcgattgagatcctcctatgtagatctgtgggtccatatgttagtgacaacggtacggtgcagtcgactgcagaggatcgtgatcctcacttctagtacaaatttatttattagtactgttaatgtaggagatttagcctaacagtggttgacacgatgtgattgtgagtgaggtaggaattgttaggcgaaaatgcaatcacacatgctaacatttgaaacagagcctgatgatttctggatgtacatatatactatgcgtgaatggaacatagcagtcaattggatgatgaatacttaaaatctaaactcgaaaactatcaatgtcatgaaaccaattttcctatagtttttaatggtgcccgtagaaagttttaaagacttgcaattgcatccttttttccagcgtttgatgtggacgtgtctggtaaatctggttttgaattcttcgtcgttccaacggagagaaatttgcgttgcctcctgatcatccatccctctttgatagtgcgcgtgtcgtaacaacgaatctgattctcatctcgagcaagatttttatttttctttttccgcttgcttgtcatatccacagttcatgatctcgtccagcgaacatattctgacgctttaacaacgatcgaatattagactgaagtggtaaaaggttgagaataataataataactcttactccatccgttttacaatgtaagtcattctagcatttcccatatttatattgttgttaatgaatctagacatatatatctaaatagattcattaacatcaatacaaatgtagaaaatactagaatgacttacattatgaaacagaggaagtataaaggaaggatcacaattcagcccatgctatcctctcctttttcattttaatcgatccaaaggcaagcactttgaaaccttaaactgagctttacaacgcatagaatcaaacattcattctgattagctcagatgagacgtcaggttatcagatcaacgcaataagaaacaacagtttccacaagaagaacccaccgattcttcaaccaccgaaagcacagatgcaagcagacacaagaggataaaaagggcagaaaaattcagtaatagcaggttcaatgggactacctcttgggatataactatgttagcactggtgctcactggatggaaatttggttcaaaagcattcgattctagctatttttattggagtccttctgtctgaacttttctgaatttaggggggaggacgg

SEQ ID NO: 27524 - DNA, 448 bp, Oryza sativa
tgaaatatcagaaccaccagcatttcaagcaaccaagacatggaaaaggacatgtatcaaaaattatgttacaaaagagaaaatagcttataatgaacagtcgtcgcactggtaggctcaaaagtcagcactgatttaaatcacagcaaaaagaaaatcactgcataacacccccaccaaaaaaaaattgaccacaaatatttcaagatgtttgacagtgtttccggtacatggagctcactcagctcaggacaacaacatgatgtttgcatcagataaccaatacaaatgattatggtggcatcagctacacgccaaataaagcacagattatccctgcttattctttaaacatagttgggacgtttttgctggaaatcttttgatgttcagaaaaaaaaatccttatcaacaaaaaacctaccttttccaaacttcttgtcatcag

SEQ ID NO: 27525 - DNA, 1501 bp, Oryza sativa
tcttaccactaatctataataattacatctaaattatgattcaaacacaggtcagctgtaattcgcagctacacgtaaatttatgataccaaggacgcatatagacagaattaacatatcaccaaaagcataccatttctaatcaagctctaaccatcacttagttaagacttaagagttaactaatactgcggtcaactggtcacaggtcgacgacgagtactgaacagaaactaacccaccgcgccgccgagcaacacgatgctacgagctaagtccaccatgcaacaacgcaagaagccaacctcgtcgcagcaaagcaaaaaatcgatgatcccacgctctttcacttgcacccgggccgcggaagcaaagcatgcatgatgcaagaggacgagaacatgtaaatcaaggacagatcgagtgagatcacccgacggagatcgaagagatgagaagatagcgtgtgtgattgatgcatgagatcgatcaggaccggatctggcctggggtgtgcgtgtgtataccgtggtgccgcggatgacgttgcggtcgggccccgcggcgatggcggcggcggcgtcgtcggggttgacgaactgcacgaacgcgaagccgcgcgcggcgcccgtctgcttgttcttgggcgcgccgacgaaggccaccgtgccgaaccgcgagaagtgggcgcggagctcggactcgctcgtccccagcggcacccctcccacgaacaccttgccgtggctcagcagcttcctccccctcacgatctccccctcgccgcccgtcgtcacggccaccgtcgtctccgcctccgcctccatgatcgatctctcggtctctccgacgaagctagcgagcgagagcgtggtgaccagaaactgatgcggccgaatggtggaagcgcgatagaggcaacgcgaacgcggagcgcgtgtgcttttgtaatcaggcgaggagagatggcgcttgtcgtcacgtagcacacgcgacgcccgcagcagaagcagcctggggatggctgacaggtggagcccgcagcagaagcaaggcgcggagtggggaccacaccctgcaggggccaggtaggggaggggacggggagggtcagcgccggcgttaggcgtttcggcggttgatagccgcgcggcacgcgcgtttgcattgcatgtcgaggcagcgagagcgagaaacgtgagccgttggcgtggtgtcgtccgcctccgctccgctccgtcgaggcgtcgagcggtttatggtccgctctgctggagttagcggtacagagactgttttggggatgcagatgtatgtcgacattggaaactgctgatgacgacgacatataaatcacgaatgttatcattagagacgagggaataccgggtagataagtatatcagcttcgaatttcgtatagcactagagtaagaggggaagtgtgtcgagttttgcgtagtgccagcttaaatgcgtcataagatattctaagacattt

SEQ ID NO: 27526 - DNA, 1501 bp, Oryza sativa
tccatgcactcttttcatcaaaaatcgtaattcagttccctaatagggaaaataatgctttattagtacactaaaatcataatctactcccatttgttcaaagtttgttacattttgggacggagataatactttacttcattcaaataataacactagttcaattcccaagtataaatgggtaagacagataatactttgtcacacacacacacacacacacacacacacacacacacacacacacacacacacacacacacacacacacacacacacacacacacacacacacacacacacacacacacatatatatatatatatatatatatatatatatatatatatatatatatatatatatatatatttgcacacaatttatatcaaaaatcaaatggccacaactgccctgcttctgacaaatacaataatactaggtttcttagcaattaaagaatactatttttctttagcgtttctataaaactaaaaaaaaatacaaacgtcgtgaagaaagtacaagtttcagaattgaattttcgtataatcagtattcagtaggctccagtacatcaatcagccccttgttaccaccaccatttacattagatatttagagacagtgtaagggagcgttgcagcatagaatgcagatcagtacaactgtagaaggcaaccactctgtctacgaatgagttgaaacgcatggagcagaaaaagggttggatcttggatgggaatgggatcaacaagaccaagctagtttacagctcgcagcatccagctgaggtacgatccttgtgtcctgataatacgactcctcgtgccatcccaggacctcctcgtcgtcgtcaatggcaagagggccggaacgacggggatgtacgcgactacgcggccgcagacgcgcccggtgtgcggccgtgcggcaagccggcaagtcggtggtgagagcaaggtgttgcatcggctgtgtggcggagagacagcggccggcgtcaagaagaggcaaatgcacctgtgaagcttctggcgcgggagagcagaggaggggcggcggcggtaggagagtaggagagactagagaggagactgcggcgaccggccggcccgtgctctgatggaccgttcgggctagatccaacggtagaaatcgctccagcctccagtcccaccacggatggtaacagttttgcataaagcccccttcttatctatgatcgcgctaccactggaacactggaagtggacctatttgttttcataaaaccccctattttgccctaagttgtgcataacccccccccccccacctgttttggaccgctacagtatttcgctaccaatgagtacagtacagaattgggctatttcaaaaagatccctggtagtgatattttatgcgatgtgtatccttcccgagcacgcacactcgccgccgcactccacttccccaacacgccgccgccgccgccgccgcccgagctcgccgcga

SEQ ID NO: 27527 - DNA, 1501 bp, Oryza sativa
aagcaagagaagtattattgcaaagttcaccgacaaagaaaaggctgggacctgatgatggttcatcacaaaactggaatgttgcatctaccaaaggtgacaacagtggaatgtctgaagcaccttcattggaagaagcaacttctgtaccgatgaatgtggttgaggctgacaagcatccgatttcagtcgctgaggtggaaataatagacaagtccgtggttgaagaagagctggtggtgaaaaatgagaccaagagtataccttctgactctgagaaggctaatctgcatatcacctcggacgatgatgataaagaggtggaggactggctgaaggatgtggctcctgtgtccagcaaaacaggcaacgtcaattcagcagggcaggaggaagacatatccttcagtgatctggaggatgaagaggatgattgagagacggctagcttaagcagcgcagccagtactagttccctcggttcaatgtcgcaaacacaagacaacggctagcttcatgaagaacatcaactgttactgaatgatcgaaactctgcagctacagcaaagggaaccgtgttgttgctgagtgacggattcatcctaattgcatgttgatgtaatgatgtatttatgttcgctctctttttgtacatagatatatacactatgtcacctgcgtgtgcactgtatatccacgatagcgtgcagcactcatacttactggattctgaatgcaagatatcctctcatttgctgtcaaatgtcttagaatatcttatgacgcatttaagctggcactacgcaaaactcgacacacttcccctcttactctagtgctatacgaaattcgaagctgatatacttatctacccggtattccctcgtctctaatgataacattcgtgatttatatgtcgtcgtcatcagcagtttccaatgtcgacatacatctgcatccccaaaacagtctctgtaccgctaactccagcagagcggaccataaaccgctcgacgcctcgacggagcggagcggaggcggacgacaccacgccaacggctcacgtttctcgctctcgctgcctcgacatgcaatgcaaacgcgcgtgccgcgcggctatcaaccgccgaaacgcctaacgccggcgctgaccctccccgtcccctcccctacctggcccctgcagggtgtggtccccactccgcgccttgcttctgctgcgggctccacctgtcagccatccccaggctgcttctgctgcgggcgtcgcgtgtgctacgtgacgacaagcgccatctctcctcgcctgattacaaaagcacacgcgctccgcgttcgcgttgcctctatcgcgcttccaccattcggccgcatcagtttctggtcaccacgctctcgctcgctagcttcgtcggagagaccgagagatcgatcatggaggcggaggcggagacgacggtggccgtgacgacgggcggcgagggggagatcgtgaggggga

SEQ ID NO: 27528 - DNA, 1501 bp, Oryza sativa
ataccagtgtcatctgtcaacctcaataatgctgtgcaatttccactgcccaagcagattgattccgggaatcgtcctcagaaagttcaccaagatgatgctggcagtgctaggattccagacagctattctgttggccgtagagacattgacagctcgagacctccagtggtggcattgcttggggagttctcacttgtggatgcaagtagctcaagaggaagctcccggaaaggatcaaatgaacatgctggggatgttgcagttcaggaaccatcagtaactctgagaaaagatgtggtgaagatgcagaaggaaactacagcaattaaaagccctagtgctcgaaaaacgaaaaaggaggtaaaattcagtgtcctcaaacacttatctttacacctacaggctacacatagtgttcagatgcttagataagtcttttatcatcatactgctgacattaatatgtttccataatggtcaagcatttgttttagtacacaatatcgagctgtgggtagcagtgctacttattcacttccttttgttttctgcatcaggaaaatgctgcaaaggtggagaagaaggatgttaccacgccaactccattgagacgctcaaatcgtctccttaaccgggtgacttctccttgagccagaatgacacattaacactgtcaacagatgctgatccttactgtggagtggagagagtttcgggactacaactcctggctgttacccaagcaagttagcttttcttctgtagcacttcgcaagttagttgacgtacaagactgcagtaataactcatttagtcctcttctctcaaagtacccgcggaatctcattcgctatattcatgatgctttgatgttcatgtactactcattttctactcctgacggtaaaaacctgtaactgatggatgtattggatatatggttgtgtcctggtttacctaattgagtcaatcaatatgcttctgaatctgctgatcgcttaatgcgccgtgtaaagactttgagaagagttggtcagtcgattgatgtaccagtaacaaaggattattactgtttacctgggtatttattagtgtagtaggtatggctaactctatggattagagcggactgggagtataactaaccatatcttcacagcccacggattttatttcaattttcatgtcaatgcgagggacctagtccaaaaccacctgtacactgttctctctaaaaaaacacagccgtatgtggaagtggaaccctggaattggcaacaacattatcccgaagcgtcccatccacgcgacgcggcacaacctcccgcgcccaacacactcaccattccggactggggacatgtcacggggaatgtaaccgaatcccaatcccaccattccacggtacaaaagagagaaaaaaacacccgccgcaacgcaaacacacacacacacaacaacaacaacaaccaaaaatccaagaaaaaccccaccgtct

SEQ ID NO: 27529 - DNA, 1501 bp, Oryza sativa
tatatctatatatgttagtgtactccaaatgtccacaactccacatactatgctaagcactctctgttgcaaatgttaggaacacatgctgcccaccggagatgccgaaaccacagaaacaattcattatctgcataaatgggagagttaatttatgaggggatatacacacattatttgtatgtcatttatatggtttagaaaataataacatagataattgtgcgatgtatttcctccgtttcatattataagactttctagcattgcccatattcatatatatattaatgaatctagacatacatatgtgtttatattcattaacatctatatgaatgtggataatgctaggaagtcttataatatgaaacggagggagtatcactttatcaatatgcaagtttaaattcgatctgcatgctaaaaaaaatcttttgtttgcgaggaagaaaataacgaatgaataatacttctactactcaatgtgtagattgtttctcctctcatcctatgaagaaaattttaagttattcttttgggggtgatagttcattaatgcatcaatattatcatttttaagattttgttataggtatttgggagttacaaacaaaaataaacataaggacatatctttaggggggggggggggaaaccagttccccacgaagcaaatggtcttccaagaaatgcaccatgagaacttccaacctaataagttagtaataacttgccatggttcatatctatactattttaaatgatgttagtggtggtgtccaagtctacaccaacaccagaaactcaaactagctatcataaacataaggtacccacaacatgtcaatgactctagaattattaattcaagaaattataaggggttacatacaaaacctttaaattcacctttcatctacagatgaattataagcttctaatcttgtattatccgaccgtacgtataacttgtggaaatagataaaaagaggtgatctagcagtatatttccgtagggttgcttgtgaagatgaaattatatgcctaattaactaactatactataaacctgtaatttttgcttttacttttatctttaaaaatatccgttgcaacgcagctagtttctcaaagaaagaacacataatgatacttctagaaagaacacatatttatgcttctacgtatggttattctggtttgatttctagctagtgattgtcacttcattcggaacctcaatcactttctgttatttagaacgagtcatttctcattaaaaagagcggaaaacaaacaaacttttctggctgttacctgctagtgaccattggtgactaactcgccaaacatgcatggactgatgggccattggatcggtcgatccttctgacggaaagcaagaaaaaacagaaaaagtagggtgaaacttcccctgctgcgtgctgccggccgccgtaaaatacagcacttcgcattgcgagtctcgcgccttcct

SEQ ID NO: 27530 - DNA, 1501 bp, Oryza sativa
cagaattatgaaatcgaaaggaacatatactttctaaactcttctcgtaaataggttgtgtttagttccattcaaacttccaaaaattccatcacatcaaatgtctacacatatgcatggagcattaaggtggtgtttgaatctcctgaagatgaagatgaagattaagtgtttcatgcaaaacgaggtggtaataacgtgtgattaattaagttttaattgttataaacttgaaaaatggattaatctgatattttagaacaactttcatataaaaagtttttacacgaaacacaccgtttagccgtttgaaaaacgtgccacgaaaatccaaaatttaatccacttcttgtagtggaaacgaatatgaaattgtacagtttgcatgtaaattgcgagacgaatcttttgagcttaattacaccatgatttgacaatgtggtgatacagtaaacatttactaataacggattaattagtcttaatagattcgtctcgcagtttacgggtggaatttataatttgttttgttattagtccacgtttaataatttaaatatgtaaccgtataattaaaaaaattgaaaaggaactaacacggccatagtcgtcttcccttttctgcaatggcacgtatctcatcaatgctctttggccgaagcttcgggacatcggacggcagctatcaacttatcaagccacttgccattgccccgaggggccgaggggctcccacgcgggacgggacgaccacgcccgtccgaccgtctgtttcgtccccgcagtaggaagaacggagacgggctcgtagccgtccgcttcccaaccgtcgcagtcgcagtcgcagcatccacgccacgccacgccacgccacgcgtttgtgtgtttcactcgaaggctcgctccactcgaagaccgaggcgtccaccaccaccaccaccactcgagttcccccacgatccccaacccttcctcctccgattcgccgccggtagctgccagcgtctgctccccggctcgccgcgcgccggccggcgagtgcaccgcgcgcgggcgcttggtcgacgctatctccggagtactccgcgtggatttgggtgaatagtggctcgtttcgacagggtgacttgtgctgtgctcgatcgcggtcgtcgcttgctgttgatcgaccggtccagatccgcgtcgtttacacggtgcgtggctgttcctcaatctacgggtgagtgttttctgaacgaatcgatcctacctgttcgggattgcttgtagaagagacaaaaagagagtgatgttgtttcacgcaaccgagaattaattaattaaatcgtctggcatggtagattttgctgcgtgcgtagaaaagagatttcctaaatttggggatactagtggacgatcgatcgagcgcctattctgtcgatcggttcgtggattcatggcttgagctcatgagttggttggtacgttcccgcgttttgtagatcggacctcggactca

SEQ ID NO: 27531 - DNA, 1501 bp, Oryza sativa
gtgaaaccccacccacctcgccggagactcactcaccgcccaccgcacctcgccggagactgactgaccaccgccgcatcgcatgcatcctcacagtaaaaaaaaaagatgcaatttttttttacagtaaaagatgcatttttttttgacagtgtaaaggatgcttttttcttcttttgtggttttgttgttcatcaggcgatgtatatagatagatgttgctgtagttgatgtgcagcgcgattgagatcctcctatgtagatctgtgggtccatatgttagtgacaacggtacggtgcagtcgactgcagaggatcgtgatcctcacttctagtacaaatttatttattagtactgttaatgtaggagatttagcctaacagtggttgacacgatgtgattgtgagtgaggtaggaattgttaggcgaaaatgcaatcacacatgctaacatttgaaacagagcctgatgatttctggatgtacatatatactatgcgtgaatggaacatagcagtcaattggatgatgaatacttaaaatctaaactcgaaaactatcaatgtcatgaaaccaattttcctatagtttttaatggtgcccgtagaaagttttaaagacttgcaattgcatccttttttccagcgtttgatgtggacgtgtctggtaaatctggttttgaattcttcgtcgttccaacggagagaaatttgcgttgcctcctgatcatccatccctctttgatagtgcgcgtgtcgtaacaacgaatctgattctcatctcgagcaagatttttatttttctttttccgcttgcttgtcatatccacagttcatgatctcgtccagcgaacatattctgacgctttaacaacgatcgaatattagactgaagtggtaaaaggttgagaataataataataactcttactccatccgttttacaatgtaagtcattctagcatttcccatatttatattgttgttaatgaatctagacatatatatctaaatagattcattaacatcaatacaaatgtagaaaatactagaatgacttacattatgaaacagaggaagtataaaggaaggatcacaattcagcccatgctatcctctcctttttcattttaatcgatccaaaggcaagcactttgaaaccttaaactgagctttacaacgcatagaatcaaacattcattctgattagctcagatgagacgtcaggttatcagatcaacgcaataagaaacaacagtttccacaagaagaacccaccgattcttcaaccaccgaaagcacagatgcaagcagacacaagaggataaaaagggcagaaaaattcagtaatagcaggttcaatgggactacctcttgggatataactatgttagcactggtgctcactggatggaaatttggttcaaaagcattcgattctagctatttttattggagtccttctgtctgaacttttctgaatttaggggggaggacgggag

SEQ ID NO: 27532 - DNA, 350 bp, Oryza sativa
cgcatcatcatttgtttgtttaatcaatcgatcttggctcgtggacgatactacatgcagtcacgtcgctgtacaccatgcctgttgtctatagctcgcatgctgtttaattgcatttaccagcacaattaattatcccgatggagtcaaccgatcgatcctttccttaattttctctctattttagtctagatgtgtgcatgcaaatattgggattttttgagagaaactaccctaactgggaagttgttcgtgctgaataattgggagtttttgatcgacttaattaggtactagagatgacagatgacttggtaatattattccacgtagtaatttacatttgcagt

SEQ ID NO: 27533 - DNA, 304 bp, Oryza sativa
gattttgtatctcgacgacaaagtgaaggaccttgggtgtactttttccttatatttgctcgtgaattgggccacatgtgaaccgtccgatcaatctatcgttcatgtgccgcgggggattaggtgggccatcgaagcaaggccttagatgggccatcctaacctgtggcccagcaatcatcatccccttctccctctctctctctctctcaaaaaaaacaaaagaaaagaaaagaaaaacatccctttctccttcctccgatccttgtcccccaccactcttcccggcgagagctccggttaa

SEQ ID NO: 27534 - DNA, 508 bp, Oryza sativa
gcatgttcatcagcatggttagagggtgatgttggctgtcagctaggacctgagcaggtctgtaggctggattgcctccatgtgccccctctgtgtgacctggcttcctccacagcagggcagcctcaggagagtggggcttctcacatgcagtccagagtttcagggatccacgtagaagttgcatcattttttgtgatctatccttgaaagttgcacagcatcattttattaccaaaatgccagaggtttggtctaagtcctgctgttcactccacagaaagccaatcactgagacaacaagtattgccagggaagaaggctttaatcaggtgctgctgttgaggatatgggagatcagtctcaaattcacttccctaactgactaccattaggggtttctaaagcagggaagaaatgtaaccatgtgcggggaaacaggaattagggagaggtagggaagaggagttcaccaacagaaagctggtgcttatttaagcagtcatga

SEQ ID NO: 27535 - DNA, 158 bp, Oryza sativa
caacaaacattctagatatatacaggcaacaaagcgtcaaagcaaacggcttttgatctatgtactcgggcctcgtttcagaaatgcaggaagccatagctagctgaaaccatttctttctctcttctgttttttatccttgttctcgttgtgacaga

SEQ ID NO: 27536 - DNA, 1501 bp, Oryza sativa
ggctcacgcccaaccccttctcgatctccttgctcctcgcccagtacttgtcctccagcatcgccaggaactcctcctccaccttctccacctcgaacgccgccgccgcctcctccggcgccagctccatcagcaggcacggcttctcgtcctccatgtcgccggcctcgtcgtcctcgcccgccggccggcgagaccgcgaccgcgaagacgagatggtgcccttctccatcgtgatgaaccccgcgccctcctcgtccacgtcctccacgcgcccgaacgcgccgccgccctccatctccgccaccgagttctcgatcgtgatgaacccgcctcgatcggatcggagcgacgccgcccgccgagccgaccccgacgccgccgccgccgccggagacggccggttccggaggcagctcagatccggcaggcacgacgcgtaggatcccttccccttgttcttcctctccgctcttgcatggcctgttcgtgatcgatacacgtagtaattaattagtatttacttcttaattcgcaattaattaaccactacactgttatttagcgccataattaagtgattaactaggctagctagggtttcgtttcttccttattaccattggcgccgccatggttttcctcacgctccatcactctgcagtagacgctgacggtgagcacggcgccggcggccgcgccgccgagcgggaagctgagggccttgccgccgaaccgcgggttggagctctccgcggtggcgatctcggtgaggtcgacggggaaggagccgaggtcgccgccgcccctcgccgtcgacgccaggtcgtccacgagcgccgcccacacggcgaagctccgcagcgtggcgccgccggcgacgaaatagttgaggaacacctcgtcgaacgcggcggcgccgcgcgacgcgcgcaccggcgacgtgtgctccccctcgccgcccctgttgcgccaccccaccaccacgccgcgcccttccgccgccggggggaggccggtgacgtgctgcacctggaggcacacgacgcaccgcgcccgccgcggccggccgaggccggccagcgagcccagcagccggcacttccactgccccagcccgccgccgccgcggccgccatcgccgccgccgtgcaagaggttgagctcctccgccacaagcgaggaggagccatggtgatgtggcttgcctaccatcttaagctcttaatcaaattaattggaagctaattaagctatcgacctgctcactgatcactcagctagctaagctatagctaattatagtggagttgatcagaggaagagagagcttggtagctaggagatgcatatgcttatatgagattgaacactactgtaattaagtggagattagctaggaataatataataaaggtacaagggaggtgatgatttgggtagcatggcatgtgcagtggctattagctagtagctttgatctgatgggaattgtggaggc

SEQ ID NO: 27537 - DNA, 1501 bp, Oryza sativa
tcattttcctatatgcaggttattttcagggcaactcattggctccggttttgggcacaactacaaaggtgtgatgaagatgaagagtttctgaaagttgcatgccgaaagttggagaccacggttatgcaactatttgccaattatggttggagatttacaaatagacttcaataattgtgatctccttacattaggctggtttcaataatagtgatcttcggtatgtttctattcatttagatttacactatgttcatgaaaactactatgtaataattggctgtagctcttttgagtaaatgccgggatattatatttcattatctaaaaaaaataaataaaagcacttcacgcttgaaagttgaaagttgaaaggaacagtgtttgcgagggcattgagttgagttggaccaggctttgaagggcgtgggcctcatagatgggccccaaacgggccaatcttaatttgtctcacatcttcttctcccttttttcttctgcctttcctttttctctggccatctttggttggtacaacagcgtgcggggaataatgatagacgtgatgatcattaacgcaggaaggggctactataatcagtgtgcagtagaaaatgactgcagccaacatattctcgagcacattgattggcggagatcaccatacgaaatgatgagattcttattctcattccttccctttcaccaaaagaaaaaataaaaacatgacgtatatttattaaagtaatccaaaacaatgatttttaagtgcttgttcaatttattattattattaaccttacaacaaatcaataatactcaatttccatgtagtttgatgttactaaattttggtagcgttggttgcatttggggccattttggattgatgctaaaatatgccctaccaattgtttagcaatttaaataatagtttgattggtttggattagagtcaaagcattggcaatgcccatatctaatttggtactactctataacttttcttcactataaaagcatattaatagcaaatgatagcaaacaaacacatatattatatgaactttactctacggtagtgccaaaatttaccattgaattggtagggtagagaaccaaatagacccctagtttaaagtcttaactatcatattttggcagaatcttaaagtagagaaacctcttcaattaccaaattttacagggtaacaatggcaagaatatattttgctcattcaaaatttgatgaaaaatgtacattttttatatatacataactgaaggaaaaaaaaagtactagttgtagtggcgaagatgtgggccgcggtagtgggcgtgcctaacggccccgtccgtagtgcggacgagtggtgcactagtagtagtgtatttcgcttcgcctccaagttccaaccatttccaccaccatcaccaccctccacctccgcctccgccacagccgcgccgcgccgctcccctccgccgccgcccgcga

SEQ ID NO: 27538 - DNA, 1042 bp, Oryza sativa
  unsure (1)..(1042): unsure at all n locations
aatgtttgatttctttgtgagctgtatgcgcagcgtcggccttgttgttcacactgtgagcaattgtaagcggctgggtttgcgaaggatctccaatagaccgtcgtgtcagcanaaattgaggggattctttctgacactttgcctgaaggtgagcgaggcatggccagagtaaaatatggtatcggaatggggccatctgagatgacctcgcactggattggaataagacacgtaggcacatcataagccaccaaataggagaagtgagttgagttggtggacaggcaagagattgggccagcaatatgagtggaagggatatcagtttgtgtcaactcttgagaacagcttactagggctgcagaaccccaattgtatatgtcgcaagagctccagtttgcaccgtgataatgataatggagtggctgagaaggaagtggtacagaatttagaagcggacatgaatccaagtctccgatagggatgatggtgagggtagtatgcttgtaatctatggcggtcaccttgtatgggcttccaaggtacgagtatctgctatctaagatggtgtcttggccggagcatgctagcttcatgcatggtacgctacatgaggatggtgtagtattgttggattcaagttggaaagggaacctgatctcggggccatgctcgctgcaccgcgacggcgggcagtagctgagaaatccttgtcttcccatgccgtggcctgcagctgcagaagcagagacgacagcagcagcaagcagggtcctgcaacaagagcaagctcagagctcatcttgactggactattcgtttctgtctgtctgacccatggaggcgaagaagagccattaacgcaaatataatatcccaataattcgtgtaggagcgtgtctcatctgtgcctggacgactggtgtggccgtccaactttgactagtactactgctgcagttcgtccactcgcggtcataagtcataagtcattcatccaggtcttgaagctgcagcctgcaggcccctgcagccatgg

SEQ ID NO: 27539 - DNA, 1501 bp, Oryza sativa
actccatatatatcttagtaccttcggtaggatttctgatttctaccaccacatttaattagtttcactgaaagtacattgctttcctactagttaatccggaaattaattttgttgtttttattaattagtgtgaatcatgactcgatgtgatcgtaacatacatgtggtgagtctcaaattttctgaagacgggataaaatgcgcaaagatgagtattatcagggtgtgtttagttcacgttaaaattggaagtttgattggaattgaaacgatgtgacggaaaaattagaagtttgtatgtgtgtaggaaaattttgatgtgatggaaaagttggaggtttgaagaaaaagttggaaactaaaccaggcctcagatgccaatttctaagcgggaatgctagggggcagttgcctgatcgcctacttccacaccatcctgccttctgactgcatccccgtccatccatctatccattgtgcaagatcaaatctggcgagatggtcagtggtggtgtggatgaagcgtatgtgacgaggatagagccaccaaggagcagctcatcacccccttggtctttcacattgttgggtgagcactcacttcgatctcccttttcatctctatcgtcttcttcgatggggaaagaaggaggaagtgacgaatggggaagtaggggagatgagatggtggcattggcgagcgtgatggaaggaagtcttatgctactcctctttgatgtgagctcgtcactaccacggttatcctctcatgaaatcgaataatcatactcaaccaaatgcatcaacattggtgaactgattggtagttataggtattaggcacgtaccactagtatcaggcctgatacaccacaagtatctagtatcaggccatgatacaccacaaatatctagtatcatgcctgatacacaagtatgaaggacgtcttatactgacgggtatcaattgatacctatgggtatcggtctggtaccgatggggtaccagatcgacagatctgatatctacatagtattatcatatttgaacgggatcgcgtatattatcatggttaattgagcaatccagatcccaacttgctagtagataatgagaacagatctagaagcataggccatccatctttttccttacaagttagctagctagctagcaatccttcattctaaagttttgccctccacagtcagccctcttgttcaagtaacacatgagagctaaacaatggtgcaaaaccctaacactggtcctccctttccacattagggctccccatatatcctgcctccacaattcccatcagatcaaagctactagctaatagccactgcacatgccatgctacccaaatcatcacctcccttgtacctttattatattattcctagctaatctccacttaattacagtagtgttcaatctcatataagcatatgcatctcctagctaccaagctctctcttcctctgatcaact

SEQ ID NO: 27540 - DNA, 1501 bp, Oryza sativa
tttacaggatgggttaagcgaaggaaacgcgtctttctccatagacactacagaatttatgagggaaacaaaaaaaacagctcacacgagggtcgagagtattcatgccatacgtatttgagagcagactgaccttactgaattgttgaggcattccttggtgctgatatgatgattgaggtggtgtttggatccagggacttaactttagtccctgtttttagacactaatttagagtattaaatatagactacttacaaaactaattatataaatgaaagctaattcacgagacaaattttttaagcctaattaatccacaattagagaatgtttactgtagcatcacataggctaatcatggattagttaggctcaatagattcgtctcgcgaattagtccaagattatggatgagttttattaatagtctacgtttaatatttataattaatattcaaacatccgatgtgatagagacttaaaagttttagtcccatctaaacagggcctgagggaactatgatccattgggaatcgaacacgaaaccccttccctatgaatccaatgatatcagtataacttgcattttgtagctgtgagactgatatatgttgagtatcaaagggaatcatggacaagtatcgacaagaaggttgaagctctccaattgtacagccataaaactcgttgagataaacaaaagaattgttggtaggcaggcaagagacgggcctgtaccatggactagtagtatcttgtattggtctggaacaattcacaaagcatgcccaagcactgtctgaagaagtagccaaatcgagaaagccataagaatcagttgtagtacggtccaacagatcgtcagtactgtaaggagggtgatcggatggaggaagagggcagctgctatcatcatcctgcatggtggcgtcggtgaccaagaaggacagatcggtgtagttgatgctactcacgtagtatgttcttgtgttgatctgaatggtggccttgccagtgttgctgcaggacaggtcataccatggacggggagcagcaacgcaatcgcgcgaatcgccttgaagacggaaagggtaggatatgttgtgaagatcaccacaggaggaaggaggacagtagtggttgttgctttgccctcctccaacatctgctgcaacaagcaaagaagaagagatcactagagctgtctgcaaggtgtaggtaatactactgctactaatggagctcgccatggctgcaggggcctgcaggctgcagcttcaagacctggatgaatgacttatgacttatgaccgcgagtggacgaactgcagcagtagtactagtcaaagttggacggccacaccagtcgtccaggcacagatgagacacgctcctacacgaattattgggatattatatttgcgttaatggctcttcttcgcctccatgggtcagacagacagaaacgaatagtccagtcaagatgagctctgagc

SEQ ID NO: 27541 - DNA, 1501 bp, Oryza sativa
ttcgccgtgtgggcggcgctcgtggacgacctggcgtcgacggcgaggggcggcggcgacctcggctccttccccgtcgacctcaccgagatcgccaccgcggagagctccaacccgcggttcggcggcaaggccctcagcttcccgctcggcggcgcggccgccggcgccgtgctcaccgtcagcgtctactgcagagtgatggagcgtgaggaaaaccatggcggcgccaatggtaataaggaagaaacgaaaccctagctagcctagttaatcacttaattatggcgctaaataacagtgtagtggttaattaattgcgaattaagaagtaaatactaattaattactacgtgtatcgatcacgaacaggccatgcaagagcggagaggaagaacaaggggaagggatcctacgcgtcgtgcctgccggatctgagctgcctccggaaccggccgtctccggcggcggcggcggcgtcggggtcggctcggcgggcggcgtcgctccgatccgatcgaggcgggttcatcacgatcgagaactcggtggcggagatggagggcggcggcgcgttcgggcgcgtggaggacgtggacgaggagggcgcggggttcatcacgatggagaagggcaccatctcgtcttcgcggtcgcggtctcgccggccggcgggcgaggacgacgaggccggcgacatggaggacgagaagccgtgcctgctgatggagctggcgccggaggaggcggcggcggcgttcgaggtggagaaggtggaggaggagttcctggcgatgctggaggacaagtactgggcgaggagcaaggagatcgagaaggggttgggcgtgagcctggacatggggctcgatctggggctggacctcgactcgctcatcaaggacgcggagatggagctcgccaaggcggagcaggcgtggcggagcaaggtcggcgccgccatcgtcgaggaggaggagtacatggacctcgtccgccgctggagcgcccgcgacgccgccgccgcgtgctggccggccgccgccttcgccttcgggagccccatctaggctatcttaatttgttctgctcgatcgatcatcaccatggcctatggcatgtgctactgcttcactcgtgtaacatcatcagtgatttatgtctgttataagtgttaattaattgttgcaatatcatactccctccattttttaatagatgacgccattgactttttctcacatgtttgaccattcgtcttattcaaaaaatttacgtaattataatttattttgctatgagttgttttatcactcatagtactttaagtgtgatttatatcttatacattcgcataaaatttttgaataagacaaatggtcaaacatgtgagaaaaagtcaacgacgttatctattaaaaaacggaggtagtatcattgaagagacaaacaaattaatttgaaggattcatgaaactcctggatctcttgttagtaggtt

SEQ ID NO: 27542 - DNA, 1501 bp, Oryza sativa
aagatttacattatttaattaactaaaatacaatttttctggaatactggggtatttctaactaggtaggtaaagtaagcgtgacaaataaaattgcatgctgatttaacttttgttaaattatccatgattaatgctatgttcttatgtgagtgttgggaaccctcacctccgacacgaaaaacggagaaatagattaatacgtgattaattaattattagcttaaaaaactttaaaaatgaattaatatgatttttaaattaacttttatatagattttttttgcaaaacacgtatcgtctagcagtttgaaaaagtgtgcgcgcggtaaacgagagagtgaggttggaaacatagacttaagaacacagcctaattacactctctgaatttttcttggaatttttagaggccaattgctaattctaataatacaaacaccatgttagtatttatttaaataaaaatctaaataaaaaccctcttttctatatgggccatttatagctcattttcctcctcaacccgcacaagagccagcccaccttcctcccttattctctcctccacctcagcccgtgagcacatgttcggcccagcaagcaaccgaatgtctaattggtctcccctgttctctctcacactgtcacgtggacccatcgcgacagtatcatccctaacctccgtccggactccctcgggtgcctgacgccgcctgaaactgcctcctctgtaaaatccagccgtacccttggagataatccaaacttaattgagaggtttctatcctcatctcctactctttccgttttctcaagaatcagagcaaatccgcttcgtatcgagctcgaaattgagttctatcctaaacaagcgaacctacagtttagtcatccgtttcgtttggaagaaaataatgtagtggatgatgacaacgatggacgaaaaatcgttccggaagccttacttatttttaattaggtataaatagattatcgtatcggataatatcactgtgtagagaaaaaaagataaattgaactggttttgacatgtaaggatacggcgtgtctagtttaggcaaaaaaaatgggactcctgattttgtgggtgaggaaggaaattcagacttggagtcatcactagctggagtcagcacaaggaggtaatatagcctttattctttgctccggagcctgccgcgttgcatgtgtttgggctagcaggccgctatgtgtttgggtcggtaaagagggaggcctacctgagtcaagagggccctagaagtggccggactccgaacagaatcgcggaatcattgccagtccgtgttgtgaacgatttcggactacgactccgtgtcgtaaccaaccaaggccctataaagccacgtcccccgaggcccatcgacgctatcgtgttcgcctcaatcgaaacgcgcaatcgccttcgaggcttcgatcgatcgttttgttgctcggcgcccccggagacgtacgt

SEQ ID NO: 27543 - DNA, 1501 bp, Oryza sativa
ttgtcaaatcatggtgtaattaagctcaaaagattcgtctcgcaatttacatgcaaactgtacaatttcatattcgtttccactacaagaagtggattaaattttggattttcgtggcacgtttttcaaacggctaaacggtgtgtttcgtgtaaaaactttttatatgaaagttgttctaaaatatcagattaatccatttttcaagtttataacaattaaaacttaattaatcacacgttattaccacctcgttttgcatgaaacacttaatcttcatcttcatcttcaggagattcaaacaccaccttaatgctccatgcatatgtgtagacatttgatgtgatggaatttttggaagtttgaatggaactaaacacaacctatttacgagaagagtttagaaagtatatgttcctttcgatttcataattctgaatagccaacactgtccctactcctaaatttctacttcgggctcagtttagttattgagatttcaaaaacaagttctccaaattaatcatttgggttaacatagtccttagacccacaaaatatgccttattagcatgccaagtcattctcgaatgcaactatataaatgaaatgaccattctacccttataaaccatatagaaagaaagaaaagaaaaaaatagaggaaaaaagaaaacaaccaaaatgaacaagcaacctgttagttcaagtcagtctccacacatgctcttacgtattaccaggaataccattacaataatctgtaagaatcatttttactttcaaaaagaacatgccaatcgaaataaaggaggatcaaagttgttgattccgtccgtcatcggtccctgcccgacttgagataaaattggatgacaaatcaaactcgtatttgaaggcctcattatttggcttatgcttattcttataagctaaatttaaactttagaacttaattttggattcgattttttggttttttattgtactttattttaccataatagtttttgagtcactaagaacatatatataaaatatttgcacacatatattattttatttagtaataaatgattcggataagcacatgaataaaacgaaacaatgggttgtgattatttatccaccgacacatatgtacaaattaaattggctttaccgttgcaacgcgcggatatcttttctagttatattagaaaatcaaggttaaatatatattttgtagactgtgtcattgtccaaaacatcaacaattatatatggaaccgggcggagtattgtaacgccccgattttcgttcgggtttaaaaattattaaataatgcattttctagaaattaaataaaagttaaatcaatttaatcaagtgaaataatgggagaattaaaattttcccttaaaaatcattggccgggaatattttgcaatattctttgtgccctaaaatactctccggatttttccgtgaattttcggagttcaagaaataattttaaag

SEQ ID NO: 27544 - DNA, 1501 bp, Oryza sativa
catctagttattatttgcatgtgtgtgagggtttgaattgctcctataaaaaaagtgttgaattgtagtggctaatgtttgagaagtacaagtatgcaggaatactagccaatagccagttagtcgcgtgactttggacgcctacaaaaaagtgggagggagggagagggagaggtgaggaaaaagatgagatgatgaaaatgttgttgacatgtgggttatatctgctaactgaataagtcagtcgtgatcatactgttacatcaacaaaaatcattttctaaaacattgcaggagtagatttacaccggtttttgaacatgatggagccgttatactcgattttatggttaagagagtgattcaatcaagagaaagaaagagatgagagttataaaacacacttattccaaaatacaatgttttgtcgatttgaagcttagatgggtttgtacaggccatatgcccctgcccttctttttgtgtgtgtgtgtgagagagagagagtaagtgttaattattgatgggcgatgggctgatgtttttatgtatatgtattcaggaacattgctgaagagagaaattgatactgtaataatatatactgctccctccgtcttaaaatataagcttttttttactttgacacagtcttcgaaatgttattttgacaaacaatgtctataaaaataagatgttttaaataaaaaagagttacatataatggcagtttgtttaatgataaatctactaacatcaattttatataattgattttttattttttttgttaatagttaaatttaaaaaggtttgacttggcactatgctaaaaatatttatattttgggacggagggagtatttcgcagaagtgcagtgctgggcgttgatcgttgactttagactattttgtggagtcaaccgcaacgaagctcatgccttacattacatcacatcggtagaaatatcgttattcaaattacttggtgctgtgtagtgtaccaagagtctcatcggttatccatattctctaataagctaaaatgacttattagtaaatataaaaattaacatgtaaaacttttatatatttgttcgtagcgacttaaaagccaatgttaaaaagaaattactttaaaaatattttaattttaagttaaaaaatttaaattttgatttatacttttacttattaggccaaccgatgaggcttgaagagtcaaggagcatctaaggaagagctcctagcagaagtaacttctcttatacgaatacgagtaacaaactgagcggtcaccgttaaaagagcatcccagggaagcttttctcttcattaatttattttctttcaacttattttttttctaacttgaaaataaattccttcctcttgtgttatgtgatcatgattcatttcggtaacacaaaatttactatagaacatccaaaaatagtgtaattcactataagacaccacaaatacgtgacactgtcgatgg

SEQ ID NO: 27545 - DNA, 1501 bp, Oryza sativa
atggtataggatacaacaaatagatgcaacccatcttagacacatagctaggctactaggctcctccataataagtaccctacatagctagggtacaggtctactagtagctattacagggatttggcatgcacaacaaccagctaggctagtatcaaaggcatgacttaggcatgctaggtactagctagctgtcaggaacaagactatacactgatacacacagcaaacctgtgtgataataatcctagcagcatgcgacatactcgggagaagccggcacgtggggtcgcggcatgagggataagtggtatataccgttgtgtagtctttctcataaggatccaagcaggcaagcacagctctgctcaggtcaagcaccgtgcagcgacggcgaccgttccggcagcggcgtgcgcggctccggcggcggctccggcggaaggcgcggtgatggcgacggcgagggcggccgccgtggcgagggcgggcgggcggcgagagcttgcacgcggcgcggcggcggctgcggcgagggcgggcggcggcaagggcgtgcgctcgggggcggcagccgcggcgagggcgggcggcggcgagggcgtgcgcgcggcaacggcgtgcgggcgacggcggcggctgctgctgctgctcccgtggccgctggcttccacgccgaggcatcgtcgtcagcccccgcctccgcctgcccccaccatcgcttttgctgctactgctcccgtggccggcgacgaccccatcctgctcgacgtcgacgtcggcgcctacggcgccctcctccccgtcccttgttccaggtcctcccctgcacgatattgctggatgcagagggtatacatgtccctaaaaagtgaagataaaacagcaattgggtttgaaagtgggggcgtagatgcaattgccccaaaattgtaaccaaatcttgatgaagggaagggaaggagaaggcgaggtcagagaatcctaaacgttcgctggttcttggacggtcagtttcacccaagtgcttaacctgcagtcgatgcactcctgatccaggtcacacattctatccggtatcccgtcgacgaccgccacactttgagccagtggtagttacggccgagaagcgcgcggccctccccctttcttccccgttcgccgagactcgtcgacgcttccccgcctcctcctcccaccgaagcgcgcgccgcctcggccagaaaaggtatctatccttctctccacgctcgctacatggccggcggcgtagaccggagtcccattaggatttcttccttctgaaaagggttggattggtttcgtttcttcggttggtgatgaactgtggcttctttgattggtttcgtagcttttttttttttctggcgttttatcttgctgcgggcaaccccttacctctcccgtataacccattagtttttgaggattttgtttttttgcgtgatagtagagagcactgatagatattactcgaaac

SEQ ID NO: 27546 - DNA, 1501 bp, Oryza sativa
ttagttaatggagtatttaataaaaaaaacactgatgctgatgctaaaatgtataattagcctaagaagttgtgtggtgacaaaatggagaggcatatttgaaaatcgcaaagggatatatcgtaagacattttcattccaacagaaggaacagtggaacactatgcattaatggtctaagaaatggcaaatacctctccaaatttccaatcagtagaagtgctcgcatgtgatcccctggtcaagaaaaagctatgagataaacaaaatatttagaagatcctgataggcataagaacagcaaggtccaccttgtatcgacacccttgatgaaagtggataacactctgcatttaccatcagttgatgttgttgcaagaagtatctgaagaaacgcgaaagcaagcaaaataaaatattgcctccaaagaaaaacaggtcccgcatatacatagatgttgcgtgtataaaccaagcagaattgcatagtggtgggattgggagatatgcatctcacaagtacaagaaaaaaaagcaaaacgaaagaaaaacacagctgtaatgaaagcacaatataaagagagacgcttacattgtttggatgccatgcaacactagtgacagaagattcatgcttcttcctaacaaccttgctaatccacctataggtgaaggatccaggcagttaagaaaaatacatatcaagagtggcacatcaacctacctacttgcatgaactatatcagtagaaaacatacaacccagttgtaatgtttgacgtagctaatgtaaaactaaggaaatccaaaagtagcagtcaactaatacaggtagcagacacaattaccagttgttgtcttgttcatagtagcaaatgcacacagacttagcaccacttcctacggcaaacttgttttctgcaaacaatataaaatgaacttcaaaaacttgttttcttcatgatactgcacttcaggttataagcatccgtttttcacacattttgttgccaacaaatatggcagcacggttgagacaatctgacaaactaatgcatctgaacatctcatctaaagcataattagggctaaggaacttacaagttatgacttgtgcagttgtaattattcatgagtagtgtagtggcagtttttaagtaagggtaaggaaagaagagagggaaagtgcttagaggttctaagatgactaatatttgggaaagagtttattaggcttgcacgatttatatttgtatctgagagagtaaagaactataaagcatatacactggttataaagagaatatattgattcagcaacgggagtagaaaaatccaatgcgccagtaagcatcaaggcaggttataaagagaaccttttgggctccactggacacataaagctgcacgatttagcttgagaataacaagggtaggaacccaatcatggccctcttgtgtccaaacatatctgcagttcatataaggaaaaaaggagacca

SEQ ID NO: 27547 - DNA, 1501 bp, Oryza sativa
tctcgcgcggcggacgacatcttgacgtcgtcgtcgtcgtcgtgttcatcattccctcgggctaagtctggaggagtagcgtggagcggagatccgcccggacctggattgatttccttcgatggtaaggaagccctagctttgctgttccgttgctctagagtctagactagacgcgggtgatattaccctactgggtactgacgctgatagcacctttttgatttcccacactattttttgagttctaactatgccccacgttaggtccgcgcccttggatagttaggctgtttcagatgggaaatgaggacgatgttctttttgtcccgataaattattattgtgatattattccttttgatgaaaaaaattattgtgctatggacgttgacctgtgtgttgctacccttaagatcaagtgaccaatatgccacgctcttgttcgcgccagaaaacggtttgctatacaactgctgtaatgaatgtgggatgcatgggtttcgttgacattttaggtataacgctatttttcccgcgtcgagcaatatgcagctagcgtttgatggcataaatttattcctgcaggcggctcaagctaccattgtggtgggatcccaggtttgggttgaggatcctggtgttgcctggatcgatggggaggttataaaagtccatggtgacacggttattgtcaagtgttccaatgaaaagacggtaagttgttcataagtaattaggttttgctatagtatgaccagctggctactatattattgctagatttgtaacagctaggcagctaggagagaccatgtaaagatgagctgaactgaccttccataatagcggtatttacacttaagttcaaatttggtcgttttgttcaggttactgttaaaggttccaatgtccacgcaaaggatccagaggaatcaccatgtggagttgatgacatgacgaagcttgcttatcttcatgaacctggggttcttcagaatttgaaatctagatatgacatgaatgaaatatatgtaagtcttttacactgacataatgtgactacgcttctctatatgtttttaccaatgctaccattttaagtgcagccatcattcttctctaacgcatgttttcaacttatttgtgttgaaaccagacatatactggaaatatcttgattgctgtaaatccttttcgaagactgcctcacctgtatgatactcagatgatggaacaatataaaggggcagattttggtgaattaagtccccatccttttgctgttgcagatgttgcatacaggtaggctcattatgatatatatgttgataactacaaggtggtctacgatttaaatgggttagcttccataaagaacttcttttctcctttgagctctactgtgagaagaatgtctttgattactggtgtagattgatgcttaatgaaggaataagccagtcaattcttgttagtggagaaagtggtgctggcaaaa

SEQ ID NO: 27548 - DNA, 1501 bp, Oryza sativa
cctaattctcaaagattgtattaggaattatctatatagttggaagaaaagcggatgtgcgcacaatgcataccattgcaagttgttcagccatatgatgatttacttcgtcaaatccatagtttcttgtttcatactcgcgtcctgttgaaattgagttgacatagtcaggaagggatttgactctgaatacgatgctgtaccaagttagacatacctattaggttaatgaccacattggatttggccatgacagccttaattgaatccacatctcttggattgtatttcataggaacaatctgccaagagaaaaaagtagaatacataaaagggaaaaaaaaaggaaaaatgagttaatgacttcactacttgtaatttgtgaactacaaaaatacagtacctgacccaggtcacccatcaacttcaggtgtcggtgacaatcctcagaacctctgaatggtacaagcacttgagaccccatctttgctgaatagaaataaataattgagttaccatactatttcactttgtttttatggtaatataactcagtaagatattattcattacaacgtagtactataggtctaaagccttatcatctcaccaagttgttggacaaggtagcggccaagaaatccagtagctccaaacaccgtagctatgattccactgtcacgaaatttcttgttataaattcaaaggaaaatttgcaggttaagagtatcattaacctaatttgatcgtcattgctcccaagatgcaacaaacaccagcaaatgtgcaagtaacactctttaagataaatattagtaccacaattcgtacactcaacaccctatgcaaatggcaaatgaattttctcaaacctagcaaaaaaatgtgggaagtaggatcaaatacatttggtagaacaacatcacatatctgtcaaccagagctccaattcagctcataataactaaaatcgactctctgttttttcagggcacagaatttccaaggcctagctgtgttacaggtaactccaaattccacgagatgcacaagtatacaagaacaggtccatcgcaaatgcaaccatacgaactgcacaaatctgacgatctaagcatcaggaagaccattctaaggaacacatatctgctatgacagtacggatggatcagaacattatcacaacctaatgaacctaaaccaaatcattgggaaggccaaacctagacgcagactcgtgacaacgggaatgcccgatagaatcaatcggaggaacggaaccagcctgagctcctcacctcacagacgacctccctccggttcccttgcggacgagatgccccgtccccttgaccgccggcgccctcgcggacatgtacctcgcgccatccgctccacccaatcctgcatcgaaaacccaaaccacctctaagatctaccctcggggggcacccgcgggcgatgttcagggctggtcccggacgcccggaagggcgcctcc

SEQ ID NO: 27549 - DNA, 1501 bp, Oryza sativa
gacgtcatgaccttataaaaaccgccagccatttaaaatgtggtatggagccatttattaatatgtaatctattcatgttgttttactactgatctataaatttacatttgttgcacgtatagagtgacaaatgagaatatatataaaaaaatatttattgatcgattataacgatatgcacatatacgtgcaacactcttagagcaggtacaataggttgtttaagcgggtgataatctatacacggtggcaaaagtgatgatctggagaagaaataagtggagagagagtgaaagtgggcgactaatttatcgccgacgacacaagggctccaacgcatgcaaagcagctctagataagcttctactggccacacggttgtgaggtggggtccaagtgaaaccatgcagaaacagaggtctgtcagtaactgaaaaagtagattaaaatattgaaaagtaatacatgcaaatttatggatagaagagctaatagctcattactgtgtatgttatctttactagttaattgtattgctgatgtggatgtttttggagccaaccgtagactatactattgaccttgctcttatgatcagtttttgtttgactcgaaccttaggcaatttcaaacttaagtgacactatagtattgacttatttgcttagtatagctagttgttattccttcacaatccctcatcactaccacgagaagatggcacttcatgatgaactaacttcttaaaatgcatcctttttatccttttgtattcctactactttatagttgaattatagccacaccatagcttaccgatcatatataccatctggatagccaagagggagcattacttcctaaatcctatcatcgtatgatctataattatttaatcgataatcatctggtttaaggtatagaattttgtaacatatttttataaagattagtattatacgtgcaaaaagtataaaaagatgaaactttcccctttacgaaacatatagaacaaaattcatgcatacaccgtatcgtatgtcctcgtacatggtgggtaagatgtacttgttggaggcaagctaggagtaggtactgtgtggctcccgtgtaatcggttttgtttgacgtgaacctcagtcctcgggcagtctcaaacttaagtaacactatgtttttgtcactcgtgtgcctcactatgtatagctagttgaattcccttacattccctcacgcaaggatgatgcttcatggctaaactaacttcttaaaaagttaaaatacacagcttgtcattctggattcctacaactttataatcgaattatagctgtaccataatcttagcttactgataatatataccatttggatagccaagagggagcatcacttcgtaccattgtttgatctataattatttaatcgacgatcgcttggtttaaggtacggcacttcgtaacatatttttttataaagattagtattaagcgtgcaaaa

SEQ ID NO: 27550 - DNA, 818 bp, Oryza sativa
cttgttgtttatgaggtctgatatgagatgagagatgaaaccaccagcaacagacagcaattgcacgatccgtgtggcgacggccctcgggcgcttcccccagtatgcagaaatgatctcaggactgtacacgagaggcagcgcctcattgttgttcatggatgaaacctagagccaagaaaagggggaaatgaaaattttgttcttctattagaccttagttgaaataaactgttaattaacgtgatgattgaattgtgtggttggtggggcggacctcgacgaggcggaggcggacgttgtcgtcggcgaattgggagtcgcggaggttctggccgcggaggccgcgcatgagcgtggcgagctgctcgtcctcctccatctgcttccgcactcgctggatctccttggacacctccccgaaccgcttcaatcgcaaacacacaaaccacaccaacacaatctccacaatctcagcgagatgaaacaggtgtaagaacacggaagatctgactgattgagcagagaggcgatcggtcttacggtggaggagatgtcattaggggtcctcgtcctcgacctggagcgaggcgccggggcggaggcggagggcttgggctccgtggcgacggcgaggacgcggcgggatgggcgccggcgccgacggcccggcagcgacgccgcgagaccaggcagacggccgaagccaccgcagtgcagcaggtgcggcgccgccgacgccgccgccgccgcggcctccatgggcaagaagaagaaggaagaagcttagcttcttcggcgaagaccccgaggcggag

SEQ ID NO: 27551 - DNA, 1501 bp, Oryza sativa
agagaaacagaagaataaaaaatggatctagacaacaacaacaacacgatgtacaagaaattttacagacaccaggagaccaccccacgtacagcagcagctccaggacacccccaaaggtgatgtgcagcaatagctacctcccaattcatcgcgttttcgcagctgatgaggtcccgttcttttcaatcgcccgctgcctcgcacgctccatcttccgtttgcgccattcctcaagagctgcagatgtttacacaaaatggtaaaagaaaaaaattagcatcagcttctacatattaccgagggaggtagaagagcaaaacgctgctccagcaagcatgcaaaataaaccgttgtgtacagaccaaatcacactgctattgcataatggtatattaccaattgctagcatatgtatatatatgtacacctgatgacttcaggatatgatttgctatgatcattttgtgtctctgcatcaactggcaggatagaatggaatggtggtgaaatcacaatagcttggtattgcaagcagttgtttcattctttcagcttttcttttcagccctgtcctgaagctctctgatctatagcccatccaactgtattattgaactgttcggtttaactgtgcaactggtcttttttttctttccatgaaatatatactgtcaaatactcgcagcacaagccacaactaaagggccacatattgacagcaatatgatggtagtactacaaagatgtaactgtcacaagactcacaaccatgtttgcaagcatctaacttcattttgttcacatcatatgctcctcggatccgaacagacatagtacagaagataaactgaaagaacaatgcagccccaaaatatgaggagtggtaagaaaccaagaatgaatttacgaacctttttggctgctaccatcattccctgcccttaaatcttgcaacctttttgatgcatcaacagcagctgtctgcttggcatcttcttgtgtcatcatgccatgctcaccataagcttcttgttcgatttccttcacctatgtagcagaaatagcgaagttctaactttgattagcatcccaatgaattctctttcaaccaaatcacgagaaacacaatatacaatatacagtgacttactctcctgatcaaatccacaggctccatagcacgacgtaactcttccgactcccatataaaccgtagctgagctgcggaattgtagcacgggatctttcactgaattgagtatataacaggactgatctcacatgatataaaggaaaaactagaatttgtactaaacgaagaatggttgatcccattctataggttttgagcgcagcttatagtgctgttctctacatttggggtttccccatatgctcagagctcatgaggtatttcgattggaaaaaaaaagagtgatttttgtcagctgctcggattcgtaaagaaattccctgcatttcctgtggcgtggtgtta

SEQ ID NO: 27552 - DNA, 358 bp, Oryza sativa
aggtgggcgatgtaggcgaaccacgagagcgtcggcgacggccggagagagggcgtaggtgcccggcgcggggggagagtggcgccggtggggtacgcggcggcggcggccatgggagcgtgggggtttagacgaggtcgccttatcctgtacttacaccaattcttttaagagtaaatggcatatagggccacttctttttaccaatgtggtaagagtaaaagactaggaagtaggaacagccgagcagcccaacactttaaatttgaacccaaaaagattacatataagttttactttgggcaatttgcttcttccctatctttccctctcttccttgctctctgtcttcttgagc

SEQ ID NO: 27553 - DNA, 1022 bp, Oryza sativa
acgacggaatgggaaatgcacatagttaagacgtccgcaggagaaagatgggcacttgcctctcccctgaacctgatctggtacaacaagtgcaagcacagagaaggcagccatggcctgcagggcagcagaacgacgaaacgcaccagccatcgctacggtagctagcttcacaggcagtgcaaacaagcctattacaatagagaggggcctgctgtccaagctagctagctatatgcttagcccacatgtcagtgactttcaatatagggataatacagcagaggatctcaattgcaaatggacacgggtgggtaacaattacatggctgagagcagatgacagtgatggcattgactgacttggggaaggaaacaatcgagcctggatgtgacaaaagagagcatgtctccagcctcaatccattagagcatcagtatcagtaaagcagtgaaaactatgggattcaattcatgtggtctggtaaatttggagagagcaaataaaactggagtacctcatctggaattccagagtgaagacgagatgcacatttggactgaagctggtccgtcccatcatctgtcacaaaataattaggaagatcagtgtgcagaataaggctttcggagaactcttttacaattggatatggattggagtaaactatctatgaagaacttcacaatatctttactacacagggctgtgctgcagagggtcatttacaatagcttctagccactgccagcaaattcacagtttaagtttaacactaacaacagttcaccgttgcatggaagtgcggcttcattttctgatgacgccaggaatgcagtcacactaaaaaggactgcaacatgggaccacagaagtttcattgtactttgggattgctccaaaagtacgctgctatcatgagttcatgacaagcacagcataaactcccagtaaatttcattatagttacattcatggccttctccttgtgccttcaatcttcaacagcactacagaaaca

SEQ ID NO: 27554 - DNA, 1501 bp, Oryza sativa
gcgcatgcagacataggaaatggaatctggctgcagcacgccattatcaacctgatttgactcgacagcctgattgcatcttcttggctcggcaatcattttttttcccgaaacacaatagaggctcatatacacacgcgcatgctcggcaatcatattggaagagattgttcaagctgcgcataagcaggcatttcggtgccaatggcctcataagcaagaaaataaaggaagggggaaaagattcctagtacttgtgcatcacctacaacaaattgcctctagcaggcaggcagggaagctgcccttgctagctgacgaattgtcagctctgcaagtctgcatctacaaaacttatcaggcgtatacgagagcataaactcagagttttgtacatgtctcaatgaactgcacagcctttttcataaggcagcagtacactaaggcagcagtacaccgaacagatgctgattccgttgtctttggtttagtgtgcaccgaacagaataatatatgcattgtggaactcaggtgtcaccctgttttccagaattatctgcagatctcaattctctgttcatattatctaggtagcgctgcacagaaagtaaaaatctttttaggaaaacaaagtatgatagtcaatgtcactaagcagatgttcagctaaatgaactatgagtactggttttcaataataattacataatcgaaacaacgaagtctacaatgacgtcatttggtatttgttgtatgtacctggagtatgcaaaccgcagcaaatttatctgtcattgttttggtttcaactgggtcatgtagtttcagaggatgtaaaagggcttctacacactggagacataaacagatcaatcaaaacacttcaccataaaaaagtacttgaaaagtaggataaaatggtcacatgagtaatgcaccccatgctaatatgtagtttcatgtttgagagataatgggcaaaaaagtaccatcaccttcgaggtaaaattttcatcccaataggtgtaactcatatcatcaagtttcccagttttacagagctctccaacaagaagccttacttgtaatgcctgcttaatagaaaaaggaaacatcaccaaacatatagtgagaaaatgaggtgcactatcccaggctcccagcacaagagcactttacatttggactagattgaccctgcaagttgaacggatagccgacaacaaagcctgcaagggagtattttgagacctattcacaaaaacaaagaaaaggaattggcttccatgtatgaaaaatagcaaaacatgagtgcttttaaatgttcaccagaatctaaaatgaaagaatatatgcatcatgagctgtctgtaacttctattgctaaatcatttatgatttctttgtggacaatgtcaccctcgagtattttggaaatgtaaatgacatgagtaaattgagcagtaaagaacagcatattagagaaggcctgtaaccctgg

SEQ ID NO: 27555 - DNA, 853 bp, Oryza sativa
atatatatatatatatatatatatatatatatatatatttacaaataacaaaaatttgatattaaaaataattaataactaacacgtatataaaatacaatatgaatagtacacattagtagttttgtaaagttattgcaaaatttaaaattatgttgtcattttaatatatttgaataatataatgaaaaaatatatatgctattatatgagagaaaatataatgatactagccgcgcaatctgcaaatgcaaccgtgctagtttacaatgaaagtagatacggtgttatcactacattcttttagtataaattacacactacacatgtaacatcgtactcctacattcacaaatacagtggtggagtgaaggcccggtcaccatgggcatgtgcctgggctcccccgcattagccagtggattatcacttaataacagtgcctaatttgcttcttttagtggaggttacatcagcagctgttaagcttgctcgtgctcaaggaaacttgtaaatccgccactacacaaacacatctcttaacacacacgattaaagatgcatattctactaaaattctttcaagaaacacattaaatatactcttattaccaacccatgcatgtatacatactacttgtggcatcaagatttaaactctggaggtggagtcatatatgcacgcatgacttcgcaatcacactacagtattgatgtaagtatgatgtatcccatcaacccaccatatttaatcagtgttaatcacgcactgagatgtacacaagtcaagattaaggcgtaaccataattattaacctcattatgtatagtgttcagtatgcatgtgtcaaca

SEQ ID NO: 27556 - DNA, 1501 bp, Oryza sativa
atgattggatacaaatatggaaacaatatttctcggaacataaaaaccatcaatacttctaatagaaacaaataccatgttttatctcctttcatatacaaagtttcatcgtggagtaaataatgttcattaagtccaacacatgcaacattatcagcacaaatatgtgcctaactgatattagaacaaataacatattataatttgtaaaagtttttagaagttcaaataatattaattgtgtaaaatagggttagtgtgatgtgctgctattaaaattttaaagaggtagactgatagtccagagttagaaagtgcttatcgccttatccaattagacaacttttatagtgaccatcgacagtgtcacgtatttgtggtgtcttatagtgaattacactatttttggatgttctatagtaaattttgtgttaccgaaatgaatcatgatcacataacacaagaggaaggaatttattttcaagttagaaaaaaaataagttgaaagaaaataaattaatgaagagaaaagcttccctgggatgctcttttaacggtgaccgctcagtttgttactcgtattcgtataagagaagttacttctgctaggagctcttccttagatgctccttgactcttcaagcctcatcggttggcctaataagtaaaagtataaatcaaaatttaaattttttaacttaaaattaaaatatttttaaagtaatttctttttaacattggcttttaagtcgctacgaacaaatatataaaagttttacatgttaatttttatatttactaataagtcattttagcttattagagaatatggataaccgatgagactcttggtacactacacagcaccaagtaatttgaataacgatatttctaccgatgtgatgtaatgtaaggcatgagcttcgttgcggttgactccacaaaatagtctaaagtcaacgatcaacgcccagcactgcacttctgcgaaatactccctccgtcccaaaatataaatatttttagcatagtgccaagtcaaacctttttaaatttaactattaacaaaaaaaataaaaaatcaattatataaaattgatgttagtagatttatcattaaacaaactgccattatatgtaactcttttttatttaaaacatcttatttttatagacattgtttgtcaaaataacatttcgaagactgtgtcaaagtaaaaaaaagcttatattttaagacggagggagcagtatatattattacagtatcaatttctctcttcagcaatgttcctgaatacatatacataaaaacatcagcccatcgcccatcaataattaacacttactctctctctctcacacacacacacaaaaagaagggcaggggcatatggcctgtacaaacccatctaagcttcaaatcgacaaaacattgtattttggaataagtgtgttttataactctcatctctttctttctcttgattgaatcactctc

SEQ ID NO: 27557 - DNA, 1501 bp, Oryza sativa
atcaaaacagatttattcaaatatattccacgaaggtcagctacgttccgaatatagaccggttaagcaggtcgtgaacaatgtttacaattgcttgtcattgatacacattgagaatggtacttggttcacagtttcgcaccaaattttcacttagccgtagtagtattctgaaaccaaaatacagcaatcaagctgatcctatcgtctccagatcccaaccgaccaccgatcccccagttctgctcatgaactcatcagcaatacaaaatgacagataggcacagttgttagttcagatgaggagccatgcataccggcaccatggacgacgacgaagttggagtcgagccccaagcctcccatctccgacaagccctccacatccacgaccgggccggtcggatcgccgggccgtctgctccagtccatccccacaaccttccccgccgcgccgccgtgggacatggcctgccgcagctgcgcgcacgccgaccgcaagctcgccgcgtcgatgctctccagctctcccttgttcgtgatggccgctccacctgcgccatcgaagctgctaaagaggagcagagaggaaacaagggagcgacggagcgcgcgcgagtaccgagtttgacgatgcagcggacggggcgggaggcggcggggtccgtctgctgctcctgcgccgcctcctccgccatgggagcttcctctcctcgacctcgcgccggccaaggcctcgggagggagaggcgaatctggtgctgttcagtggcaaccggcacttctggattgcccagaaatgctgggccggtgcttcgcctgccgctccggcccatcaaagcttttccatccgctcgcggaaattctcggcccaaacctgctcggcccgatccgtcgccaacaagagcaaggcacgaaaccgcaacccttccgacctcaccgtctcaccgccgcatcccgctcgccggtcaccggctagacgccgccgtcgcgcgggctcctgggttgccgtgtctccatcgcttccttgttggcctgttcctgcgagcttcgccctctggcttcctccctgttcgggatccgggatcgtgtgtctgcctctcggctcgctgcgccgccgccgccgccggctcgtcccgtctgtgtgtgtgtttgtgcaggtcagtgttattttgtaattttactacgagctcagattcgtatacgttttaattttgtgtgtatgtgctactattcaacttgcatctgttcaagcgggtgacagtgttatgctgttgtacattagcattgtgcatttatgcatgcattttgtttgagcattaatttgtgcccgattcagtactagttttcctgttagtatttaccttttgtctctgactgttctaggattctggcttaaaagggataatctatgccgtcgaaatcgtggcatcagttgtcattcaattcaatccccttgttgattcatgtgcttgcagttgaaattggagtaaatatacaa

SEQ ID NO: 27558 - DNA, 1501 bp, Oryza sativa
ttttctttcttttcaatcttgtgtttctccttaatctgcgcccttctgtattgaaacttcggttattgtacatttattttgttgtctaatctacctggagtatactcacatgtactagccaaaaccaacttattttgttgagtaattatctcagcttatactagctagccaaaagcaaattcatgactcttatccatgctttatttattgcatcacccgatcttgttagcataaaattcattttcagctgatgttggagtgtcccagctctccttttctcttatgtctagactttagagtgctttattatttcatttccttttttttcttactggagtgtctcttttccaaaacacggcagaccttatttggatagcgaattcgagtcatcatgacctataaagtcaaatgcaaatatagccaaaaccaactttatggcatgatagacatgtatacaacacaacaagtatagtagtattacgtacttaaaaaaaatctaaacaacaaaggaaaaaaacaaagaaaggaagtgatttttagcgtagctgtgtttgtagcgtaattgcgtaaagtcctttcaattttgctatatctcactcgaaagattttttcttatctctcactcgattttctcactcaaatttacagtgtattttcttgtaagttacagtgtaatttatgaaacttacactgtaacttttgtaagttacactgtaatttttgaatcttcacatgtaaattttaaattttgtattggatttggtctttttcttgaggatatggtaatttaatgttcattatggtgtttcttaattgctttttgctttttattatatctatcggattttaatacaaagattaaaaatctgtgtgatacgattataaaaatctttcgaaagatgtataggtactcccaagcccttttaagaaagtttttcaagacaaaagtttttggatgaaaggtagttatagggaaaaaggaatgtgcgtttatgtttatttgcattgcttattagcaaccaaaaactaatctataagtaaatcttttatatacgtgcgcttaataattcaaaagcaaattcatgtaaaataaaatgcgatgaagaaactttaaaaagttatcaaatttagattttattaaattttagtttacaagagcgctacgatgaaggctttaaaaagatgggaaaataaaacctttgacctttctggacttcaccaaacagctcacgctttcggcttcgtgccgtctcgtcccgtgctactgctaccccctcctgaccccacccgccactccacgctcccttctcctccccttcccgtgacacacagtccccactccaccgcctccgtataagtatcccttccttaccgccggccagccacagccaccgcctcccccaccccaccccgatcccctccccgccgtacgggcgcagaaggaacccgtcttctagaaggaggaggagggctacctctctctctctctcttctgccatgg

SEQ ID NO: 27559 - DNA, 1501 bp, Oryza sativa
cattcctgtgtctccgctgtgacaacaatacactgaaacacatttctgtagctcgtacactgtagtcgtacgaacgttcatactaacgattactgctgatcctaatcacaatgaacagaggataatttgttacgctattagccatttattactagcgttcatgaacattcaactcagcgatcgaccaagtgccgacacattcaggaagtaaacatactctagtcgaatcaaaacaagttacctgaaaacattgagctcagtgtttattgaaacgtggacgcagataggatcctatgcagtgactgatcacctttacaccataatggatcctcaactgtatgatcatcgatcatgcattgccattggtgcgggtgtgagctggtcaccgcacagaacaggatccatgcaaatgctttcttccctaatcgctttcaaagtgctaacttccattaatgtgtgtttcgtgtcagctcacagctgacatattcatgatatcagccagtgtcagccttaaccaaaaataaaatgacctcgatttaaactacacgtttgacgttcacgttcttcaaaatcccaaattaaagaagctcctcaatgtccttcagaactcagagttgtacatgttttcatgaaagtgacgcaaggcatacttttttgtttaataaaaaaaagaagagtatgtccaaattcgttgtattagaaatgtcacatcctagtactagattggtttttcttaggacgaagagagtatgctttactgcaaactttgcacaactacaagttctaactgctgaactatatgttaaggtttgttgtaaagtgagcataacttaactggttaaatttcttatggagttatggtgaaattttgtctacctgagttcaagtattaaagtattttgtcaacatttgaagggaatatttcagtgtaggtgatatattcgtcagtagcgaaacgtttatggtagttttgttaatcttaagatatgccggcttagtctttcagaagtgctcatatccttgccgtagtaactttgtcgatctaaaaatatactgaccaaatctttcagaagtactcataggaattaggtatgtgtgtgtggctttataaaaggtaagtgtgcggacgtcatgagcatagtaataagcattaatgtattaaaagaaattaaggtttgttagtgctagttgccgccgcttgaatcagcaaactgcagcagtcagcgttcggctcgacgctgttcgctctaccaactccacggaccagtctgtttggtgaacttgccaaccacacggtatttgcctattttgccaagccgtttcgccgttttagccgatccatctctgcattaaggcgtggcgcgcctaccatatcaaaccgtcgtcgtcggtctcttcgacacattcctgtcacggagagataatccctttcgcatcagcggcggcatgatattccgagtgtccggccgcggcgcccgcgcgcgccgggggcggccgaaga

SEQ ID NO: 27560 - DNA, 1501 bp, Oryza sativa
taccagtggttactttgtcaatttcaagatatgtccgtccaatcttttggagatgctcatagagatatggtgtgcgtatgtgtgttcatagagatgaggctcataagggtagcgtgtgtatatgttcgtagagatgaggctcataagggtaggggtgtgcgtgtgtgtttatagagatgagtgtacccgtgtcataaacgcgtgcgtttgtagtatgtttctaaaacaaaattatgggataaaatactatacctacatgttgcttccacctataaacttttcacttattcaaagcatcatgtttcatgccatacggttgcaaattactaaattaggcagcgggaagccacctcttaagctagtcagacgatcacctcaacagagccagctcctctgcttttaggggctgaaggtagaggcgtagggtaaaatgatcctgctactacagtagggacagtaatttgtagttaattactataggtacagtacaaaacacagtaaatacagtgttcccgaatattgtttatgatgtacctagtatactgtagtgatcgatctcattcattcgctgtaaatcggacaactgagaatatcccaaagtaatggcactgtacgtctctctgacttcattatgtgaagtcagtggatcccaatccctgctcaaccgactaccgccgatatttgaaaaaaaatagctagccgataaaaacactattaattgtttggactcaacgatatcgttggcttcattacttgagttatacataactatataggaatcaacatcggatatacagataacttgctttgacatgaattattgacatatgggctactatcaagtagaaacgcatgttagtgatagaaggccccctttaaatcaaagaaaaaattatagaaattctagaggattttatcctatggaaaataattctatagaggtatcctttgaaacggagaattatttttctatcaatttatttgaaatttctatggaatataccttactagagcaattttagagaaaaataagtatgaggtctcacctcatgttttcctcttcatgtgtgctaatcaaacgatagtttaaagactttcctttgtttcgcaatcccacataaattcaataaatatggcattttattcctacgtttttcctatttctctattatcataagtaaacatgaattttgtgtcatgattattcatcttcaagatagtgcttctcaactcagaagcagaggacatgataaaggagaatatttaagttggaagataccggttattactattcagaaacttctaaaataaatcttacaaaaatacctgccgtgctgggaaacccaacctccagtccagtggcgcgaacgtaaatacaaccaaacccagcacccaaaatccaaacctcgcaacgaaggccgctccttcaaaatcccaccggtctctttcgccggaatcctcatccctcctccccttctccgtccaaactacccgcctccgc

SEQ ID NO: 27561 - DNA, 1242 bp, Oryza sativa
gtactacaacagatctagactttaaattcttaatgaatccggcattgatatatgacgaattcacccaaaaaaatcattgtaaaatccacccttagcctatttctactgacgaccggaggtcttggtcataagatatgtttacctagacaagcaggatcatcacaaacgctggggatttcgaagttagcagcttgctatcacacggcgaccaagaatttcattgtagaaattgatcaataggatcctcatgcatggatccataggaactaagcattaattatagcaattattaagacacaactcaactctgatagtgctaacctacatgcattaccaatgattcaccgataggatcctcgtggatccataggaacttagcatcaattattatcaattattaagagagaagaaatggcgagaaaacctatacaatcaacacaactcaactctaattgacatgcattaattacctatgattcgtcctaaatataggttacccataatttgtttttgaaaagagaaaagtaggaaacttagcatcaattattaagagaaaagaagttgatggtcataatttgtttttgaaaaagagaaaagtaggatacttagcatagattattaagagagaagaaaataatggtgagaaaatcaaagttgaggaaactcaaactttgaccactaagaacaccatatagctcctctaccaacgtgctacaatgccgttctcctacctataatttgtagtcttgattttttttaaatgaacatatatatcaagggaggccggatcctcgtttgtcttgatctctctcatgcacccctccctccacttgtatgttgtgtgtctttagaaactgcatagatccaccactcgctagctcacccatgtcatcttatattagagcgtactccctccgtaaaaaaaatcccaatctagattgatcgtctgttaattaacacacttacaacataacctaactatacacacacacatgtaattaaatgcagatgaatatcggttttgggatcaaccgcgcactccctagctagcttccttaattatatacttcctccgttccaatatgtaacaaactacgaatctgaacatagaataggattagattgctacatattggaacgagggagtattcggtatcgccatgcatccacaaagagacaaataaataataaaaaataattaattaatgcctctgtccaattggtcgcgcgcgtgcatgtagg

SEQ ID NO: 27562 - DNA, 1118 bp, Oryza sativa
tgcagtcaccttgcaggagcctagaactgggtgatacaggatggtgtcctgtccagaacatgataactccatgagaggtgtgccgcacgacggagattgtgatgcaaggcggagtgggaaccggacttttggtccatgtttgctgcactgatttggtggacaactcttgaagttgaagaagctctcggcatcccatgctgtggccgcatagatgagaagagatagtagcagcacaacaacaagaagtttagccatgtttctgtagtgctgttgaagattgaaggcacaaggagaaggccatgaatgtaactataatgaaatttactgggagtttatgctgtgcttgtcatgaactcatgatagcagcgtacttttggagcaatcccaaagtacaatgaaacttctgtggtcccatgttgcagtcctttttagtgtgactgcattcctggcgtcatcagaaaatgaagccgcacttccatgcaacggtgaactgttgttagtgttaaacttaaactgtgaatttgctggcagtggctagaagctattgtaaatgaccctctgcagcacagccctgtgtagtaaagatattgtgaagttcttcatagatagtttactccaatccatatccaattgtaaaagagttctccgaaagccttattctgcacactgatcttcctaattattttgtgacagatgatgggacggaccagcttcagtccaaatgtgcatctcgtcttcactctggaattccagatgaggtactccagttttatttgctctctccaaatttaccagaccacatgaattgaatcccatagttttcactgctttactgatactgatgctctaatggattgaggctggagacatgctctcttttgtcacatccaggctcgattgtttccttccccaagtcagtcaatgccatcactgtcatctgctctcagccatgtaattgttacccacccgtgtccatttgcaattgagatcctctgctgtattatccctatattgaaagtcactgacatgtgggctaagcatatagctagctagcttggacagcaggcccctctctattgtaataggcttgtttgcactgcctgtgaagctagctaccg

SEQ ID NO: 27563 - DNA, 1501 bp, Oryza sativa
acgactacagcggcagcagttgaaacacagcagcagccatagcggctgtagtagccagcagttccaatcagcgccaaaactctacatccctggatctagacatccccttgaaatggaattagtaagtggctacctgctgcttgggctgtgtttagatccaaagtttggatccaaacttcagttctatttcatcacatcaacatgtcatacacacgtaacttttcagtcacgtcatctctaattttaaccaaaattcaactttgcgcttacccttagttatggtttggtttcttcgattgcaaggtaatcgagcatgcacgccactgcgcagtctttcagtgaagtgatttgacgcgagctattagtagctgtactgctgctttatgtactctatagagtactacttactgcgttcaaatcctaatttccgtgtccaacgtttaaccgttcattttatttaaaaaaattaaaaagataagtcacgcataaaatattaatcattttttatcatctaataacaataaaaatactaattataaaaaaatttcatataaaacggacagtcaaacgttggcacggaaacccagggtttgccttttttttagacggagggagcagtccatactccatactgccttcggataaaaataagtttatttttcacctattattatacacgtatcaatataaaaatagaaaaaactagaataactctatattatcaaattctaatataactattcatccatttatctatttctaacaaaactatttccaatgaaataaataataggagctaaaaataaacttgggacggatgaagtattatgatctgtttagtagatctttaactcttaaatctagcttcaaaagttgggttcggaatggagttgtggagcaggctaaacctaacttcacctctatagcttattttctaagaaagttcgtcctattttaaaataggaggtaaaattgtttacaagctgtgcagacatatcaatagggtgtgtttagttcccacacaaaaaaattacacactgcatcgtcgtattaaatgcatgctaaaaaataaatagattacgactaatttgcgagatgaattttttgagcctaattgctctatgatttaacatcgtggtactaatgatatattaattagacttaataaatttgtctcgcagtttacatgtggattctataatttttttttggttattagactacgtttaatattttaaatatgtgtagtataccttatctgagacggcaaaaatttttattcctatctgaacacagcctaatcactgagctcgcctagtgtgatggagtcgatctctttcacatcaatcgggttggagcagagagcatcaactccagtttgtcgggcctgccgttgactgacccgttgacacggccacacgcagtctccaacccaacccttgcagatcaaggagccgcgtcgtggcccccgcccaagcccagcttctcccttcccctcctc

SEQ ID NO: 27564 - DNA, 612 bp, Oryza sativa
gcagtttctatgctcctattcctatattcctgtagaatgcgtatatgtgggcttgtacgatttattatcttgtgcttcatctgtatgaatgcatgcaaaaatcgagctaagctagtgttctgtgttggtcggcactgttgctatgttctttcctacgtgactgaaatctagcaattcccggttccgattcatattttgcttatctatatgcttatttgtacgacttattagcaattaaaaaaattgtagataaaaattttaaatacgggttcttagtaattcaaaagtaaatgctataaaataaaattccgtgaaaaaaccacaaaatctataagttataaaaatggtcgatttacagttataaaaatttccacgagcagaaagaagacaggcctcccgcaggtcttttttggtccaaatgcaaataaaggcccattagcggcaggagctttagggccggccccattactagccctaggccgagcttagtttctggttgcaaaccgtacggaatcccctttcctccctctcttgccacgaacccttcgccgtcgccggcgatcccaccgactcccggccgcctctgcttccccggcgatgtctcttcttagc

SEQ ID NO: 27565 - DNA, 287 bp, Oryza sativa
tctgcagctttgttgctggataatcattgatctcgcattgttttatatctgactgcttgcttgctggagccgtaagtagatgtaactggagatggaatttttgcagcaattggtcttgccaccgccgtcgcacgcgctgcccccaccaagtctcccccgaggccggccgcacgaatcacgctatgccgcattgccacgggctgccgccggcaatccatgtgcgctgatgtgcagacagaggtgcaggaggaggggaaagcgcggcggggagaagttgtcgtatatga

SEQ ID NO: 27566 - DNA, 1501 bp, Oryza sativa
atatttgataataaaatctggaacttctcagagatattttcaggtatacaggacactagagcattgttacaaaaaggaccagaaagcaaatgatgaaattaaattggccaaaagtttcatgagaagtacggtgatataatgttacacacaaaagattgcacacataataactgtctgagtcttttgcaccaattaataaatagccagctttttatttttaaacaagcataaccagccagtttttatatgtaacaatctcatatactgttaagatttttcacgatatttacccaagaaacacaatttggataacatagagaagaaaaatcctccatcaacatatttagctcagcatcgtcacaaataacaaaaaggaaaaattaaagaacttcgagttgctagagttggtaacggaccagtacacatgctagttcatacgcacttgatacaatccttaagaatattttctgaggaataaacacaaactaaaacagaaaagattacctaccaacagtatcaagtgactcatgaggccatagaagtaaacacgtcagaccatattatacttcagtcgctgagtccataggaatcacattcccttctggcattactgacttgtcagattttgtggctgcattttcgatactgtcctggttcatcctggaactgcaggagagccagttgacaaccaatcctggaaaaaaaaaagagaaaatgattgaatatcgatgtcactctggctcattctggagctgattttgctaatacactgaggtaatgtgctcctggaaaaatgaaatagtttgatggacccatatgaactatgaaaccatgcaagacaaaacaaaacacccaggagtaaccaaggtggcgtctggctgcctctagaattacaaagtagctcgaaagtgtaaataattgagactgcgagggagcacttgactgagaaagatataacctgagtattgcttttgttaactgatacaacaggagctgcagctagatctgtggttgcttcaatgaatgatcagtagatacaagagttgatatgtggaacccttgataagttaacccgcaatcaacctcaactcgctctaacatccttatctggcattctagcataatgacaaaattatcagagctagtatgcagaactggcttatgatgatactgctaactaagatgtaaggaaaaattcactattgcaaacatattcatataaccatagactcatagtgcagttgttcctttaaaactaaaactctatcctatcccactagggccatgttctgttgacatgttgtgtaactaattaactatgctggatctcattgttttttcaagaagtacttgttcattatcagttaaaccatcaatcaaatcttattatcttttttggtacttgcaggttcgagtgtcaaagtcatttcaggtactgctataattcaaacctaccctctattcattattcaaaagagagaagaagcactgttataactta

SEQ ID NO: 27567 - DNA, 612 bp, Oryza sativa
ccttaattctcctttggattcttccctttgcttgctatgcttttgcttctcttctccgcgtctcgttttctgatcatcctgtcatgttgttgctgctttatttcgatcttcttttctttctttcttcttccaagcagttattgtcccctatctccttaaccgcattctagcttacttctccttaatttctgaggctacagagtagtatttatgatatgcaactgtcgattgactatctgaatgatgcagacttcgagtatatgatcttggttcttgtccatgaaaaaggtagtatcagagtacacatgcatgcagagaaagtataatgcctgcttggtcactggctgtttgaccgtattaaccaaaactatacgcaacttacgtagaatgtatcgtgtgctcgtgcagattacgagacgacgacgaaaagagattggcacgccacacgtgcaaacggttgcacgagcaacgggacttatggagactcattcatcatccatcccaatgggagtttttttttttctttcttctcctctcattcagctactacaagtttacaagataggtgagatcacaagaatggagatccatcaatgacaacgtacccatgta

SEQ ID NO: 27568 - DNA, 804 bp, Oryza sativa
ttgcttaatgtactataccgatcttttgattgatagccagatattatccagctttttaggtgttttgtcgcttaatgatccggttatcgactcgaacagaggtttaccacatacttcctaatgaatcatgtgattcagtatttccgactatatgtttgctcatagaaagcttatactccgtgaggcagacgatggttatatctagatttctcagtggttcagtacaactgaaccataccgactatatttgctgattgaaagctgctattttgtgaggcgatttgttgatagaaagatcaaagatagactttcaagctgctactaggaaacttttgaccgctatagtttatggtgaattgatcatacctgatacaatcacatttaatgtatctcaatatctggcggtctgggtacaccagcctgatattgcaagttttttctcatctcaaaaaagggagagagagagaagtcttcaattttttccccaggtttcttgctgggtcctgttgatagaaatatgccaatatctttaggttgtgttccattcaggattttgtgttagtatgaattaagaggaatctttgatcatagatgttaaggctgtattctttttcctcatggcatcttgccattatattccatgagaaacaatagttctcacaaatcaataacatttgagcaaaatgtggcagcagttgacattcattttttttatgaattccaatatttgttgtgagcaaaccttaagcagctttaataacacgtcatcaaatttattaatcttgcataatttcttctgatcag

SEQ ID NO: 27569 - DNA, 239 bp, Oryza sativa
ctactagttaatcagctattgcagtcctaattgatctgtagtacgatgctacatattgcatttcagatcagtatacgtacatattactgtgagctagcacacatatatgttcctcctcttgattaagaagtacactccactctggtatgattaattaatagtactactagcacatgaaagtcatgaactagtgctgttgctgtagttagccctgtatcgattgagttttactactgcaa

SEQ ID NO: 27570 - DNA, 1383 bp, Oryza sativa
atctcttaaggggataccacatgtacccttccctttttaaactggacttttcttctttacataaatggacggagatttgcacggttgccctccgaacgtccttctgatgggacggcacatacctacctccacttctgccggggcaggcgcgtcgtgggaacgtggctgtgcgctgacgacatgagcagtgtcagaccggtcaccaatcggtcattcttgtccaccgcgtgtcagcttagcaacgtgcatgtttgcccttcttcacacaacatcttgcctgtaatggttaggatgaagcctggcatatatcgatcggggctaacgtgccatctctgggatgtatcacgctagctccagctggggacgagtgcctagaggctctcgtcttgacgggacggggcgaggcgtgcgtcagaccgccagtcgccacctaaccgttgatctgaccggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaatggtgtcttggccgtcagtcatgggcggtctcttcaagactgccacatcacttgagcagcgctcgaatctgggcgtgcagattcgtttcgtctggagatatggtaacgtcgcttcggtcggcgatcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggagcgagatagtgggcacgagaaacgaggagccgggctcagcgatgggaagggtataaagccatcgaggaaaggacttgctcccttcctttcgccactattcccctttccttcgccgtttgcgccctaaactctctctttgctgcgcctcaccttcgccacacacgctcgttctcaaccctctctttctcggacaaca

SEQ ID NO: 27571 - DNA, 1501 bp, Oryza sativa
gaaatggaattacagaacaaaacagtgatgattgatgcatatggaccagaaaaagctctgggactttcggaggagaatggcttgttagcacgatggtttgaaggacttgtttaagaaacatggaatggattcgggatgaacctaagctaattgccttgattacttcggctcccatcggacgcccaacgggaagtcacgtcccacataaactaccagctttttctccaaactacaaactttctctcaactttccaacttttccaccatctaaacacaaccaagaaaggaacacaatcacacattatagtacagttcttctgcaaagttagtgtggcaacttggcatgatagatagatcaatgatacctaccaatcttcagtttgctgcagcaaccaatctctcgcagcttcctgatcaaagagtcctgcttgcttgcatttactagcaaataatccctcgacaccatcagacactattgacaaatcaccaagggagaaaacgcaatcacgcaccaaacgaacagcaatggcggcattcagacacgcactgacgatcactccactccttcactggatatgccgatatagcgcatatcgcgcccctgcctttgcctccccaacatggcgagtaagaaagtgcatcttccatgtccacctttcgcaacagaatccagctagctgccaatccgcgccatcgatcgccgaggcgtggagccacgcggttcatcgcccgagaaagtggaggcatgggcgacgcaatattagagagcgcgacgatcagatcaccaccaggcccgggcgggcgaaaagtgtcgcacgcacgcacgcgatcgctggatcggtcgctcgcagtggcgacgcaccgcgccccgcgcgcgctgacggccgcggcctcggtggaaaggaaggagagctcactcactgctcacgcacgcacgggcacgcgcaccagcgatccaccccccccccccccccccacaaatccacccgaccaccgatcgcggcgggacggcggcggcacacgccgctcaagtgcgtcgtagtgttacaacgaggcagggctagggagaggagtgctatgggcgccgcgacgtgcgcggccgcggaccgtgccgcttgtaaaggaagggccagccaaataattgcgttaaggctggcctggaggaggacgtgcatgatgaacacgatcccagtgcttaatgcgctttttttttctttaacagtatgccgaagcagctggtcaccagggagaaaaaaaagtcgatgttgactccaacgattgcatgtctgttcgctagggacgctacacgtacgaacatcgcgttttcggtggtgatcgatcgagacggcacatcaccacattaccagcaggacatcgagacgactgtacgcgcgctgctgtactacccaggttgatgccatgccactcctatatttgaatcgaacgcggctcgcacagacaactccctccattcgctaacactgcccagcatgcagcagcc

SEQ ID NO: 27572 - DNA, 1501 bp, Oryza sativa
acattgaagttactcaaggcgcagataaatggctttttccttgttaaatatatataatttagatggttgcactgttacagaagcattttcatgtgtgtatgtgtttcccaaattgtcggttcagcatggcatgtttcgtcacgtcaattaatgcttatggtgtgacaaggttattttataacgtcagttttcttggcgtgatcaaaaagtttagatttaaaaataaaatttggcccgatctattattaaaatattttattaaaagttttaaaaaataataaacattccctacgatatttttattttaaaattctcactagctagctatttatctgcattaaaaattcgctgccttacaactcctagttaacttgatagtaaaacgtggccatgattcacagaacttagacacatccatatgaccgtatttagtttgttattaattactattattactattactattgaattctaaaagttatagactaaatttagccgtgcaatttggatggacccttgcttgttacatggccagttacttgtttggaaggtagcaacagtacactatacactgactaaaataacccaccacgtgcaacactacagatgctgacttgattgcgaccaaacatcacgagtgagtaacatgatcaccgagcaaacctcctagctatcgtgtaatgccgcacagcaaaagataaaacgacagttaatattttctcttctaaaagttacacatgtaacttgcttattgtgtttgagactttgaggtgaggaacacactcctaacgcatcgccggcgctttgatttctataagatataataaattaagataataaatttgtgtgatatacaaatatatgtactccctttctcactgagtaagacgtatacatgttttaagatccaactctttgaccaataatattcttttataattaaattgatttttatttaatatcattgggttgatatttgaatttactttcgtataactgtgattgtgttgctacaaacatcgtaatatttgagaaattcaaatataaatattagttttgaataccatgccaggtttgatcatgccataattagtacggtgaagggagtatagttaaagtttttttttatagcttgtataaattgaatttaaacttacatgttttctagactaatatactattaatctatcttttatcctttttataactagttactctaattcggattaggctttgtttaggggctggtttgcaacaaccccgcttttttttctctaaatcttaaaataacttggtctggtctctttgcgggctgggcgaaaaaaaaatatgttacacatgtctagattttcaacacagttagttcactatataagcatcagcctatcagctcgacattttatattcacaggtggccggctctcttctgcacacaacgtgtagctcgacaatctacttagcaagatcactttagaaccagaatcaccagcaaccatggaga

SEQ ID NO: 27573 - DNA, 1501 bp, Oryza sativa
tgcttcagaattattttctcatccacgatatcgcactggaaacaccaaataatgcaatccaaacttggatcggtctctgttgaccttctgatcaaacaatagctattaaggttaattaaagagatattaggatgcattgcattagctatgatctgtgaattgcagcaagtttgagaaaacatgtcctggctcattaatcatgcacagtctatgaaaattacagaataacatgtctagtccgctcactttggaggataagatatgaccattgcaacctccaagtccaaccttacaaattactgtgctctgtacttcgtacacaaaatgctcttcttttttttttcaactcaggcagtgtgccaacaaaagctgcaggcaagatgaacactagtcctactaaaaacgcattcttggcgatgaacattccttcaggaccaccaaatctccacccatctttgagagctgaagcttgtacaataatatgatatcttgctagaaaaagccagcctagacctccatagccatgggaccatcagtcccatgtaccggcctgtacgcttcgaccataccacactccacactctcctactgctattagccctaagcttagaattttccaaataatgcaagggtcgatggttgacatctgcgcttctcccataggctttcccatttcaggagaatttggctaaagaccagctccatgtaactattctattccttctatatgcttctcgtgtttgacgcgccgaaaagtcgccgcgcgcgcatctcgacggcgcagcaccttcacctgccagatatatgtatcaaaatcgctaaccccggcgaacaccacatggggaaagccgtcgccggtgcgtccaatgaaagacctgtaaaccaagggcatttcctatattatcagcacggccaagctgacgaatccctagctgatccctgcatcgctttgcttgtgctagtagctagcagagtacttacaaatggaacagtgctagtggtgctcctcatcagtcgccacgctgacttgacagtgattgggatcgaggctgagctgcgtcgatctctgaagtcggcaggtagaatcgatgatacaagattggccttgtaaacagtggccaaacagtggtccgtggaatgatctgatcttttcccatgagaggtatcgtatcgatcatcatctagctcctgctggcattattatcttttttttttaaactaaaccggtaggggagctgccaattatattttcaataagcaggagtaaaaaccctagacgggttacaagaaaagaaaaaccaaccaccgaactcactaacagctaaaaccactgacagagtccaatgtaggatgtcgttaccaaggttgaccaaaacaacataggaggttccgactttgcaaccgtgtcatctttgccgagcttgccgccacgcgacacggcagctcctacttcaaaccggatgcaccatctaaacctagatgctgcaaatgatcaagtagc

SEQ ID NO: 27574 - DNA, 1501 bp, Oryza sativa
tgcagcctgaattctcaatggtatatctattgcgttagcaagccactccctcttgcgatctataaaagttcgcccgtggttcagtcatcttcaccagccaagatacatttttcagatggagtttctactatgggtatcctaccttaccatcacactcgccaccatcctcttatttcttagaaccctgatcttgaggcacaaccgccgggtgtacaacctccctcctgggcctaagccatggccaatcatcggcaacctcaacctcatgggctcactcccacaccgctccatccacagcctctccaagaagtacggtcccctgatgcacctcaggttcgggtccttccccgtcgtcgttggctcgtcggtggagatggccaagttcttcctcaagacccacgacgtggtgttcgccgaccggcccaagaccgccgccggcaagcacaccacctacaactacagcgacatgacgtggtcgccctacggcgcgtactggcgccaggcgcgcaaggtgtgcctcgccgagctcttcagcgccaagcggatcgagtcgtacgagcacatccgccgcgaggaggtgcgcgcgctgctccgcgatctgcacgcggcgtccgggcgcgtggtggcgctcaaggactacctgtccgcggcgagcctgaacgtgatctcgcgcatggtgctcggcaagaagtacctggagcgcgaggtggtgcacgagggagaagtggtgacgacgcccgagcggttcaggtggatgatcgatgagctcttcctgcttaacggcgtgctcgacattggggattcgatcccgtggttgggctggctggacctgcaggggtacattcggaggatgaagaagctgagcaagatgtttgatcagttcctggaatatgtattggacgagcatgagaaccggatgtgtcgcgagggggagagcttcgtggcgaaggacatggtggatgtgctgctcaatgtcgccagcgatccttcgctggaggtcaagttcagccgtgacagcgtcaaggcattcacccaggtaattaaccgagtcaaatagcatctcaatatattaatattatttgagtgtagtgtagggttggtttctaatcttatagtagatgtgtcatctagattcttaaaggggcaattgtgttcttacccctactttcatatgcaattgtgattttacccttcttttctagggtttgtgattttaccctcacattttcaaaacgaaactctgatttgcccctactctgttaaaaccacctaacggtgtcaataaaactaaaaaaagacaggtataaccctgtacagttggccctacttttcttttaggatctgtgtattttccaaaaaaatatgatcgcacttggacaaattttgaaagaacttcgatatcattgataggatttcacagaactttcaccaggtacgaaagatccatcgcattcaccagtaaaaaatcaccaaacaaacaagctcctcacaaagtagcaca

SEQ ID NO: 27575 - DNA, 1501 bp, Oryza sativa
aaaaaaaaatctaaaaatctacaactttttccattttattgaatggagtgccccagggaaaaaaatctcaatccagaaggggagtgagacaaggagtctcattcaactctccttttttaactagcaacagacctcctacaatctattcacaataaagctatgacctatgaacagagggaccttgcaatcttcactgacaatttcaacttgtacgtgtcttgacttactagtaatacaatatgcggatgacacgctcctagtaatatatgtatgctctagacaattgttttgactcaaagctttttacatacattttgtggactcgactagtctaagaataaacttcaacaaatcattcatggtgccaattaatgtgtcagaagaaaagatgaagattcccacaaatactctgcaatgacgcaacgatcctttcctttcagttaccttggattacctttaagtctcaccaaaccactcatacatgatttcttcccaatagtatagagaattaaaagaaggctcgtctcctgttccatttatctttcttatggaaataggctcgatctggttaactatgtgctttctgctaactttctacatgtgccaactgaaacttccagttaagagttgtggagcaaattgataaaaacagaagacatcgtctatggagagggttagacatgggaagcaaattaaacactcctcttgtttggaataaagtttgcatgtcactgtattcttaaaaatgtttatattttgagatgtatggggtactctacatggtgcacggctgtatgcctacctactgttgcttactcattgatagcattgttgcagtttcttatagcttctctgtctcaaaagaaaatgactacctcaacaggtcatacaaaaagtacaccatttatcaatgcaatttgttctattgtaaaatagataccaattgatcagaggtacatatcctatatgtacaaacttctcgtgcacgctccatgcacaccaacaagcaaatggcacgaaaatttctacgaataattgaacatttactcctaatagtattaaacatatctgcaaagtctcatattcaaattcattatattttagccgtaacaaaaaagtgaaaaatctgacaatttaaaagtaaaaatctgttagaaatttgttttttttgttacggctaaaatataatgtatttgaatataagatttcacacgtaagtataataccattggaattatgtgtctaattttttctggatttttctgtgacatttgtcagttggtgtgttaggagtgtacacgggaaatatattcccttccagatcacgagattaattagcaacttgggcaattaaccacagtggttttttaacatgaccagtacaagttgactaatgattgtctttatttatgccaagtgcaaacaaaacatcgatcgaatgcccatatgcagcctgaattctcaatggtatatctattgcgttagcaagccactccctctt

SEQ ID NO: 27576 - DNA, 1501 bp, Oryza sativa
ttcgcccactctctgtctgctcactgattagagatagataatacagtatatgcaggcagagccaaaaagatctgtcactgtccatagtacatatacttgtgccactgccagccactgaaatggaaatccgaaacctgatcaaccatttatagttagggtgtgtttagttctcaaaaaaaaaaaatttagtgtcacattggatgtttgaccggatgtcggaaaggtttttcggacacgaataaaaacactaatttcgtaactcgcttggaaaccgcgagatgaatcttttgagtttaattaagccgtcattagtatatgtgggttactgtaacacttatggctaatcatggactaattagatacaaaagattcgtctcgcgatttccatacaacctgtgcaattagtgtgtgtgtgtgtgtgtgtgtgtatatatatatatatatatatatatatatatatatatatatatatatatatatatatatatatatatatatatatatatatatatgcgcgcgcgcatgcgtctaaagatttaatgtgatgtttttcggaaaaaaaattaggaacttcttgccaccccgaaaacggagggcatgtactatgattagcgataggtcagagtctaaaaaggtgacgccatattttgtagaaaaaaatatatcgattcctagataatacgatatgcgttaagattcgtgtagtacatacaaaaacatcaaaggaacccaagagaggagcaggattgaacgcatgacctgagcattacaaaccaagacatttaccatgcaagcaaccaccacattttgtttgacttacatataacttacatatgtaaatacaaattacaaattacacagacttacatattttccgcaaattacaaatatgtaagtttataaattacatatgtaattttagtgtaaatacaaattacaaattacacatataaattacattgttaatacactaaaattacatatgaaatttataaacttccaatataaatatatgctattttttctgttgaaaaatatgacggtataaatattctgacttttttgcaccttctgcacgttcttttttttcccccaaagagggatacctgcaacttcacatacgcagcagagcgttgtgcttgtgcagcctagctgagcagcggtggttccgtggcctcggtctctctccacgtttttctcggcaaaacgacaatttgcacaagtggacgccttggcccatttcgcggccaagttttctttccagacatcgtgagaatcgtcttggatcgatttccccgtcctttcccaccatatgacacctcaacttcctccacacgctcgcgcgctctactaccgccatggtgacacctccgagctcgtcgtcttctataagtagctagctcgagctctggttgtccaccaccggccaagcagctcagcctataacatagtaactgaattgcagccaatccacgtactaccgaccggttaccgatggagc

SEQ ID NO: 27577 - DNA, 1501 bp, Oryza sativa
caacaatttaatttagcactacaaaactaaaagacaagccattttttcaagtcttagatgcttggccgggactagtgattataaatatgtatatctcatttaaaaaaccagaaaataaaataagcttaacttttttatgaaggagtatatattagttgatatatattttctctctcaaaaagatcgctaacaaataactagcaactttgacaacactaaaaaaatatcagatcatacatatgctacaatcttatatactccatccatcccattttaagtgcagccatgattttccatgtacaattttgatcgtcagtcttatttgaaaatgatttgaatttttttgaaacataagtcacgcataaagtcctattcatgttttatcatctcataacaataaaaatactattataaaaaaatttcaaataaaatggacaatcaaagttaggcacggaaaattatggttgcattatatttaaaatatgacggagggggtagtatgtaacttcaatacaaagagactgtagaaatgactaaaaacactgaaacaacaaaagctacaatcttatatagtatgcaacttcaataaaaaaaagactgtaaaaatgactaaaaacaatacggagtacctttgcattgaataattaaaacaaaagttacatatattgaaaagaaaaactacagttgaccaaaaagttacaattgtttataggatgtaacttcaacgaaaaataatgtgaaaatagctagaaagtcctttggttaccacgaagaagggatcggaaggttacttataaggtcttgtttgggataatccatcaatcaagctgatttggagtggattatatatggtcctaattttctcgatttttttatgggaattatctgaacaagcccttttatatgtggaactagatagggagcaaaagctactccgtggtagtagtcaagacgtggagatccaggaacaaatctcaatgcggataaaccgaccaaaaattcaaccaattccaatgataaaatgtggtgacacatgtatagcaaaatcgattttgatttagcaatcaaattgaacaattgatttagcccccacaaagaaaaaagaacaattgatttagcatattaagaaaaaggatagatgtattattgatttctaccgatatgcatgggtgatgattaaattggaatggatgaagtactaggatctcgactgcactactactcctaggtttataagtgcaacccaggaaagataaagaaattgcaccgaggtccttgaaaaaacttggaaaaggatagaatgtttatggattaacactaataatattgtactattgtcgtttgctaccacattttgggtaccattggtcgttgtcatatatatactgacaataataaatctttaaggctaattaggtaccaagtacaggtcacattactcacagtatcaagtttgaatagtcaacattggatccaccaaacatgtaattaattggtatga

SEQ ID NO: 27578 - DNA, 224 bp, Oryza sativa
atagtctacgtgactagccaccatttaatcatacaagaggtttattttttttgagtgccgaatccaaaccgtgagcaagcctgctatgtggtcgcagatgttttgacaaaacaaaaaagttagcaagctaataagtggctagctcacttatagattcataattttaatggagagtgcaaaactatgttaaaagtggtctactacgttcgagagatgtatggcta

SEQ ID NO: 27579 - DNA, 391 bp, Oryza sativa
gaaaccatactttttacaggatttttgcatggcacaatagcggtagcgtcgatgaggcgacggtgtggtcgacctcatgcgcgacactagaacactgtcacaccctgaagttctctccccaagcctaaattgaatttataaatcaccttgagaaaatatcggtgtcaaagcaagagaaaccctaataaattaatgcaaataataatcggaattggtgtgtgggatttttcttgagttctacatgtcgaaatatgctaacaagatttttagtggaattttcagagctctagaaataattttaaccaattaaaattgagcacaagcaatatttaattccctggaaattcttttcctcctttttctttctttttccctcctttttcttttcagg

SEQ ID NO: 27580 - DNA, 1501 bp, Oryza sativa
gtaccagcgagcagagcgccttctttcctgcctgaatcaattgatgcaatgtcattatctggtttgctagagctgaagcatgcatgaaggcaaagaaccaccatctgcttctgctcttgacattgcatgcggggcgagcgcgccgtgaggtattctccagtactgtggccaccgacagtagatgatggggatcaaatcggccggcgggaaaactgctccgtttctgcgctcgtagggaggaacagatgagaaagaagcgatgcggggagggaggaaagaaagagcgcagggaggaaagcggcggcgcgactccggaattgttccgcttctcttgctctttctgtttccaatcgtatcctttcaagatggatggccagatttgatcttctacctcccgatactagttacctgccggtacatgctgccagacgagagtaaatctctttaagttaaatgagaatttatactggataagacaaacaagctaccagtatctccagtgatcatccaagctccatacctgcatagaacccacatccgttcagacacggcacgcataaaaaacgtacgtgcacgcattctgccatgggcgagcatcgggcgttcactttgttgcaggttttgctgctttccttttcagttacatccggtaaatcatgacaaacgcatgtattagccatttcagttatccggtaaatcatgtgttcaacaataaattagcaaagcacacgtttcatgatcaagatggcttaataatatactactactattgcttccaaacttagattttctcagccacccaaaacagcatctgataatattccgttcacccatcaaaggttcaaaagcccgtaaccacatccctgtcagatgcacctagaaggctgacgtgtccactgccaacttcacaaaaccgtgacaacccctttcatcacaaatcgatataggcactgttcttttttttttattttttaattaagatacaaattttatctttattttcgttaaaacatttttcataccgttaacgatgtattttgtacgaaaactttctgtatataaattcttttaaactataagataaatctaatttttagatttgtaataattaaaatttaattaattatgttaatggtttcttattttcccgtatcttataactttattaaaaacgaaacactacctatagaaggagaaaaaacagagacaccacacacacaaagtgcaaaaattcctgcatcacgcagcaaaatgccaaccccagcctacctatttctttctttcttcttcccaccttcaccaccaccaccaccgcacacggcgggctccttcttcttttcggcaaccaccggcgacgatgtcgtccacgccacatgccaggtgcacgcacgcacgcacgacagcaagagagagagcggcaagaaacaccatggcatatctccgaggatatgccctaatccaaagtcttcctaattgttattaaaatcctaatgacgtgcaa

SEQ ID NO: 27581 - DNA, 1501 bp, Oryza sativa
gaaggagaaaaaacagagacaccacacacacaaagtgcaaaaattcctgcatcacgcagcaaaatgccaaccccagcctacctatttctttctttcttcttcccaccttcaccaccaccaccaccgcacacggcgggctccttcttcttttcggcaaccaccggcgacgatgtcgtccacgccacatgccaggtgcacgcacgcacgcacgacagcaagagagagagcggcaagaaacaccatggcatatctccgaggatatgccctaatccaaagtcttcctaattgttattaaaatcctaatgacgtgcaattatgctctcctctcccaggtcgtctcctcctccgggctcagcccaggctggccaccgatgatgatggcgacggccgcgatggcggcgagctcgtgcgatcgaggcgacacgcgtaagaagctgcagataactgtagttttcctcgtccgcacgctactgctcgcgtgtataatagcccgcggggtgctcgcgctgatacgggttgcgttccgcgtcgccgtggttgctccggcgagaagcctcgtcgccgtcgcgggcgccgccttctccgccgtgaacgcgcggtgcgcgtggtgcctggaacaggcggcgctcgggcggagctgcacggggacggtcctcggcgacgcggtggtgggcgccatggcgagctcgtggaggctgctgctgcaggggatcacgtcgctggtgttcctgtgcgcgcgtggcgccgacgagtacgtccggccgccaccgagcccgctggtgctcacggcgcacggcaagccggcgtcgcatcctcagcaggtgcgggttcatctctgggtgttgcagacttgcagtgtgcagagtctgacagagtttggcacttggagttttcttgttctgaatgcttcattgcttttcccgtcttttttcaataaaaagttcatccatgatccatcccaagattgatcagtggcaaacgaattctgtttgtctcatgatttcatcatcattctttgcagagttcttttatgcttgaactctgcttcttttttttttcttcagaatcagaggcaaagagtgtcctttgtttacagtaacatattttcaaactttcataatcagacacaaatacaaattgacacctaatacagtagtacagaagatttaattccacgtttcctatcaacctgtcaacgttacaatgtgaagtacagacaacaaaattacattgcagtatgacatagtagctgggagctttacataagttttaatcaaagagaatttgcagctgaaattattatccagcataattctgattcctaatgtttcggtaataactttgacatggttgccaatgataatcaggtgcacatttcgatggtgggggagaagaacatgaggatttcatgggtgaccgacgacctgaacgcgccgtccgtggtggagtacgggacgtcgccggggaagtacacggcgtcggcgaccggcgaccacaccac

SEQ ID NO: 27582 - DNA, 1501 bp, Oryza sativa
aatgcaggcttcaaagaaaggctgttgttttttttgcaattgattttatttgaactcttttctaaaaacaactaagtgagtgcttctcaaacgacacggatgagacagtgcgtctcgtccggtcagagtatgtgcaatgtatcagtctttagaattgaatcaaggttggcacccggccaacagcttttcaaacggccacccgggccaacaactttcaaacggccacccgggcctagctgatcccatcagctgcagatttttcaaacatcgaacccctttccacaacagcaatttcacaagcagtagtcaaacaaaactacgctaggaatcacctcacatccgcccatgaccgtgggcacggctgttcgaacagtttgttaacctctgcagaggggggtacactttacccacacgacattactaacccggatcacccagcccgtggggatcagccacgtcgggagacctccaagctttcgtgacaaggcatttccaaagccgacacaggtttaccatatgccgacgagaggggtcccagaccaacaacaggttaggtcccagaccatactgtgccagaaagcccaggggtcctccccgacaccaccccggcgaatccacatgtctctcggcatcaaggcttccctgataagctagttactcagccaggggtgtcccattccacccatgtggtcgtacttgtcttatgttcggataaaattccaaggaaacggtccttaggtgcaagagcgggaaaccgtacacccggtacgttccccggtccgcggttttggaaaatccatttagttcgcaagcaccgacccaggtgtcgggttttccaagtcttttgtaaaacccaagttttacccaagaagttactcagattttaagtttgaaggcgaccgtcggtactcgcacagagttcatgatttccgaggcgcaactgggtggttacaagggaacatggtataacaattaacaaaggaaggatcaaatgcaacaaactaggtaggtccgccaatctgccttgcagacgggataaacagattaagtgcgatcgtatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgagccattagatagatctcgggatttgaggaattttggaagttgaacggagtcaaacggatttacggttgggaagatattgaatttctaagtttattggatttttggtctaaaggaaaaggatttaattaaatcctttttgaaaaagaaaagaaaagaaaagaaaagagggagggaaaatagactttcctcgggcggctagggcgcggcccgagagaaatggggcggtccggccgagctaaa

SEQ ID NO: 27583 - DNA, 1501 bp, Oryza sativa
tgcaggagttatcagagcatattggtattggtccaactctaagagattggatgagcctaacatgcaagattacttcttttctatcttcccaagggatcatccaaagaacacaagtttttctacaaatttcttcacttcaattggtcttggttgtatcactatgaccatgagcgagattacctgaagagcattcctcgccatctaatgcaacagaaacctgcctcatgtattggtatccatgtgttctgatcctaactgttttgtttttgttggatctccatgtgcaatataatcagatcttagatgctgttcagagggcttgttgaattcaggacccaatcataattagaatccccaaatagggttttataagatatcagcagagtaccagctggtaggaacgtattcatgtgcaataattaatggtgaatcctttgctcagttgaactttttcatccaaattcaaagtggttcatttgggactggagattggaaggggagaaaagcggccgggcgaaagcgatttatgcaagttgaaagtattccttgtcaaattggggggaaaactgcaatatttcctgaattgcaagttgaatatattggtttgaaatggtccccacaaattgaatgaaaaaggtcaattgaaggttgaggatgagacgtggaaattaattacttcctccgttttatattataagactctcttgtattgtccatattcatatatatatatgttaatgaatctagacacagatgtgtacctagattcattaacatctatatgaatacgggcaatgctagaaagtcttataatctaaaacggagggagtaagctggaaggggcagcagtggtgaagatggctgatggaaggtgatgggggcaattacatagtctgcatcatagacatcacacacccatgtttcttacattttgtaacgtcatccatgttgctgtgaacaaatatatacactacagaaaaacctaaatatcctagaaaacattaaaaaggaccaaatgtataatctttaaatggaaaaagggcaaagatacataacaacaagttgaaaatcttgtcgcccaatcacttttgtgtgaaggcaataataatataatgttgctttacagcaaaagcaatgtgcttttgtgtttattagctgcaggtggtttttatcattgaccaaacgctacaaacaaaagcataataaccataggttgaatatataatcaatcctggccaaaacaatcggattaatctgccttttgggcggtcggcacttgctaaacaatggaaatcatcaacaaaagcactcaaacaggacagtgacatgctctaattatatttgaagctggacctcacgaatcatgctgctcttggccaataaaaccaacagattaattaggaagataaacagggagcagttactggattaggagacactttgttgaggtgcaggtgcagaagaggaggagacaaggtgaacatggaggagaaggtaggag

SEQ ID NO: 27584 - DNA, 1052 bp, Oryza sativa
ccctctgcctgcgcagcggcagcgcgccggaggccggaccggcctactccagctagcaacggtgggggggcactgggtttggggctagctgtgttgtgtgtgggcgcgcgcacggtgcgacgttcacggtcggcagcggtgccgcgcttgccgtgggccgccgccgcgtgctggctagctgggctcgcagcggagcctgcctgatctagtggcagacgatgacggcagatgaaacgaagcgagaacaagtccactttgattccttctaatatgagtccacggataggatagtcccttaaaagcaatctaaactatagatctagtagtatttaaggatctctcaactgcaataacacatcaactattaaaatcattataatttaatttcctcggttgttttaaatgtggttttcgcttatgtggctagataaattggtctagccagctgagccagcttatggagcccacatgttagcagatctatatcaataggctgggtataatagctcagcaaggtcatcgaacttgttagggatgaatcggctctgcgcccttgtcagctagagactcttatcttgattatgtttctcaatacgtaggatgaatttgaacttgttttttatagtattagatgtcaacatactttatattgctaatttcccataactatttatattgaatttagaaaaaaaaaagtacacgaaggatattcccttatcatattagaacccattccccatcttattggagtggtggagttttcacagggaccatactatattggtttccatgaagaggtcaattataaagtcactaacaatgttctcagctcaattaattaaaccttcacccacactctttgactcttctaggcttactctaagaaaaagagaaagagaaagaaaagaatcagaaaagctttgccacacctcacaccttgtgtccttgtgcctcctacaaatagctcttgccattcagtttcctctcagcagcccaacagtcgtcttaaaccatccagctagaagacaacatcctcttaattccggccttaa

SEQ ID NO: 27585 - DNA, 1501 bp, Oryza sativa
ctgtgaccggggatttttttttttttggagggggtagcaagtagctaggcgatgcatactgtcgatcgtggcgcggccggacggaccaccggcaaagatggagccatggatggatggccggccggataaagaaaaaccgtgtgttatggatgcgtggttggctatcgtacaaatacaacaacatcctgctgtcattttgcctggtacgtacggcggccaagaaaacagcgaaacggaacggaattttctgccgccctggaccaggaggaccacgcgtacgtacggcgtcgtcgtcgtcgtcgatgatcgacgagaaaaggtagccgatcgatggctaatcggggactaaatttgagttcttatcatatcggatcggatgtttgacattaaataaaagtattaaacgtagattaatgataaaaacttattttataatccttgactagtatgtgatgctacagtaaacatatgctaattatggattaattaggcttaaaaatttatctcgcaaattagctcttatttatacaattaattagttttattattagtctacgtttaatacttctaattagtgccaaattaatatttgatatgacaagcactaaaatttagtctctggatccaaacaccacctgagtaagggattgatgcatatatgtccgagcattcacacgaacaacatatataaaaaaatattttctaaagacactaaatatagaaaagaaatatcattaattttttttagaaaagagagcatacattaagttatgatcgattacaatcttacaaaagacgaagctgcttaattaaataatacacgttggatggtgcatcctctcgccacacgggcggagtgagatgtaccaaatgtttagcaaagttagcaagttcatcagctaccttatggcacgcctgcatatcaggaagaagacccatgtgaggccctttgtctctgggatgagggagctcagcttgatatgttgcccatcctcgatagtaacaagtcggcaaccgaggagcaatcgagctgactactgggatgctggtgttctacatatgctcccctttttcaacttctactccctttttcttcgagaactcttttctcacactggtaaacagtgttactttttttaaaaaaaatctatagaaaagttgcattaaaaattatgttaatctattttttgatttttttaactaatacttaattgattatgtgctaattcattattccgttttgtgtattaggacggatggattccgaacccataggttcaaatggaccctaatatactccgccgccagcttcaacccttctttgcaagccatagcctccacatccttcgcagcagcactaatatctattgggaacaaaactgaaatccacactaaaggcatgctcatgcctgctatatgaattagctagataaccagattttttttttactttatgtagatcttcaaaaaaacattgaaagttatatatttcaaagtaaat

SEQ ID NO: 27586 - DNA, 1501 bp, Oryza sativa
ttgagcaccacgacgccgccggccgcgccgtgcaggtcgcgcagcagcgcgcgcacctcctcgccacggatgtactcgtacgactccagccgcttggcgctgaagagctcggtgaggcacatcttgcgcgcctggcgccagtacgcgccgtagggcgaccacgtgatgtcgctgtagttgtaggtggtgtgcttgccggcggcggtcttgggccggtcggtgaacaccacgtcgtgggtcttgaggaagaacttggccatctccaccgacgagccgacgacgacggggaacgacccgaacctgaggtacatcaggggaccgtacttcttggagaggttgtggatggagcggtgcgggagcgtgcccaccaggttgaggttgccgatgaccggccacggcttcggccccggcgggaggttgtacacgcggcggctacggccgagcaccgctttcaggaacagcacggtggcgagcactacgccgacgaaggacgcccatggcggcagcatcagctccatcggtaaccggtcggtagtacgtggattggctgcaattcagttactatgttataggctgagctgcttggccggtggtggacaaccagagctcgagctagctacttatagaagacgacgagctcggaggtgtcaccatggcggtagtagagcgcgcgagcgtgtggaggaagttgaggtgtcatatggtgggaaaggacggggaaatcgatccaagacgattctcacgatgtctggaaagaaaacttggccgcgaaatgggccaaggcgtccacttgtgcaaattgtcgttttgccgagaaaaacgtggagagagaccgaggccacggaaccaccgctgctcagctaggctgcacaagcacaacgctctgctgcgtatgtgaagttgcaggtatccctctttgggggaaaaaaaagaacgtgcagaaggtgcaaaaaagtcagaatatttataccgtcatatttttcaacagaaaaaatagcatatatttatattggaagtttataaatttcatatgtaattttagtgtattaacaatgtaatttatatgtgtaatttgtaatttgtatttacactaaaattacatatgtaatttataaacttacatatttgtaatttgcggaaaatatgtaagtctgtgtaatttgtaatttgtatttacatatgtaagttatatgtaagtcaaacaaaatgtggtggttgcttgcatggtaaatgtcttggtttgtaatgctcaggtcatgcgttcaatcctgctcctctcttgggttcctttgatgtttttgtatgtactacacgaatcttaacgcatatcgtattatctaggaatcgatatatttttttctacaaaatatggcgtcacctttttagactctgacctatcgctaatcatagtacatgccctccgttttcggggtggcaagaagttcctaattttttttccgaaaaacatcacattaaatctttagacgcatgcgcgcgcgca

SEQ ID NO: 27587 - DNA, 1501 bp, Oryza sativa
ggaaggttaaggagggtgaatttgtattaatatagtttaatcacaatattattttgggcaaatagaggaattaaagttaaaaaggacacatttgtacccatttataataaatattgtagccactataaatttgtaccaattttgcaatttggctatttgcattaatgtagtttatcccctattagtttgtgctaatcgagggaagaaagttaatgatggtgaatttgtaccatttatatagaacttctgttccaaaataagtttatatttggcttcttcagttcgtcccaaaataaatttatttttaagcaattattgcattgggatttgtaaaaatagaatatatatatatatatatatatatatatatatatatatacatcggagtagttaaagagagaaacaattgcattgcgatttgataaagtgagagtatttttagctcttttttttatattttatattggtatgtatatgatggatgaaaaagaacttattttggatggagggagtagtatattgtagtcactatcaacgtgtactgatatagggaagacaagtaatttggaaggtgcattcatatcaattcatatattaatatagtgttgcgcttataatttgcgttaataattgtctgatggttgttgacaatcaaatcgatggcattggctttagagtcgactgggttgccaactttttcggaggtattgcttcatcccaaaatataaaaaactagtaccagattagatattttatagtactacgaatctgattatattgtctgtcaagattcgtaatactataaaatgtttaatatgatcttagatttttatattttaaaataaagggatcgagtaatgaaggaacaaagatgcatggtagttggcaatatttgtccattccacatgccggagatagccaaacattatggttaggctcatttgctcgcatctctaggctctagctatgttttaagatgtggaaaaaaaaattttcctcttctattccttaatataatttacccagtttcgagaaaaagaaaagcaccaacaaagtaaaggaaagttaacgaggttgaagtatcatctgttaaccattgatctcacaacaatagcatgtttcatcccaaaaaccagctcggaagcaatatttagcagctataagttgtactctgattttttagcacacactttggacccagctcagcatgcaaaaatcgctgggacatagctgtgtacgcgcaaaaaatagaaaaaacaaaacacacaataaaagaaatatagagaggcaaagctaggctgccgggaaaacgttgttaaatgtttagcgcacgtgtcccatgtgcgccttcctcgtccacacgcattatatatagccatcgcctcctccttgactcctccccacccaagctcacacatctccctctctccctcttcttcttctcctcctctcgccatggatgccaccaccaccgtgtccatggagatggaattgccgtggg

SEQ ID NO: 27588 - DNA, 1501 bp, Oryza sativa
tgacacctaaaaattttcttttcgtaaactaaaagcattgttggtgtgtgatggtggttttgtctttttctaattctagtctcataggacggtagtcttgtcatttttttcctactatatcatttttttggcactatccgatgttatttgttttttaaaaagcatgcatgatacgtagttctccttctagacaatagctaccatgtttttagtatttaattgggatatatttgaaattatagatcagatttctctcaaaagtactaccattagaaaaaaaataacatataatttgttggggtgaataaatatgtaataatagaaactggtggttatagttgtattttataagtggggtcaaatggtcaatatccaaaacatgaacagcatgtatttatgcccggagagactagtagctactactatgttcttaaaaaaaagataacaccttagctacgaatatagacatagctatgaaccctagctaggattgagttttttttttttttgaaacggaggtggtagatgatatataaaaagtaagttttttttaagatagaataaatcttggccttacgaagaaagtaagtggctagatgataggaacaaagtgtcatactgctcatttggacggcaccgagaagagaaatggaggccgtgttagtgtctccttttgcttcgcattcaggccaccacttcaatcttgaggtggacatgctcagttaaaggaaattttctagccacaatttgaaacggatggctgcatgcatatgcaatgaggctcaattgaggagttgtgaacgtatccaactccatgaccgtaatagttcagaaaaaaggagatgaaaaacatgggctaaatcctttcttgtcatacttctgtgcacgaaatggataagaactttggggcagctaaccagagttatggcaaagctagcacacatatgccaatgcagccaaagtgccaggtgatcaaagaggctttcattttctttgacattctgtggaacaatcaaaaccagtcgatttgatagtttagcggtattagtttttttagcacgtttcaggcatatatacatcagtttaccatccagctgaatcacttcaggaaagagatagtgaagctactaaatcacttcagaacagttccaaaattcagcatcactttaaatgtcaagcattagagctgacgaattggagatgaagacaaatacatgagttctgcagagtcagtgaggtaggtgttcatgaaaattgagtagccaagaatctgcgcatagactgtggaaacagatagccgtgatgaagcactgtaacctatactacagcaactaaaaatgcccatgtatggagcagtttcagtctgaaatggcggctttaatagtaatgtaatttgccttcgaattttctaagataaggattcgtgtgaagtactccctccttttcaggttataagacgttttgacttttgtcaaagtcaaattgctttaagtttaaccaa

SEQ ID NO: 27589 - DNA, 1501 bp, Oryza sativa
actccctccttttcaggttataagacgttttgacttttgtcaaagtcaaattgctttaagtttaaccaaatttataaaaaaaagtagtaacatttttaacccaaaacaaatttattatgaaaatatatctaattattgatttgatgacactaatttagtattataaatattactatatttatgtataaacttagtcaaaattaaaacagtttgactttgaccaaattcaaaacttcttatacaagaacaaaagtatatctcatcctccccggctcatatgcaacatggtgtccgtattccaaaagtaaaatttaaaagttaattatgctatcgacctttcagttttacgctaccgtttaattatcagtcttattaaaatattaatatagatataaaaaaacatgagaacttacctcagcagatccgcacctgttggtagcgatcggtcgatgccgcgaagcgggctattttttccccccacgtacttcgtgtgcgccacacgcacgcacgctcgatcgatcactatctctctttctctttcttcgtgtcgtcgacttcgcatgcagccgtcgcgtacggctacagctcgacggcgacccaccggagctggctgcccatccggcatccactccatcgccgccgatgctcagctcgctactcgtcgcgggatgagcaagataacgacgagcgaaatccagctggactggacggcgagtcaatactatgcttgagaagagacagttgtattgtgttgtgtgggttgacgatgttgagatgtaaggatagaatatggcgatgcatgtccaaatttctggttacagttggcacagaggtgatctcataacatgcattgtatgcaaatcatggtttgcaaaaataatttggtcactgatgaaaaccgttcctaattaagtggattttagttttatatattatttaacttggcccctttgcctagcggtttctcaatttgtaccagcttgacacaagttcgatgaccagaatttccgaccggtcatattcatttgtcaacctgattgtaccgtggttgactatttattattgaagccttgcaacatggacattttggattagaattagtaccttgagctcctttcgaaagcaacaatttctgtagaattttaacaggatttagttgagttccttccaaaaaaaaaaagaaaactcatttcaaacttctctgctgccaacgaacgaacagaatgggctggattccaacagaggggcctttccctgctagatcagcacgtccggcccatccaagactagcccacttaacatatcttatctatggcccaaagctcacaaaaccagaaaagacctcggcccaattaccccattccgtccaactccaactcatcctggccgtccattcccgatcagaatccgctatataccctctcttccacccgcgccacccactcatccccttcctccgaaaaccctagctccaccacctcctcctccgccgccgccgcca

SEQ ID NO: 27590 - DNA, 332 bp, Oryza sativa
ccgctttccccgcgcccacgccaagttgccgcgcccacgccagtggccgccctctcaccgcgtctcccggccgcgccagcgcacgagaggggcgggattcgattttgaatcttcccccccaccttctctctctcctcccccacgtcgccggcgaaatcggagcgcctcccggccacgtccgcctccccctccgcctataaaatgctccccatgccctcctctctcgttttccgctctcaccgctccatcccgtgccccctaccgagctcgcaccgccgccacttacgccgccgcccgtcgccgcactccggccgtgtgccgccgtcgctaga

SEQ ID NO: 27591 - DNA, 215 bp, Oryza sativa
cctcgagtccgagctcctgcatcgagcccacccatgtcatcgcccctgcgacaccactaggtcggcatctcacctaccaagctcgggccctagatcagcagccgcctatgcttctcgacaaccgctgtcactgatgccaccggcgccccaccgcacaatagatttctccttgatagtagcgacctctcacctacctcttcctccctccctccaga

SEQ ID NO: 27592 - DNA, 1501 bp, Oryza sativa
acgagcagggttcttctggcactgggataccttgtagctttcaactgaaccattgattggtgactttaattgatcttatctctgacactgaccatccgctgccaggacggaagagaggtggaagagaggggttgctaaagataaggtactaaaccacttgcctactgatctgttgtgagtacacttttattgttcaagttgcttaagcaaacaacctagtatggtcgcatccccaccaatgatgcaaaccatacccctgcacacaagcaaacaacacacgatctagaagctaacgaaactactcttcagggaaggattgggtttaggtcatctccgggaaaactccacttgatcttcgcagaacgacgactctgaactgatcttctcgctccttgcacgaagcttgaggctcgaattgacttgacttccgaacagacatgaagctgacagctggtcctctaggtttgacaactaaaagaattggagagactgggaggagaattttgaaaaactgtttgacaaagaattgccgaagggcgagaggagacaatttgcaaatagggttttcagaaaacttgtccttagggtttgaccatttggctcaacctacagtcgagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaaaggggaatgatagcaaggctgagtacaaccaccgtactcagcaagccacaccaacgatgcagacgtgcaaggggatacaaggacggtttgtggctatttgcataaaggcggttgtaaaacattttattgggcaaaacagtaaaactgttgagtaattagagtaacattaaatctccactgatcaacgctacaccacgttgaacaggcccaaccaacccacctggactacagtgtattgggtcgatttattaagtgtgagactaatcacggtgaatctggtcgaccgcccataaccgcgggcacggctattcgaatagttttactctggccagaggtgtacaactgtacccacaagacacagccccacgacacgtttccgtgcgccgacatgccgccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgc

SEQ ID NO: 27593 - DNA, 478 bp, Oryza sativa
cttgtacttccttgcattaattatgcatctccggtgtggcttgctgagtactgtggttgtactcattcttgctcaatcttttcccccttcagtaagagaagctttggagaagaagtcttacgtggagtcttggcttataccccagttgagcgcctgtgaagatggagccgtaggcccgctagtccgctgctgtttatttttgattgtcaggcctgaagcgcctttgtaataatgtaaatattatcggtataataaagatgtgtcttttatatcatgtttgtgtggtgtaccccggcttttcctgggacggggattaatacactagcgttcgggaaaaggcaattttcccggtcgcgacacgacccaatcccgcctacggccggaacctccgggacaggcaggcaggactgagccccaagcagcagggcaccaaccctctgccacgacatctcgactaccgggccgcagctcgtgtagc

SEQ ID NO: 27594 - DNA, 205 bp, Oryza sativa
tattcgttcagtattccaatttattttgttttgttttatgttttgtgacattggtatgcatgtgcaggaagtagcaccctttgcaagtcacactatgcagtcccccgcctccctatttattttgttttgttttatgtttatgtgcaggaagtagcaccctttgcaattcacactatgcagtcccccgcctcatccatcctcacca

SEQ ID NO: 27595 - DNA, 326 bp, Oryza sativa
taccctttcaccaccttatcacaattggtaccgcccctcatagagacacggtaccatgaggtaccaaccaatttcagtcgttggatcctcccagatcgacagctaggatatggtattgcatgccctcaacctcaattacggtaaaaaacctccttgtagttttcttctccaactctttttatatcacgtctttgagcatgcaacaattcactccatatataaaaaacagatcactgtataaagacatagcaacattaatgaggtaagtcacaaaacaagaagaaagatgcggagaggatatcaaagagttttgggaatatgaggca

SEQ ID NO: 27596 - DNA, 686 bp, Oryza sativa
gtaccaaccgggactaaagatcctcggccccctgacatacgtctgacaggggatgaaccgggagtaaagatcatctttagtcccggttggtgttaccaaccgggactaaagatcaaaatttttataaccgggacttaaaaacaatctttactcccggttctttttgaatccgggactattgtgaatttgtcggaccgaccaaagaaggtatctccaccagtgtgggttatcctattttttaaacaaagtttgccgaatagcaaaaattctggcaaataagcttttcactcataattcggtaaaccgtcgtgctcgttagcaatatcatacaccgcgtatgtatgtttgtaaaccatagttattgctgtttcatgacgcctcttattcgtatcatattaagatgtacatacagcgaaattacgtgggcatgatgaagacgtcataattgcatgtaatgcatgaactgtaattagtgtttgtttgaggagcgattctcgatcttctgctctctactgatagtatcatgacaaaatttggtacaagacatttaaaaattgtgtaattagctggtagaaaaatctggattgtttattattaagaataaatttgtaatttgttaatagagtaatgagggtaacttagttcttttttttgtttttttttgggtatgggtcactaacgtcagg

SEQ ID NO: 27597 - DNA, 1501 bp, Oryza sativa
tccaaatcagtgattttgggatgaatgtacaggaggcttcattggttccaacagctttggtctctattcgtggcggctccttgacgcctgaaatagttcagactgagttagctcatcgaatcagaccggattggaagtgggaggcagtccttcatgctgagaattccttccttgtcgcttttccttccattgaggaattgaagaggatggatgatgtggaattccgtctaaaaaatcatggtgtgtcaatgacaataatcgagtggaaaacgactgatgagctgattccggcatatgagttggatgaagtgtgggtgcatgtgtcgggtgtgcctagcccatggcatcattacttggctttttgggcacttggttgtgttattggagctactcaggaagtagatatgctcacctacaggcggacgggagtgattcgtgtgaaggtttgtatgcattgtagcatacaactccctgtcactacagatgtggtttttgggaaattgggctacccaatcacttttgctttggaagaggaaggttgttagccggcacagatttcggaggtggactttatggaccatgacggggatgcacaggaggatcatgaaaactcgtcaaaggatggctctcatgatcaggcacacaagagggctaagaattcagcttctccaacaatatcaaaggaacaaaaatcagatgttacagccatgcaactagttctaacaccgtttggaaattgtcggcctccaccaccacctcgtctggtgatcgcaaatgggatagcttacaccattgttcacaccaaatcaggtgcaacagtggtgggtgaggtaataacagcagcagaaaaggtggatgaaatttatttgtctcaaccagtggacagtcctacacccgatcaaccttgtttgctgccaccggagttggaacgttggtccttgctgtcctctcagccggctgcagctgccaagatcaccggcgaggcctctttggcagctaccactgctgcactctccctagctgtacctcagatggctacacctacctcaaccgatgtcaatcgcagcaaggaccaactgagcaagacatcttctacacctcgttgtcgtagtgtgagatccaatgttgagaacatggatggcatcgctgcgggggatgatgactcactgctcaaggcaatgaagaggaaagcattgcgcaatttggatgacagctttgttggacgggaggtttcggcaacgaattcttagcagcactcggcctctcataaaacatcctctagtgaagatactgttataaattcatccccttctttaccttctttacattatgattttgttgcttccaatcttagttctttaggtgtttctttgggtaactctcatgatgaaatttctttctcgcttaacgctttgaaacatattgaggttgatagaactaaagcaacaaacaagactagtgaatgtaaccattctaagcacgttttttcagaagtggatca

SEQ ID NO: 27598 - DNA, 537 bp, Oryza sativa
ttttaaagagcaagcaaggtcacacattccccttgagcatgttgatcccaatttacaaatgttttactgtttgcaaacaaatatgcatgttttgctaattacatggggtcagggttttacctatctgctcgcttgtgccatgtttacttgatatatgttctttgtcaaccttgggtaatgaatcgactagctcatgttacttatgtgacctagctagaactatatgcttagccatgcttaattaccactagctcagttgatgggataattacaatattagacctttttagtatcagagtgagctgcgtgctcgagacatctggccatgcttcatggtcgtaattatccaactaaaatgcaactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagcttttctctagccgacgtacccaggcgagggtgggcgtga

SEQ ID NO: 27599 - DNA, 1501 bp, Oryza sativa
gtggagcaattaggcttaaaagattcgtctcgcaaattagttgcaatctgtgcaattgattattttttagcctatatttaatactacatgcatgtgtccaaacattcgatgtgacagggtgaaaaattttgacaggggatctaaacatgcccttattgtctacatcgtaattttgatttctgtaccattagaacacatcgatatttgtgcaaaaagggaaaaaaatcacgtgttgcaagtttttttagaactacacaataccacgtatacactcacaacgcatgtatactcaccctacccctatgagcatcttcgaagacatggggacacgcacactcacataggtccattaaatcctggaaaattcgctcccatggggacacgcacactgacacatgtccgcgaaatttcgacgtttcgacatggctcggaattaagtttcaattggaatttcgaaggttaaacaatagatttggtctaaatttagttaaaatttatcgaaaattgtgataccgatgggactcgaaatttagtggtcaaccggtaatgtaaaccctgccacaggcacctcgctgttgacgagtacgtcgcctaccattgaaagcacaaagccgttaaatattagaaaattcgcaaagttgaatctaggacctaaggtgctattgaggcttgtaaccactaggctaaaggcccttgtccttccgcgtgttgcaagtttttaatactactacttatgtacaagtattccaacccgcacatattgtttgctatgatattgttttgcgaatttgctagtattatttgcttgtctgggcattgctgcgggaaaaactcttctcgaagaagaggactcttccgttttcgatcttttgatacagtgcagaaggtgtgctatggttgaaaaaattattgtacactccaaaaatcatgtaaggtagcagggttggagtgtttttttttaactaaaatctctccaaatcagttttgaggatgaaataggaggacctttggtgatgctcggcgagacaaactccagggcttgatgttccatgtcagcacgttggcgcggcgcaaccggggacaaaaaaaagaaaaaaaaatgcagcgatggatggatggtggatgcccggctgctccgctcccctgttgcctccgccgtccgctgcaacactagacttcctattttcggatgatcggatcaccttccctagaaattcctaaattaattcaccgtcctttcctcctcttcttcctccttatctcctcttctctccctgttccttctccttctgttcgatcaatcggtgcgttcgccattgcagataattaatcatctttattttttttcttatctgacggatttatgtatagattctagccatgaacttgtctatgatcgagcatgagattttgcatcatggtaaacacaatttccctttttgtatgtgtgcaggggtgatcatcgagatcgtgttgagggatagatagtttaatctaacaa

SEQ ID NO: 27600 - DNA, 1501 bp, Oryza sativa
agggactttccacgaaattggtttccaatcggtctgtgtgggaaggaaggaataccgacactcataactgaattctggggaagggaattagccaaaaatcgtcctcccgcactttgatcgactcggtttgatgcggacaccatcgattgccgatcttgggtaggtgttgattttgaatttggtgaagttttggcccgcggcaagaaatctgccagcaaaactgtttgcactggccgtggacgaggtaatggtaccttccatggacgcattacccatccacggcgatggcactcagtggattttgtcttctgttttgatgagactctggtccactgatcgtcctcggtgataggtggggcagtcggagtcacccctgacactatcgggcttttttgttcccaccaacgagaagcaggagtgggaaaaccaatctcgtcccagaacccttggattagggagagatcggactctcctgattgagagtcatgcgttttcagtcctataacctccatgccggcgagagccgttgagccgttgtgatgaacttgagcgggagaatcaggagcagaagttgtggcagccatggttgcaatcagattctgtccacaaacgtggtcttgattgcagccggctgaattaacgatctctccttcctaaatgacgtcagttaggctggagaagcgagatccacttaccggcgaaggaattggtgctagggttagccgacgtcggtgggagtcatggcgccgtccatagaccttcagacttcctgcacagagatcagcacctgcatcctaggtaggaaaattaccttgctcttgtcctgaggaagaagaagccgccaccgaaggagatgcactcatcgccggcagtgaggaagaacctcaggggagcctccaatggaccattgatccgtttttggagcaaggacacagcgccggcgagggaaggatacagctccactcccggccgtcggcctgaagaacgctgtttactagactgaagaatgtcggacttgaaacattggcccgattcctggttccggaggtgttgacagaaaacacgaggcctgggagatctgcttaactctagtgcaggtccaaaactcgccttcggatgtatgagcgtgccagttgatttgatcctgcaatcaacaagaaacaaagacaaagaaaccgtggttaaatccacaaatgatagccaatcggctagatgccgatgacatatcatttgtctttgagccgatgtcatatgtagatcgatcggcaaccatgaataagtaaagaagaactagatctactcgatcggctgtagacattaacaatatataatctttatgtcgatatattcttaaatcaggtgattgggatagatcggtcaccatgccgagacagtataaatcatttagatcgaaagatatattaacaacaagattatatatgttcatagcatagccgatcagataaatttagcgtgtattggctaatactccgatacgact

SEQ ID NO: 27601 - DNA, 1501 bp, Oryza sativa
tgtcgtaagcaaagtagttggtcgccgcatatggcacaactccaattaaacttggcgttaaacctcggtacagctcagtagggccttcttcacggacaattttgacaagagcgtggagaaagttatcatatacacctctctgcacattttaaggcacaaccatcgtatgacattcgtgtattgcgtctcaggaagttaaaaggctctagtttcagggaggcatacagagggatagaactaacctgtatggttaatcgtgtcttaattaattccagagggtaagtacagagggttgaactgacaccagcaaatgccccagccactagtgaaggagggagtgggaccttcttttgttccccagatttgggggtcaagaacttgttagctgtatcaaaagcgaagagctgcagaaaaagaagggacggccaaatattaatatatgtatgtgcacaaatacttgtacaactagctatttatgtttcaacatgcatccatcatttatatcgtagttgtccgatgatatacacaaccatgcgcatccaacatgtgtgaactaagcaacaaacagaacataaaaattaaacacccaactgtgttctgttcaaccctctaactgtgaatgccagaaaaggtttcttgataaaagaaatgaaaatttgaagaaagccaacaataatgcaaggacctgcctgatgttttcatacttcaaataagcatgagaattagcctttttatagcccttattacatttttaattacgataaaaaatcaatacaagaactttctgactgtagcttccttgaaacatacaaaccttttcttacatgaatcatgcaacaagttgcctgaggtttggagcagctcactcaaacataaagatataggaattatttagctgcagatcaaaaccttggtttaatcaggccaatacctctgggaatggaaatctcaaaaaaaaaaaaggatataattagttttgtcttgtatgtgccttcggtttgcgctcagctgttgtctaatattgtgtaaattatcaggtatggttcactggagagaaagcaaataccaagtttctattatgttaaaataaaaaaaaatagtgatttatgaagaccatactctgttcaagctacttatcttcagaccagcttgagcagggaaatgttatggcaacagataagagcaattcttacgtaccggtggactaaactgcaaactgcttcttgtttttgggtatataatcatcactattttttcccattaatatcatccataaggtcaagatagcacaacgctgatgaaatgatgtgttataacagaaattacatcgatgctttcagccttacactagctccgaaattgcatactgcgcaaggctagcacactgacctatataacttaactctatggtatccaataccaaaatggcacaatctctcaacaaattttaagctatgccaaaagagctattcagcttttcttgggtaacaggggttaatct

SEQ ID NO: 27602 - DNA, 1501 bp, Oryza sativa
ggcccctccaactttgaatatcctctaaatgcaacagccctactctcccatagtcccataccgcaaaaagagagaagtctaaataaacgtccaaaaacacggaatttttttattaaaatatttaaaaatatattttttctttcgaaaattaacaaatctaatcgcctaccgccctttgggagggcgatttttaaaaacctaaatgcaaaatttttatttgtgtttaaaccctttccaccggttttaattgcttaaaaactaataatgcttattcgatactccaaatgattttaaatggaaaagtgataaactacaaagttatagatctcatcaagatctacaacttttatataaagtttatctccattcaatgtcgtttgaaatgtagatctgagattttttaaaatgtgttttatattttgtaatgaatatttggatatctaaaacatcttaaataaaaaagttgttaactacaaagttgtagatctccttgagatctacaattttgatataaagttttatttcatctgactttatataatataattttaaattataaaattatagagctaacaagttgtgctgaaaaatttgcatttaggtgccttgccgccctctggaagggcaaagggcggcaggcgattagatttgtaaattttcgaatcaaaaaattatttttgtaaatattttaataaaaatgtataaataaaaaaattccaaaaacacgttggattagattcgggccaacccaccttgaacataccaaaccacatagggccagcccaccttgaacataccaaaccacatatttcggcttgggcccagtttccatagaatttttttcggttttagatttttttaatatttacagaaataatctatcgaccaaaaaaattgcagaaatagcccctgccgcccacctctggggcagcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagcccccagccctcattcttctctcctcaattccagtgaaaaaaaagaagagaggggaggagaagagaagaaggggcaaagccctaccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagata

SEQ ID NO: 27603 - DNA, 1501 bp, Oryza sativa
ttgtaggaaataaaactcagaatttttggaggttgttgttttgtgtgtcagatatagtagacagacaaagggatactgcatgggacttcagactcctttggatttggctaatcatggtgcatgataagaaaaacataggaattgattgccatggctaggccaaatcctacagaaagtaaaatttcagggatttgctaaagagcatgtttagttagtccataggaaaacctcaggaattgtgaatgaaatacttcattagaataaataaaatatgagagataaagagacatgttgtcttggccttctcaaaggaggaaaggaagcgatcctacagaaattttggaacccagtcttacaatccaaaggaccttatagggaattttctataggattttaattctttgaaattccttggttccaaagagagcttatgcttatatcctatggaattgaggcataggaagcaattccaaaggatttttatcaatcgcattcctatgatccaaaggagctaatagggaacttttttttttctaaggattgaaatcctccaagtttcctttgaaattccttcagcccatagggattttggattatttttaatatgaagtctaatctctaatatccacttcgtgacacaggattatagaaaaataggaatatgaaaagcataagaataataggattttaaaacacaggaatcctgaatttagttccttttataaaaacagaaatagagaggaactagataggtaaataaagcacaacatttttcaaaatatttaatgagtatattaaaaaaaatcaagcattaataccagcacatgacacccctctacatcattcaaagcatttattgcaaaatgggtactcccaaaataatatacatatcaacatgagctatcgagatcaccgtgggcagcaacaatcagaagcgagagggatgatgcagcgtctccaaagtgtgcaggtttgcaagatcaggagggaagcaaataggattgctcatgctttagctcaaatggctatgaggtctagatcgtatgaggagtggaagttgtgtcctcccgcagaaatcttagacttgataaatcaagaatgcaattctcttttccgtaatcaataaaattccctctttgaagtaaaaacaaaaacaatatacatatcgcatatattgtaaaatagagagaatccgtgaacacatttaaagatgaggaagctacacatgaccacaaaataaattcatatcatgtttgcaacatacatatacttctgtgccgtgcggtttggtttgagccattgaaaaacatgtgtgttgtaccgaagaaaatgtgataggtgcccgtttataaaatccacatgtagagacgaagaatcaaaacctctggtagctaatcaacgtcacttagactgccacacaggagcacaccaactccctactagaagtagtagaacgccacgtgtgcaaaccaggatttggatcctctgcatagaggatgaa

SEQ ID NO: 27604 - DNA, 1501 bp, Oryza sativa
cctctccattataaattaattctcttctaccatgtgatatactattatttattttagccctatctggcagtctggctctcagagtttcaatacaagtcgagccatctggccttcctaaaaaattgaaatgtgtttctcaaaaataaaaaggaaatgtgaaaaggccataattattttttcttgaactgattcgatacttcttttttacttcgcctgattattggtttatatgggttatttgaatatgagagtttgaaatttgacatgaaagaaataaaattggaactgattgttacatgtattggtcatctgaagctctgatgaattttgtgtgctctttttctactacatgcttcgtgtgctctttcactatactacagaactgtttagacttcagaccacagaacaaattaatatggcaacaattatacttacatgctgcagtaacagcttgtaaatttgtacccgttgtagaatctaatggaattggcattctttcaatcctgcaatacactgcaaccttagagtttaagcacctaatctaacttggatcatagacatgaagtttaagcaccttgtacatacggccggcaagaggggattgaagacatgaagttgaccccaaagctgtagctcttcattttccaaagtgattccatatcttataacatggggagaaccattagattccaatatccaaataaagctcagcatatgttcttccttagaaaaaaaaagggtgcaatttcccaactttggaaagtcaacttaaagcaattccagtaaggacttctctagaaaccatgtacttctagtacttcatttgatcatttctttgcagaaaattttggcttgtcttattaccacctccgttctcgaatagtaactcaatgttattattcaatctcaaactttgactgtttattctcttgggaaaaaaaaacttagaaaaatgttatattattgaagtgtgcagcgttatgaatacaatcatactagaatttacgttcattgtaacctagtgtacacctaggtgtagaaaaaccatatccctaatttctctacggtacgtcaaagagagagagagtaatactgaatagcgataattattcgaaaaccgaggaattgaaatggcacacaggactcttcaatcttcattcatatacaagtcttggttgagatttccaacagagaaaagaaatctgcaaatgccatacggtgaatattacatatccttatatgacaggtgactgatttgctcaataaacaatctgaggaatatattttacattatttgagttcttttcaagccgttcgaggtcaactggacattcagatttaacaaatactcggcacaccgatatgcatctgcaagcaagctaaactaagtaaacgcctgcacaaacaagagatctcaccggttaatcactttgtctgatgaactgaatgatgtcgacacctgaatgtttaacaattgctagttgctgcacatatgtgaagt

SEQ ID NO: 27605 - DNA, 1501 bp, Oryza sativa
ttcacttacttccttcactgttgacttttctacttgtaatagttggagttgtgttttcatgaccagaactttgaattcatcattacatagtgctgaatttgggctccttacgctaatcatatgccaatagtgatttgtgtagatattttcataccccctggttgtcagtctagaaggcattctttcttcatcttttattcaccatgtttatgatttttctctgttttcatgctttccaggatgctgctaagtacagagatgaactgaagattttggctccacacgccctcctaaaatgttctagtgatgctactaccctggtatcttacaatccaatgatttagtgatgttatactacaactctggcatgtttctttcactcgataaagtatcatagttttgaatgaaatggtttggtcatttgaaaacttgaggctatgaaacattatcattgtctatggcagtatattagtgtttaaaacccccagctggtcacgcaatttcaccagggaacttgggtatcaagtagtgacctaaaaaaatagctaaggcaggatatggaaaataagagattaatacgtgaaggtcatcaagaatctatttgagttggttataactgtgtgcgttggcccttgggcaccacttcatttctttcatatgttcaggcgccccattctttttttccacgaaaatctcatgcactacagatgaaccacctccgttggtttcgtcacctgttctgtaataattctttagttaatgtagatcaaatattttctcagattcttcattgagcttaactagatttcctgatattttttaatgttgaatttaggggattagagttcaagtcaggagtgtttatattgaaagccggagccagcctttgaagggccagttcttctttgcctacagaatcagaatcacaaataattctcagcgccctgttcagcttctcagaagacattggattgtcactgatgcaaatggaaggacggagaacatttggtaagtctctattgtactctcaccttaccaaaagaaccgtatgttaaagctaataaagacttgctccattgccatgccaggggtgtaggtgttgtgggagagcaacctgtcatatttccaaggactggttttgagtactcatctgcatgcccattaaacacaccaaatgggagaatggtaacatctaaatcttccacaacctatgttgtcacacttgtaaataggttattgtaaagtaatttttagattctagctgtgcaagagattcgtatggttctaatatctcttgattgcatatagctggcatcaatttatgcccaataattaacatggtatctagatcaattgttttgattgaagctgaaagaagaaatagtaatgttcaattaagaaagactagttatatcctgcaatttatttattgtttaggttgtttgcgtgttgcatgtctgcaaagcaaacttacctgaattctcttttggatttaggaagg

SEQ ID NO: 27606 - DNA, 1501 bp, Oryza sativa
ccaaatcttaaacccactgtaacaagtattcacttgatcatctaaatcatgagccaaccaaaacttaggctgtgtttagatctaaagtttagatccaaacttaagtccttttccatcacatcaacatgtcatacatacacaacttttcagtcacatcatcttcaatttcaaacaaaatctaaactttacggtaaactaaacacagccttagtggcattctagttcatggccatggtgagaactgagaagagaaccttctctatgatgcagacctccactttggttatttggtagtagtgtgtcatctggtctacaagcaggggcggatagttgtgaccttcatgagtccaatctattggacaattttattatcttttttttatcatggacattcacaaaaattgtgttacgcttaagggcaaatgtacttcctatattttactagtataatcatatatattttaaacttaaattagtttgactgcgtgcggggtaactagactgataaggttgagttaaccttgcctcctcacatggaaacacaaagtaaaagattggcgcaacattaattaagtattagtaaaaaaacttaaaaaatatattaatatgattttcaagcaactttcttatgtaattttttttaaaacacacatcgtttagcagttaaaaaacgtgaacgccgaaaacgagggatgttagttgagaaatgagtgggaagaacatgccggctgtgttcggtgctctaagttcccaacccctctccctcgttttccgcgcgcacgctttttaaaatattaaacggtgcgtttttttacaaaagaaatttctatatgaaagttgcttaaaaaatcatattgatatagctaatacttaattaatcatgcgctaacggactgcttcgtttttcgtgcggaggagatgggtttccaatcccaacttaccaacacaccctaaatctagccacataatcaaacacacaaaaagaagctaagagcaggtacaatagcaggctataagctagctataaacatactttaaagagataaagtaagagagagaagagcagcggactacagatctgtagctagctgcagtacggactccaagacgtaatgtgtgtatgacaggtggaaccagctattaataggatagtaagcaactattatatgaattgaccattacgttggctatagatgatttgatgccagtagtgggctatactattaaacctaacactaacagcatacaaaacatttcctgttgtttttctccgtcgatcgcaatcgcggagtcgtggctgcccctgtgcccacacccaaaatccgggatctttttcgtgcgattccaacatgtcgatcgttcttatctgatccaataatgacgcgccaatcgctaatccgcaccagttaagcccaaacatttcttttcttttcttttttttttctactcctctccctctcgtttcttggcggcgatggagatggagagagccacagaaatg

SEQ ID NO: 27607 - DNA, 305 bp, Oryza sativa
aattcgagctcggtacccttgacctctaagcgtgccattagatagatctcgagatttgaggaattttggaagttgaacggagtcaaacggacttacggttgggaagatattgaatttctaagattactggatttttggtctaaaggaaaaggatttatttaaatcctttttgaaaaagaaaagaaaagaaaagaaggagggagggaaattagacttccctcgggcggctagggcgcggcccgagagaatggggcggctcggccgagcttaatgggccggccggcccaagaaggcggcccaaggcg

SEQ ID NO: 27608 - DNA, 229 bp, Oryza sativa
tgagccattctacgggtaatgcaagacatgcggcagcttgactatggcaacaacatataattcccggagctatcattccagggggggaaagacacaacaggtctatccatcgactactacggctgtacggctctggcacgtactaaactacaccccaaggaagagccatgagctctcactaatcctggcgcgcaggtcaactatgtgaacgacccgattaactagcgga

SEQ ID NO: 27609 - DNA, 587 bp, Oryza sativa
catgcaaatatacaacatcatttacaatttatttaattctacaaatcaacatgcaatcatatccagttatcacctctcacaaatctatctatcatttttatagtattaaacatatagttatcaatatgtttcacattaaaacgcaggtatcatctgtttgttttatgataagtactgataaactctgatgttttattattttttttcttttacttttagcttaattgtcgaaaaaaatattgagaaatacttagtaattttcgtggcaaaacgtgagaaatcatacagttaacccatccaaacagtccgtaaagcccgtaagaaaaatggcatatgagaatacacattcggggaggatatggcacagggttttaaaagaaaaaccatcaaattaactcaactcgccccaaattttcgaggggagattttttttttcctttttaacgtttttacacctcatcatcatcaggcctttcccttccctttctcctttctcgttgtgtgggttctttctaggccctaggacaagccaagaagcggcggaggggaagggaggaagagggcaccagccgcaccggccggcggaa

SEQ ID NO: 27610 - DNA, 258 bp, Oryza sativa
caactggggtataagccaaacgtcttctccttcgcaacttcctcaattgaggtttgattgattattgcaaggtgagtacatggaatactccgcatgccacacagcaaatatgcaagtgcacaaggataccaaaggatggcataatatagggcttatttgcaaaagcagcatttagcaaatatttgagaatagtaaaacagtagagtaattaatcatcaatattaatcaacactgtacagcacacccatgctgcacagg

SEQ ID NO: 27611 - DNA, 322 bp, Oryza sativa
tcctcttaccacatactgtcttgcttttcacttgctacagtacttacctattatgtctattgacatttgacaggaagtgaatttgtgatgcatagtgaactgaatactgaaagaaggggtggtatatagaaggaccaggaaatatgatgcggttattgcccttctatgttatatatacaaggtggtcataattaaatttctctcatatagtatcatcaacttcttgggttgatctgaattaaatagtgaaaataaatgtgctatgatttctacatagactttttgtaccattaattactcacccttggagagctagaaataa

SEQ ID NO: 27612 - DNA, 352 bp, Oryza sativa
tcgatctctattgatttctttaatcctcctcctctgaccacatactttcttgctttttcacttgctacagtacttacttattatgtctattgacatttgcaaggaagtggatttgtgatgcatagtgaactgaatactgaaagaaggggtggtatatagaagggccaggaaatatgatgcggttattgcccttttatgttatatatacaaggtggtcataattaaatttctctcatatagtatcatcaacttcttgggttgatctgaattaaatagtgaaaataaatgtgctatgatttctacatagactttttgtaccattaattactcacccttggagagctagaaataa

SEQ ID NO: 27613 - DNA, 1501 bp, Oryza sativa
gtagctaggggtcaccaccgttcctctctattcggcccaaaacactgtagaggaagagattgggtaagattgagtttttattctaagtatccgagtggcaaatggtcattcgaacaaggaaatggtaaaatgttgttcgagttggaaaacactattcgagtcggaaaataccgttcgagtgagtccttgtcactaagtctcattatccgttttgcgtatttcctgagttaataacaggtcagctgtcacgcccagaaattaactagcaatttccgaacttatttgtgcattaaatcctcgtccaggaatcagccgaggtacacaaactgacaattaatatacagattcatcataataataacgtaaatacttacaaaagaaaagaaaaatagcagcggaattacagtctagcgaagctccggctccactcccacaggcagctcaactgaggtataagccaaacgtcttctccttcgcaacttgtcttcaactgaggtttgattgattattgcaaggtgagcatatgacatactcagcaagccacacagcaaatatgcaagtgcacaaggataccaaaggatggcataatatagggttcatttgcaaaagcagcatttagaaaatatttaagaattgtaaaacagtagagtaattaatcatcaatattaatcaacactgaacagcacacccatgctgcacaggcccaaccatcctgaacaaccatacccggctgcacagatctatctccaaaccaggaatgtaccattccaaaccaggagctaaattaattaccatcaattaccacattattattaatgagtagtgtaggactaatcacgaaagacattgttcgacccgcccataaccgcgggcacggctattcgaatagttttactctggccagaggtgtaccactgtacccacaagacacaactccacaatatgtcaccatatcatcatgtgcccatgctaaacatgtcaccatttgtgtagttgtgacaagacccctcgcatatgtcaactcaaagcagtgcaccgttcctagatcgtagtcaccccctcaaaaaccagaggcatggactccccagcgacccccgtgggcttatctccgccacttctcagtctggcactccacgatgagccttgctatgcaaagtgtccagccgttgcccattctggcttgtggttgacacggttaatgtttcacaaccgaaactcgtgaaccggtccttaattgtcatgagcactaccatcaaaaccatgtgctcacaacccaccattatcaagttttagttggcacattaattaattcaccaatcacgattaaccatcgtgagctatcattaaatctctaccattaagtaatagtgaaacattagttatcccaattatgtgctaatgtttctaagcatggctaagcaattatatctaacatctagctgaaccaatatataaagctcaactagtcaaattataataacccaatgtatcaaggaatagt

SEQ ID NO: 27614 - DNA, 1501 bp, Oryza sativa
atggatgcagggttttgagggaacggtggagattcactccctatggctgttggagggtattaccgacctttccaaccaccataaccgtcattacctgcctatttaaggagttcactctcttcacttcaacacacacctcaagaaatagctctctcatttctctcaagtttagtttagtagtatctagctggtggaataggaatagagtagaaatcaggagttcggaagtcttcggaagagttcgggtatggctctagtagcttttctcttctcttttgtaagctttgtacttttattagaatactcttctaaatacatttatggtattgaaatactttccgagtatatgagtacctactttacattatgttcatgttatactgaatatacggctagcttatctggaagatgctttggtgcgggtataatgtttgcttatgcaattcctctatgtcatgacgatgatattagagaagtatctgatagtttaggcgtggtgtctagattacgggatatcattatttggggttatatattgcggatgagaggtgggccgctgatggtgatagctcagtacgggtattcctccgcgccggtatataatcctaagttaatttcctagggagggtattcctccgtatttagccctggttgtatggtcatgatgggctgtcgtaaggaactcggcagtcaggggtggcttctcgaagtaccaggagggcatcggatagagggtattagctagtataccagttaactagaatgtatgtatactatgtgtattagaagtataggaatagattttctttctcttttctttccactaagataagataatatattatgagaatgagtaataatgcttgtgtgtcattctacccttggattatcttaacccctgcttagaatatgattatcataagtaacatataaattattagtcaagctctctctacatgatcttcccacgggataaaataaatacgatacccttggaatactctcgggtgaaatgctacaatggtatatctgtgcgcttgcggatgaattctgtaaccataatataccaggagtatttctgcgccattgctgggaattatatttctagtaatgtcgttaagaaataccaacaagcatttctggcgccgttgcccgagaagattcataatagagattacttgaactaatactttatatttacctctgtataatcattttcctttgcaggctaaccttggttgttttcactgtttgttgtgaaaacagggtagtgcatgactggtttcaacctgccggaaaacttcaaagaaaatgcagaagctttcatccggagcgtcaagccgcgagttgttgctccgcagaaaactctaccgacagagaaaccagccgtaccagcgccaccgaccttcaagactatggccaacaagactcttcgcgagttcgctgctctctctgctgactatgtggccattgggccacaggtcaacataggggacgtgga

SEQ ID NO: 27615 - DNA, 1501 bp, Oryza sativa
tggcatagtagggtttcatttgcataaacagcatttaataaacatttcagaatttaataaaatagttaagtaataattaaacaatattaatccaacgctatacaacataccctgttgcataggcccaaccattctgaacaaccatcccggctgcacagttctatctccaaaccaggaatataccatttcaaaccaggagctaaacaaattattaccagttatagcatcttttattatggtgagaagtgtgaaactaatcacgaaagacattgttagacctgcccataaccgcgagcacgactattcgaatagttttactctggccagagatgtaccactgtacccacaagacacagccccacaacatgtcaccatgtgcctcaataccaccacggtacctcggaaaggagctgtgacagtacccccgcacaacacaatccaccacagcgcacctttcctggatcataatcacccccttataaacaaggcatggactccccagcgacccccgtgggcttatctccgccacttctcagactggtgctccgcaatgaaccatgctatacaaaaggtaaagccgttgcccacgctagcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcattgctaagcaatcgtatctaatatctagttgaaccaatatataaagcccaactagtcaagttataataacccaaggtatcaaggaataaaataatcaagaacaaaagggctataacaaacaataggttaattccacccaatgacattcgaaaataaatgcaatagttgaatagaaacaatagctttaaacgggatcaacatgctcaaaaggttgtttgggatctgtgtgacttgccttgctggccttggaactcttcaaattcttctcctgcgaaaacgaactctccggaaacgttggaatctaaacagaaaagagcaaaaacaccaaaacagcacataaacaagcatgaacagtgcatgtggatatttttaacatgtagatctctattttagaaaaatttagagacttgaaccaactaaatccgagctaagatgaattagttatgaatttttaaaggttaaatcggattaaaacacttatatggattttaattgaattatgacgcaataatgaattatttttgaaaaggaaaagggaattattgcgtcagcggctagggttcgcggtggaccgggtgcacggcggcggctcacggaaacaaacggccgagatcgatcctatccaaaacggatggccaagatccaacggtctatgaccggtctacgacggacggcaacga

SEQ ID NO: 27616 - DNA, 1501 bp, Oryza sativa
actagccggtcagaccgcccacacacctatggtctgaccggccctgtgaaggaaacccgtcactttccaaactttggcaattttcccctatttcgtccataggtgccaaatttgggtgtaaacacatgcccccctgcctttttggtgaacatacatgaacctaaaagcataaaacatgttatctcagggcgataatccaattaccggccataggacttccctagcggagtcgccaaaaatcgtgttggtaactttttgtgacaagtcgacaagcacgatcgcaacacctaaacgccttgcggtgatatggagtcgccaaccaactcgatctagccaaagggccaaattaagatgggttttgataactaaaccagctagcggagcagatttctagattactacccgtctcgtgggcaaaaggaaggttttcaggacaaacctacaaagaggtgtcgcactctcgcagtgtcggcgtacggtgtacggtgcaaaccgacaaagatggacaaactaagagaaaactaaaaagtaatatgaaaaaacgattcgattgattgatagtagattagatttttttacaatgaaccggccatgtcccttatataggggttggtcttgccctatacaggccctcctccatgtccaactcggggtagaaaccaaaggaaacccgaaacatgccttcccgagcaaggaaacctcgagactagacgaaacacaatcggactcggccctgccggtcagaccggccacacaccgccggtctgaccggccctcaaccggcggtctgaccgcccaacacacggcggtcagaccggcccactcggaggaaaccggtagacttccaaattttggcaatccttcctattttaatcctaggtgccaaatttgggtgtaaacacttagtttcctttgttgctaatctattttctcgtgcagcaagttgagaaagctttgatgattgaacctgacgactagataacttctcttgcatttccatcatcttcatgcgtcttgtgtgaatatcagattggacttggtctaacttgtatatctcttcagcatcagaaatatcgttggactttcccttgctttcacgtgcagctcttttagcagctttttgtccgattggccgtggggtttcttcaacatctgttattagacgacttccttttagatctctcttgagtgcatcattatatgcattccacttaggctgatcacggcatgcgtaccatacatctattagaacgaaccatcctaattttttgttatcggcctcattgaacttatgggccatgtcaatccacatttggtcagagtaaccactagtatatgtgcgcttagccttcaaccaacagccttggaacagatccgtccgtgtgttgagtttgtgccaacgctccttggcttgctttgggcttctccatctattctgtggtgtggttttattgtattctgtagcaacatctccccaatatttttcagccttcttatcatt

SEQ ID NO: 27617 - DNA, 1501 bp, Oryza sativa
agtggaatattattattctaacatatttattcattgcaagcatcactagttctcctctattttggtaatatcaacagatacgtctggtgaaaacagaggaagaggtactatcatactcaaagtcactaaaagtacccaactgaataaaaagggaggcagttgagatctggcaagtggtatggagcctcataataaacacttcccatcaaggaagaaaatcagcagttagagtacacacaacgctggtacactaagaggatcatgcccacatcaaaaagcattaagcaagaagaagaaacatatgaaaaatgcatatcctcgtatatctatggatactcgcatagagtctcatacaaccaatagaagttaacaatgagacctattatgggcaatgtttcctttagacagtaaaacttattggcaatcaaccaggagttgaatggaattaatcaactagaagttcaaaaaaaaaacaacctgaatatagacaacactgaagataaaatctggatgcttttcaggagcttggattggacacttgcataacagtacataaaaaagtacttagtcctaaaccaatatgtaatgtatataataatctataaagaattgaagaagcgaactcgttcattttgaatttgaatttgatttgaaattgaaatgtttggctgaatctaaatcacgcttagacttgcagctaaaaaatatgatagatggaagcttagtacatcagtccaaccacacttagaaagtgatcaaggtgcatggctttggagtagtcaattatagctaaaattgggacgaaattccaaacacgagtgtgtgatagcagcactcgaatacttggctaatcgggactaaaccgaattaagtatcattgaactatacatagccttggcatggctttgagagatggttacatcgctccagcaatcgtggttcgaaaattatctcaaccccattattttatttgaaaataatgtagcgtatgacacacaatgcaaatgagttcacatgaacaaactcactcaaagcatatgaacctcccaagttcttctatgcacatgaattgcatataaacaacgaaatattgcatgctaagttatgtgaaaatcttgctgattttatcactggtcattgttgacatcttctcgaatagatgtgtccaaggaaccagaacaatgagacttgtaagaatgtaaaatttaaggggagaatttcactgattcattcagaatcttaatatagaaaattcaaatacccaacaaatcaatttagaaagattgaacgaagaattggatgaattgtactctttttcccttgataagttattactggagtttcttatcaaggtttttaatgagacaattcgtgtgacaccgcatgaattttttgtagagttttgatgcacaagcatcacacaatgagagcacggagggagtgttagggaaccagcggcccatgaagagcggatcactaaatatgaaaggtggatgaggct

SEQ ID NO: 27618 - DNA, 1501 bp, Oryza sativa
ctacatgttaaaaatatccacatgcactgttcatgcttgtttatgtgctgttttggtgtttttgctcttttctgtttagattccaacgtttccggagagttcgttttcgcaggagaagaatttgaagagttccaaggccagcaaggcaagtcacacagatcccaaacaaccttttgagcatgttgatcccgtttaaagctattgtttctattcaactattgcatttattttcgaatgtcattgggtggaattaacctattgtttgttatagcccttttgttcttgattattttattccttgataccttgggttattataacttgactagttgggctttatatattggttcaactagatattagatacgattgcttagcaatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagctagcgtgggcaacggctttaccttttgtatagcatggttcattgcggagcaccagtctgagaagtggcggagataagcccacgggggtcgctggggagtccatgccttgtttataagggggtgattatgatccaggaaaggtgcgctgtggtggattgtgttgtgcgggggtactgtcacagctcctttccgaggtaccgtggtggtattgaggcacatggtgacatgttgtggggctgtgtcttgtgggtacagtggtacatctctggccagagtaaaactattcgaatagtcgtgctcgcggttatgggcaggtctaacaatgtctttcgtgattagtttcacacttctcaccataataaaagatgctataactggtaataatttgtttagctcctggtttgaaatggtatattcctggtttggagatagaactgtgcagccgggatggttgttcagaatggttgggcctatgcaacagggtatgttgtatagcgttggattaatattgtttaattattacttaactattttattaaattctgaaatgtttattaaatgctgtttatgcaaatgaaaccctactatgccatcctttgttatcctgtgcactttcatatttgctgcgtggcttgctgagtatgtcatatactcaccttgcaatcattcatcagaggaagagttctacagtggtgctgatggtgtggaggattaggtgtagccctggtcaagctgcctgtggagtggagtcgtctgcgctgtttatcttattttttccgctgcttagatctttattgattgagaggaactatctacctctgtaatgacattttattcgcttattaattagagtaataattgtactctattatcaatttgttctaagcacgac

SEQ ID NO: 27619 - DNA, 1501 bp, Oryza sativa
cgactccacgaaagatcggcaaagtgaggttaaatatagttttgatgtggccaagtgtgataagatctttgattatcttttgcaagaaaaacaaattagattacctaaaggccatgtcataccatctcaagaagagttgaaacgtcgagcatattgtaaatggcatgattctcattctcactctactaatgattgcaatgtgtttcgacgacaggttcaatcggccatagatgaaggacgattgaagttcaccaatggttccaagatgaagcttgatgatgatccttttccggtgaacacaattaatttcaatgataagaaggtgttgattcggccggagcaagccgaatctactaagggaaaggaagtggtcattggtgaaccgaggcctaagatgatagtgccaaagaagccggaggtgggtgtttggaaagaaaataagagtggagcttcgacttctaaggcccctaggaagaccaaggtgacttttgatatgctcttggagaaatatgagaggcaaggtggtgagaagattcgcaacagagggaaaagaccaagatcacctcctagggagcgatttggtcattcaccaagacggtcgcattcaccttcatatcatcatccacaagacatgtcatggggtccctatccaaagccgccgccgggttatccttatccctacttcaagccatggggggcaacgccgccaatgtacaattatatgcctccaatgcaattcaaccaagggtggggaggaccaaggaggccaatccatgagcgtctgtcttcaccaaacaatagccggttttatggtaagaatcgggctaatgaagaaaagagggaaggaaagcgcgtcaagatggaggaaaggacttcggaggtgattactatcaaagtggggtctcatgatgtgccaataccttctggagatggagttggagtgtccccgaacaagaaatccgaagccggtaccagctcctcgcagtcggccggtctgaccaggccttctggctggtctgaccgcggccatacggccggtctgaccgccgacctgacgacggtccgaccgacgcctcaggccggtctgaccacgcgccacatgtcggtctgaccggcgcgtctggccggtctgaccggtggtctacggccggtctgaccgggctccagcgccggtttgatgagagggctgcaataggcgatgtgagggcttcatcgtcttcaaacaagattaatagagggcattatttacctcctggaacagagccgaatcctaggtggatgcctaaggatttgacggctacgcaaaagagaaggttgcaacgtcttcgggcccaagaactaagagagaaaaaggccgaagaacaaagagataaaaggttcaatgagttgcgaccaccactggtatggaggcctaaatccatagagaaggaaaaaccgattgatgtagaggagaaggaagaacaatcggttaacaagggtgaatcgtctccaaaagaagaca

SEQ ID NO: 27620 - DNA, 1501 bp, Oryza sativa
attcaaagtttttgactttcggagagagtcttttgcaatgcactatgatagtggaatatgcacacaaataaagtaaatgcaatagtactagttgcagagcagatgttcatgctaatggtctgaattttctttcagaatccgctgatttcaagactacatgtccattcatactgcaggtattataacaatgacatagcaagtattacaattcatagtttatatttagtccgttcatgcagatatttggtacttcatgctgctagttcactaatcatcaaatgctattctagcattgtccttgtgtacttctaaagatgattagtgaaatttgttcaaatttatatgctcttgatggatcaatcttggcaaatatatggtgtcgaataggcattggatgttcactacttgagaagcgtctctatccatatagtaccaaaaataggatggtaagtattccatgcaatccaattcgatgttataattatacattcatggtatgtggtctatgcattaatctcctgttggggcatactggcacataaatattcatgatttaggaaattatgcatatatgtgctataactatacgagttgtaatgtctattcttataattctaagaccaatatgaccaaaaatctattgctaaaagatagtgtagcccaaatcgtcacacttttagagagttcaagagggttaattgtacaatcaattcttctacaaagtgcataattgctccataggtaatatgactgtgatgctttctaggccaacaaatttagttgttgcttctagcaatagtcattatatttccagttttatgcttctggaaatacctttttatcttaaagtgctatttgtggttatgcgttccacaattcattccttttttttatgtttgagtgctacacaaaattcaaagcattataaccatgtgctagaaaatagcaacaaaatagtaaataccttaaatatgctaatttatactagaaataaccgttcgttgtagggaaaagtgtatgctctacttggataaaaccatttattcaattcaatattctactaaaaaattacaacaaatgatgacaaagtagattgattcaacaaagtattccgatacgtcgcatttaattaacttcatagcgagcttcttgcttggcaactatggcaaagattttctattctgatataaatttttaggacgtatgcggtctagtatgagagattctacatccttagccatgcaaatagggtaggagttatccccctcaattcatgatgggtatgctattaggatcatcattttctttttgtattcatgagtacatggttgtggattgttcaccttgaactatgtaatactcccacttttccttttctttcgttgaggtaaatacactaggtggtttgggaagacaatactcttctagtaaacactatcctatatgttacacaattttattatcaactagctaggcatacttcttgcatgcgtactaatga

SEQ ID NO: 27621 - DNA, 218 bp, Oryza sativa
agcaccacatccagattcaaaaacttcaaactatctgtcgtctttataatcaaagaatttacattctttagttttcaatttcagttgaataaaaatataaatgcagaatagtttataaggaaaaggccaggggaacaaaaaaatagtgattgcaaaagtaaaataaaacggcatcaatgcttccctcttccggatccacggacgacacactatacagg

SEQ ID NO: 27622 - DNA, 425 bp, Oryza sativa
caaactcttcttctgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagagggtttattgcgtcagcgggctagggtttggtggaccgggcgcacgggcggcggttcacacgaacggacggccgagatcgaaccaatccaaaatggacggccgagatcgatcgggtccacggcggctcacggcggacgaccccga

SEQ ID NO: 27623 - DNA, 688 bp, Oryza sativa
tcggaatttttgtccacattttggaagttttatcccaggggtattttggtcatttggacaaaattgtacagtactaacggagactaactggacggcgatggtaaatcatagaagttaagtaaaagtcgatggtatattatagaacgtgacaaagacagtggtaaatcgtagagctatgacaaactcagtggcatataatggattgtctcattaacctaagttgctaggctctgaaggataagtctaaccaagaaactaggttatgttttgcaatactacaataagtttataccttaccaaattttcccctttttaatacgacacaaaaaaaaaagcaaattcgagttatcacttccctaccaacactagatttagacttccctgacggattcggtgataaagagggaatccatcattgatccttgacgacttcacaaaaaaatcgtcctaaacttcacactcggccgatcctagcaacgaccagaggtcttggtcatcacggccacaaatgggctcatcacaaacacatataagaaataactccgtactccatcttttacatcattgacttgctaacatcatggtataagttcacatcattggcttgctaaaatgatggtataagtgcaatactaggttaaaatataataacattttggcctttgcattgctgacaacattagcagga

SEQ ID NO: 27624 - DNA, 1501 bp, Oryza sativa
gacctggaaggacttgaacagcaggagcgccgtgccgagcgcgcccgtgtagagcgtgtagtccgtcacctgtcgccgcgccctgtccacgtctcctccatgacctgcggggggggcagggagcggtcgggggaaatcagccgaacaccttgcgtgcgtgcgcgcgcgcgccacccaaacccaaacccaaacccaaaccgaggcacacgcatgcctaaccttgtccttgatccggagcgcggcgcggaggagcctttcggagaggctggagtaagggagcgacagcaagccgcggccgccgtcgggggcctcggcgacgaagtccgggaggtcgttggggaagtagcggtccgccatgcccgccacgcggtgacgcttggtggcgcgcgaggaggaggacgacgacgtcgacggcaactcgccgcgcgggggggtctcgagcggcggcgacggcgagtctctcctccccttcttgttcccaccaccaccgtttcccatggccgccgcggctggggctttgtataaaaaatgctcgcgaatttgctggagtcgccgcggcgctgggcgatgacacggtggcacgcgcacgtgtactatatgtcagagttgagagctacacgtaacacatggagttcgtagcctcaacggctactgttttcttgtacacttccttttttactaaataattttacgaaaattttaagtttgtcagttggatgataagtttttttttcagaagtcaaaataaagttcaagtatccaaaccccaaatcccaaaaaaacaaatacggctgtgtgcagtgtgcttaccgtgatgaaacttgctggctcgttggattcgatggcggacgctcgaggaatcacggccagatctttgctctagccacactacttactcctcttcaccagcctactccatgactcaagccctgacgaaaggaacaaattaattagaatctggatttgaaggaaaggaaggaacatatggatctaaataagatgaaggggatggagatgatttaggaaaaaaacagattgctccatggcttgagcactcatcagtgaaacagattacttgtgtgatttaaagaaaaaaaagaggatctgaaagggatggagcagaagatgaaaaaagctaatggaataaagaggggaatagttgcctgttgcttggagctgcacgggagaatgaattggagagagaaaagaggaacaagagaggataataaacatgggagcctcggagataccgagcttcgcgcgtttttttccagattgttcgcgccaaaacgtcaaatgtttcgcgctattcacaaaaggattttcacgccgttcttcacgaaggtgagtgtagcgcgctctctctccgcacgcaacagtcgtgccgcaagcgtggcgaataatttgctcgccgcgtctttgcccaaaaaaccaatggcaaagcaactgagttgtggcagactatttgtagcagccaaaaatctggtctctaaacaaacgg

SEQ ID NO: 27625 - DNA, 1501 bp, Oryza sativa
agaaaaaatgactcatgttgaaaatggaagtagtactttctcttaatgaggatgaaagattcatacaatcatacttcctaatatattttctgatgcaatttaggagcaccaagcacatacttaccctgttgcctgacaatctcatttgtgctctcttaatatgctttgcattcataaaccaccaacaaaatgtaaaattatgttatgaactgaactgaaatcatgcatcagcaaaggaatgcttttaattgtacatgttgaaaagtatatagtttaacatgatttacaagttttattacattaaacagcagcaaaagtttcaatatccaattaaaatttcgatttaggaagcaagttgtactttgcagcataactaatattcaaaacatcattcaagaatacccatgttttgctccagagaaggagctgtgatgtagtaatgtctaaccttggagatgggcaactgatatggcagttggttccggcagtggaggtgaagatgctgctctgatcatccctccttgcaggggtgggaatcctttaccataatgtcactaccattatagtcactgacatgggggttctatcctcttattactccacacgtcagtggttgtagtggtagtaccattatggtagaggatgtgaatttttacgtatagggaacttgtccctgaagaacctcgagtatttggtcggtgggtgctcgcactgcccctggcaggccagctatagtaggtgtcgtacgttgctaaacttgtagcatgtgctgtcgcaaccccccgtctccggctgatctcgacggcgcacgtcagtcagcgtatcttagtgcagcgagcgacatttttggttggctgaaagctcaccggcacgttgaagccgtcgatgacgccggggttgcgacttgcgagcgtgtacctggccaacgtcgtgccagtgacagcgtgggccatcgtgttttgggcagtcgccggtgatgcagtggccgcggtcagcgccgttaaagctgcagcccatgctccgccgccgttttggatccgggagaatctagccgctaggattcctatggtgaccttggctgtgttcgagggagaagggattgggaagatacgcaaaacgaggtgagtcattagcgtataattaattgagtattaactattttaaactttaaaaatagattaatatgattttttaaaacaatttttctatagaaaatttttataaaaaacaaaccgtttagtagtttgaaaaaagtgcgtgcggaaaacgagtcagtctcccctttctcctgtcaacgtacgcagcccttgtgaggagaagaagagtaggtggtggcggtgatgccttgtgccgcgcgcaggggaggagacagggggattgcggttcacgcgcgagctatatttgattgggctagatgggcctcgctgatccgctgctaccgcagctgggcttgcccattacgcgttgctatagacgccctttcattttttttattttatta

SEQ ID NO: 27626 - DNA, 1501 bp, Oryza sativa; identical to SEQ ID NO: 25878

SEQ ID NO: 27627 - DNA, 1501 bp, Oryza sativa
aggactttgttggtcttggcattgataaactgagtaggatctgtgtcactgattgggtccaaaaagaattggtgctggttttgcaagctaggaactgcaacttgacgggataggtgctacaatagaatgaagaagagatcagggaagggagcacaaagtggtaaagagacagaaagggcctagccgatggtgcttacctcggggaactcgaccaccggagcgcttgagggattggcagaagacattgccgaagtcgggccgccgccgaaacaagggatcgcctgcagagtcgctgagcgaattactggagtgattgggggaagtttttggccaaggcaattgaagcgggggagacgccgtgaaattttcaaggtggttgacactatttaaaagggcgcgttgacggccgaaacagaaaagaaaccctagatgcaagcggaaacaaaatcgagcacatccgcaacatcgcaaatatcacggacttgaggggcatgtgttaatgatcaaaattggtaaatcaaagattggatccgaagtcagaaccaaagtggatttggtggaaatctgtagcctcagaaacagaacccacatcagctacgggttgcatcggctgctaccaaatcgggcaaggaggagccgatataactgatcccggcaaggcgatcaggagattgttgtctagatcggttcaagtgctacaccagtattgccaagtgtggattgagtccggagaaggcaattgtacctattaattaggatattctaatagtttccttatagatattttcggtaagagtccgcaggacttgttcgtatttttgagttgtaatagagatagagtcgtgttcggcaaggacatatcatgtattttgggtataaatataacccaggaccctgtaaacaaacaacatcagttcgataacactttcggcgcatcgccacccttttttcattgtttcgacgagttcttgctttcgagttgggctgcatagttttcgatctccgacgaaaagtgtggagattatggataccccatacctacacggcatgtatatccgactgggtatggggtgccctgtatagatagaatatctttaaaaggactcgggttaattaccaaacttgtatgtcaaggaaatacccgggatcctagtcggttacgattgtattttatctgtaattatctattccgttagggatatggtttgtactttgtaatacggaccccttcccctatataaggaggggtccgggtgcctctaggggcacgattttctcccagatcatacgatcaataatacactctgcggatcaatccccggacaggagtagggtattacttcttggttaagaaggcctgaacctgtataaaatctcttgtctctgaacccatccacttttccagcttgatagccacccccttttagtattgccgaaatcttgtttcgacagttggcgcgccaggtaggggcagcgtcaagttcttcgccgactagtgtga

SEQ ID NO: 27628 - DNA, 1501 bp, Oryza sativa
ttaaacaagtcgatggcaaccttttgaagatggtagatgcactatgtaatctaattcgaagtcagtatctaaccatgtcgactgttttcgatgatagaggctagccgctgaggttaggtagcaagatcgacctagattacatagcatatatgataactcgacgatttatataaacaggattagagtgtcatgaagatgtaagcactaatcccgagaacgcaagccgctataacaagctttacctttttgtcgaaacaagattttggcaatactaaaagggggtggctatcaagctagaaaagtggatgggttcagagacaagggattttatacaggttcaggccttcttaatcaagaagtaataccctactcctgtccggggattgatccgccgagtgtattattgatcgtatgatctgggagaaaatcgtgcccctagaggcacccggacccctccttatataggggaaggggtccgtattacaaagtacaaaccatatccctaacggaataggtaattacagataaaatacaatcgtaaccgactaggatcccgggtatttccttgacatacaagtttggtaattaacccgagtccttttaaagatattctatctatacatgacaccccatacccagtcggatatacatgccgtgtaggaatggggtatccataatctccacagtagcccctgagacctttacagtcgacggaataatcttctctcataatccgaaaagacaatccgagtgctttagcttcatctgttttgatctcccgagtaatataatcaaagactgtgaagggctgaaaaatagaaaaaatcaggtgcatcgactagatgcacctaattaggtgtagccctcgactatatggttagttgaacaaactaagcatatagtcaaggaataaataatccaaccaaccgagtggtttttgataattgttatcaaccaagtgacttgatatcaatatatagcatatgcagtgtgaatcccccaaataatatgatccaagtgatataccgactgctttgcagaatatgatgcgtgcaacctaaagttgacaacatttttggaaattcacatagcaaaacagctataaagaagagcttgatgttgtgaataaagaaatttccaaagtattgggcatacaccatgagcacacttctttaacagatgtgcttaagtccctaaaagacacatgatttcaccacacctgaaaatatatggcatatgtggtgtaacatccgagtaaataaactcgtaaacgatttaccaaccgcctggaaaatgaccacaatatataatcagccaaagccataatattagttaataaaaatgcacacttacgtggcaaaaagcaatgatattatatccaatcaactgctttataaacccaaacaacaccttgactatataaaaaagtcagtagggcagctatgtaaagctttactgtttgacaccttttaagatgcattgtaccaactcctaaaaagtt

SEQ ID NO: 27629 - DNA, 1501 bp, Oryza sativa
ttcttgtcgtgtgcgttcttcttccgcttctcgggctcagcactgttctgccgtctcgttgttggccatgaatacaccgaaaaagagaggcgtgtagtcgtcctcgtagctgtcgtcgaagttaccgtagtcgtagcgatagccgaagtcgtcgtactcgaggatctccgttggtcgagaactgacgccgggggagctgaggtagcaatccaattcttccgtcgagaccgtcccgagaggctgaaatataacgcctacctccctagaactagattggatcgaagccgaagccggatcccgtctaggtcttcgggtgggagatgccttggtcgtgaagacagcagccagatcatcgggaagtctcatcaggattgggggataggacccatcatcttgatctggtcgtgtccgagtagattggatctcgtacgagtggtttgaagccaactcggcagagatgatcttggggtagacctcggccgagttcggggtaccgaacggggcggagatctgacctcttcccgactggttcgaatccgagtcgaggagagaaatcttgccgaagtcgttggtgatgaagtcgaggctgccgaaccggaacgcctgtccgggagggaagacgaagtcgtcgatgccggagacggaacccatcacactagtcggcgaagaacttgacgctgcccctacctggcgcgccaactgtcgaaacaagatttcggcaatactaaaagggggtggctatcaagctggaaaagtggatgggttcagagacaagagattttatacaggttcaggccttcttaaccaagaagtaataccctactcctgtccggggattgatccgcagagtgtattattgatcgtatgatctgggagaaaatcgtgcccctagaggcacccggacccctccttatataggggaaggggtccgtattacaaagtacaaaccatatccctaacggaatagataattacagataaaatacaatcgtaaccgactaggatcccgggtatttccttgacatacaagtttggtaattaacccgagtccttttaaagatattctatctatacagggcaccccatacccagtcggatatacatgccgtgtaggtatggggtatccataatctccacacttttcgtcggagatcgaaaactatgcagcccaactcgaaagcaagaactcgtcgaaacaatgaaaaaagggtggcgatgcgccgaaagtgttatcgaactgatgttgtttgtttacagggtcctgggttatatttatacccaaaatacatgatatgtccttgccgaacacgactctatctctattacaactcaaaaatacgaacaagtcctgcggactcttaccgaaaatatctataaggaaactattagaatatcctaattaataggtacaattgccttctccggactcaatccacacttggcaatactggtgtagcacttgaaccgatctagacaacaatctcctgatcgccttgccggg

SEQ ID NO: 27630 - DNA, 1030 bp, Oryza sativa
ctgggggcgaaagtgagttaagtccaagctgggggggctatgaggccgcccaagcctctggacacctttcgccacactcacacccttcgccacagtacccgcgaggtacggcgacaagggctgggggcgaaagtatgttaagtccaagctggggggctacgaagccgcccaagcctctggacacctttcgctacacgccacgcccttcgccagagtaccaataaggtacgacgtcaagggctgcgggcgaacaggtttcgcccacccacgcctttcgccatagtgccaataaggtacggcgtcaggggctgcgggcgaagaggtttcgcccacccacgccctttgccatggtaccaataaggtacggtgccaagggctgcgggcgaagaggtttcgccacacccacgcccttcgccatagtaccaataaggtacggcgtcaagggctgtgggcgaagaggtttcgccacacccacgcccttcgccatagtgcccataaggcacggcgtcaagggttacgggcgaagaggtttcgccacatgccaagcccttcgccatagtaccaataaggtacggcatcaagggctgcgggcgaacaggtttcgcccacccacgtctttcgccatagtgccaataaggtacggcgtcaggggcagcgggcgaagaggtttcgcccacccacgcccttcgccatagtgctaatgaggcacggcgtaaagggctgcgggcgaagtggtttcgccacacccacgcccttcgccataatgccaataaggtatggcatcaagggctgtaggcgaacaggtttcgccacacccacgcccttcgccacagtaccagcgagttacggcgacaagggctgggggcgaaaatgagataaggagttgctcccaagagtagccgaaagagatttatcatttttcaagatggtccaaggggccggcaaactcaattggacacctgagtgtcaagccgccttcgatgggctaaggcagtaccttcggcactagtgtaaaaatctgttcggaaaa

SEQ ID NO: 27631 - DNA, 1501 bp, Oryza sativa
ggcacgcttcaagctcagctactagttcggcctccctggtttttagccgatctatgttcacttgagtagagcctagcccgacgatcatctcatcaagcttgacttttttttcattaatgaagagccgattagcttcgattgttgcttccagtttagctctctcgcgcatgtctgctattctttgttgtgccctttccagcttgaaacgatgttgctctagatatacagccagggaaatgatgtcggcttcatcttctgggatctggtggtggatctcttcaaacctggccctgattgacccgcagccagtaaccaaggaatccaaggaactccctagccgttgagcaatatccatgagtttggtcttgagatcatcatcaagagggaccaaggctccactggtggtttcctcttcttcttcatctaggaactgtttaacgtcaaaggaaaacatattggccaagacctggagaaaagataaatcgggattattggcaaagaaaatatcgcagccgatatgagaagatttaatagtactaacaggcacaacaagaggtggatgttctggtgttcccaagtgatgactgtccacagccgacggggtgtgctcactagatgctagccgacgaggagatggagatcgaggaggctgaggcaaaaaggggaggagattaagtttttgtggcaactaataggagtaagaacacaagtttaaggttaccaatggaggcggagtggatttcttcttcttagcagcccttggcttcttcgtctgctggaaaaatggcaataaattcatatgatgcacacttaatcggatgataatgtgaagaaagatgcataccaccacttttaggggccggtgttggagcatctggcgtcttgttgggacttggtgtaccagctggaggtgtcccagctcgacccgtagggcttgcggataaggccctggtgtcactcatgccagcagcagcattatcaatggcctcctctatttcttcattctccaggacctcctctacatcacgatccaaaggaggtagatcatcggcagcaaacttttgcttctttgctacctttttcgaggcggcaggaggtttagcagccgatggcttgacatccgattgcttagtgcttttccttttacaagtttcaactggaatcggttcatgagtttgtccatatagtaaattagttgtcttgggggcaatatagccgatcactgaaggagctagtccaccaccatttgggataatccctgcagcatagttaatcggcttcccactttggctagtgtaaggcagtgaggagtctgtggtctgcgaacaaggaaaagagatcaagtatcgattaaacatttgctcaaggttagaatttttcaaaaagaaaagtgtacctgaggcatcgagtccgggaagattatcgtgaagaacattgaggctgatagatggaataaatgcttcttccactcagcccaccatcgatcgaagagtgtgctcct

SEQ ID NO: 27632 - DNA, 1501 bp, Oryza sativa
actccaactccagcgagcggtctagttatgcacacagctcgtgtgcaagaaccttgtttcttgaaggcatgatccgttggcacaatgcgtaggatgcatctcttttcgagcaaatgtgcaagtgtcaactagagtggggcagcaaacgcaaacgcctagaaatgaagaagaatctcctcctgcttgtatgcccgtatgtgctgcgggagcgagaaattgcgcatggctaggagtggataaaggcttagccaaggcggcacatgagctcaagagagggactgggtgtagatagatatagctcatcagctctcttcctcttctcccatctttttttttctccttccgtctctcatttctcctctttttttttcttttttttcttttttttatcaagctaggactaaccccaacttcaaaccaaggtggccttggttgatggaactcgttatgacaagctcatcgacattcacccccacacttggacttgtgtgtcacaagacatcaaaaaccaagtgtgtaatgttggagtctcctatagagtttgttccaataccaaggatcaccaaagtgtgtaattgatgtagctaccgtgttcttaggcatctgatgactctcgttcttaatctcaacttgcaatgtttagcgaccaagaatacccgaaggtgcatattatcctaaaaattggttcttgcttttattagaagggaaacttaccatagcaatccgggttacctccccacagtgctttgtttatggtcacaagcttgaccatggggacattatgctgcaagattagtgccacaaatacgatatttgtagtatttatgataaatataagcatccacaaccatccttctaaacacgttagaaatgaggaccgaaaggtggagtggtcctcgcacagggaagtggtactaaccaaacaggactctggggattctttatgtgagcatgaatcctgggggattttgaaagagaaactctcatgctcatatgtggaatgttttctctcgtcctccagagtcgatgtctcaagcttatccgcggcctgaaggttttccttctcaagagatgcatcgtgcaagaactgggttatgtcttgatgataaacaagaacaacgttctgagggccagagggacaaggttaggcttgatcgaaggtgataagggtcgttcagtttcatgaagacggacaataggttcagaagaaacaaacgaagatacaaacatcaccccctcgaacggctcatgcttgggatgagcctttgtattgctggaataattcagggtgtttccatgatcttcataaagattatccctgaattagaatggaattttcggaggatgaatttcttcttcttccggctccagcaactggaatgaggattcgacagttgagtcgggttccgactccacgtgcagacgttcctcatgggtaatctcgacctccaggacgacttcgctgcggcagaaagaatcgctctctaagatgagatctagg

SEQ ID NO: 27633 - DNA, 1501 bp, Oryza sativa
cccaaaaacctaacgataaaacgctcgaacacccttatccgattcgagcaaacagtggaaaattccacgcgatgaggtaaagcgtgatttcgacctcgtcactccttcgaaaggtaagaaggacggcggttttcgaacaagttttaccttcgtccaaaaacctaacgataaagcgttcgaacacccttatctgattcgagcaaaaagtggaaaattccacgcaacgaggtaaagcgtgattttaacctcgtcgctccttcgaaaggtaaggaggacggcggttttcgaacaagttttaccttcgtccaaaaacctagcgataaagcgctcgaacactcatatccgattcgagcggaaagtggaaaattccacgcgacgaggtaaagcgtgatttcgacctcgtcgctccttcgaaaggtaaggaggacggcggttttcgaacaagttttaccatcgtccaaaaaccaaaataacgatgaaacactcaaacactcataaccgattcgagcagaaagtggaaattccatgcgacaagataaagtgcgattttgacctcgtcactccttcgaaaggaaagggggacggcggttttcaaaaaccaaagctaaacgctcgaattcttttctgattcgagtctttgcggaataaaaggaaaagaaaaaggaaaaatgacattgagaggagaaggcattcccgtgtaagggacaattgagtagcgccttttccatattctaagttgacgctcagatggtctaaaagtttgccaaaagttaatgctgctcgaagcattattcgaacgccgttttctaaactcgacaacgaagtcacgcaaactaccatctcgatgttctctttgccattggaaaaattttaaagaaaaaatacaagtgtcatcgtaatgtatttccttctcttcatcatcacatttagttgctttagaaaagagcaacttctcgtgtgttcgaaatgcaacgagcttcatgtttcgagttgaatgatacttgttgcgtcgaaccacaacttttcggttcaaataaacctgcttccccgacaaaaacgaaatgatgatgaagcacaggcatacagagaaaatagcaaatggtacccaaccacagaaaatatacataattaagttcccaaccacaataggttcgacggagcaaaagaacaagcgttttcgaccatatccaaaaagttttccaagttagttttccctaaaataacttcacacctgtgaatcagatttgtgagcgtcaccaccgttgtctggttgactcgaagaggattgtgcggtgtgtgagctcgaagccaacgatgcttagagagaagcaagggtatcttcatagcctttctttttccagtaccaaacttgaaaagctttgactacagatcaaactgccgcatggtgttgagcaaactttgacataaatgtgcatattcaatacataaagaatatgtatacatataacaatatatatatatatatatatatatatatata

SEQ ID NO: 27634 - DNA, 1501 bp, Oryza sativa
tacttgacgagggactggagctcgggcttcgagacggggcgttcctcggcgagccaccactgctccaggacgggggccagcgggatgcgcgggtcggcgcccgcgacccgccggaagagggagtcctcgccctgaaggcgcggcggcggcggaggaggaggaggtggaggcgagggggagacggtctcctcggcggacacggagaggccgcggcgacggcggaggaggccgccacggaggtggaggaggagtccccgccggtgcagcagcatggtggtcgccgccggcgatcgcgcggcggcggaggcgagggttttggggggaggaaggagagagtggcccgaaatgagcgtctcgtgatgtgtaaagaatgggctgaagattcgcagaagtagatcagcaaggcccattcaacagtcctgtttcggcccaatatttatgggccatacgtggatcacactagcgttttggcccatattaaatgggcttggaacaggccgcattggatgacaatcccattttggcccaaataaaatgggccaaacgtgaatcgttataacgttccggaccaacttaaagaaacagtacagtttttgcttagacagagccaaacgaacagtacgtacattcttttagctttagattttttttttatcacaatgccactacgaaccatcagaatcaaatgtcattctgccactgaaaagataaaaggtaatttgctgttgtgccactgaatgaacgaccgtgacaactcatccaccatttgcagcagcaatgggttcccaatttcccaaatccattacgcgaccgtggcaatcaggaaggtttacaaaaccgtgcggttatcacacggtaatcttattagtctttaaaataacgctatacctcatggtaaccatacagtttttacaataaccacatggttatcacggtaactgttaaaccgtaaaaccacgtggttatagtggtaaatgccaaaccagtttctacaataaccacgtggttatcgtggtaaatgccaaattgggaagtaatcataaccctttccaaaatggtttgataaacccgatcaggatatagcggccacggaaatgaagggctgataactgcgggcccaccaccggagtccaagaagcgaggatcaccggtgagctcgtttgcctcgaggtgcacgcgcgttttccaccattgctatgcacaagcgtttttgctagtaacaagtacaaaaatactagcagtattcatattaaaaaaaaatcttcatctgatatcagcgctgctgccatttaatttttttctttctaacttagcaaatcgttcagaaaatgatacgtatcatgattctacccagggctcccttcgtcccataaaaaaccaacctagtactagatgtgacacattctaatactacgaatctggacatacatctgtccagattcattgtattagaatgtgtcacatccagtcatatgttcgttttttttttggaacggatgga

SEQ ID NO: 27635 - DNA, 1501 bp, Oryza sativa
ttgcatgagaaccttgcctatagtggcgtatgagtgccaggtcataagatcattgcacgtatcggccttctcgagaaccttttcaatcgcctcaatatcttcagcaaccacatacgctgccactagagtatcagtagtgaacacatcagcaacaataccactctcttccatagtacgatgcatggagtgcaccctctcaacctgcccatcctgcaaataaagcctcatcatcacattgtaagcataagaactggccatccccatgccccgcatcttctcgaagagctcctctgccttctccacgcacttggcctcggcgtagcatttgagcagcgagccatagcactgctgctgcttcagctgatccggcatgctgtcgaagtactccacggccctgtctaggccatggaccttggtgatcagctccagccgatacgcgacgtcgccgggggatagatggaggtgcagccgctcggtcatccacatggaaagctgcaagagaaaagaaaacaaaacaaaatcgaatgatgcggcgacggaagtggtgaacaaggggattcgtagattcgtcgttcgtcccgcacctggagcgcctgagagaagcggcggcggcggcagagatacttgatgatggactggatctcgggcttcgcgatagggcgttcctcggcgaggcaccactgctccaggacgggggaaagcgggaggcgcgggtccgcggcggccgcgacccggcggaagagggagtccttcttgcgccgcggcggaggaggcgagggagaggctctctcctcggcggccacggagccctcctgcggtttccccggcgagggcgaggccgtttcctcgtcatccacggagtcctcctgcggttgccgcggcggcggaggaggcggcgacggggagacggattcctcgaccgccactgataggcggcggaggaggccgccgccgccgcggaggaggagaccacggcggtgcagcagcatggtgggggggcggcgtcggcgctccggcgaagtcggggcgagggttttgggaggggagaggggaaggaaatcgcaaaaaaaataataaaataaaaaaaatgaaagggcgtctatagcaacgcgtaatgggcaagcccagctgcggtagcagcggatcagcgaggcccatctagcccaatcaaatatagctcgcgcgtgaaccgcaatccccctgtctcctcccctgcgcgcggcacaaggcatcaccgccaccacctactcttcttctcctcacaagggctgcgtacgttgacaggagaaaggggagactgactcgttttccgcacgcacttttttcaaactactaaacggtttgttttttataaaaattttctatagaaaaattgttttaaaaaatcatattaatctatttttaaagtttaaaatagttaatactcaattaattatacgctaatgactcacctcgttttgcgtatcttcccaatcccttctccctcgaacacagccaaggt

SEQ ID NO: 27636 - DNA, 1501 bp, Oryza sativa
gttatgaaattagttttttcatccgtgtctaaaaaccacttacgatatctggtcaaacgttcgatgtgacacgcaaaagttttttagggccttattcttccaaattccctttcttcgtctctccacaaggatttagggcatcatcgattgcctatatttcctaatacgacaaaacgatttattaggaaataaaaattgatttatagataaaatttttatatgtttattcgtatcgacttaaaagtcgacgctaaaaagaaattatgctgaaaatatcttaaaatcaactctaaaattcagttgaaaattcaaattttaatatgtgcttttattaagtcaaccaatgaagctcctattaggtaataagagcttgagcctctgatactcacggtgatctgcccctgatggtgacgactaggtgactgcgtggctgcattgcttgattgcctgtctccaacttctgtggtgttgtttatagtctggcggcaagcacagtcagtgactactccttccatctcataaaaaaaattcaatcctgagaatgtatttggacatacacgttgttcagatacatccctaggattagttttttttttctgacagagtatgtgacaatgttattatcaaatgagggacaattaccaggccttgggaattaccatccttccagttccagggaggtgaaaaacatggtcatgaatgcgcacacaggccgactccactgatcgacatgttttttagtattagaaggcgtggagaaatggcacacgatggaagaacagatttgtccttgaattcatcttcctctttcagggtgataagcagaggactccacagtagacaccaagcactagataatgaacaaaaatgctatgaaaatgactcatttcgaatcaaaacttgcagttgctgttaaaacacttctgaacaactttattacaagttcgcatgttcaaaattgattggcagccccctgtcgcactgggttgacaggcgacactacaattcaggttcatgcatctgactaaagtaagatgaccatctacactttgggaagttgttagtgtaatcttttgcttttgggaagttgctccggtgacaatttccattacttcgacagcttctcgttgaagttataactttgtatatttgtatatattcttcaatcctaagtaaatttggttggcctttcttggccggcccggcaaaaagatgaccatctacacatagtacaccattacaccaagtcaccaacagatgagagaaccacttcgatggagaagaccctgtagtagcagaaggtttttctctacaactttaaaaacggagtcatatcctccatttgttcccttcccaccgtagaaggtctgcttcatgtgtgcgtagcaatcgatccagtaatttattctcaatccacccacccagctgatccccaattatatggttctggctcgttgcaaagcacggcatattactgtagtaacaacagttataacagtta

SEQ ID NO: 27637 - DNA, 1501 bp, Oryza sativa
gcacagactgatcctcttggctcggcgtggggattcttttctttaagcaatttaacattattgtcctaacaatatacacaatattggtttttctttcagtatcaaataattcttttacttttgaaaacacatttgcaatgtgttggaaacacaattatatcttgcacttccttttggaaatttaatcatttgaaaactgattcgcatttcatggctgtaatcttctcttgcgaacatcgctctttctttgatggttctctgttgagaagaagagcaaccaagtaaattttcgaaatgtttttttgttctttctattcaccattgcaggttgtcaaagccatcgagaaggccataccgattccgagagcgcaacccattgccttggatggcccagcaagggaagagctgaaggccatggaggcgcagaaggtcgagatcgaccgcaccgcggcgctccaggtgcgccgtgagctttggctggggctggcatacctcgtcgtccagactgccggcttcatgaggctcacattctgggagctctcatgggatgtcatggaacccatctgcttctatgtgacctccatgtacttcatggccggctacaccttcttcctccggaccaagaaggagccctccttcgagggcttcttcgagagccggtttgcggcgaagcagaagcggttgatgcacgcccgggatttcgatctccgccggtatgacgagctccggcgagcctgtggcctgccggtggttcggactccgacgagcccctgcagaccgtcgtcgtcgtcgtcgtcttcgacgcaggagagccattgccattcttactgccattgccaatgatctttgtgctgttctgttctattgtcagaatttttttcatgcccagtttatgggggttaagctagcttctccattgtatcgttctgatgtgcggatgatgcgatgcaaagcatagtttgttgaagagatgacaaggcagattttagcttgaaaacctggaggtgagaaaaaaaaatcctgatgtgtgtgtgtgtgagagtgattgcagatgactgaaagccaccactagtagacttcattttaggttgtacaaatttgacagcgaaaaacatattgctccagcaaaggggcttttaactatttgccacttttagatttgataaataactatttaccatccctatctcaatgatatgtgggtccacatatgtctatgacatgtgagttcagtgacaaaaagttaattgccacatctaaatatggtaaatggttaaatatctctcgagcggagcatgggtcaacaacgaaatcgtcgaagagatttttcattggaacgatgtgagcgtgctctttacggcatcattacccttccttggcccctgcctatgaaatttctttaccccattacgatccaactggactggcattcattcacattttcctttcgaggtttctgaaaaatccacttgatcttttctttttttttcttcttcgtaga

SEQ ID NO: 27638 - DNA, 1501 bp, Oryza sativa
aattttattcgttttttgaaattacatatttgtatttgagtcgaatattaagtttgttcgttttttgaaatatagattgagtcgtatgagaaatctctttagaaaaactctcatactaacttataaaaacaatatctaaacaaatttatacagtgaattttactttagctaaaccgtataaaaaataagattaaaataacatttacctattacaacgcgcgagactttttttttctagtatctctctatatataaatcaatataatgtttttgatgtgaagttttgattcatgcaatcgcgcgtccggatgtttttggatttgtatatgcgtaaggtgtgctcatgctcaaatctttttttttgttggacttttcttcttcatcgtgtagttgtgtcatgtggggctgaggctcttcatgcgccctgcaagaagcaacataattttacgaaatattccctacacttcatcgtcatcgggagctggtgatccaatccatacttatctaagtgcatatatttttaatccaaagcttcttttggactatgtaggatatgtattaatatgtatatgcttttcacttttttttaagctcacggccttttgctacgtacctacccacttattagaacccgtttaaaacgaggacggattaatttcaacattttccgaaaaccgaactgtttttcttacaaatgccttatttggaacgaaataatttagtgaacaatttggagaaaactatcacggataactagttcaatcatacattttgaaaaattatagcatttgaaataaaactaaaattcatttaaacatgaatagtgtgaaactcctatgttcaaatcgaccttaccgtcaataaacaaggatgtaatgataaacacaaaccattttcatctagaaaaaaggataaacacaaattctgacacgtgtgaatgtggggatgctcgtacaaatgacgattacctcacctcggctcaatagtgacattttttttagaaaaaaaaaccaagcacatatccatgaggaaatttcttatttccaagtggaaacataccaaaaaaaaatcagtaatcatataggagtactagaccaacaaaaacacgatgccaaaacgtaccgcaataatacaagtcatgtataactggcagaacaagcaagaaacacgttccgctccggcctatctggaatgtactacgactaccaaatttcattcaaagcaagtaatcaatacaagaaaaataggtgttataatcccctagtaatactcaattaaaggctttcaaaaattgctggctacaatggagtataacacatgacttccccatgtttcctgtgtcaaaatatcaccgtacgaacttcgacgaattgagcgagatgttgggcttgttcacttccttgctgaaaaccttactaaaatttagcaacattttagtgttaccagatttagtcatgttggaccctttggtttaaagccttacgcaaatttgaaaaagctt

SEQ ID NO: 27639 - DNA, 1501 bp, Oryza sativa
agtctcggatggagcattattgttggtgtcttggtgaaggaaacggcacggaagtgatggggaggaagtgcctttgtcaggagaccaacaggctgtggttagctaactcgttgcatatgcaatgcacccaagctaactgctcagaggattcccggcctgcagacctcttcataagagcaagtacaaaagcaggctataagtcagctacaaatatattttaagaagttaaatgaggagagagaagagcagcgggctacagatttataaacagctgtagcacggactccaagacgcggggtgtgtatgacaggtgggaccagatattaatagtgtaatatgtaactattgtatgaatgatctattagattgactatagaagaattggagctagtagttggctatactattgaacttgctctaagcagtaagcaacaacgttgcgttttgtaagggcattaacagtggacggaggccaccctgacgaccggtccgagaggagaggtaatataatgtgatatataggttgaggcttacctcctctcccacaataaggtgtggctttaatttttctaatcaacccttatcgttttttattttagtcctcatatttaagaaaactcacatctaagtccaaaattttgcattagacaccctaaaattttgaaatgagtataaaatctactccattaattgattgcttgatcccattccgccgttgcccctgcccaccttctctagtgatttatccggccaccgccctctctagcatcctcccacgctgttgtgtcctctcctccctttccatcatgtcatcctctctgctatcgtaccctcctcgttgcaggatggagcgaggagcttgacagggtggtctacgcatgaagaatgagcatggtagcagtagacctctctaccgtcctccctcgttggcgagcgcatattgagatggcgacgagtaggttgaggcgacatcgtttggtaaatcgagttgtcagtttgtcactagactgtaggtcctcgcacagagctggtgggggctctagttgacgaggtccatgatgcgagaagattattgagttatccatggtgaggcttgttatgatgttactactagaggcatcctagtatagttgaggacacaaaacttctgtgcaagtacaactggcacttaaaagaccttccatgtagatgagtttcgcagtggcaacataactactagaacttcccctcttctccaaccaccaccgcctccatgctcaggatctcaatgtcgagcccatccctttctaaatgcgcgtgaacggggatgcgcgttgaggatattcatgctctcaacatgtctcgtgaggtgtggctccgcaacaagtggccttgccctaaccaggctatcgtgcccattgcaaggcggtacggtacaaacattgcgagagcacatgaccaatcaatgtggagcagcggcaaggacgtggcgcattgagggtgctcgccacttcttctcact

SEQ ID NO: 27640 - DNA, 378 bp, Oryza sativa
taagaaaattgaaacaaactatcaaatcgagcagtgtaaagtgtaaacaaagcaacgtatgagagagagaaaggggggagggcacctgcaaagaaggacatgatcggtggtacaaaagaggagagggaagggttgagggcagatgcacaccttaaaagaaatccaagaagtttggcctctcaccttaaccgtcaattacaggaattaaaaaacggattagcagtaaaatactcaccagggagccacagcctatgggagtgaggagctccctggtgtactgctggccaggtaagggaaccgacgcacggggagggagtgagggagggagggagggagttgagcgggtggaggggaagcagcgcaggggaaggggaacca

SEQ ID NO: 27641 - DNA, 322 bp, Oryza sativa
agcggcactagggaatgtgataacgctgttggtctgcaaggtacatgctaatgcagattgagatctgcattattccatcaaaggggtgtcgaatctttaagaggcaagagcaaactggaattgagaaatgaacaacagtgatactaacagtagtaggatgcatccatctgatagctgatagccaagaggaaggataggtcccattaagcttgttgactcaagagggtggaacattggtttgccaagctagtctgggtagcagccagcaagaaagccttggtcagcaccatcagagttgtcacggccaatctctcatgaagaa

SEQ ID NO: 27642 - DNA, 1501 bp, Oryza sativa
gtgtcataacctgttagccgtccattaatcttctagtattattctaatgtgataaagatgtagcttatgtattcaacagatattaaaaaaaaagggcttctttactcatgatagtgttgattacttgatttccaactagtaaagtgaacggtagcagcaatagaagcaagcatgtaagaatgtcaaaaagtaagaacagaagtaagaatttgattctgaaaagtctgcaacactgctaattatctatgctcctaggtccttgaattcactcttaagaatttccaattaattcacattttatggttgtctattctctaacttcaggtgattctcatttgctgaaccaaaactagaaattcttccaaagcaacttttaccaaatagtaagccaataacaaggacaccactatgagctatcctgcgttataaaccagaaggagctgatctaaaaataacatacaattctagcaaatgcacagaaaaggttatggagcaaaaagggaaccacctagtagcacaaaattgtttgatatgtaactaactttcagttttggccctcaaatttgttgggaggtatcacaaagttaaaaggtactacatcaatactccaccaccactggcatgtgatggggaatgcaatggcatcttagatactgaatcctctgccatgcaattcaaacatcatttttatactatcagttgtgcagcccatgccctgtaagagagaccaaatatgtctccaattgttgtcctcatgacatggcatttaaattgcatggtagaaaatccaatagaatactaactatgaacatttccataaatgatataatatcagggaacataaaagttttgagtatgtgctggatgatgactattaatatgcatccttcctccaaaaattttggctgccacaggttaattctcctcatgttcattcatcggagatcaagattaaaattatcactaatgtcaattaagttctctccttttctttcttgctccctcaggtataagatttgaggggctaaagaatagtttttttttttagttttgtttttagtcgatctggttttgtgagaagaaaagacactcccatgtcggacggagtaaaaatccccaaactttgtgtgtcaacaactgctcttactaccgtttaagaacagcgccctttctttcattcttttcctgttgggaaacatacaaagaaacacgcggaaaatctcatcagatctcgacacttctgaattctcaacccggtcacccggaaacaaaaaaaaaagaaaaaaaataactgcaaggagagagaaaagatacgagaaaccagcgtgtatttctctcatgacatgctaactgcaaaatcaaaaaaaaaaaaactagaacaaaattgggagaagagacggatcaagcaagcggcattaaattaaggtggtggatttgaagctgatgagatgggggggtggatcgtaccatctcgggcctgaggaagacggtcttgccgagg

SEQ ID NO: 27643 - DNA, 979 bp, Oryza sativa
gttgattaaacttctgattaattaatctactgttttactactcttaactctttgctaaatgctgctttcgcaaatgagcctatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctatgggagtggagctgaagccatcgctagaccgttaattccgctgctgtttttcttttcttttgtaagtatgtaacgttattattatgatggatttgtatattaaattgtcagtttgtgtacctcggctgattcctggacgaggatttcatgcacaaattagttcggaaattattagtgaatttccgggcgtgacaagttggtatcagagccatctcgactgtaggataagccaaatggtcaaaccttaaggactatttttccgaaaacataatttgtgaaaattttcctttcttccttatctagaactctttgcaaattgtttcattgtctactctcttctctcgttcaacttgagtagttctgaaactagtggttgaaacttgaagacaccaatgaggtctacttaaggaggttaagtaaagtggatcgaggaagaactgaagtgccaagtggtcaagatggaatgaagtttggatcctgtcttagcacctataccgccaaagtaattttgaagaatagttagtagggtagaacgtttgttgtttgctttgtgtgtaggtatggttgcattcccatcattggagaagttcattgatgagtgtgtgactatactaggttgcttgcttaatcaacttgaacaatataatggtctacacacatcagatcagtgttaacctggttaaggtcttatctttagtgtaacccctctccttctatcctttctaatctgcaacaga

SEQ ID NO: 27644 - DNA, 611 bp, Oryza sativa
caactggggtataaagcaaacgtcttctccttctggatcctttatcttcaactgaggtttgatgattattgcaagaatgagcatatgacatactcaacaagccacacagcaaatatgcaagtgcacaaggattccaaaggatggcataatataggctcatttgcgaaagcagcatttagcaaagagttaagagtagtaaaacagtagattaattaatcagaagttttaatcaacactgaacagcacacccatgctgtacaggcccaaccatcctgaacaaccatacccggctgaacagatctaactccaaaccaggagctaagcaaattattaccagttattacatccataattattgtgaaaggtgtgagactaatcacgaaaaacattgctcaacccgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatcaaccccttataaacaaggca

SEQ ID NO: 27645 - DNA, 1501 bp, Oryza sativa
tcggtgcctagagggaaagggtttttgaactttttcaattaaaaaataattcgtgaaatgatgtttcatttattaaaaatacttcccttgctcaaacaattcccagaaaattctagaaaatagaggaacaagcaaagtatttaataaaattttatctaacccaattttatattgagatttagcacattaaaattagatcttctcttttaagcttttaaaatcatttctaataattccttttaaacaacaatttataatttaaggattttaaacaagaaaagcacttaacaattataattagatcattattgatcaaataattactgaactgttctctgtatcatttacatttaggaattgagctccgaaaaatccgagaaaattccagagagtataattaaccatggagaatttaataaaaattaaatccacccatgctttatatttaggaaattttatttcccacatttaacttcacttgtaaattaatgaacatttcatataaattctattaataatttattaaataatttataaatcctaacacgaaaatcagggtgtgacaaatctaccccccttacaaagaatctcgtcccgagattcggaacggctagaaagaaaaaggaaataggtaaactgcagtctatcttattccataactccgataattattctgaggctttaaagaaaactactgccgctttgaaactggtggctgagttgtaacacttgaagacacaactcttgaagacgcaactggcactgcattggctcctgtgacgacaatgttgttgacttgaccttgcggctgctgacgcttcggcttcggacactctcttgcaaagtgacctggcttgtaacatttgaaacacacccgctgttcccttgctggttctgcatttgttgcactaacatgttgatcaattgggtctgttgagccagcacttgagcaagggttgggttctcttcattgttattgtttccacttccactagcgtgagtgttcaccatctgttgcagattagaaaggatagaaggagaggggttacactaaagataagaccttaaccaggttaacactgatctgatgtgtgtagaccattatattgttcaagttgattaagcaagcaacctagtatagtcacacactcatcaatgaacttctccaatgatgggaatgcaaccatacctacacacaaagcaaacaacaaacgttctaccctactaactattcttcaaaattactttggcggtataggtgctaagacaggatccaaacttcattccatcttgaccacttggcacttcagttcttcctcgatccactttacttaacctccttaagtagacctcattggtgtcttcaagtttcaaccactagtttcagaactactcaagttgaacgagagaagagagtagacaatgaaacaatttgcaaagagttctagataaggaagaaaggaaaattttcacaaattatgttttcggaaaaatagtcctt

SEQ ID NO: 27646 - DNA, 1501 bp, Oryza sativa
tcttacatggtctttcgtctctacaggatccgacaaggccttatcggctctaggcgtccccagccgaagatcccttaggttcctcggaggccttgtcaagacggcgtaaagggacagtaggataggtttcagcgctaggtgtcatctgggtaagggatctctgggtaaaacccttggcgatcttgtgtacctgacatcaactttgttgaagtaggggtaatgggagaatcgctacatcgctggtcgaggactaggcagtagtcgtaactcgaccacttgaagtggaaatagtgggagaaacgctacatcgctagtcgaggaccaggcagtagtcataactcgaccacttaaagtggaagtagccggagaaacgctacatcgctggtcggggaccaggcagtagtcgtaactcgaccactgaaagtagaagtagtgggagaaacgctacgccgctggtcgaggaccaggcagtagtcgtaactcgaccacttaaagtgaggcgagagagatcattacattttactggttcgagaaccaggagtaggagtctcttaattacctataggggcgttaaagttggtttattatatgtgcatattatgtggccagcatgactcacatacccaacttatagcatatccggatgtccgttcgcaatcatgtcgggtgatcaagccgacggcgttagcgaggaattatccgttaacaaacttttctcgagtagtccagcgatggccggagctatgagataggtcgtcggtcttcgttggtaggttgggcgcgacgactctgcatttgtcgagatcgttctcgataatgcggtgtactcgactacaacctactcgagtgctcaattgtttctgaaaattattttctagaagacaagatatatagcaggggatatcgagtatgtactcaaaaactgcgtggatcttctagtattatcaggatataacgagcagattaaatatcaggcattatgtaacccgtaaacaagcatgatttatacagaagagaacagagcgagcccccagcgttagaccgtagttggtttaacgtcggaaacatccgcgcaatagatattgtataaaaaacatgctctaggtaaacataataaattatagatctgacaatattgtatgatctgaataggtacgataaattgcatataaaatattgcgtacctttgtagatacatgccggctgtatctacgaaattagtagatcaatttgaaaaaccaatctaccaattaccttattgtgtactcgttggacataatatgatctgacatattttggtacgccgcgtatcttgaggcttggatgatctcgatagaccaagttgtcgatgacgatgatggttccgatctggtcggaagatgtacttcagttgggttagatctcctcacagccgaagtcatcgagtagcttgttgtcggagagtccatatcttaaacgcatctcgtcgaaatcctgaagcaccaaaatccccctacctgtc

SEQ ID NO: 27647 - DNA, 1501 bp, Oryza sativa
ggtgaccgggaggtcgatatgacctagcggccaagtgtgcccctgcgtcacacctacaatcggctgggacggccgaagcaccatccccggggccttgatggcgtcaaaggctgcgggggaaaggatgttgagggctgcacccccatctatgaggacacgccccaacttcacgttgctaacggtgggggaaaccaccatcgcgatctgtcctccccgggcaacgcacggcgggtggttggtctggtcgaaggtgagggcaacctccgaccaccgcgcccgccgcgtcgcctcatgggtaggggccgcggccagaagctctcgcttcatggccttgaggctccgacgagaagcgtgagcgcatgctcccccatcgacggtggcgatggtggccccaggctcctggaaccctaggtcatcgtcgccatcgtcgatgtcctcggcgggggccttctgcttggcctcactttgccggttgccggagggagccgccggggccttgccctcacggcgctcctgcctcctctcctcctcccacttcctcgtccactcagccaaacttttgaccgcgcggcagtccgcgaggtcgtggagggaggtgttgtgcacggtgcaccacttgccggtcgggcgctccctgctgggagcgccggcctccttctttttgtcgctcgcaggccttccctttcaggtggcccgcgaagcgccctcgacggcgaggacgtgaccctcgtcgtcggaatgggccgacctcttcttcctcctcctgtcccgccgccctgaccgagcggcggatccgggggcggccgaagctgccacaccggaaccggtggagttccaggtccaggcctctttcttgcgagccacacggtccgcgagctgaaaaagctccgcggtggtctggggctccttggaggcgatcttttcgagcatgcggttgtgccgcacgccccccctgaacgcgtagattaccgcgtgtgcggggatgcatggtatggtgttccggacttgacagaaccgctgaatgtacgagcgaagagactcatcgtcccttcgctgtaccgcatgcaagtccgcttcttcacctgggcgcggatatgtgccttggaagttcatggtgaactgctagcacaaatcctcccaagagtggaccgacgcgggcggcaagttcattagccaaccccgcgcctgtcctttcagggccatggggaagaaattcgccatgaccctgtcgtcacccccggcggcctcgatcccggtcatgtagacctggagaaactcggcggggttgacgcttccgtcatatttttcggtgatggtgggccggaaccttgggggccaacggacgttccgaaggctcgccacaaaggctcgacagccgacaccaccaatcgggggcacggggggctggcccccgcgcccgaaccgaagtggcgctccggacgaggaagcgccttccgttgcgtgggaagcgtgacgaccattgcgccagcgctcgatactg

SEQ ID NO: 27648 - DNA, 1501 bp, Oryza sativa
cattactgccacttttaacattaccaatttttgagtaacaaactaaacataattaaatattggtgattctgggtttttcctcttcccaaaagctttttcaaatttgcgtaaggctttaaaccaaagggtccaacatgactaaatctggtaacactaaaatgttgctaaattttagtaaggttttcagcaaggaagtgaacaagcccaacatctcgctcaattcgtcgaagttcgtacggtgatattttgacacaggaaacatggggaagtcatgtgttatactccattgtagccagcaatttttgaaagcctttaattgagtattactaggggattataacacctatttttcttgtattgattacttgctttgaatgaaatttggtagtcgtagtacattccagataggccggagcggaacgtgtttcttgcttgttctgccagttatacatgacttgtattattgcggtacgttttggcatcgtgtttttgttggtctagtactcctatatgattactgatttttttttggtatgtttccacttggaaataagaaatttcctcatggatatgtgcttggtttttttttctaaaaaaaatgtcactattgagccgaggtgaggtaatcgtcatttgtacgagcatccccacattcacacgtgtcagaatttgtgtttatccttttttctagatgaaaatggtttgtgtttatcattacatccttgtttattgacggtaaggtcgatttgaacataggagtttcacactattcatgtttaaatgaattttagttttatttcaaatgctataatttttcaaaatgtatgattgaactagttatccgtgatagttttctccaaattgttcactaaattatttcgttccaaataaggcatttgtaagaaaaacagttcggttttcggaaaatgttgaaattaatccgtcctcgttttaaacgggttctaataagtgggtaggtacgtagcaaaaggccgtgagcttaaaaaaaagtgaaaagcatatacatattaatacatatcctacatagtccaaaagaagctttggattaaaaatatatgcacttagataagtatggattggatcaccagctcccgatgacgatgaagtgtagggaatatttcgtaaaattatgttgcttcttgcagggcgcatgaagagcctcagccccacatgacacaactacacgatgaagaagaaaagtccaacaaaaaaaaagatttgagcatgagcacaccttacgcatatacaaatccaaaaacatccggacgcgcgattgcatgaatcaaaacttcacatcaaaaacattatattgatttatatatagagagatactagaaaaaaaaagtctcgcgcgttgtaataggtaaatgttattttaatcttattttttatacggtttagctaaagtaaaattcactgtataaatttgtttagatattgtttttataagttagtatgagagtttttctaaagagatttc

SEQ ID NO: 27649 - DNA, 1501 bp, Oryza sativa
gtacctacatccttaggctctgttcttttggttgagttgggaactcatccctccggtacggaaaacgaagcagtccattagcacgtgattaattaattatttgctaatttttttttcaaaaatggatcaatataatttttttaagcaactttcgtatataaactttttgcaaaaaacacaccgtttagcagtttgaaaagcgtgcgcgcggaaaatgagatgggggagttgggaactccagcaaacgaacagagccttagagcacatacagtgagaagaagtggcgagcaccctcaatgcgccacgtccttgccgctgctccacattgattggtcatgtgctctcgcaatgtttgtaccgtaccgccttgcaatgggcacgatagcctggttagggcaaggccacttgttgcggagccacacctcacgagacatgttgagagcatgaatatcctcaacgcgcatccccgttcacgcgcatttagaaagggatgggctcgacattgagatcctgagcatggaggcggtggtggttggagaagaggggaagttctagtagttatgttgccactgcgaaactcatctacatggaaggtcttttaagtgccagttgtacttgcacagaagttttgtgtcctcaactatactaggatgcctctagtagtaacatcataacaagcctcaccatggataactcaataatcttctcgcatcatggacctcgtcaactagagcccccaccagctctgtgcgaggacctacagtctagtgacaaactgacaactcgatttaccaaacgatgtcgcctcaacctactcgtcgccatctcaatatgcgctcgccaacgagggaggacggtagagaggtctactgctaccatgctcattcttcatgcgtagaccaccctgtcaagctcctcgctccatcctgcaacgaggagggtacgatagcagagaggatgacatgatggaaagggaggagaggacacaacagcgtgggaggatgctagagagggcggtggccggataaatcactagagaaggtgggcaggggcaacggcggaatgggatcaagcaatcaattaatggagtagattttatactcatttcaaaattttagggtgtctaatgcaaaattttggacttagatgtgagttttcttaaatatgaggactaaaataaaaaacgataagggttgattagaaaaattaaagccacaccttattgtgggagaggaggtaagcctcaacctatatatcacattatattacctctcctctcggaccggtcgtcagggtggcctccgtccactgttaatgcccttacaaaacgcaacgttgttgcttactgcttagagcaagttcaatagtatagccaactactagctccaattcttctatagtcaatctaatagatcattcatacaatagttacatattacactattaatatctggtcccacctgtcatacacaccccgcgtcttggagtccgtgctacagct

SEQ ID NO: 27650 - DNA, 1501 bp, Oryza sativa
gccggagtggagagcggagggtgcacgcgcgcgcgcgcgcgcgaggccattcgagaaggaaaaaaacgggaaaaggttgcggaaaagttaaaaaagaagaagaagaagaaaaacgaaggtgttttgttgtgccataccgccatgcatgacagcgtgatgagttttcggggtaccactggagctaaaatgtcgatgggtgtaaaatttcaaatcgagagaaaaacccaaatcttgatggtaccattgtgagtgattttacggtcgttaagaggtgcccgattaaatttgactaacatataatgttatcgaaaatctctctctcaatataatagaagtgatccgaattaaatgtcacgatagattattttttttctgcatttcgcgactaaattcccgacaatatatatggttggagtacacggtaggtgtgatatgctttacacgaatattgataaaaaagagtgataagagaatcggcggtgcaccgtaggtttccaccattttgacgtggaaattctcatatatatatcgtgcacgattaaataataaataatgttgtcggtatcgaggataagctatgacttggcacctatgccacgaaccaaaattaaccgataatttggagaaaatgtatacaacacaagataggtaaggtaggcacataaaacaagataggtaagataggcgtgtgatccataaatatctttgtcatttggcgtaaaaatatcacagcaaacacatatgatgacgcattaaaatctattttttccaagtgaatgtggacacaataatcaagaaaccatgactaaatacttcctttggtgatgctctaaatcgtcatatatatcacataaatcgatgcaaaaacataaatcaacgttatagtcttagaaatcacaaaccattttttctttatgaaagtatgcagtagttcaacagttactcaattctctgttcagcggtaagctagtcacggtaacacgactcatgttttagagatatttaactatttgtcacttttagatgtgacgtttaaaaatttgttattgaacttagacacgtgaggacgcaagataaattattaaagggactatctacaaatcattcgccataaaacgaacccaaacgcagtcggatttttctctactgctaatccatacctaacgatttagtggacctccaactacgtacacccttttacgattaattagggactagtacgtattttattttttaaaccatatgattaataacacataaaaattacaatgtaattattctataactagtaattaatgtaagtggtatgtaaactgtagtgtgagtggtatgtaattacattgtaactgtagtgtaagtggtatgtaattacgttgtaagtgtggtgtaagtggtatgtaagtgatatgtaagtatggcgtaagtattgtaagtacctagtgaatgaattttaacttaattttggcattgaaatcattaatcctactatgctgagttggtt

SEQ ID NO: 27651 - DNA, 1501 bp, Oryza sativa
gggtcggaccccgagatcccctgggaaggaatcatgctacagaataaccctgatcgcgttaacaaagaaaaagaagaggaaggaacaagagaccgagatgagcaaaaagcatcgaagcgggtgccagcagtcgtacctgcggggagggcggttgaaagtccacttcgggggctcgatgaagctcccccgacacggctccgtttgacctatcttccagagtcgcttcttcttccgtccagcctcaggcgcggcggggcgcttgtggcccgccggcggtcggtccgccacgcgctcggcgccccctccgcgcgggggagggggcggtcgcgattcggacatcttccgcttccctttcgggtcgctggccgagtcgaccccgggtccgcggctcgggccgggagccctggagctgccacccccgccggggccactggtccgactcccgcctgcggccgcgccgccgctacccacgccgacaacgccaccatcggcgccgccccggcgggactgacccctgctggcgccgacggccgacatcacagccagaatactctcccggtcgcgatcgctgcagaggggaaggatcccgtctggaatcagtgtttgctcggcagtgtccagacccagcacccgacgaatcaccgtcttcatgtcctcctcgccccaatcccagcgctcgcccacatgcgtgcgcatggggtcattgggtccagtgtactcccacgcgccacgggcttgatcttggaggggcgcgatgcggcggcggaagtagtcgccaaagaccattgcccctgtgaggcccaggcttcgcaggcccctgaggcgatcccgcactgcgtcatactcctcgcctagctccgaaaccgccagccatgcggcggatcgttcgggagggccggtagggagccgaagtcacgggtggtccggcagcgcggtgtagaaccagtccttcttccagtcctcccatttcttgcggagataactctcgatgtattgccccgccgtgcctggccggggctggaagtaacatccccccaccaacgcaccatgcagcagctgtgggacgaagaaagactggaatagccgcatcgtcggccgcaccccgatgaacatctcgcacaaatgcacgaagatggctagcgtcatcacggcgttgggtgcgagatgcaagacatggatttcgtagaaatccaaaacctcatggaagaatccggagaatggcgggatcaaccccgccatagcaaaggacaggaggtgcatggatcgctccgggtaccgcggccgcggccgcgactcccccgttctcacggcggcatcttccggcttgatcttgtgggggagactaaggtgcctatccgccgtaatgcgcgatgccggaagcactgcgtcgccggcatcttgagccatgatgaccagcggagaaacgacgaggggcttggtgtgcggagtagcgtggagaaacttcctttaatgcgcgcagcgccccaactgccccctgttg

SEQ ID NO: 27652 - DNA, 1501 bp, Oryza sativa
tttgggattgcaattgagtgattttgtgattcatgtattttgggaattggggacaaaggtgttgggagcaatcgaccgatttgctcagggattttttttaaagacggatgactcagactcaaacaacaatgacggacgaagcacgtatttttttaagtaggtatatagattttacaagatatttttttgccaggtccgattttttattaagaagaaagggtgcctaaattacaattgtacaacaaacaaggttgttgcggcttcgacactaaacgctttctaatgatagccaggctacagcttcttaattttgcctcgtcaattttctccatccactcatctttgacaagattgacgacagtttccttgacctagaagcaaaacgaacttgtaaaacgaacttgtaagaccaatttgactgggatctttaatcttaaaagctggatgggcatgttcttgcaatcccgtgtccgatgtgatctctgacgataaaaggaagggtgtgtttagttcacctccaactaccctaaattttcaactttccatcacatcacatccaaaactttcctacacacataggctgtgtttagttcacaatgaagtttggaagtttggttaaaattggaactgtcgaggggtgatccactctagcgggagatcgtgagacccccctttcgtgagttcggccgggggaagaagctcgcctatagaaatcacgtatccgtccccaaggctcctagctagctcgtacacaaccaaattatacaggtttgggccgctatcaagcgtaataccctactcctgtgtatgggatttagactgagagttacaagggttcctgatctcgggagaacacttttacttccctcctccacaagctcaggttttctgagagtcgtccactttctcggtgtgcaaggtcctccttttatacctcaaggggataccgcatgcaccgcctctacctactcttctataaggtggggacccaccttatctggactggaactcgacccgtgccttcgcctggaagctaaaccacagcttatccttgagcggggcccagcgccgtccctcgcctgaaacgggggacagccctgtcattccctcattaataggtgaagacttgtggtggccgccgtccgaatgaccccccgatgggacgggtcatacctacctccactccgccggaagcagatgcgacgtgggagcacggttgtccgtccagtcagacgtgaccggcgtcaggccggtcatagacaggtcattcttgaccatcgcgcgtcagtttaacacgccgcacgtctaccccactacattaaatgcaacagggggcagttggggcgctgcgcgcattaaaggaagtttctccacgctactccgcacaccaagcccctcgtcgtttctccgctggtcatcatggctcaagatgccggcgacgcagtgcttccggcatcgcgcattacggcggataggcaccttagtctcccccacaagatca

SEQ ID NO: 27653 - DNA, 333 bp, Oryza sativa
aaggttcactgcaagtaaactgatgtatgtatttttattttcttcaacttgcaggtaaattttaatgattttcacttgagaatatgcttattcggtttgaccccagaactatattatctgtgacagaaatgttaaatttcctttcctgggttttccttttcaaatgagccataagaaacatttttcttttgtcaggtaaccatctgttgacaaattaagtttttttttatcatactatacagtagtatactgtatacacccttgagattggtcaggaattgtgaaaataatgaacttgaaaatcgtgatatttcttggccttctttttataga

SEQ ID NO: 27654 - DNA, 1135 bp, Oryza sativa
tagggttgctaacggcccgagctcaggcaaacctaggtacctaggcccgagcttagcataggtttgagctgagctcaagccgaacttatcatgaccttcatgtaggttcaagctcaagttgggtaaagctcagtcaaactcgagctcggtttacgtgtaggctcatgaataggtagcagaggttttaagcatggtatcttaataaaaaaaatggtttccagctagttaatcaggctaacataaaagaaagaggggctaaggaaatatatcttatcttaactaattaaaaaattcgtaactttctgatcgtcatcttgtttttgtccatgttttcgttcgtcaacatgctaatttttcgtccgtgcatatgagcacatccgatttcgcaaaacaaaaaatcctatctggattgccccagagccccaccaacgcaaataaaaaggataaaatgcattgagaagaggtgacgaactaattcctttgtaaaatccagaagagaaagaagaaccaaaagcaaaattggatatcagcttcaatggcttcatcccaggtcagagaattaattttcgtaattgaaaggtgattgtttataggctaaagcaataagatcttgaattagaactccaacattgtggtatcaaagcttaactttaacctatttaatttcttattcagattattcatgtgattagaagccatcaatgccattttggttcgacatgaacaattttgagtcaaacgagatcaatcggtttcaattttcccaaaatccccaatttgaaagaaccctaagcccccaaatcttaatcaaatccaaatctaattaagaaaattaagtttgagttctgtcatggttatggataccacatacccaatagtaatcgattaatcttggtggggcccaccatatcttatacggaatcatacctcgtatatagaagaaattacggataagtaaggacaagtagagttctctatagaaactacaaggactactcggatcgtatcgatacttgtctctctagttctacttggacaaggggacatttataggtataaatacaagaccccctagaaggagaggggacagaacaacacacagatcgacatacaagtcagaatagacaccaacaca

SEQ ID NO: 27655 - DNA, 1501 bp, Oryza sativa
tcaaaagatctttggattatgagtagtaggagacagttcagaatatgctttgatttgctaagcacagaatgtataggcttcctacattttacaatagctgaatattcaaaattgtgctgtttactcgcttcataagtatgtatgtgcccgttatatcctgtttagttaagctactgcctactggacattgattcatagcgtcagaaggacttgaacttaagcctctgagcatattggtagggggcatgtcaacctgacattgttagctaatcaacagcaccacgtttgaagggtcctaagcttccatgggaccacgactctcaggggacgtccatggaagaataatacaaaacacatcatctagccaatgttagttaatcaatcacattcatgacagagaaggctgcagttgcacatcaccagaatgcagtcacacaaactacatgcacagaccaagaaattctgcgtaccagtcctggtagcatctgaggcacatattatgggtgcagttgggcaacaccactttgctgttcatctccatgcaaatcccgcactcctcttctctctcggcatcaatttcggataagatgtttctttcatcctcatctctccttctgtacctctccatgcacacggccttctgctttttgtcctccgtatcagtaatccccctttgcagttgcagcagagaaggaaatatcacagctgttccagccaaccatataacaattccaatcaataaaacaatgcaatgaggagaatatctgcataattagaccctcggctaaagttacaagaacatgttacattaccgtagaattctttgatgctggctttcctctcatgggtagacattgtcgtcgtcccgtcgacataaacctacacaatgagctacaatttcagtaagaaaaactccgaaacgcaagcaccgaaccgacaaacatacattgtaacatgccattagaccttgtagacgaggatcctcagcaagccgagagccccggcgaggctgcagtcagtccactgcaccaggaagaggaatatatgcgccgcggggctatacgagagccgcatctgcaggcacgcgccatcgtactcccggggaaattcggaggccctgctcatcagaacaccaagaaataaacaagcaattagcatcactgggtggtggatcacatcacatgtggctggataggcaccctgccccccctctctctgaatcacaccactaaaattctcctccacttttccgcagggaatttagaacgctggattgctggaacacatgggagggagtagtgttctttttaatatgctaaatgagcacgcgacaagatcccttcctgatctgccaccgctcgtgcgctcgctagctcgcggataatgtatcgaacaactgaggagacgcggcagaaatcccaccacctcaccagccaacccgcgcggcgcgccgcgccgcggcgtggttcgattacccaccgatcgatctctcacgccgcac

SEQ ID NO: 27656 - DNA, 419 bp, Oryza sativa
gttccataacatatttgcatagttaattgctctgtttctatggtatgctaatgtggcatgtagaagcgtgtcaggctataggtttctttgtttgagaaaacaggaagttaggatttttcattgggtacttgatttcaggctaatgttacaactttccagcaatctggccaatggaaattagattgtgagttaacaatgagtttgtgcgctgcttattaatcgctttggtgacatctagttttttttttttcttaagagatagtcaaacgtccaggaaaatctttatgttggagtacactactcagctggtctcaactaatctctttgtggtgccttttattccctcctctgtaacagtgggtgaaattaatgatgtgttgggtatgcttttgatattttgctttcattatctgcgcagg

SEQ ID NO: 27657 - DNA, 1501 bp, Oryza sativa
tggaaccgctgaagatttttgcagctacgaaattctgaattggaattcttgtctgctacaatcctgctagtggagggttcttttctctgtatgcataaatagcaaggtttcaatcaagagggtttcatgagttcaattatgaatactgttgggtctatactagtttgcctttctccgcactgaagaaatgatagaagtattgttattcaacaaatgcagtatttaattatccaaaaaaaaacattgtggaacaagatcttgttgtataaaatgatattctactggatcatcatatctccaacatattaatactatgtgcatatggtaaacttgaaatgtttgatgaagaaatgctttttgtactaaactgactatttttgacgtaaaaaggtagaggtggctctaccttgtagccatctcattaatggaaattgtggaagacaaggttgcattgtgaacattaggttggaggggaaaaaacaaaaaaaaagggaaaaaataaaaaacattacactgtaaggtgaactgtctaagctgctcgcaccaatttttaatccccaatttggtctcacaactggctcggtggctacaaagatgaagagtaccagatatttgctgctttaggaattaactggatatcgtcatgtacagagttattctagaagaactttgtaaaaaaagaataatactactagatactagtgttcatgaagtgctccagatgtttgacaattggcaacctcaacctgtgctcaactggttttgagattgattctgggactgcagtatcatgatagctaccttgcttaaacatggcagaaagcatgacagcatgatttgctagcttctataatctgggccaatggtttttagcacctggtgctttgagcgacagataataactgtaaatcctatagaacaagggttgttgcaaaggttctgaacttctgatgaaattatcaatggttgtgcaagctccttcggccatgttttgttgggtctggaaagaaaaaagattcttatcgtcatacatatttttctcttttttttgggtaaggaaaaagtattgtgttgaagaatttctaaagctttccctcagcattaggagattgaaaggaatacttttttttgtgaggaaagggatacttatttggtactattgttctagcatggaaccatcccctgaaatttgtttgttaaaatgctaatcctacttctatttttccttggacttttcatgaatttgcagggaacatcttcttggcctgctgcaccgagggagaatgaatattctgccgaagtcataaaacatttacaaatttatttcttgtcaggaagtgctcgtgctcccgccaattgagacctgcctctcgtttgcaaaaacatgctggttgttttggatttggattattatgagttgatctgcaaagattgttttggatttggattattatgagttgatctgcaaagaggcaattcaagagaagcaaaaccgtccaac

SEQ ID NO: 27658 - DNA, 1501 bp, Oryza sativa
gaaaccgaagcaagtggtcaaacggaatggtcaaaaagcgtagcctaaaccgagcagaaacctctttgctgctgcctgtttcgaccaaagtgttgttcagcacatcagcggtggcggctgagcgagccaaccaaacaagacaaaattaaaagtttagtaaaacaaatctgagatctaccataattacaaaatgatcccacatggcggttactcctgttctgtttttttttttaaaaacaaattcggtactagttcatgcatttgcactatttttcaggttccaattgaatctcctctgacctgtgtaccaactctggaggcacaattggatttatcatattgtcaagttacagctagcattggatctatatgttccatacatctattgtgaaatatattcttcccctctgaagcagctagcattgcacccattgcatgatagtgaagaagataatcatacaccattaggtcaaagttcttttagtaagcacaattaacttcccaacgtttttcacaacatcccgttgttaagctggtgacagttgacattcttgctggcaattcgtgctgcacacttcatggcttcttgccttttttttttcctttcaccgtgagtctgtgacttggttgcaaatataatggctcttgtaaacaatggattatggatttatttactgctttagtgcttttaataatcttagtttgtccactaaaaaaatcttagttcgatgatctgtcatcctgtatctcataataacatttttaacccatcccatttattccaaaataaatttatctttaagtaattattgtaccggagtttatgaaactaggggctaaatgtactatgagtatataaaatgaataataattccattggaatttgataaggtaaaaatattttatttttcttggttttacatttgtatatatatatatatatatatataaagagccaaaaaaatcatatctcgaagtggagggcgcttatttaccactgtaagaacaatgccaaaacaaagcaaactgcaaacaacataaccgtctcacggagacacggagttacggttccagctcagatcggcttggcttgagccgattctagaaaccaggcccgagccgcgcgcaaaccagcacagagtaaaaacaacgggtaaccattaaaccaaaccacccgtgtaaccccccacctcccactgccgagtggtccccacaaaaccgggccccacctgtcatcgagccacgcgtgaacccaaccgcgtagcggccacccccaaagcctatatatatgcctcccatcccgctccacggttaaagccaagccaaatcggcggaagcgaaaaaaagcaaaaaaaaaatcccgtctcgtctcgtcttcttcctcctccgcgatttccgttgcaaaaaaaacctcgtctcgtctcgtctctcttcttcctcctcgacatcgtttgtgagggtttcgatctcgaaaccgacaagggttcgccccgcgagtgca

SEQ ID NO: 27659 - DNA, 449 bp, Oryza sativa
gccgccacctccgccgccgatctgacttcaaatttgccgaggatgttcgatctgatgttgcgagcgaacagagccatagctgaaatccggaaggcctttggagtacaagaggcctagcattcgaattgtgtccatggatgcatctgtacatcgttcaaaagtaacattcagatgtactgtgtgtgatgataatagcaaatagatctggtgtcttttccatctgttgatgatcagatcaaggtgtttatgcatttggctcactgtcgcagttgcttggaagtactgaagctgaacagaagacacaactcttcaaactgtaatcttgatgtgtggttagcaactgatgggagtccacactatcagtttttcttgtttgcgatttccttttaaactttctcttcccacatagttaattaattagatggaatttcaataagcagcagcagcaa

SEQ ID NO: 27660 - DNA, 1501 bp, Oryza sativa
tggatagagaggttagttatgtcatcacctgcagcctcctccatcatcagccatgatcatgtggagcagctcaagagcttcttggcttctgttctcatcacacagccccctgagaagaatattgtaggagaagacattggtatgcaaccgagctcgatcattctgcagagcactatgtctattgcgtcgttcgtcctcttgtcggcacagaggcccttgagaagaggattaatggtgatggcttccactctaaatcccttcttgacgacattgcccaaggccgcgaaaccgaggtccaagcggcccgcacggcagcagcagccgatgaggatgccataggtgtgcacggtgggaggagttaccttgccggcgccggctcgggccatgcggttgaagcgggacacagcggccgcggggatgtagcgcgcgacgtcggcgagagcgagcgccgttcaagctgtacatcgaggcgccgctgccttgccggagcaattcgtcgaacacgtggcgtgcgtcctcggcgccaccgccacagactgcaccctccgagcgaggggtcgcgcccacggagcgagggccgccggcggagcgcgctcggctcgagtgggtacgcggcgtgccatggcgcagcctgaaggacatgagtcagcggcagcaaccggcggcagcgctgagtttactcacaccaggaaggagtcggagggaggcaaggaaggaagggaggagctaaccagcgcgcgaaggaatggcgtatgccggtcttgtgttcgcgatggcctccgccgccggcggcgacggcggcggcggcggcgggatgcggtgctgtgtgttttggcttcgcgttttgcgcagagcaatttggatggcaatttcacttgcaaaattatgtttaacggaaaaggttattcttcaaaactttaacctccaatacttcgtaatgcgtaagattacttctcaatccaaatcactgcaactatgtcctgttctaatttgatttgatttgatatttttaagattacactttgatagtggtttcgatatatcgctgaaaaaaaagaaatattttttcttgcagtgaaagcagaggtgcagtgaagtaaccactcctgtcaatggtgattcagcgattcttgcaaaatagtcagtttaaatgttactttgctctgaaaatttagacaaacattcttcctgttacagattgaaaacaggttatcttcatgtttcaatccagctgacacattttttacttgcacaacttcctggttcatagaagtgtatctggcaacgttcaaaacttcaaattatcgaagtactggagtaccttccgttaatttctgggcactgtactttagccatatttgtaatttttcacacaaaagcatccgggaaattaaagattttcttctggttaacttcctaaaagtttgttaaatcgtgcacttgcatacctgcacttattttcattgaagaaacattactgcaactgttatgtacatatagc

SEQ ID NO: 27661 - DNA, 1501 bp, Oryza sativa
aaataaaatgaaatctaaataataaaacttaaataaattgatacctatgaattttgaggcctaaaaatggttgtgattacttggtgttatgagagaagaaagaagagacaatttgaaccataaatctatcatctaatgactagaaataattggggtgatgtggcttaattagagaagagagaaatatcattaactaaactatataagtatataggattcattgaattctacaaatcaacatccaatcattttcctttacattattaataattacatacaaaacttatacaagcatgcaacatctataattcattgaattctacaaatcaggtatccataaccatgacagtaaccccccgacttcaactcaaatgaattcatgttgtcatccgcgttttctctgtcaacgttgtcatgctcacttggtcgttctcgataacaatcgagaagacatggagtactcaacatcattgaaacaagatcaatggtccacaagtgaatttgaattgaagtctaaacaactgccataaacgagcctgaaatcaacgcaaatgaacgagttgatgttctcgaccggagaccttggaacaacagtcgtcgtgatcgcttaaccgttctcagttgatcgagaaggtgcggagtatgtgactacattccttgtcttgtcgtaatcaagaatttgggttgaagtcaagaattttcatctcagcgggtacaccatcgcttcattccgtaatctttgtcgaactccaccaactgttctcgagtaatcgagtagttgtccaatcgttctcgagtaatcgagtagttgtccaaccattctcgagtaatcaagtagttgtggaatctgtgacaaagctctgaaatatgactatcctgaaatcaatactcagacagattgttagatacaaatagccccaagggtaatacaatataatatgaattttaaaattgaaaatatattgaatttgcacatgacaataaaagagtactctcgctaaagcttccatcagcaataggagtctgggactcttcctagcccccagctgtctttatggaaaaatcgtttttccacaaaggcagctaaatcttataacaaaccaagttgaagatgacgaaattctagcatccagccatgaagttgggaaaaccaattctgattacacggcttagttaatacgcattcaaaatagcacaaaggaacgataggatcgacttcaagacagggcgatataagaaaagaggatcaacggacaaatattacatatacaaacacttacagaggttgtcggagaatccatctcttgaacccatcttgtcgaaaccttgtagcaccaaaatccccatacctggcgtgccactgtcgacgtttgagatctcgactacggttattgcatggtatggagactgtcggtaccagggaatatgcgagattgagataaaagagatagatacaaggattttatacaggtttgggcccccttatgtgacaggtaatagc

SEQ ID NO: 27662 - DNA, 1255 bp, Oryza sativa
accaagtggtgtaatttcactctgcaaagtccttatagcacccatgacattgtcatttctcaaaagttcaagaaatttttgttccagtatcagaaatatagcagactttacaatgttttcgtccaaaaggccaaccttcttcaaggtaaccactgcactatcccaattcccatcaagtacctgccttctgaaaagattcactgttggggaatgcagagttattcctgattcttcctcaagaactgctccgcttttttcataaccaaggctatacagagcctttgtgattatcctcacaaattcatccctcttaataacacctttagagccaaccataacttctttcccctgggaaggcaaaggtctagccattgtgcttcccaaaggagcggcaggtttcaagcaagaaaaactatctaacaaacttgctggttctactgaggatgctcttgcgcgtttcgagggtggttcatcgtcttcaaaacctcccatgaaatgttaaaatcagcccatatatatttttgacttctagggagatgatgttatgcagctccgagcggaatgcttgcaatgggtggtgtataacgaaaggacgttgctgcagagaaacagcagttgaaaagtgtaagttctagatgatcaaatgcagagaagggtctatctaagtgatcatcctatctacaatttgcagctaatgcccacccaccaggaaagtttgcatagcaagttacaaacaacaaataaaaccagcaaggcatgtaatgcgtgaaatacaattgaagcccggacttgatcggccttagtgagcaaaaaccgcccaagcgtatcaattagcgtagaaactgaacatcctaacatcacattgaatacgcggtacacccatcatcgccgcctaagcaaagattggatgaagcgatcaagagcggcaagcatggatcccagcatccgtagtctgtcaagacatgaactggagcggctgtggtgtggaatccacggccacagaggcggatcttggcagcggcggcggatccctgcggcgctggtcgatgcagacgaccactgaagcaactgtcggcaacgctagtcccagaagatttggggaaatttggccccaacaatccctatcaaaccttaccccccaaacataaaaaaaagattggcaacacgcatgaaattctgattgatcccaaatcccaccgcgcgatcacaaattcctgcagcgcaaagcaccaatccatccagaatcacgcgccct

SEQ ID NO: 27663 - DNA, 757 bp, Oryza sativa
gagccgattttcccagatgcgacgagttaccgtctgcacgcaatctgaaggtccctgtccaggaaaatcgtttctgtggcagtgaatattgtgtagctgtaagattgttacacgtgcgatcactggatgtatggccatacgatggcatattggcatatatcataatattgcatgtttaacatattcacccattcagttattcagcacaaaagaacctgtggttgttgcctgcagtcggtgatcaagctaagtcgatgatgttcttttgtgctggataggttagcttaattgcgttcatgacacacgagatgcaatattatctggacgatgacaagtagcatcggaacacagagaaagacgagccgtgatggacgaatgtcgcaccgtactttttcaaaaaccctcacattctctaggttgtaggatcacaattacaatggattctagggacctattttcccaactacctgtgcaagccagcaagcaagaattccagcagcctgatgatcaagttaacacagcacatcagctattgtgcacgctataataaaatgcaccattagcagatttatgtttttttggtttccaacaagctagtttaattgggatatatcatagcaacagggttgtaatgtgttactccctccgtcccataatataagagattttaggtggatatgacacattctgtctctgtctatatagattcattgtactaggatgcgtcacatccacctaaaatcccttatattatagg

SEQ ID NO: 27664 - DNA, 1501 bp, Oryza sativa
gagctagtccggtttttggtagtgtctagttcgaacagtgatcagtgtgaagctaagacatgcattactccctcgatgccatgataaatgataacacattacaagcttgttgctatgatatatcccaattaaactagcttgtgggaaaccaaaaaacataaatctgctaatggtgcattttattagagcgcgcacgataggtgatgtgctgtgttgacttgataattaatcaagctgctggaattctcgcttgctggcttgcactggtagttgggaaaataggtccctagaatccgttgtaattgtgatcctacaacctagagaatgtgaataaggtttttgaaaaagcacggtgcgacattcgtccatcacggctcatcttcctctatgttgaatagctaaatgggtgaatatgttaaacatgcaatattaattattaaatatattagattttggagggatgcaacactttccagtactatgattctggataggcttatctctatattcatagattaggaaatatgacatccctctaaaatcccttaattatgggaaggagggagtacattattgtgttggaattaatagatgggctaaggcccattcgaagattaattctttgaaaaatcacaaaagcccacctcatcggatggcatgcatgtggagtttagtaccaccttgcttattctaggagagggggatctccttaaaagggaggataccctcctagccacttgaagcatgtgtggtggagagaagaagggaaatacacacgcgctcgctggcctggcaggcggcgcgcgtgcacgacatacgtgttgaattgtccacaaaattggcatcctcacccttgcgcagatgcagcctccttttgcagttttgttttgctgcgggaaattcggattccgaaaaatccggtgcgtgaaaacggcgtggagtccggataagttacgcgtgacttatccggttcggttacgcgggcgccctgatccgccttcacgcaacacacgcgaaatcaatctagggtttgcctcttactctgtactgcgccgtcgctcatagactactccatcccgctcgccggcgtgcaccggcgatcgggagagtaggtctccggaacctctgccttcgacgtcctgcaccgggagaaggcggtaataaggtttttgggaaacgcttcacgcgactgctccctgttcgtccgcgacggctcgccttcctctccgctcgtgtgctgcgcaccttcatcgacgcccgcaaccgtgagtagttcctgccgagcaaccggtctttccgccacctcggtacgtgttcgacatattgtgcatatttgatctgttcatgttttactgcttagtttacatgtgtagatctaatgatgcgttcaatctagtttacatctgcaatgtcatgatttatttatggaataaattaaatcattatgtgcttataatttcaacaatccaaaaaccttattataggcgctgtgattttacta

SEQ ID NO: 27665 - DNA, 1501 bp, Oryza sativa
aaaccgaggtctaagcggcccgcactgcagcagcagccgatgaggatgccataggtgtgcacggtgggagttaccatgctggcaccagctcgtgccatgcggttgaagcgggacacagcggccgcggggttgtcgcgcgcgacgtcggcgagagcgccgttcaagctgcggatcggagcgccgatgcctcgccggagcaattcgtcgaacacgtcgagtgcgtcctcggcgccaccgctcccaacgcgtgctcggtcttggatcgtaccctccgagcgcgggacgccgccggcgcgggcgcgggcgcgggcagcgacgcggcgtgccatgtccggcctgacggacgggcaaggaaaggtggaaacctgcggcagcgctgaataaatcaccccgtggtttactaggaaactaggaaccagaggcaaaggaaggtggaactaaccagcgcgcgaaggaatggcgaacggatcagctgctggcggcggcggaggggcggcctcgacggcgacggccgacgagcgcggctgcacgggtgcgtccgttcgagcagttggcttcgcgaaaggcgcgggaagaagacgacgagaagagatcaatcagatcagcgtcttatttgttctttttttttttcttttttcggtttcacatacatcttgcttcaacgagtattacttgatttggggttactcttttttttttctatatgggaagcatgtttttatattccttaagttactttttttttctagctacgagtggcatgtttttacttgttttttttatactgcaaatatttccaactttctttgttgctaatgtggcataataatatttcacttgcaaaattttctcaattttttcatagactaaaaaaatgcccgtgcattacaatgggtaaagtctattttaatcttgttattattatatggtttagttaaaatgaaattcactatggagttcgcttggatatatatttttttataaaatcatgagctgcagttagaagtccgatcgtttaagttagcatgcgagttttttttaaacagatttcttatatgattctttctgtattgccaaaagtgaacaatgttaaaaaccgactcaaatacggatatgtatttctaaaagcaaacgaatttaaaaaccgtctcgtacccggatgacgtacgaaaataccagtaaaaatattttcaatttttataatagtagagaaaaatgatgccaacgagaatgtcactcttcggtctctctgcttcctatccctactcatcaatccaaattactgcatctccgtcgtgttttagtttctttttaaaatattccactttgatcacttgtttctcacaaaacatgtcctcaactattctaaactgaatcacaatttagaatttttcactacagcatgaaaactcaaatgcttatttatttggaaggcatatccaaaaagtctcagtttgttcatcagcaccaggccaaggcagagacaaatacttcagagttc

SEQ ID NO: 27666 - DNA, 1501 bp, Oryza sativa
tgagctggaaccgtaactccgtgtctccgtgagacggttatgttgtttgcagtttgctttgttttggcattgttcttacagtggtaaataagcgccctccacttcgagatatgatttttttggctctttatatatatatatatatatatatacaaatgtaaaaccaagaaaaataaaatatttttaccttatcaaattccaatggaattattattcattttatatactcatagtacatttagcccctagtttcataaactccggtacaataattacttaaagataaatttattttggaataaatgggatgggttaaaaatgttattatgagatacaggatgacagatcatcgaactaagatttttttagtggacaaactaagattattaaaagcactaaagcagtaaataaatccataatccattgtttacaagagccattatatttgcaaccaagtcacagactcacggtgaaaggaaaaaaaaaaggcaagaagccatgaagtgtgcagcacgaattgccagcaagaatgtcaactgtcaccagcttaacaacgggatgttgtgaaaaacgttgggaagttaattgtgcttactaaaagaactttgacctaatggtgtatgattatcttcttcactatcatgcaatgggtgcaatgctagctgcttcagaggggaagaatatatttcacaatagatgtatggaacatatagatccaatgctagctgtaacttgacaatatgataaatccaattgtgcctccagagttggtacacaggtcagaggagattcaattggaacctgaaaaatagtgcaaatgcatgaactagtaccgaatttgtttttaaaaaaaaaaacagaacaggagtaaccgccatgtgggatcattttgtaattatggtagatctcagatttgttttactaaacttttaattttgtcttgtttggttggctcgctcagccgccaccgctgatgtgctgaacaacactttggtcgaaacaggcagcagcaaagaggtttctgctcggtttaggctacgctttttgaccattccgtttgaccacttgcttcggtttccagcttggcggtagtagcatgctgggttttcttttatagtttttaaatggttattttgcaaacgtgtttccaaaaccaaattcttgtcacatcaatattgcttgcgcaatattttgactaagtattattttcatattttggacatttagaattcagtttgaccaaagtaggacaacaaccattatatatttttgtccgttcataccacatgatcattttcctctatctttacaaacctagtggatatttcggatattaggatagaactgtaaccttttacatgtggaagctttatcagaaatcttttacatgtggaagctttatcagaaatccactaaaacgatgtgctacgaacggaggatgattatggattatccacatgataaattggtatagttttcgtagagtaaagttaactattgt

SEQ ID NO: 27667 - DNA, 428 bp, Oryza sativa
aataagacgaatggtcaaacatgtgagaaaaagtcaacggcgtcatctattaaaaaatggagggagtaccatatttgcaccatctagttgtcctctctaagatatattgcattcgataacttggttaatttataggttggccaaaaatgtggagaacatgctttcagcttcagcaccagagaaagagaacaaacatgaacaccttttttaatccaatgaggtattcagggctagctttttaaaaatattttttttaataaaatgatcaacgagttttacagcaacaggacaatagggatagtacagttaatgaagtatgcacaaacagaaattccaaagttaaaagattttctcaccaataacctatggtatctaccattatatatcatcagcacacttgtactctgtgaaaatagatttcagtagta

SEQ ID NO: 27668 - DNA, 1501 bp, Oryza sativa
ttttttttgtactttggactagggttcacaaagttgcaagcaccgaagactccatcaggtgatctactattttaataaattgttaatttaactttgggatggctcaattagacaattactctgctttaaagaaccgagcctaattaggggcgctataatccagtttcattattatggaattaacattgagtatttcattatttttagtttgagtacttcatcaagttaagtgccctcaactgttaagtagtgaaatatgatttgtgagcgttcatatgtagtaatgaaaccccatttatttaataggatctactataacttgctacattagttgttcttgtgctaacatgtgtatagttgtaatccctggtccaaatgcaataagaatgataactatatatgtggtgtcatgtgaaagataggttaggtcttaacccattgtaaaactttggttattaaagatcgtccaaagtaagattctctccacattattttagtttactactactccactagcttagatgctcatagcttgtaaccaaaaactctccataatttctttttttaaaaaaaaaactctccacaatggtttatttggcgatttggagagcatatgatttttttttgcaagcttcgagactgtattatcctgtttattgccccgtgatagactggtaatagaccttgtttatttaatatttcaaaataaattaaacatatgcaggagtaatcgtctgtcggaaagattttgatggtgaagccgaaaggtgtttcagaaaagaaagaaagaacgaaaggatgatgttacttcatattgagtatctcactctcaacagtcacctcctatgttatgtaactaatgcacctacctaggcctagcagaaggcaaaaatagaaaaaacttttgccccattatttacttgctgggttttattagccgtagcaaattttaaattttggaacttaagtataaagttatttttaatgttttctatggtactttgtttttagctttggattttttttaatcaaatgctttcgcccatctttactaacaaaacataacgattgttcttttagcattggattttaaataaacaagcagatataaaagttttatgcgttcgttcatttctccacgggttatcagccacagagcgatcgatcagagtgaattaataggaaattctattgcatcaaaattttatttacctgaatgccgtttttcttttatctttttaccactctctcttttacgctttaaactttcatttcaacccctttgctctctcactcttttcagaataaggaatcgttggttaaatagtagtagcagcagtataagacaaggcaataaaaacagacaagaggtagaaatacagtaaaatggacaaactagccatcatcacaggttcagtacaaggagcagtatttataaggactatatatcactatgcccccagtgaattcttgagcccctcttggagacaagcaaatttga

SEQ ID NO: 27669 - DNA, 1203 bp, Oryza sativa
ccacgcttacttagctgccacttaaatcaaaaccggggtcaaaaccaccgaaggatctcgggtgactggttttgtatagttaagggaccctgcatatctggttttgtgtttcgagaacgttttttatcccgatgacaagttgagggaccttcggtatactttttccaaaacagaattgtttagtaccacctcgcccagccacgatagaggggagccggaggcgctgtatataacgcgacccgataccaaatcacaaagcatacctttctcagccttttggctaagatcaagtgtagtatctgttattatcagtttaatatctgatatgtgggccatatttccatggatattaaattaatattttgtgggggagggtccaccacggtagctcgctactgggcgagccctggctttgcactgctgccttggcccggcgcacctgtaaaattttttaagcttttgctcatgttaatttggtttaatcattgaccgaattaaactgactaggagtgaaatcattgatgaatttttgacttgacttgacttttcagtgaatgattttaagatttatttgtccaaactgagttattttggttccagtttatattgaaaaacaaacaaacgagaggtgtgtatttggtttaatcgttgaagaaattaaactgactaggaatgaaatcattgacgaattttttactgactttttagtgagtgattttaatatttatttgtccaaactgtgagtgattttggttccagtttatattgaaaaacaaacgaacgagaggtgtgtatttggtttaatcattgacaaaattaaactgactaggaatgaaatcattgacgaattttttacttgacttttcagtgagtgattttaagatttatttgtccaaaccgtgagtgatttttggttccagtttatattgaaaaacaaacaaacgagaggtgtgtttggtaagcctcgtctcgaaatggcgacttgctccgctgcttgcgctcgcccagccgtcgtcgtcttcgcgtcgccggccgccgcgcggcggcgcgccgcctcctccgtctacctccctggtcggcctctgcgcggcggcggcgtcgtgcgatgcagcgctgggcctgtaagcggtgggatgatctcgaagaagggtaagatatgttcctcctcgtctcgcgtggggatttttttcgcttggaaaaatc

SEQ ID NO: 27670 - DNA, 1501 bp, Oryza sativa
ggatgcaatcactgctggaaagcgtgtccgctgcgagactaacatatcatcaggtgctgtctctgtcagttcagctgcagttgaattggccttgatgaagcttccaaagtcggaatgcctatctgctaggatgctgttgattggtgctggcaagatgggaaagttggtggttaaacatttgattgccaagggatgcaagaaagttgttgtggtgaaccgttcagtggaaagggtggatgccatccgcgaagagatgaaagacattgagattgtgtacaggcctcttacagagatgtatgaagccgctgccgaagctgatgtcgtgttcacaagcacggcatccgaaaccccattgttcacaaaggagcacgcagaggcgcttcccgctatttctgatgctatgggtggtgttcgactctttgtcgacatatccgtccccagaaatgtcagcgcctgtgtgtctgaagttggccatgcgcgagtatacaacgtcgatgacttgaaagaggttgtggaagccaacaaggaggaccggcttaggaaagcaatggaggcccaaacaatcatcacccaagaattgaaacggttcgaggcatggagggactcgctggagactgttccgactatcaagaagctgaggtcctacgccgacaggatcagggcttcggagcttgagaagtgcctccagaagatcggcgaagacgccctcaccaagaagatgagaagatccatcgaggagctcagcaccggcatcgtgaacaagcttctccacggcccattgcagcacctgagatgtgacggcagcgacagccgcaccctcgatgagacgctggagaacatgcacgccctcaacaggatgttcagcctcgacaccgagaaggcgatcattgagcagaagatcaaggcgaaggtggagaagtcccagaactgagattgaagaagagatttttttttttcagcccgtgtatctactatgtatactactaccatatctgtccagacattctaattccaattttttttctctctctcttgagcctttgcttactgagccctcgctgagttggtcaaattgtctcgtgaattagcgccatggctgctgctagagataactaggaaaatgccttgtttgtaaattactgcatctgctgtggcaagagctccattttgaagatattatatacacgctgttggtgaaataaaatcagaagttcatcaacctttgaagctgttgttttgtgagcttatatcatttttgtacagttatgtcagatcgtgtatgtaaaattgttgattattaacacttcccctagtgttcagctgtttgtccatgttgattgcctgcactctgcagcgaatcttaagggaatttgtgctcctcaggcttcgttttgtgctgaactggcttttcagaattacacaacaaaccacatactagagctaacaattaattctcgtaatttttcgtagttagtgcacagtgaacacagtggagcccgat

SEQ ID NO: 27671 - DNA, 1501 bp, Oryza sativa
gttacaaatatattgaatagcatacgtgtgttgatatccaaaatggtgtcattttttcttttttgcgaggacaaaatggtgtcattaatttgtgcgcgttagaagagagatcaggatttaccggcagccgatgggttggcgaaggtggcgttggagaaggcgtagaaatcagcgagggagtagcgaaggcgacgcttctcggaccggaggccggcgaggagtgccccgagagccgcgttgaactccgcggcgaggccgttcatcctcgcgtcgcacccgccgccgccgccgctgccgccaccgcggcgcgtgtccaccgtcggcccgcacccgacgaggccgacgttgacgacggcgaacctcctggcgcccatgccgtatagcgacgtgacgctggcgttgtagagctccacgagccgctgcacctccgtcttgttgtccggcggcgacggcgggaacgtcaggaagtagttgcagtccgggaggaggtccatggtgccgacggcgagcaggaagagggacctcgagaggaggtcgctcatggcgaggcgccccagcttggactccatctgtgacctcgtcgtggcgaagtagctgatttgcttcgacagtgggatggtcaagcctgcgttctgtatgcatcatgctgattattgggcgatttgatttcataacattgacattgtcacgccatatatgatggatgaaagacacagacacacagaacgcatacaagtgaaggacaccgagtatgtgagtgtgcccctaacacatactcctaacattccaaattatagggacaccatctttttaagaaaaattaaactcggtaacttttgattaataatcatactaaccatattatgctatattatatatatatatatatatatatatatatatatatatatatatatatatatatgttatatcactacattcacagttcaaagtatttttcatgtgatactaattttatatttgttgaaaacataacgtagaataaataatggtcaaaatatcattaaataccttaattataaaaaatatatgtattataatatgggacggaagaaatattagaaaatagagaccaacgtaaaattcttgacctaactgtaaccttcttaataacgtgtgcatgtatacttaattacgaaaatcccatggtgtagctttaatatgtgttattttgtactcactcagttcttaaaagatcatctattaatgtatgcaaactagtcgtacatccaaatcttattaaatcagtaatgaacacaataatatataaggatttgatatgtgacaataatagtggtgtagatttgtgtttaaaaaacaccttcacatggtactgacgtactgtgtctctaagctcctttgcttaaaaaggaaaaaaggagtagagttgactcactgtggagttccgtatgccagcatctgcagaagcatagttgactccagtaaaaccgtccatgttgaccggaccggagagagacag

SEQ ID NO: 27672 - DNA, 1501 bp, Oryza sativa
aagttctaggccctcgacaaccacctgcccagccagagtctgaaatgttttgatgcaatgttttttggacatctattatctagccaattgtctctccgaaagagggttttctgtccattgcccagggtgatttttatgcaggcttggaaaaagtggatatccactgcattgtaagggagatccatttgttctcaaggcctggatgggtttgtccaccttagccaaatccatcttaatcttaaggccgaggagaatttttatagatctatgatttcaagtccacccagctactttggtctgcaaacagtttgccaattcaccaaactagcccctagcttaacattttctggctcctcacctttccaaaggaaagcccttatgagtttattgattcttttgaaaacccatttaggtattaaaagagctgacaaatggtatattggaatggaggacatgactaattttaccagagtttctcttcctgtggagctgaagaatttgcccttccattctggaattcgcgatccactcttttcaattaaaggtaggaagtcaactttcctaagctttcttaagtgaagagggagtccaagataacttgttggaaaagattgtattgagccaggaaaatcttaggtgagtgattgtacatcaatgttgtcacaggcaattggcaaaatctacgttttttttgcacattgttatttaatcccgatgccttgccaaacacctgttagagattaagctttacgataacactcaataacccttgtggtccaacacagaacatcgatgccgggcctcaactaaaccctatcactgatgaggatcatcggtgacgggtgctcacttaccgccagtcactggtgctttcgtcctacgtaccctagctagcggtccgatgacaggcgctgacgttaatctgtcactgcagatgtcgaaccaccgccttctctatccagccggtctatctggggtgaactttctcctaacatcggtaattcactgtgccagtgttatcgcccatcgcccgtatcttctggtggcttgtggagtgggattgggagtgggagcgaggatgggcgaaagtagtgggtagcagtatggctgggttgattgatatggagtacaaactaagtgtagcaatatagtactccgtccgtcctaaaataaatgcagttttgcactattcatgtttaacggttgacggttcgtcttatttgaaatttttttatgattattatttttattattattagatgataaaacatgaatatactttatgtgcgactaattttaaaacaaattcataaaattttcatataagattgatggtcaaacacggattcccacggttgtacttatttaatttgagattgaggtagtacttaataaccactaagggattataatccatcttaagactaggggttacttgcgtatctacagttgactttaactccgtgtgattataactacacatcagcttgctggccagcct

SEQ ID NO: 27673 - DNA, 1501 bp, Oryza sativa
  unsure (1)..(1501): unsure at all n locations
tttttttatgaatttacaaaacttttaggtatgattttcatgagtttccaacacttaactcgtttccacatatatgtccccctagcttgttttcacatatatgtccccctaaatgtaacataatggtgaacgatatctgttccagacgtttattattattatttaaataatataatgtaggcactcatatacgcgtgcatacacacatttcttataaacgcgcgcttgcaccactacactatggctgcctaagcgcctgtctgaagccctgaacagtgaacacttagttctgcttactatacattctgctgctgtctgcaactacaaggcactcaggaaattgtgccattcaatttctttacaattttaccgaattcttctgaacagatgagaagagcgaaccctttaaacagatgagaaagcggtggcgcgacaccggagatggtttcgcttctcttctgtgtttctcaattgtaccctctcacgatagatggtcagatttgattttgtacctcccagtactagtacctcccggtagacgggagaaaataacgccaaaattaggtccttgatgaacaggcgctccatcccttgttaagcggaagagcatgcgtcacctttggatccctccttccatatatataaaaaaaaccacgcttgatagctacaaggcgacgttgacatttttcgttaaacatcaatcacaatacgcccgttttggatgcatgtatctttggtacggcctagttaacatcacttaactaagaacaaaaccgtcgttcttatggtccattactcaacaagtatatattgctacatctaggctagatacacactgtaaactactagtattaatctattcccgccattgctgattatttttcagcaatgacagatgctgaacttgagcaatataaaacagtagtaataatttaatgttgcagatcgtgtaacagggaaccatttcaagtcaactcttgctacacacggtcggcacagctggggctgtgccacactgtggagcccagatgcttgctatgcatgtgcatatataaatatatgtgccatcttcttcttctatgtccattgtatctgcaataagcttggaggtatttggnacacncagnnnnnnnnnantccccccccccccccccccccctctattttgctcatcaacttcttcttcttgatgtccagaagttcaaaggcacctctgtttcttccctaggtgagattaattcttctgtgtttgtcgattcagggctcctttggaacgcaggaatttttatgggattttcatccgatttagtctaattcctctgttccaaaggaggtcttgttgtttggctgtgtttcttgtgtttttaatgtttcacttaactttttcatgtcacttcacttttttttgttagcagcctctttatcctgttctttgaggtgactgttatcactttatgcaggaaagccgtttcttaacaacaagataaaggtgtggtttgta

SEQ ID NO: 27674 - DNA, 861 bp, Oryza sativa
tttctgtacaacaagattggccgatgaaaaatacccacaattccctcgatacaatagatcctagattcactcctacgatactgtatgctggtccgaccgatgtgttattgctggtcagaccggacgcatcgatcggaccgacgggtgtaataccaccagtccgactagaggcagcagccgatccgattggagggacatcaccggtcagactacgctcggcatgtttcgtagaatcagctcatgtctggtgctcctctaaaagacattgacatgtggggtccacgggctgactcaacaagattggataaactgcctcctaaaccgttcaaggagtcaatttgtaatggttttgtgagttggaggataggttatagggatgcgattcaaccatgggcatgagttgagggaagcaaagtagacttagggcctgttcactttgatgaaaaaaaaaaccttaccaaattttggtaggcaacttgccaaaattttggcaggatttcttatatagttatcaaaatttggcagcaaattaaatatagtcacttttttggcaaatttactaaaatttggtaaggttgaaaatgacatcaaagtaaacaggcccttattacccacgggaatggtgtggggtgggctggtaatataagcccagaaaccaatccatccagcccagcaactgcgaggtcggctgctagtctaacgtgcacccaagccatcaccccacacgtgaaaaatccccgctccacccgcgccgcgccgcgcccaggtagttcagccgcgcgccaacccaagctcgctcgccggccggaaatggcgctccccttcctcctcctcctcgccttcgccctgctcttcccgctc

SEQ ID NO: 27675 - DNA, 1501 bp, Oryza sativa
aatgttaatgaattttgacatatatatctatctagattcattaacatcaatataaatgtgggaaatgataagatgacttatattgtgaaacggaggaagtaatatggaacgaacggagtatattcaagtcctgtgtatcgatcattcatgtatatgatcagtcggaatctcaggttgtacatgtatgtagtggtagacacctttgatagctatccattttcacagtagtttcgtgtgatctccacagcctccacagtacatgagagatcgaatgaagagggaggctctactacatatggtcacctgcggtccatctgtcccaggtcaccaccagtacatatggtcactatatatatatatatatatatatatatatatatatatatatatatatatatatatatatatatatatatatatatatatatatatatatatatatatgttgactgatgcatagtttcccatgcataaattgtggtagtcgatcgataatatagaccctgtttagatgtgactagtttttagtccctatcatattggatgtttggatactaattataaatattaaatatagactattaataaaacccattctataaccatggactaattcgcgagacgaatctattgagcctaattaatccatgattaccctatgtgatgctacagtaaacatgtgctaattatggattaactaggcttaaaaaatttatcacgcgaattagctctcatttatgtgattagttttataagtagtctatgtttaatactccaaattcatcagatatgacagggactaaagtttagtccctagatccaaacaccaccataatgcatggctgtagacgcgagatgaggaagcgtatctttggtgactagaaatttagttagatttacgcctttatggatttatatattttatagcctctctctatatatattgcatatgttaaaggggattatgggcatgcatacataagtgtattatgtgcgtatctatctttgtgttccgtgtagaagaaataaaagatgtggctacctatcttactataaagttataatccacaaatcttaaagcttaacatgcaaacatgtcacctcatcatccacaagcaataattacatacaaaacttagggcctgtttagatgcatttggaatggcaaatggcaaatggcaaaagtttggtggcaaaagttttggtattgcaaaactactagttggagtttagatgcatactaaacttttgccattctgtaggatcgagatgtcgactagagggggggtgaataggcgatttaaaactaaataatacctaatcaaatttaacctaagttgctaggcttggtgagggagaactctaactaagcaactaagttatgttttgcaaacctagggtgatagtggctcaaatatatctctaggaaagtaaatcacgctcctatgtcgatgttttgcaatcctagggtgatatgatctcaagtgtgtctctagaaaag

SEQ ID NO: 27676 - DNA, 1458 bp, Oryza sativa
tttttaagtactgatcattattataattatataattacccaacttccatttatcattatataatagttaaaaataatttatgcgccacattcaacattagcaactactccctccgtaaaaaaaaaaagacaaaccctgggtttccgtgtccaacgtttaaccgtccgtcttatttaaaaaaatatgaaaaaaattaaaaagataagtcacgcatagagtattaattatgttttatcatctaacaacaataaaaatattaattataaaaaaatttcatataagacggacagtcaaacgttggacatggaaactcatgtttgtcttttttttttagacggaaggagtagtaatcgacaacagaggtggtagtatgaagtttctggatgtagtactcgtttgagaagttttctgacgtttgtttggtcgatttgagtggtgcaggcgtgagcctttgaaatttggaataaccacgagcaatttaattaatccggtcattccaccaggaagacttgaaatttaattgtacgatatcctaattaaaacgaggaaaaagaaataatctcagcgcacaaatttagaaaagatcaccccggccctgaactattataaaattatggaaatcaatgtcaacatcagacactattttactcaaaaccgtacgcttttcaatgttaacaccgaatttatagtggtttagatgatgtgaagatgacgtacttaaaaaacaaatctagaactagatgtgatacattattaataataatattattattatcatcaactactactactatttcctctataagagtatatatattatagaaaaaaaaattggtaggagaaacaaaatataataagagaaaaaatgtttaaaactaaataaatgtatcttcttaggttaacaaactttattttcaaaacatagtaaaaacatagatgcttgtatacacacactcatccctatggatataagtaagcacatcatattcgtatgagcacatttgagagacttgactgatattaataaagtcaccatggacatattgttgtttatatgtatgtcgcttatcactttataagaatagttagctgaaatattccaattttgcagcaggcaagatttttttaatgaatttatgaaattaaaaataccattgtagtgatatgattctttttggatttcataaatcaataagtgaacttaaaaaagtcacaaaacaattctgcattgagcagttgattatatattataaccaggataagttcagtttacaattgaatagtttgaatgcaattgtcttaaacaccattttctggttcaattgaatttatttttctcacacaaaatttatctaggtagttgtcagggttatggataccacatacctaatagtagttgactaaatctcggcaggacccaccacataccatgtcttatacgggaactgactccggata

SEQ ID NO: 27677 - DNA, 329 bp, Oryza sativa
tttaatcttttacctaactttaccacaaatacaacttacaatctataggaaaaaaaaatatgacaagccacacttttctaaaataagttataacaatgttagttgagaactaaacaacccctaactcatgtatagagctcactactacatgcaccaattctatatagtgctcactactacatgcaccaattctatagctagaaaaaaaatgcagcgataccaatgcccggtcgctctgccccggggacgacacgggtggtgaaacaagctgtgccgcccccctcccccctctcctcccctcccccgcctcgcctcgccgccgcccgagt

SEQ ID NO: 27678 - DNA, 461 bp, Oryza sativa
gagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgttattattaccttgttcaccctagaataaacaaaaccccatctagtggacactctatttatggttccactagtatgaatttaggtagatgcttcgctgattaattaggcaacattaggtggttttataattttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 27679 - DNA, 313 bp, Oryza sativa
gctttagaattatttagtgatgtattcttctaactagtatcagctggtgtatttcctcttttgcactattcccattatgatcgtgcagttttaaaaatgattttaacttgagttgtgggcatatgttgttacagaaaataattgtgttctttaccgatactgtcaaagaggaagactccatggacactcaacacataggaactatattgctttccaaaaacagtctggatggtagtgaccttgcatcatcatttagtttttttattaattttttctcaatctgagcatgcttcatacattatacttctttagg

SEQ ID NO: 27680 - DNA, 416 bp, Oryza sativa
gtgagagataaaataagtttcatcttgatgaaatcttatctacactgtttccaatacagtttctcttgcatgttctacctacgaaacaacaaaaacaaaaccacatgtatcgtatgagctattttaattctcaattaaatgctttgttgcttatgtggcactactggaaacatgcaaatgatacttcctcagtcccatattatatgggattaggggttaaaagcgtgtctcaaaatataagggatcaggtaggtagagtactaatacaaacagacatcgggcagggagagtactaatgcgaacagagagctgtcggtggaatttgtccctaccttatcctctcaccgagtcacccatcgaccaccgcttgttcccctcccgattttctttgccttttctctatcccctccatcagc

SEQ ID NO: 27681 - DNA, 1501 bp, Oryza sativa
tgtatgcttccatttccatgttgttggtagtacctgtgtttgttttggactttgcattggatgtcagtttacgctttggattgtttgattttgacaccgcagcaacgcaatgcaagatttggaagctagcgtgggtatgacttggatgtagccattgattggtgtggtactggacatgaaatttgcagcaacgttctagccagtgaactatatgggataagcctcacaagtaggagtatcaatttaattgactcttgtcaacatgtgcattaatgtcattgtatactgagaaatgcttactctgtctttgtgccaatcatttgctggcaagcttgtaaacccaaatattctctcactactaatgcccagtactaaggactggtttggtttgtggtctaaattggcattaccaatttttatcaatgtcacattttgtcaacttttggcatggctaattttggtaaaggtaaaattgtgtttggattgaagccaaaatagcctaaattaactgttgaaatggcatattttcttaggcatgccaaaatttagctccaaaccaaatagacaataaacactattgaagttgacaaatattggtaaggccaatttaggcctcaaaccaaaccagccataagtaaatgaggggtacatgtgtcttttgccagcctccttattttggatgaatagtgcccagtcccatataatgtgggatggagggagtacctcccactgagaatgacctaacaataacaccttttgatttgatttggaagctatgtatcaagcaaaaaccaaagtttgaattgaattacaaccattcgctttcatagaaatccaagaaaataagtcgatttgaactttaatatccgatactgtttaactctaacccactgaatcattcatatttcaatcttgagtttttcttttatttctaatagtagacaaaaacttcaacaagttcataaaaaaatccattttacatttttactccctccaattcacttaatcatgtaactttttgtttattttacttctaaactatcacaatcggtccaccttacatcttaggtgcctacatcttaatagtatttatattttttttctttatacaagttattttaagatgaaatattttaagccataaaaagatgataccattctcaagttttatattctcaatttttttcatggctatttgcttgaattttaaaatatctatgtttagatcagccttacgtaatttcaacctatgtaaaaaaatattgataggtaagttgtaatgcatttattcatcctactgaatttcagtgcaaaatataagttatataaagagaaaaaagcagagaaatagagttatggagtaaagtggatcagtttcaatagttcttagctgaagattagtatataggtttaagtgctctggtaaaatattctttatagggagtaaaatgaactttttttcttcaaaaaagtattgtttgcacggaggagtatttactac

SEQ ID NO: 27682 - DNA, 1501 bp, Oryza sativa
acaccaatgacatgtacaagttgaagaagaaggagatggaggaagcctcaccctccaagaagtgcattgctctccaagccgaagttgaagacaagagcaagagtaaggtgaatgaagtcaatgaggacttggaggaagagatggtccttcttgctaaaaggttcaatgatctctcgggaaggagaaaggagagaggaaggggctccaactccaataggagaagaaatagaagactcaataagactctctccaacttgaggtgttttgagtgtggtgagaagggacactttgcttccaagtgcccttccaaggatgatgatggagacaagtcatccaagaagaagagtggaggctacaagctcatgaagaagcttaagaaggaagggaagaagattgaggctttcatcggggaatgggactcaaatgaggagtgctccgcctcatccgggtccgaggaagaaggtggtgatgatgcaagctccaagaagaagaagatgatcgttgttgccatcaaggaggctccatcactctttgctccactttatctcatggcaaagggttcctctaaggtaacatctcttagtgatagtgagagtgatgatgattgtgatgatgtttcctatgatgagcttgtgagtatgtttgaggagctccatgcttatagtgagaaggagattgtcaagttcaaggccctaaagaaggatcatgcttctttggaggtcttgtatgaggagctaaagacctctcatgagagacttaccatttctcatgagaagcttaaggaagctcatgacaacctcctttcaactactcaacatggagctcacattgatgttggcatatcttgtgatttgcttgatgatagtgctacttgccatattactcatgttgcatcatctagcatttctacctcttgtgattatcttatggatatgcctagcccttgctctagttctagctcgtgtgtttctatttgtgatgcctcacttgttgttgagaacaatgagcttaaggagcaagtggctaagctcaacaagagtttggagagatgcttcaagggtaataacactcttgacaagattatgagtgagcaacggtgcatccttaacaaggagggacttggattcattccaaagaaggataagaaaccttctcaccatgccactcgttttgtcaagagaaatggtaagtattgctccaagtgtcgtgaggttgggcatttggtgagtgattgccccggaggtaagcctcctaagacatgcatgtttgattctcattatatgcttaggaaggctcatgatggtaacattgttgctagatatgtgggttcccctatactcggtggtaaaaagaatgccatttgggtgcccaaagctttggtctctaacctccaaggacccaaactagtttgggtacctaaaagagcttgatcttcttttgtaggtgaactaccgcaccggtgggagccattgggtgcttgatagtggatgcactcaacaca

SEQ ID NO: 27683 - DNA, 1501 bp, Oryza sativa
caagctcatcataggaaacatcatcacaatcatcatcactctcactatcactaagagatgttaccttagaggaaccctttgccatgagataaagtggagcaaagagtgatggagcctccttgatggcaacaacgatcatcttcttcttcttggagcttgcatcatcaccaccttcttcctcggacccggatgaggcggagcactcctcatttgagtcccattccccgatgaaagcctcaatcttcttcccttccttcttaagcttcttcatgagcttgtagcctccactcttcttcttggatgacttgtctccatcatcatccttggaagggcacttggaagcaaagtgtcccttctcaccacactcaaaacacctcaagttggagagagtcttattgagtcttctatttcttctcctattggagttggagccccttcctctctcctttctccttcccgagagatcattgaaccttttagcaagaaggaccatctcttcctccaagtcctcattgacttcattcaccttactcttgctcttgtcttcaacttcggcttggagagcaatgcacttcttggagggtgaggcttcctccatctccttcttcttcaacttgtacatgtcattggtgttgatcttccccaagaggcttgtggatgtcattcttgacatgtcggaattgatgagcatggtgacaagggtctcatacttctccgatagggctctaagcatcttttgggcaacctcaagatcggtgtagttgccccaagccccttgagatcattcacaatgacattgagcctcccatacatgtcattcacactctcatgaggcaacatggagaatgtctcatattggatcttgaggaaatgaagcttggcatccttgtactcacttgtaccctcatggatctccgccaacttgttccaaatctcatatgcggtctcaaggttgctcactctatcgaactcctcttggctcaaagagttgaacaaggcattcatggcttgggcattgagttggaggttgcggtgatcaatctccgtcaagggtgtgccggtgatggcaaagtctacatccacaatactccaaatatggaagctcatagctttgaggtgagtagatattttaattttccaagtggagtagtttgtgccattaaacatgggagccttccctacatggttcacctcgttcgacatcttctctctaggcggtgaagcccaatcaagagagaccaagctctgataccacttgtaggatcgagatgtcgactagagggggggtgaataggcgatttaaaactaaataacacctaatcaaatctaacctaagttgctaggcttggtgagggagaactctaactaagcaactaagttatgttttgcaaacctagggtgatagtggctcaaatatatctctaggaaagtaaatcacgctcctatgtcgatgttttgcaatcctagggtgatatgatctcaagtgtgtctctagaaaagt

SEQ ID NO: 27684 - DNA, 549 bp, Oryza sativa
catgactgtagtgtagtactagtagtagtactagcacgtatatgaatgaggagtacatacaggacgagaggagagggcgagtccgagttgcattgaatgggcgagaggagagtgttgtgtgttggtggcgtggtgttggcgttgaatgaggcccaaacggcgagacaaaagagacaaggcggggtgttggttggggcaggcccaagccgggactggaatatggttcgtgcatgccatgcccgtgcattgatgagagatgcccgtgcggttgcggttgcacgcaggggaggtaaatgcgagcgagacgccggggaatctcgccctgccaccgccttcatcggggcatcgggcccgtgcacgtaaatgcctcgtcgccagagaattttttttatttttatttttttttattaaaagttttacaaaaataatttttcattttgaaaattgacagaagtggtcgcctaccgccctctgggatggcgatttttaaaaatcgccctcccagagggcggcgaaagtgacgtggcagacggccgttcgctctcgggc

SEQ ID NO: 27685 - DNA, 233 bp, Oryza sativa
catccaagggaaataagggcttgtttactttgctatcattttcaatcttaccaagttttgacattgccaaattttggtaaggttgtcaaaaattttagcaagatttcatatgtatttattaaaatttggcaacaaactaaacatagccaaaattttggtaactttacgaaaaaatggttgaaaataatattaaactgaacaggacctaagataacaaaagcacataacgatga

SEQ ID NO: 27686 - DNA, 217 bp, Oryza sativa
ccacgtgtttatagctaacttgtaacctgctacctaaccagcttagcattgcgctttggtactactttggatcttttttttttctcattgaaacaatgtacattacatttgtatagagattattagtgtttttacacgtaatagtcaaataagaacaactaccaaaacgaaataaagatagtctgcttgctagaataacataagagatacgagctga

SEQ ID NO: 27687 - DNA, 259 bp, Oryza sativa
tttttttctggcttttttttccccaagagcgccgcgcagaaaagatcgatcgcgatctccctgccccgacgtcgccggccgatctctcattctctccacgccctgcccgtcgccgatctcctacaccatccctgccatctcctccttcccctcccctctatcctccactggtgccgcccacctctccgtataagacaaactgcgttgcggcgttggtttccgccggcgctgctgctgcacctgtcagctagggcgggca

SEQ ID NO: 27688 - DNA, 326 bp, Oryza sativa
ctgagatagtaaatggactggaaatggcccatagagaaatttgggaatttttttttaaataaatgttgaaaaggtgtttatattatcaaaattagaaattaagctccgaaaattttaaaaaatattcaaagagcattattattcatgattaatttaataaaaattaaatccaaccatatcatattatttcacggcgcgcagtagaaaaatgcgcagctctgatgaatcccctaatgatttttatcaaaatcattaagttaaggtagatacacatcttgtcatatgatcaaatggtttcgccaaaaatcaataatcagacagcaaaa

SEQ ID NO: 27689 - DNA, 302 bp, Oryza sativa
tagtgtgataagtgcaaaaccaactggtcagtcaattgctagatgtggtgtaataaattcagattcaattgatatttgctctcccgttcaaatgaccaatgaagaagatactggtgacacttgtaaccatgcaccaaatgtagaagactcagctgctcttgtggactggagtaagttggcaatcattttggatggcttagatggtgatgctcatgcattgttggatgaggatgaactatttgatgctatgggtttcaaaaaaacagatgagagagcagcagcaacagcaatacaagaagaag

SEQ ID NO: 27690 - DNA, 681 bp, Oryza sativa
acccaaaagatatctttaaatcttacccattcattattcctcttccatttaatcctaaccctatattcatttctcaatctcaatcccacctcctattttccattatccaaacacacccaataggctaactgcggtagaatttctttttttgattttttttagataatagaatcaaatatcccggcctttactcaaacgagctacaaccaattattacatagttcacaaaatagcaaactcacacagtgagtccagaaccacataatgaaaattttaaacaagcccaaaccaatacttgatgctactaagattcataaaagaaagcttgtactaggccttaggcactgcgctgaagtacataattgctgatggtctctacagaatgaaccagtcctaacaagttatgatcctggctcagaaggaacgctagcttgcttaacatatgcaagtcgtttcggggagaggggcagaaggaaaagagactcctagcttaagtattctcgccctgcttcaaaagtacagggcgcgcgctatgccgctatggctttgacataacaaggacattactccactatttacggaggtgctaggccacgagaaaatatatgtgattgggccttgcacattacagaatttcactagattggcccgttagatgtaaatgctaatcgttaaatcagg

SEQ ID NO: 27691 - DNA, 337 bp, Oryza sativa
cgtgctggtgtgaggattcctcgcgtttaattcggtgggtttttgagctgaaagaccggccgaggagggacgggtaaggatgatttcgggccttgattgatctgcttggcgagatccggacgattacagctagctatagcttacagcattcattcacggagacacaaacttacatgtgccatcagctagccgccccatgctgcatcacacaggtcaggataaacaggctcggtttcagaaacatcttggcaatattgcgattacgattgactattgagacgagcagcgattgagatgcagtcaggctgagcatgccctgcccctgcccctgcccagg

SEQ ID NO: 27692 - DNA, 1501 bp, Oryza sativa
acatgaattcatgatcatgggtctattttctgtgctcaaggactagactatttattattccccgtaaaggttatcaactgaatacttgcaccagtcgggattcaattgttatatctattttggagtatcccataagggataatcactcagatcagaagctattcatatgagctacacttggtctatatcacccggaagatttattactcgggagcatgttatatgcgtcatcctttaaagggtgtcgaaggcatattttttggcctaggcctaatatgtctgcagcccacattttcaggtgtggtctgtcacgttcttttagggacttaggcactttttgcttaggccaaagtgcacgtgatcaagtgcccaataccttaaaatccttttataccgcagttacttaactttttaggagttggtacaatgcatcttaaaagctgtcaaacagtaaagctttatatagctgccccgctgacttttttatatagtcaaggcgctgtttgggtttatcaagcaattgattggatacaatatcgttgctttttgcgatgtaagtgtgcatttttattgaccaatattatggcttaggctgattatatattgtggtcattttccaggcagctggtaaatcctttatgagtttatttacttggattttacaccacatatgctgtatatttctaggtgtggtgaaaccatgtgtcttttagggacttaagcacatctgttaaagcagtgtgcgcatgacttatgcccaatactttggaaatttctttattcacagcattcaagcttttttataactgttttgctatgtgaattttcaatgatgtagtcaactttaggttgctctcatcaaattttacaaagcagtcggtatatcatctggatcatgttatttagggattcacaccgcatatgctatatattgatatcaagtcacttggttgactataattatcaaaaaccactcggttggttggattatttattccttgactatatgcttggtttgttcaactaatcacatggtcggaggctacacctattaggtgcatatactcgatgcacctaaatttacattcaattatttttcagccctccacagtctttggatttggtaaaagtactcgagagaccatggcatagatgattgaagcactcggctctggagtaatctagttcgagagaagattatcttttcgactgtgaaggtctcaggggctactgtggagattatgggtaccccatacccacacggcatggttatccgactggttataggggataactaatatctatgaaatatttaacgaatcatgacttgggtattacgtttccctgtatattatggaacggcctaaagtcctggtttgataatattataaaatagatttaggaaaccgataccatattggttaaggtttctatcttgtaaccctgccccccaacctatataaggcgggcagggagccccctctaggggcatgagcacata

SEQ ID NO: 27693 - DNA, 1501 bp, Oryza sativa
ggtgtgtttaattcacaccaaaattggaagtttggttgaaattgaaataatgggatgaaaaagttaaaagtttacgtgtgtagaagattttaatgtgataaaaaaattaaaagtttgaagaaaaattttagaactacactcccgccgtagtactactccatcaagtttacacgagtagtagactgcactcgtattatcatatcacttcatcaagttgtgtgaaaaggctatcctctcactcatcagtagcatcatcttatcaatcagatcacatcgtggcagccaatgcgtgcaaaaaggatggagcatacgtatagacagtgtagtttcagacttttacttttgtaggagtagtactactagagccaaattttttcccaaaaacatcacatcgaatttttgacacatatatgaataattaaatatagataaaaagaaaaactaattgcaaaggaaaactaattgcacagtttgcatgtaaatcgcgagacgagtcttttaaggctaattaggccataattagccataagtgctacagtaacccgcatgtgctaatgacgaattaattaggctcaaaagattcgtcttgcagtttccaggcgagttaggaaattagtttttttattcgtgtccgaaaacaccttccgatatccggtcaaacgtccgatgtgacacccaaaaattttcatttcctcgactaaacaaacccgagcctctttctttttcttttgcgctacctatacttgtactagggcgaaaaatttaaaatttagctagggtggaatcaaggcattgtttagggggtgtctacatcagggtgaaaattactgaggtgtcacatcggatatatggacataaatttaaaatattagacgtagtctaataataaaataaattacataatccgcatataaactgcgagataaatttattaagcctaattaatccgtcattagcaaatgtttattgtagcaccacattatcaaatcatgttgcaattatgcttaaaatattcatctcgctcatgtaaactatgtaattgatttttttcatccacatttaatattttatgcatgcgtccaaacgttcgatttgaaagggtgaaaatttttgggacgggatttaaacaagaccaaacgttcgcgaaaagaaacaatagttttggagacatattatattatgggattatgggatagagggagtactaattatttaatttgatgattataatacttattatgagtagaaataaaaaaaatcgggcggatgagcggatggatgtgctgggccgaacgtggtcgcgcgtgggccgagactccctatacctccccgcaacggtcaacctatccgatgtcggtctcggattgtataagtgtaaaggaggccgagtcggtcccagcaacgggtgggaccagagtgtatggaccgggtttatttagggcagcggcaaaattaaagatatgcgatacgttttagagagagagagagggaagggggaaag

SEQ ID NO: 27694 - DNA, 283 bp, Oryza sativa
catactatcaaggggggtaatgacctagcaaagagatgattaaattgccacattaggtcattgcattttcatttatgctcacattttcatcacacacacatattcacattgtatctcactgggttcggcctgaccaggggcggtcagaccggccacatagtggcagtctgaccggcgagccctggccggtctaaccggccgcaagaaggcggtctgactggcgcataaggccagtctgaccggtggcacacgcgcggtcagaccggccccctggagaccggga

SEQ ID NO: 27695 - DNA, 770 bp, Oryza sativa
agcaagggcaaagcatctctgctgcttggctgatccgtcccatggctgtactagtatgtgcctgtgtatagtggattcattggggcaaaagtcaaacggccaggctgggtttgtacaggattgacaaactagctccatgttataattatctacgcctccagtctaaagaaaaacaaatcctagataaaaatatgtccagatatatataagtagataaaaattattttttcttgttagaggagtacttcctctatttaatattattagttacttatttgatcttgtttcgaaacctacgtattaatctgactctgttttttttctaatttgcatatttgacctgttttttcaaaatcaaacattacatttgactctaattccactacatcattagagtatcgtttagaataaaatgcgaatgagtagggttaaggtgtcttcgtgtgtattttgttcaatttggcaatcttgctaaaattttaacaaccttaccaccgaaatttgataatatcgaaatttggtaaggttaaaaatagtagcaaagtgaataagcccgaagttaaaaatttgttgagtggaattgcgagttttgtttgttttgaagttggaacatcagaaaagaaaaacaattttctggagtagtagtagtctactatatccgcagcgtgagtgcgtgacgggtggggccagggttcatagacctggtctatacagggcaacggctagaaataagatagaggagacacacagacacaggaagagacaagaag

SEQ ID NO: 27696 - DNA, 1501 bp, Oryza sativa
taaaaggttagggactaaagtagctattctcccctctctttttttttcatgtgttatgtctacacgactgtttgaagcgtttctaattttcggcaggaattcaaaaagcgtggcatcataatcccgtgctttcaaattcccatgttccaaaagaaagagcgtgtccaatcatttgtttgaaagggccaaaattacactatgaatgaagcattttagtgctccctccgtttcatgttattaggggcacgtttggatccttggcaaaccaaatcctagccttaattagcttagcaaagcgaggtgtttggtagagcgattaaaaacttgctttgccaggcaatgtgggctataaccgcccaaaaaagcttgctcccggcggagagccaaatcggctctcccgagtgggcaagcgatcgtctggttgcaccaaaccctctgtgagtggctctttgtaatcatattaaaaatcatcaattagactgtttattcttctctaggctagagtccggccaatgcatatggatcgttttttcttcgcttgaggacttgcttactagtcaaatcatccattttactatcacatgagcatgcttatttgcccggcagaaccaaacaataagcctggctacttcgagctatagctcagccgggctaacttatcctcacccgactaagcaagatgggagaaagatccaaacgtagtagctgttttgactttggtcagagttaaactcattcaaatttgactaagtttatagataaatatagtaatatttacattaccaaattaattttattacattaataattaaatatatttttataatatatttatcttagataaaaaatattacttttttctataaacttgtcaaatttaaagcactttaactttgaccaaagtcaaaacattttataacctgaaacggagtgagtagtatacctcataggagttgtgggggtgcttcggagtacaattaatgcccagctaattaaaagcttaattctggttagcttagttatgtaacctagtaataaattattggcatgacaaatcgagttgccactactatctactgcaattacttcaatttactccattcgtctcacggtatataaaacataaaactagataagtaatttcctcaaacacgctcctgtcatgtacggtagggttaatttcctgaattgtaagggatttttttaatcgtaatatgatggatcccattgatcaatcctataattttttttcttttctctaccgtattcatttttcctttaccaccaaatatgcaaggtaggaatactctagaaagtgcccagctgtccctccctccctccgtccctccctcaattattaggacaagagacgcggaggcgctcatttcgaatccaaagcctccaggcgagggcggcgaaaccctaggctaggctagtcctctcccggaggccggagaagctacccgccggcggcgcgcccctccaccctcgccgtcgccca

SEQ ID NO: 27697 - DNA, 1501 bp, Oryza sativa
gtgtgcgcgtgtgcccgatcgagggatttagggtgcgtttagaaaatttttgaaacatccggtgggtgagctatttttgtgtgcggaccatttaacaggacttgttaagtggcccatatgcgaaaattgattttttttcgtgtggtcattttaaaaagccgcacgcgaaaatggagcacgtttttgcagacgtggccacttacggtccgtctgcaatataaaatgagtcccgtccagaaaaaatcattcctgtagtagtgatctacctctccgtacgtttcctcctccaattgattataaaattgattccctattactccctcatcattttccccttgatttcctcttacaattcggctttacttcacaagatttaatctctatttaacggttgtctttttattcccgtcgcttttccggttttttcatctgctttttccatcactattttttagtcacattttttggcacgcggtaaggattcagttttctttacccaattggtttttttccatcgttgggatttaatcttcagccgtcacccgggccaaaccctagcgccaccgccacattgatctgcctccatgtgtgtttactcttccaattgattacaaaattgatttcccactactccctcatcatttttcccttgatttcctcttgcaattcggttttacttcacccgatttgatctccatttaaaagttatcattcttatcccgagtttagaggattgctatgattttagcatcgtatgggcactttcgagattgaaaactatagttggttgtacgagttaggcctacagctttacttatgggctaagctaaaaagacttaggccaagcggagatagagatagcaaactacgctaggcttaaaaggaaataatgggctttcattccaaaaccaaggaagtaatataatattatatagcgatccaaaaattgttttacctgttacaacgcacgggtattttttctagtaatcaaaatacaaatctattggtgccatactatagcagtaatttaatttgtcagaattttgtgaaagttcgtcaaaatttgagtcaaatttgaaagtggtgtacaaaagtatcgaaaaatatccaagagtatacttatttttttaccccacatttaacaccgttaacaagaattaacggaacggaggcaaatgagtgatctgtttcgaaaaagtagggagaaaaactaaaaccctaaagactaggggcaaaatcaatattagcaagaacgaaattgccgcttttcactcttacgagtgttgataaagaatctgctaaaagaaaatacagatcgtcctaaaagcgacaaaaaaaaaaataaatgaccccaaattaaaacccactcacaccccactcccactctccgcttcggattcggaatttcggagagaagaggctctcgcggtctctccgccttggcctcactcaaaccctagcccgccaagaagccacccgccgccgagccgaccatcaccca

SEQ ID NO: 27698 - DNA, 1501 bp, Oryza sativa
atctccagtggtgaagaagaagaagaaaaagaagaagcgctgccgcaagatcgatcttctgtcatgtgatgaaattttgttttcgttcataagagagaaaaactctattagaaccgatgcaccttttgatctttgccatggctgtttgtgccgcaagatcgatcttctgtcatgtgatgaaattttattttcgttcaactgatgcaccttttgatctttgtcatggctgtttgtgacctgcagtgaacatcaaaatgctattggtggagatctaatgatttgactacaaaacaaattcgtggccaaaatattatttgaagaagtgaaagaaagaagtagcaaccgacaacacagcagatgtgacaagttgtcaaattgtgaaatgaattgttagattactatcataatataatgactatacatagtactgaatatccgatttgattttcttgctagagacaccaaatagtttggtagaaatgaatttagccaaaaaattggtaaaagatgaatattcagtttttactaaagcaaaatgcaagatgaaactgaatgcttatagtacatgtcagctgcatgcaatttcctgggcggttgttcatctaatcatcttagactctttcaagcaaattaaccgctctcacttttgactaaaccccgaaaatagataatagcagaaaggaaagaaaaggcataaaaattaatgtgtctacattaagcatttgtaacaaccacattctgaagtttggtgccactaaatgaacaaacctgaaggctgaagcttagactcatcacaagtctacaagcttgataaacatatcaaccattcaaacaacttcaattagaaacaacagggggaaatgaaggaatagggaggaattggatttttatcacctcgagcaccagcttcttactggacatttcgtcaaacatgtggcttgccctacattcccatcttccttggcccttgcatcaagagttggcaagaaaaattcaaaaaaaaaacaaaacaaaatagagagctgcatacggtgcggcaacggtgttggctagcagctgagtagaggcgggaggtgctggtgttggatgcagcagtggcggcgacaaggtcatggacgccgcgacggcctgggcggagcagagtcatggacggagcctgacttgcgctgcgatgcgcggaggtcgaggacggagacgcattgtgggcgtggacgacgatagggacagcatactccctccttcctaacggcctgtttggttggagggagtttttacaagggattgacggcttgtttggttggagggagtttttacaagcgattgggagttcagatggatgaggatattaagtgatttatttggttgggagacatgggaattttggtgggatggggatgaggaattgaggaagaaacttcctccttttcaatacctgggtaggggcaggtaattgggagggaattcctcctttactttgtctaagcaaatctcagccatccgt

SEQ ID NO: 27699 - DNA, 1501 bp, Oryza sativa
tcaattttattttttctcggacctttttacccctggttgcatcttctttcttctcctctcatcctatcttctttcttctctctccttcacttgcaaggaaccgagagaggaggcgacgacggcaccggcacgagtgagggaagcgggcccaacggcacaagcgcgcggaaggagggagccagcgcggaaggaggaggcggaggcggtgacaggtgtgcagaaagagggaggcggcggcgccggccgctggtgccgccaaggggaaaggagccgctgccggcgcacggagcaaggaaggcggcagtcccggcagtggagctcgagcggcgacgaggagtggcggcggatccggtgggagatgggcatgcgagctgccggcgtcctctcaccttcctgccggcgccgccttgccctctctttgcccaggcacaaccttggctctcgccgccgtcacctcgccttctccctccgagaagagagaagatgtagccaggggcaaaaaggtccgaggaaaaattaaatggatggaaaatgatttacatgtgcaagatatagcgaaaatggcattgtagtgaatgcccacagcttgaggatggcattcgagagaatcccattttgaggatggcattctagcgaagccagtttttaaggatggcacatatgtaaatagggagaggatggtgacggttgagggaattcggcggccgccagcgtgatttagggtacaagtggcggcggtggcggcggaggaggaccgaggagagcgaggcgacaactgctgagggggaggcggtaagggagaggattggagtgtcggcgctcggtgtggaggagacgacgcgtgcgcgaaagagagattggagcgtgatccgtaggagtgcaggaggagggcgatctagcctggaggttggtggcgtggtaatgtggcggagttgggggtggcgcggaggagaccaatgaggcggcggttagagtgcggtgtcggaggtggcagagggggaacatgagggcatgagggggagagaaaccagggaatagggcccgtgcgaatgacggggatggatgcgggggcgtgcgacgcgatctgaggcattggattcggcgatcgaacgattcacattccatgggtctgtctgggtgagcattcaaagaccaccactacgtcttttttaagtagtagagatttcttatacgactcctaattttccaaaagcgaaaaaacttaaaaactgactcaagtgcggatatgtatttctaaaagcgaatgaacttaaaaaccaacttatacacgaatgacatacaaaagtatcgacaaaaacatctatagtttttataaagaaaaagtacgaattaccccctgaaccattgggtgagtatgaattacccccctaaacatgaaaaccggacgtttttaccctcaactatcgataccggatgaacccccccgagcagttttgaaagcggttttggtctacgtggcagtccaattagcaatccatta

SEQ ID NO: 27700 - DNA, 1501 bp, Oryza sativa
gccgaacatacccttagtgtggagttgtagacgagcagtaatatacatgtctttttttattttacaaaatttaatatactatctccatttatttttatattttaagtcattttacaattgtactaagtcaaacatgttcaagtttgaccaaatttataaaaaaacagagcaacaatttcaacacaaaataaagatactacaaaatcccaatgcaactctgtttcataaaaaaaaaagccaatttctatggatgaaaacatgcacggttcagattcatctccctacagtgtctttctttagacggaaggagtatatatatagggcctgtttagatcccctcgcaagttttttcacctgttacatcgaatgtttggacgcatgcatgaagtattagatatcgataaaaaaactaattacacagattacgtgtaaattgcaagacgaatcttttaagcctaattgctttatgatttgacaatgttgtgctacatgaaacatttgctaatgatggattaattaggcttaataaattcatctcgcagtttagaggtggaatttggaatttgttttgttattagactacgtttaatacttccaatatgtgtctgtatatctgatgtgacacggcaacatttttcaccattgaatctaaacacaggcatagtcttgtaatatgaaagagagagaccaagttcttgaccgttcgatttatgtgttaggattgatggtcattcatgtcaaaatttatgcgtgtacgaggatccaatttgaagagagagacagttgtaacgcacaaaagtgaccaacctctcggcgagcctgtccttgaacgtgcggcggcggacggggcacaccaccggacggcctacctgcgtgacgacccagtaaacggtgtaccgtgtacatgacctccgccgcctccatccctacccacgccgccctcccctcgccgccggccggcatgtgcgtcgccctgtagtacagcaccagcagtttcccggcggccaccgtcgccgcctggaatggaatctgtacaccgccctgccgcccatattctccttcgccaacagccgccgtcgtcgtctacatcgccggccgatcagctgtcctctctctctctctctctctctctctctagcaaattaagctgcttatatgcgttttctctacagtgagcacttggctaacatatatatagctctcgatcactagctcatacgaatcatttgactatgcatatctgatgcaggaactatagtaaacgtgtaatgtcatgctacctcttatctgcatgtaggaacataatacccgaagttatatgtcacaggtcataatacctgatcacatgttcccaaaaaagaagttcctctgaattatatttttgaggaagagggagatgcctctcccttcctgtgaattatatgttctttttttcctgaacttctgttctaggcatctatatgctgatgatcattaacatgtgtgaaatattcaagagaat

SEQ ID NO: 27701 - DNA, 1501 bp, Oryza sativa
tcaaattattataactaggtatatactcacaatttgaaaattttgaaaaatttgagtgattttgtgcattagataccatggtgcccgggcaccatggtgccccatatgagtgtcctatatatatatatatatatatatatatatatatatatatatatatatattcagatgtactccctccggttccattttaattgacgttttggacaatgacacggtctacaaaatatatcttttgaccttacttttctattataatatatacaataaataaatgcatgtttatttttattatagtgctttaaaagaaaaatctatatatgttgttttagtttctttaaactaaatatttttaaagttattgatggtcaaagttataaaaatttgatctcaaccttgtcaaaaacgtcaattaatatagaatcgaagagagacgtaagacgttgaaccttactaacccagttatatttaacaccctagcaacagttcttgtcatgaaaaactgctgttaaggcgttaaatataatgttgtcacatcaacttcaacttgttgcctagagtttcctataaaaacgtgttgtctagagcttgactatactagtacgcatttgaaggggtattagagtttatttacgagacttacatcatatattagactgattaatttctcgatcagaagatgcatacgcacacaaacagcgaatacatgtcttaacatacgctaaaaagataatactaaagacatccttaacgtcattaaaatcctatgaagacgccctgacatacgtgtaatatactgtattagtaggcaccattaaattaatactagtgggtgaagttgtatacccatgactactctatcaccacaccgctcgtgcatcctcatgttgcattagacttgttaaaaaaacattcataatagtaagaaataatcagacgattataagtagcaacactctcattataattttaatataaagttatatataattgataagtaattttttaatgaaatcaagataattacattagggtcatacaaccatcttcaaatcattttcggcctctatataaataaggtcctcatcggttgtatatggcttgattatataagctgtaatggtttattagtgataaaaaataattatggataaaacttttcatatgtgtctttagtgacttaaaagccaatactgaaaaacaaactacattaaaaaaaacatcaaagtcgactccaaataaagtttcaaaatttaaactttggcagcggcttataagccatagaacaaacgatgaggccctcagatccatagggctcagaaaacaagcatctatacttctttaaatgttctcggtggtggtgtcgatccattctgccttcccaacgccaccaccatctgacatgtgggaccaaggtccaagccaccaactccaaggaggtctacacgagggcaatccatccaaacgtaccaggaacaattggattttgttgggatccaat

SEQ ID NO: 27702 - DNA, 1501 bp, Oryza sativa
ccactcctgaatccttagactttattttgtccaataaaaaatcaatggaggattcccaaaatctatatctaaattcattctctgaatttgttttttccgtcctaatatatatatatatatatatatataaactgaatatgacatatcctaatacaacgaatctggatatatctcagtctagatttgttgttttaggatatattccatccaatctcgttttgttttgacaatatagattttgggacggaagaagtagaagtagtagtagttggcacatagctaaagatttatcgtacttatatttaaaaaaaaactatgttcgtgaagtcgcaagatatatatcccataacgagtttaatatataggtttatgcacacaattgcatacaacatagtaaaaattaaattgacacctatgtgtctattctctttatcccaaaataaatcaatctaatacatgatgtgacactacctagcactatatatttaatctgatttatagtattagatagtgtcacatcatatatactataatagtttattgtgaaatggggagtaattttttaaaaaaagaggatgcagtaaaaaaaaataaaaaaaaggaggagttaacactatagaatcacaagggaactgaaggcaacatcgaacaaatcttttctttttataaagctaatatccactaaacatctaaaactcaacatgcaagcatagtatttattaccactcctaaaaacctgtatgcaagcataccacatcaacccattaaacacacatgcaagcatatagtaattatgtctacgatttatttcattctaaaactaaacatacacatgttaaatcatcattctcaaatcattttcataatattttaattcaaattatttcatcatttctctaatatctaacatatatcccgtaagaaagcacggagtattatctagttgagggaatgttgaaggcaaaatgtagtcaatcaaattaagggatattgtcatgtcacgtatgcatcactatgattaattcgtgcgcttaccccacacgatctatatatataaatatataatatacatatatgatccacgcgagacagcgagacaacaactgctaaacaaaacgggaaaaataaaatccgtatgtttgagaaatggagtctcttggtcatggaatcaatatcgatgcgtgtacacgtacgtgaaattcgtatgtagatgtggacacggtgatatataacagaatatcttcctgttctttttgtaccaccaaaaaaaatatattcggatgtgtgctagtgcatacgatattttttttaatctacggaatttgaaattaaattggagtcatatatatggcatattcgtatcgtctctgcatgctacacaactgtccttgcagccatatatatggcatattcgtatcgtctctgcatgccgacgatggtgactggcctactaccattaattagcaaataacactgcatattaaaaccattctacccaaac

SEQ ID NO: 27703 - DNA, 217 bp, Oryza sativa
actaggacatatatagttctagtcatatgtgagagctgatttaattgtggcctacctgttgattataaaaatctcgaagaattatgcttataaaaatgcacataccttgatcagtgcccattcttttgggatgcacagattgtgatgcacttttgactctgagaagtaagcagctggtgaccttggctcaatgttatatcttttgcagaatggtagc

SEQ ID NO: 27704 - DNA, 1501 bp, Oryza sativa
aacacagagggtctgtttggttgctaccctgagcaccaagcctgagaaatttgtatgcctgagaggcattcgagatgctcatgaagcttgcctggccaggccgcctgatgctttccttgtttggtttgccactcctgcctgagaggaaaaactgatgttgggcttgagattattactgctaatactgatgttagagccaatacggttggtcttgagaaattgagatgattagtgtagatgctaattgcagacacaaatcatagaagacaactgaaatccatggggaaaaaatggggaaaaaggggaaagagaaataagaaagaaatcctcaaatccaagcatgcaccaaattaaatattccatgatttctcccagccatgtaaagcgattcaatcaatgatatttctctcagacacacgcagagcacttactatcaacgaatcaaatgctagcagccatggtggcatcttctcgaggctgcagatctagcaaggcggccggactgcttcgtgcgtgaaatcctttgagacgacagcatcgagggcttagcccagcggcagggggcgagatgctttacgtagcggtgggtttagcatgttggtgatgactcacacgccggcgtcggaggcaaaaatggtggcggtgggggtcttcgcgcgacgccgccgcccgttttttcttagcgatactgcgcctggagctcaggcgaccgattttggtcgcctggttcaggctaatgacattacgtgtttgctcaggccaggcaagaggaaaacagactcagggtggcaaccaaataggaggtaatcgaactcaggctagatccaggccagactagttttgctcagggtagcaaccaaacagccccagagtccctggatgagatcgtttcacacatcgagtataggttttatgtccgtgtcaaagtaaaatttgaatttgaaatacggaggatgtatttaaagtatcctggccagttttccatgtaccgactaccttacctgcttggtaagggtcgtttataatagggccatgtccaatacaactaaaaataaaaactaaccattttatcccatcacgtaagataaaaggatgggtgtttataatatctgtgcttgattaagcatcgatccatacttagcaggtgcttatgtgttctaaatcttgtcaatatgactcgccagtttgtcatcaattttcagaaccttaccagcaataatatattaatatattaagtattacttcctccgtcccacaatacttatctttttagattgtttaatacaaattaagatttgagaagtaaaaactatattgcccgttctttaaatggaagtaagagtgtggtgagggtagaatgtgtaaaaatttaaattgaaggtgactgatgtgataagtagtactcttaagtaatagtaagtattgtgggataaaatttaaatttataaaataactaaactatttggggacagagaaagtagtatgtagatataactttaga

SEQ ID NO: 27705 - DNA, 851 bp, Oryza sativa
atttagataggtttaagccctcaatgagaggtaataccccactcctatttggggatttgaatctgccgagctatgtattgatctaataatatgattgtgaatctacccccaaagaggcatcctgccctccttatataagcgaaggagcagtcttacaagatagaaaattatcccaacgcggatcaactttcgtatatctaatatacaaacttcacatactaggactttattaaaaaaagaataagtacataaaaaagggaaattacaacaaagagatccaattaagaaatgctccctccgtttcaaaatgtttgaaaccgttgactttttagcacatgttttaccgttcatcttattcaaaaaatttgtaaaatatgtaaaactatatgtgtacatgaaagtatattggacaatgaatcaaataatatgaaaagaataaataattacttaaattttttgaataagacgaatggtcaaacacgtactaaaaagtcaacggtgtcaaacattttgaaacggagggagtacatctttgtatatctcattcagccgaaacaacaacatgaggagatccgccttaaggagctgccccatgaatctaaggagggggctttatgatcaaagatgaaaccattcctttgcctccaaatattccaagccccataaagaaatttttttcatgaaacaatggccttcgtaacagtttctcgagtgcaccaacatattgtccaggctcaaagatgtgtcccaagagataccaagaacataccagcatgacgttgcaaagggacactgtaaaaagagatgcaatctcaaggtggtgaattaggtcatgatcatctgataggtat

SEQ ID NO: 27706 - DNA, 942 bp, Oryza sativa
tcatatccctgtatgaagtataccaagcttagagcgaaacgttgactgcacatccagtgggcgtagctatccttaatcctttacataactgtgcaattaatcttgagttaagagctaagatatatatcatgttttgactccatatttacaatgctacagcagaaaacttgtgtggagcgccatacattttatctagagacaatcatcaaactcaataagaattagagatgctagagacgctttgtgacaccaccttgcctcaagaattaattttctatgtatacataatgagaaaagatacattttactatagtgtagactttgaggttttagctactcgatagggaaaaactcctgttttggaacaaagcacccttagtagcccacagcagccggatatggcacttccttggcctatagccgtaagatctagtgctccctcaaggcccggccggtggcatagttgcctaccgagccggctgcgaaaacgcacaaacgcacactctacctctataagcaccttcaaaagattggccggcatattctgaaattgacggagtcatcacgagcgtaacacgtcatctatcaccgaaagaataattagccgtaaatgtgaacacctgtgtcaaatctagaatttcaacctaggtgagttattccacgggaaggaacatttcagtcatgcatatgaaaatttttgtacttccttgcgtagttgtgcatacccatgggtgccaacactactacaaaacccttaataggtgttagcaaaaccgacacctataaaccatttaccaccctcacgggaaaaggctcataggaaaccttcggcaactataggtgcaagttctatagtaaaaatcaataccaatatcataggtgtcagttttttaattaaccggcactaaaaaaccgagccaataatttttcattgtaaaatag

SEQ ID NO: 27707 - DNA, 503 bp, Oryza sativa
aattgagtattgtagtcttaattacacttagcatatacgcacgaaacacttagcatacattactattttagtcttaggcatgtaatattatttgagttttaatataatattactttatttggtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 27708 - DNA, 1212 bp, Oryza sativa
actatcggtccttaaacttgtcatgaggtttcactttggtccacgaacttgcaaatcatacatcgaggtccctaaacttgatttgttgtatcatctcggtccaaagcgtcctttgaccatggtcttgcctatgtggtacgccacgtgaacaatgacatggcattttttctttttcccccttttctttttctcctcctcttcttttatcttcttcctctactggagccacctcaagctccctcgtgccgaccaccactgtcatcaccaagcgtcgctgctgtcggaggaagaggccatagaagagagaaatggaagagaaagaagggagaaaaaaagaaaataataataataatgtgcgatgtcgtcgtctacatggcatgccacataggcaagaccacggtcaaatgagactttggaccggaaagacataataaaccaagtttagggacctcgatacatacactaaagatgatctttagtcccggttaaaaagggtaacgggcatatttgatctttagtcccggttggtaaaagatcatctttagtcccggttcaaatgctgtcagggcttgttaagcccctcgggatctttagccccggttcataacaccaaccgggactaaagtcccacccctgtatatatgtcttcttcctcctccaccccgagcaagcttcaaaatttcttcaaaaaagaggggaggtcatgccaaaatttctagtgaatttattttggtgattatatacaaatcacggtgcctaaaagcttagtaacttcatcctccaatgtttttttgtcatattacatttggagctatgttttgcacacttttttgtctccaaaattttgttgtaagttgatgagagagaaaatttgtgtggggaagaaagaatatatagaaatttagtttatttgctaaagaaggttttataaaatagttgagaaggaaaatatagtgaaagttaatattaaataatagaaaacaaactaaaatgaaaactaaaagaagtacaacacattaatattagtttaaaactttagaaatagtaaataagaattatttggtgtaatattttataatttttgtatgaataatgatatgtcattactgtacgagtgttgaaagagtttgtaactattttatcattattgtatgactgttattattgtacgaataattatttgtgtacgattttttttcatttcatgtagat

SEQ ID NO: 27709 - DNA, 638 bp, Oryza sativa
ctcctatatccgaaggttgtttccgtataagacatggatgtggtgggtcctgccgagatttagtcaactactattaggtatgtgttatccataaccctgacaaattccccctttatttacattgacaattcaccataagtcacttataagatattttcacaaatacctatactccattataaagcaccattacaaagctatttaaagtgtctttatctctactataataaaaagaagatatttttccggtattttggtacgtcatccgtgtatgagtcggtttttaagtttgtttgcttttgggaataaatatccgtatttgagtctgttttttaagaccattcacttttggtaatacaaaaggaatcatataagaaatttgtttaaaaaaactcgtatgctaacttgagacgatcggactcctaactgcagctcatgattttctaaaaatatatatatatacatacgatctcccacggtgaatttcatcttaactaaaccatataacaataataagattaaaataaacttcacccgttgcaacgcacaagcgttttttctatagaaataaaaaaaaggccttacaaagacattttgttcatttgttgtactgtggtccttgctgtccctgcggcaga

SEQ ID NO: 27710 - DNA, 256 bp, Oryza sativa
ttcgcaggtgcataataagattggtaggtgtaaattaaagatgagaggatcaatctgacaagcattggaacacatacatcaaatacatttttttacttatagtgtcatataactgattctcaagcctcaatgtacagtgctatatgtgagatgatcgaagatgtcagagtgttcactagtacaaaactacatatctgtgacagcctatcccgtgtttggtctttcgcactgtcacaacgtcgtcatctttaatagg

SEQ ID NO: 27711 - DNA, 487 bp, Oryza sativa
tatgaaacttacagtcgttactacatcttgtagtaacgatattatgtgattgcagtaacgcatagcagatcagcagtgatacttatgatatagaattactcctcgtggagagtcaaatttataaaaaaccaatctttaaagggtagtatctctcacatcatgtactacttttaaaaaccgtttggaccatgatgttagaaaaaagtgcttatcaaaagtagatccgtcatgactatattatgactatatttcaatattgttactgcacgtaagacatggtgttactgcacgatgaacatcgcgttactacgttgttctgagacgagagttgagaagagtggaggtggtggagaaaatgaagggcgggtttgaccgaggtgggggagctttgactgaggtgtggagtgggttttgccccctgcagggagggaaggtgggttggagggaggggggcctattctataccctgggtgtagaatagtttttc

SEQ ID NO: 27712 - DNA, 816 bp, Oryza sativa
aacagatatatgtaaattgtgtgaacaatgttactaacactttgtcggatgaagaaatgacaacaataaaagttatagatcttgataagttatacaactttgttgttgacaattttttcatttgaaatcatttagtatttgaaaatgttgtttgaagttgtcatattttcaaattcaaattcaagttatatagaaaaatgaccaaaataaaagttgtaaatcttgataagttatacaactttgttgttgaaaatttttccatttgaaatcatttactacccaaaaaattattttgactaataaaatgttattatactgcagttaattcttttgctactggtcaactcacaaatataaacatttcatatgaaaagttgaaaaatactaagtcatctcaatcgggcattagttattatctcaataggtcacggatgagtcatctgtgacgggcctagttgttatctcaattgggccccaagttggtgctcatcacggatgatggtcatccatgaagggcgtcaacttgaggtctgattgagatatggaatgttatctcaatcgggcctaaactaagacccatcacggataggagttaaccgtgacgggcgctaacttgaggcccgattgagatatgatttcatatctcaatcgggcctaaactacggcctgtcacggataggtgttattagtgacgggcctgagttttatgcctatctaacgtgtctatgcgaccatatatcaatcggacgctttttcggcccgattgaggtgacttctttgtgacggcccgctttttcggcatgtgagaggccgtca

SEQ ID NO: 27713 - DNA, 177 bp, Oryza sativa
gctgcacaccaaggacataccgatgaccaagccctaccagcgtcggcctacccacgccgtccttgcgcgaatcgcgtccgccgtcgtcctttgccggcctgaccacgccggcccgagaccattccggcacccattgcagtccgccaccacgaccgcgcccattgtcgtcctggggtc

SEQ ID NO: 27714 - DNA, 1451 bp, Oryza sativa
aataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagcccaactagtcaagttataataacccaaggtatcaaggaataaagtaatcaatgcaaattggccataacaaaggaacagattcacaccacccagtgacattcaaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacataaaacgtaaataaacatgtagatcataatgttagatgaattatgagacttgaacggcctcattctgacttcaaataaatttattatgaattttacaagattaaatctatttaaagcccatttaaaaagaattaaataaatttaattcaatttatggataattttaatatgtagatctttattttatacaacttttgcatcttgaaccacattaaactgagctaagatgaattagttatgaatttttaaagattaaatcggattaaaacacttatatggattttaattgaattatgacgcaataatgaattatttttgaaaaggaaaaggaggattattgcgtcagcggctagggtttgcggtggaccaggggcacggcggcggttcaagggaacggacggccgagatcaaccctatccaaaacggactgccgagatcgaacggtccacgaccggctcacggggaacggcaacgatgacgtcagcga

SEQ ID NO: 27715 - DNA, 238 bp, Oryza sativa
tcaggggagtaacggctctcgttgccgcggccaccagcacaaactcagtcgatgcactagaatatatttggtgtccatgccataattttaaaaattgggcaagaaagacagacaacttccagctcagcgggtccattcacatctccttacaaagggttttatggacaacttccttggcgaggaggagcaaggggagggaagtgccggcaactgtcacgggcatgatgcagatgtcggc

SEQ ID NO: 27716 - DNA, 1501 bp, Oryza sativa
gatcgcagcagagggggccgtggtggtggtggaggaggctcgttggccccctccctctcggcgaccctcccccttctcctacagatccagagatggcggcggtggagaagactgcgggcgaggtggtggccgacgcagaggctggtgcggcgaggtggtggcggcggcgacggtggtggtggaggcttgcgagcatagtacaaaaaaccaggccagaggttgacccgctctggccgtcggttcaccggtcgaactgccggattttatttatttatattatatttgatttgccttattttaaatatagaaccatcacaaattggtgaaaatatgcataaacaaacaagtatatcttttattatatggccacaacataaaaataaaataaatgtagtgtggtaacataataaattcatagtcatagaacaaattaaaaaccggttcatttcttaaaaaccgccactggttcactggttcccatgaaactgtctggttcagcgtttttgaccggttcgattgcagggacggtctttttgctaaaccgagccgccaaggttgtgccagttccggtttttttccagttcaaccgctagtccggccccctttttttttttttactatgcccccagcgcggcgtggggtggcggccggcacagcgcgtaggccggcgcggtgaggtggcggcgcagtcgccggatcggctccatcggcgatttttaaaaagaaaatactataggtgctggttgtgggtgaagaaccggcacctatattctctataggtgctggttctaaaaccggcacctatatctatgagtattaatgccgaccaatagatgtcggccgaaaaccagcacctataatgatttatgtactagtgccaccatcgatcccccacacctccacaatcgagcagagagcaggataagaccaagacgagcgtataggggtgcgtggagcgagggcatgagaaggaagagcagcggaacggagcgaactgggacgcaaggggtatcgtcctgatgcatggggacgggatcccggtgtatagttttcccgttattttttgaccgagggcaagaaataaatggccagatgcggaagtcttgttttcgcaatggacaatggtaagtcgttactcgttaattggcagcagaagcgaaggatatgaaagttgaaactagctagccagctacgtacgactcgattgaatacacctacgtcgttgaaatagagaatacgacgttctagtagccacttttgcagtaacaagcaacctctcaccttagtcagctagctagcgcatgttaatttgcagatatcggaagcaatcaacttgagcagtacatgtagatgtagtattcgtactgcctgtgttcgctgttgctagctctctcgacgagatgacaacgaggtatccatgcatgcagctagctcagtagataagggaggtagctactacgttgcagcactatagccctagctatagcttggcagctactaa

SEQ ID NO: 27717 - DNA, 338 bp, Oryza sativa
ccccgtgcgtgcagtgtgaccgtgccagtacatgcagccgttgcaccaacttccactgttactactagctaaggagtagtagagagtactgtagtaaaggttttctgcgagaattcgttgacaaattaaatccatcatcaacttctacatgaagcacgcactgtacatagcggtggaactagtggagtgcatgtacgagagacatcatgggcaactaatctcgcgcgctaaaacattttgtatagatcggttggttgttaatgcgagtgacacatgtgattgctcaaccagacatgcaaattaaatccactgttccaatcacaaatcatcaatacaga

SEQ ID NO: 27718 - DNA, 582 bp, Oryza sativa
accgggtaaaggcagacggtgagccgtggtgagtattagaatttgatgggataggcccaatttaattgtagtatttttaatgaaaccaaaattaatgttaagggattaatatcatcttaaaaccaatgagaagggacctagacttaaataagctacaaatggatagcacctattgatagggtggtggtaggactgccacacacgcgtgcgcgctgagctaagctggggacggggacgggacgggagggctttcttgccttcccctgtttcctctgctggcaatgtcaaccagtaccaggaatggcggcaatgaatgagaaaacggtggcaaaggaggagagaacggccacaacaacggaggcaacaacaacaatgccttatctggatccaaagcgttctccgagcatgttgttctattcactttagtattgaatatgttagtagatgatgctattcctgttattaatatgttcatatttagaactatcactagatcatccttttattcacatgtcatatttattatcttatttttctgtattaaaatttacaagactacatttccaatagtgaggtaggcga

SEQ ID NO: 27719 - DNA, 300 bp, Oryza sativa
cagaaatgtgtacccctaaactcactcaaaccgttcaccggaggtcccttggcaatatttttgcccggttttgctgacgtggcatcatagtcagcaaaaaaaattttaaaaaacacgtggggcccacatgtcagccgcacatctttttcttcttctctttcctcttctcttttcttttcttttctctctcttctcttctccttcaggctgcggacggaggagccgcgcgccgtggccgccgtcgtcatcggctctctaccgtcgtcgtcgccatgggcgaggctacgcggtgcggtcgtc

SEQ ID NO: 27720 - DNA, 1501 bp, Oryza sativa
atattgcaaattaaatacattgagaatttgagatatgttgctagctaccagaattacatgagtacatgttgatatatcacaaacccagttgcccagtttagtttaataatcaaacactatatgtgcatgcttcagctcactgacaactaatttactatatgtggattaaccatttctctcgctcaggcaccaaaccatgcatggcgatgcctttttataggaacgtgcataagcagtatacatcatttattattccttccatttaataatgtaaaactttctagcattgtttacattcatatatatatttagatttattaatatctatatgaatatggacaatgttaaaatggcttatattatgaaacggaggaagtatactattaagatcgcgaaatctatttcgagagcgttctcggtttagctctatagcacgacgcatctgagagccgtctaactgtgcacgtcgtcatgatgtccatccacggggatgtctttttcctttcaaataaagttcacgtgggtgcctttttcttgttcaaataaagtttcctctcaaattacttatctgatctacaatccgattacgctattatgttcgttacaattaaatcttcacttacgatgaaaaaaaaattatatttgtaaattacttttattatatacataagttacttttatcatatatatatataagttacttttagatttgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaaggggggggtacaaggggataataataggggttaggttttgcagtaaacagcatttaaaagtcacttagttgcccaaagccattttgtaaagacgatcctagagctacacagtattattaaacaaggccgtgaaccctcacgaacctgccttaacccaaggcctacgatagtttggaccgaactggcaacccgacctgggttccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcct

SEQ ID NO: 27721 - DNA, 263 bp, Oryza sativa
caaacagctgcctcgagccgtgcgacttgtccttatctcctcctccccttattttctcaacctctccccctcctctcctccctcctccccctcccccctcctctgacgacggtgacagcgggcggcggccttccctccaccagatccgatgggaggggaggccaggcagtgaccggcggaagcgaccgtggcggcacatgaggcagcagcaggcagaggcgacagacgggcggctagcgggcggtggcgtcccctctgccaga

SEQ ID NO: 27722 - DNA, 1175 bp, Oryza sativa
aaccattacaggcaagatgttgtgtgaagaagggcaaacatgcacgttgctaagctgacacgcggtggacaagaatgaccgattggtgaccggtctgacactgctcatgtcgtcagcgcacagccacgttcccacgacgcgcctgcccccggcagaagtggaggtaggtatgtgccgtcccatcagaaggacgttcggagggcaaccgtgcaaatctccgtccatttattgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggggggtacaagggaataataataggggttaggttttgcagtaaacagcatttaaaagtcacttagttgcccaaagccattttgtaaagacgatcctagagctacacagtattattaaacaaggccgtgaaccctcacgagcctgccttaacccaaggcctacgatgatttggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctgcctacggccgggatacccgggacaggcaggcagaactgagcccctagcattgggcaccaaccctccgccgtatgacatctcgactaccgggccgcagctcgtgtagccttcatttgccctggaga

SEQ ID NO: 27723 - DNA, 177 bp, Oryza sativa
agtgaattgcactttagggcaggttttattacccaagttgtaaattggaccagctatcagcagatcttttcacttttgaccgggttttattactgaactttgcatttttaaccagtggcccacacatcaatatcaaatagtgttcttcctctcctctcctccctaatcacggccagc

SEQ ID NO: 27724 - DNA, 366 bp, Oryza sativa
cacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacacacgcctcgccccatcccgtcaggacgagggcttctaggcactcgtccccagctggagctagcgtgttacctcccagagatggcacgttagtcctggtcagatatatgccaggcttcatcctaaccattacaggcaagatattgtatgaagaagggcgaacatgcagatggataaactgacgcgtggtggacaagaatgaccgatttgtgaccggtctgacactggtca

SEQ ID NO: 27725 - DNA, 485 bp, Oryza sativa
atagtttaaaacagtagatgcaaaataaaaaccaaatagatgcaaaaataaaaaccgaaaaagtttaaacaaaaacggaagcaaaaccaaaaaggataaagtttaaaacagtagatgcaaaacaaaaaccgagaaagattaaaacagtagatgcaagataaaaaccaaaaagcagaaagaaaaccgagaaagtttaaagaaaaacagctcaactaaattatcagagccaggtttcgatcctgggacctgtgggttatgggcccaccacgcttccgctgcgccactctgatgttgttggtatgattctttcacaaacttattagatgtcgaaaatattaatgggccttgaccaggacggcccaaaaactaagaaactactcatacagccacgcaggtagaataacaacgacaaataattctcagtattcagtaagacttaacacgatacactctgacagtctacaagttaatctcttggttgcagc

SEQ ID NO: 27726 - DNA, 646 bp, Oryza sativa
tagtcattcattcggatcggatctttataattagctcagtctagggttttagtaatattttattcggagtttattcgaaagtcagtcgggaatttatcgggtgatatgcattaggtcgtgtctatgttcaatggggcaattttatgcatattattataactatgcatctattttatgcattaagttattgtttagtcagttgcatttgtttctttatctgggttcacgaaaaatgttctatgcatagaaatcaccatgctcggttattcatttgagtcatttgttgccatgtttaatttggatttgagcatgccttggttgctatcccttgtccatcttaggtgtcaaacctgttcactgatcgcaagcgccgctccgagcttcagagtcactgcctttagcttcgtcgccttcttagttttgtttgcttgctagtttccgtgtttaggtttgttgcttgttggttagtcggcggtcgatatcatgtgtgagtggtatggctaccttaattaggagttgtttgcttccttttcagtgtttcaatcaagattaagataattgcacttaaatttataagaaagattagtttctaagcctcctgtttttcttccttttctcatatttctacccaatcccctctagatgg

SEQ ID NO: 27727 - DNA, 692 bp, Oryza sativa
ttaactgcaagggtgccaccagcaaaatcatgcacccacagcccaacattcagtgtattttaattaactaacaccattgcggtggcacaaatccaaagctatgctaatagtcaaagtatatgtaataatgtgatctccatttgtgtactagttgaactaagcacggctaagcatttcctaaaccaacatgtaatcattttgatacccaagttatcaatggcatatggtaaacaatatatggctgagtaataggacccataccacatgacattgtaaaagaatgcaacatttaatagaaatacgggatatttgtaaattgagtataatatgatcaaatgtaatgcatcactttccttgctctcgcactgatgagacctcagcaacgtcttcgagaaaccgtggatcgacgaaacggccgaaatgctataagactactgaaacaggaaacaaaaccatttttaataaattctagggatttttatgaatttactgagacttgaatagacttaatcggagctcggatgaattagttatgattttaagaagataaactttttttattaataaaggaaaatccttattcgatttattgcgcaatattgccccagggctgacgtcatcaaaggaggggggcgccgacaggtgggccccgcacgtcagcggcttgagagagagagggaggagcgccggca

SEQ ID NO: 27728 - DNA, 1052 bp, Oryza sativa
ccaaggatcggttggcggctcgcgaagcgaaagaaggaggaggcagttttcaattttcacacgactgcagcgccccaccctttcctactctttttatttccccacttgtcttcccccgtgcggcgccacacctcttctcatcttctcctcctatcaactccctctctctccaccgctccgcttgcctcggatcgcgctcgcgctcgcgcggagcagcgcccccaacgacgggcatggccggtgacagcggcaacagcgacggcggtagcaaccgggatgaggaggtccagatacagatcgcaggtcaatcaaatctttcccccccttcctctgtcgaaagcctcactgtttagctatgtccgattttcttcgttgagggagtgggggtgaggaggttagagtcgtcttgcgatgggcggcggtaaacgcagatgaaatgaactcgttcgttctctcgggcttatttggtgttcgatggtgtggggaagtaagcccgcgaggtgttcgatgaattgccttctcgtgcgtggcgtgttggatatggccatatgcccatatgggatttgttttttgtttatagaccatattaacttttcagactatcgtgacatcatcgagtggcagagtaggcatgtgagtttaattggcaaacccctgttgttcgcgtacatgagctggataagtggttgatgatagcaccagctatagtaatgcactgcatttaacaaaagtaaaatctttatattagtttttttatattagtgcaggatttccctgagattccaagtaactcgctttcatttgatagtttcaccaatggacaatactgtaaggatggagctatagtcttgtgttgctcgactttctctcaataaatttagagcttttggggtttatatggccaattgttggggggaaaaaaaggagaggagggtttcacttcactatgggaactttggtagtctattttgaataggaaaagaaagtttcagttggccgtgctatgcttaacacatgaagtttgggctaacctgttgatactgcctaccttc

SEQ ID NO: 27729 - DNA, 411 bp, Oryza sativa
catgtggtcgtacttgtcttatgttcggatgaaaatccaaggaaacggtccttaagtgcaagagcggaaaaccgtacacccggtacgttccccggtccgcggttttggaaattcatttagttcgcaagcaccgacccaggtgtcgggttttccaagtcttttgtaaaacccaagttttacccaagttgtttttcaaattttaagtttgaaggcgaccgtcgatactcgcacagagtgcacgaatatcgaggcgcaactagatggttacaagggaacatggtataacaattaacaaaggaaggatcaaatgcaacaaactaggtaggtctgccaatctgccttgcagacgggacaaacagattaagtgcgatcctatcaatgcataatatttttcaagcaacataattaagt

SEQ ID NO: 27730 - DNA, 185 bp, Oryza sativa
tttctaaaatggttactgatctttctccctctttcaaaattgtagatggcagtgaacgccagcttcagttcccacggttttggtgagggtcaccacgttgctcagcttcgtgacctcgcccgctttgttggcttctcgtgtccggagtacacggggtactccgtggaccgtgttccccctcgttg

SEQ ID NO: 27731 - DNA, 600 bp, Oryza sativa
aggtgattaccatcaaagtgggatctcatgatatgccaataccttctggagatggagttgggaagtcatcaagcaacaaatccgaaattgggaccagctcatcgcagttggccggtctaaccaggccctctggccggtctgaccgtagctctgcggaccggtcagaccgggccatcaggccggtctgaccaccgacccaatgtcggtctgaccggcgcttctagccggtctgaccggtggtctacgtccggtttgaccgggcttcaacgccggtttgacaggaggtttgaaaggagtagtgcaggggcttcattgtcttcaagcaaaatcaatagggggcattatttacctcctggaacagagccgaaacctaggtggatccctaaggatttaacggctactcaaaggagaaggttgcagcatcttcgggcccaagagataagagagaaaaaggccgaagagcaaagagataagaggttcaatgaattgcgaccaccaccttttggaggcataaatccgtagagagggaagaaccggttgttgtagaggagaaagaagaacaatcggttgctaaagatgagtcatctccaaaggaggaca

SEQ ID NO: 27732 - DNA, 341 bp, Oryza sativa
ttaactaactaactaacaaacaaatggttaattgaccactgatatcttttaaaccgttcgatcaagttggatgggactaatatatttaaatttaccgtgtaacatactttactaatattacttgtagatttatttataaaacaagagtagtcgaactaaaacaatgataagttaaattttgagaattgttactatgaaacagagaaattagaagaaattcagaaagagaaagagggagaaggagagcatgtagtatgatgattgcacatgtgcagtgcaggtgcagggccccagtgtcatctcctgcacttcacttgtgccatcctcttcacttgtgcagt

SEQ ID NO: 27733 - DNA, 887 bp, Oryza sativa
tatttaacttcttttgtgtttttcatttaaaaatatagttggttaaattaaggtgtttcttgatttggttttaatttaaaaaccttctttagactaagattcttttattcaaatttagtttgaaaactctttctatttttttatgaattatggtcaaagaaacattcccatactgtcctagaacctaaaacaaagtaattccaattttattataattaattgttagcccattctttgttcttaaacccatcctttgattctcgatccaaatgtccaaattcctccttttgatctagccaccaatttaattcctgtggcttgatttcctcttcggcacaagaatagtattattgtaaatattgtgaataattgctcttgtgctaagaaaatagcaatttatattcttcactcaactttccctattagccacaaataattcttcaaatacttctactatcaaatttaggattcaaatcctatttattttacctccaaccattctcctccaaacatatatatacattgaggaattatattgttaattcccctctcatttgagtgcattaaattccaccatattccacttccaaaaatattgcactcaaattagaaaatatctgttttggaaattagatccaaatataatttcctttcaaccttccctattcaaattatctccaaatatattttcctttcaaaatcttctattcaaatccctttcaaaattgagaaaccaattctacctaaattgggccgaaattctttttctccttcggcccaagccggcccaatacccagccgagccgccaacttgcaccgtgccgtgttcgtcctccgccgctgctgtgccttaccctcctcctccgccgttttctccttctctaaga

SEQ ID NO: 27734 - DNA, 181 bp, Oryza sativa
cactgtctcatccgtgtcgtttgagaagcactcacttagttgttttcagaaaagagttcaaataaaatcaattgcaaaaacagcagccctttctttgtagcctgcattaaacacttatttcccatggcttgctgagtactcccgtactcacccttgctctatataaataatcccccccagt

SEQ ID NO: 27735 - DNA, 393 bp, Oryza sativa
cggcgtcaaatatttaagtaaggagggagtatattatttgccgtattgatttcaactttcaagtcgtgtacaacgaacgagttgtctagtgttttaccctgatcgtttgagacatggctgataagtcatggaaaaatgagcgaaagcaaccgaatataatttatggtgatgattttattttatatatgtgtgttgtttgtgttttagaaagcaatgctggaaaatagactataatggaataaaaactgaaatcaacgttttataatttagattttagctggtgcctgttttaacagtcataaccggaagtggttcttgccatccattcatgcatgaacgtgatttgctccttttgctacagtccaattctattccttttttttttgctaatcc

SEQ ID NO: 27736 - DNA, 1501 bp, Oryza sativa
atgttcgacctcaagcacaatctttatttattaacctgagcttaaccttgagtagatttggaggggagtaaaataaaagaagtatattagtcatgcgacctaacttgagtgatatgattgactcatagatatactcctactcaagcaagtcagcaacgcctattagagcaggtacaataacagactataagccagctgcaaatatattttaaggagataaatcaggagagagaagagcagcgggctacagatttgtaaccagctgtagcacggacttcaagacgcagtgtgtctatgacaggtgggactaggtattaatagtatagtatgtaactattgtataaataagctattagattagctatagattaattggagctagtagttggctatactattgaacttgctcttagtgcatagctcaaggcatcataaatatgttaccactatcagtgctaaaatgtggtggtggtgggtgtatagctcaacttacgacatcataaatacgtggggaggcaaccgatgaggagtgagaactgagaacattaatacttattactcacctgatggcatcttttcctccatgaagaggaaagaatgtaagcacagagaagagccgtagaaaagcaggatgggatcaatattatgattgaaattgaaccttttatgaaattaactaatctaaaataaaaatattctataagaataagtagcctaaaataaatttactaaaaataaaacgttccatcatattattttgtttcaaaacagacaactcttttgtcttgcttgaaaaggctcaagatgatggcctcatgttgatgaaaaaaatacacacactgatctaagagatttgcttagcttcagtgcaggtccaaggaccaaatttcactgttaacaccccatccattttttcaatgccaaccaaaaatgatttactcctaccttaatgcgtttagtctgagttaaaaccttcgatgaatttcagaatttgaataagtactcttctaaagtgtacaactcagaatttagaattcttttaatgcaatgccaaaacacgccatctattttagaaaaaaattaatttttaataatgaatttggatgagcacttatccggattcctcctcaatatttgtaatttccctttttttcttaatggagtactcctgcagagatcccggtataggtgtacaactccatacataaatgccacgtcgcattcagtatgtggggcccacaacgccatagccgccgggcccattccctgccactctgccagtgcccaccacgaaaaaagaattgaaaaaaaacactgtaaaaaaagaagcctttttcccctcataaaacaagtttttttccctctctctttagtctcagaagaaaaaaagaagtttttttcccctctctctgagtctcaaaaaaaaaaaaagaagtgttttttttcctctctctctgagtctcagaggctccccgcgcgcggagccggagaggcggagagc

SEQ ID NO: 27737 - DNA, 1501 bp, Oryza sativa
catcccacacaagttaagaattttgagtctagccaagtgtaatacacgtcccggtactcaataaccgcgagcacggctattcgaatagatttagtttactcacactgcagtggatgtacactttacccgcactccgcgactgcccaacacatgagcctcgtcccaacacatgagacgcgtcacggcaaagcttttcgataacctcgccttggcagtacccgctccatgaacttaaatcctcatgcactctagacgtccatgtttctagcagtgagaggagttctggcgctcccgggaaagagaagtctcacactctcattaagttagtttctctctcacacactcatggcagccctaccaatggtgacactgatgtagggcacgcttctcggccctacctcaacggctgtcccaccgtagcgcacctgcctcactcaggggtgaaccatctatgcagggatactgcctccgcacggctatctaatccgctaggtctatacccatacgagaagtgcggttgtatgggggtcgtttcatgcttaacttcatggctcggtccttaattgaccggggacggtactagccttttccagataccacccaaatcctccgtccgccccagtcgaaaacagttgttttcactttattttcctttcacaaatcatgtcatcaatttcatggcaatgtggcgctcatgtctccacatgccgcatctcaattaccttcccaaaggtaattgcccaagcatatagcatttgataaatatgagtatgcatgattctagaatagcatttctaagcaattgtcataattgactagggactcatacgtaaacatggttacgaaggaataaggggtaaacaataatcaaggcatggcataatcacaagtaggatgttcatcattgcatgtaattttatttgtaaacaaaataatttcgcaattgggaccaacatgttcaaggaatagtgatgacttgcctgcttaggataatttgatcaaccttcacctcctggaagttgcagacgttgcctcacgactaaccgatacacaaggtctataatacgcgagaaaaaccaatattcaaacaacaagcaaatatgcacaagcaaaagataattgttggggtcgatcctggggttgctcatactattcgtgtttgctaatggatttcaatcatgctagggctaaggcttcttaatctttctattgtcatcgtggtctatttaggagttaaccaacatagcatttatgggatacatatatatttggctaatcggcgatttattctatcaaatggctatggaaggattatggctatatatgcatctatctaaatagcacggttacataccaaaggttctgttgttagatggatttgggatcaagcaattaatcgcagggaaccatttgtattattattttattgatggaggctttgctttaattatgaaaatattttacttgtcacaataaattagaaaaggttaataattatcca

SEQ ID NO: 27738 - DNA, 1501 bp, Oryza sativa
tctcgcgcccgcttcttcaacagctcggcctgctccttggtgagtgggtccgtggtgcataggtacacggactcgttcacgttgactcggaaccggtatggcgaattgtcgatctgatcacccatgaggatctcgccgaggttctcggcgctcttcttgacgccttccgggggcttacagtagggcaagctgtagtagctgaagggcaactcagtctcaatggaggtgagcgagttgaccttggctgagatcacctcatttggggtgtaggtgtgcatgaatgtgcccgggaggtagaagccattggcaccaccgtgcaggctcacgagaacgacgagcaagtaagccaagatccatcggcacgactgcatcttggcaagcattccaccccctgcgacgatcaatccaacaacactcaaatcaatcaatttggttcttgaaacctcaaaccatttatactctcctaatctcatcttatacatatacataaaaataaaataaaatcgaatcttcgtatcacaaaccgaagtaaaacgcgtaacaaggggcggatccaaacatatttttttgggggaaaagaacaaactgctactacttggtcaaagaaaatggctgcttccagatctaggaggagaagctaagggttaacgcaaacaaattcgagacgaaagtgggtggagataaagagagatggatgagaaaagaggatccggatccataccaggatgtggcggaagcagccgcgcgccctgctctgctcgcgagatgcaaaatcggcggcaggaagtgggcaaagaaggagccgagacgagcgcggagacggggataaatataagatcctcgatgaacgctgagatttttagtttttcttttttctgttccacccttgggcacgattaaattaaattaaagtaatttatttaggttaaggtccacgttatgccaagaccaatagcgaattcacataaaaatataggtgggtccatacttagtatcagtagaaaccaaagtaagtatagcttaactcgttaggttcctgtggtgaaaccaacccatccgaattgtatttatgcctaattattcttttagtgatagacgatgtatatgtggtgacttcattaatcttaagatatgccgactcaatcttcggaagatgctcaaagaggtagggtgtgtgcatttatatggatgagtacgcgcgtattgtgagcgtttacgattgtaatgtgtttataagaaaaataaaatagttaaatttagtgcgtatacacggtcaaatagaaaaaagagacacgtaggaaaaaaaatgaagtgcctttcaaggcaattagttgaaaaaaaaaatcagcaatagagctactatacaacaactaatcggcaaagcaacggtttaaattgctcgtgtcaccgccagccgtctgctgaatctgctgatgcaccctgacatggccgccccctcacagctcacaaaaaaaactgttttattacggtatactccctc

SEQ ID NO: 27739 - DNA, 1501 bp, Oryza sativa
aataaaatggtccacaatttaattaataatttagttgtgtgtgtcctgatcttattaaaaaaaaaacagaaactacaaatgcaacattgcccaagcatccaagaaattatgggcacatgctagatccatgagaaaaggattctagtatctttgtactaagtattagcacactctagtatcattggttacgactgtattaactgaacagtgatctaccttctgataactgcgattactaaaggacaaagacaacatcaccatccagtgcccactacctagacaaaataaactctaaccaaccttgttaattaattaacatcttttctgcatcttacgactgcattacaactaataaagcagtagttggacgtttgccacgaagggaaaggaacgatagaaaggggaaagtgtttacaaccctcgtttttcatgtcttttttttaagataatggagtgaaacatcccgacctttgctcatgagagctacagccaattattataagaagtagcacactaaaaggcgcagtccaaaattaaacaagcacaccaaccaaaaataaaagaaatcctaacatgacaaggaagattaactaaaaaaaagattaaatttgtaaatacacataagatatatcatgaaaaaagattaacaagataaattgataagatatatcatgcatataaacatataaattcaaattaaatttgtaaatacacataagggagagccgtgcgttaaggccagatatagcagtttgatgttttattaatctatttgatccaataccagacaacacaggatgcaaataatgcgaacatcagaatactgtaagcagaccatgaacagggaacagaatacagggcttggaggggtttgaagctgtgtatgctgttctactgttacagcttaccagaaacagtgaatcatgtcacatagtacgtcagaacatgtggcaactaactgaaaaactgtgaccttattacaaccttcagaattcagaaaacgagtattcacagcggcaaggttgacagcaactcatgtagacacatacatgtttatcaagaaaattgctcaacagcattatctcgttacaagtttcagagcaagcggaagcagcataacaagtagcagttaccaagcattcaacagtataatatcaggggaagaaacataaggactgtaatcgaatagctctttaatattgaatatctgtcaaagtgttccaacaaaggctgctcacaaatgcccagagaaaacaaaacataatagtattacaaagtcaaaaaacatagctgaaacattgcagacatgcctacaaaacataagcatgaacttaaagaaactgtgctatgctaaatgatagaattaatcagggccaaaagccatgggcgttgccatgtttacatttttcttttcaattcaatattattgtgtgatatgtttctaagggataactatcaccatgctcaggtgatcctattgcagcaagagtgtgggtgcctc

SEQ ID NO: 27740 - DNA, 743 bp, Oryza sativa
  unsure (1)..(743): unsure at all n locations
aagagggagttgttttatagaagagtttagagaggaaagataaaaagtgaggggagtttatttaaaaagagaaaannntnnannaannnannaanngnncaacgacgtcatctattaaaaaacggaagtagtaattaagaaggaaaacagagtacaaacagatccttgattaaaaaaatagagacacaacttaaggaggcttaaacgtccagctacacaagtctaagaagagagagattaaccgacctggacagaatcggcaggagttcatctgctctacaattctaagttgttcactagaattggcaagtctagagaagcagagtagctgactaatacccagccaccaaactgctaacagcagaataattaagacaagagactctctagtaaagaattagtgaggtttagcgagttgtgaaattaacaagagacccgggagctgcctcgatccgcagctgcgtcagaatattattcaggtagctgaaaattatcaccattgatgttttggttgagcacaaaataaggggcagagatagagatcactatgattattactgcttcctctgactcccttagcctaaagtgtttgattaggaatttctatgccaccaacttttcttggtcctgtgcaccccataaattatattgttgatattaaaaatagacaccatcccaatcccgtcacactctcgtcaacacggtgcaggcagcagcctcctcctaccctcaatggcgggcca

SEQ ID NO: 27741 - DNA, 659 bp, Oryza sativa
taaaagggcttgggaatagaaaatgataattcttttttgcatatggatctcttaagaggaacagccatgaaaatcaattttcacatatggttgtgggaccgtctataaaattgacgatataaatgttggagattttgaactaaaataataagcgatatctcttccttgatcaagaaactcaatttgaggggttttttatataccggtaaatattcgctaccgtattcgttccgtctcatattcgctccgtatctgtattcgataatattcgatttcatttccgtatccgagttttcgattccgattccaattccgaaaaaaatatgaaaacgaatatgataaagctagtttccgtccgtttccgatccgttttcatccctatctctaacttactaattaaaccgacaaccttccaaattaatacataggattctgatctattatctaatattacggaaaaaaaataatgttacacaatctatctctaaggaaactaatcccagtggtgcgaaagtactgttggctaactgatagaaaggagaatctcaaatgatacaaaaagcacacataggctgatttttccataggtttgcaactcacacagccacattgctagccctaaaatactatggatgactacttactcgtttcctcttagc

SEQ ID NO: 27742 - DNA, 968 bp, Oryza sativa
tttgctgtcagttgatcactgatgctatactgcataatgcatggtcaatgactgccccgggctaatgaacaatcatggacatgatcaggtcgctcaagaacaatgtggacaaagccacagggccaacgtcaagtacacctcccagtttgacaaacaagtgagggtaccatatcgtaggactgtagtaggctactcctatggctagtaagtagggtgcagcagcgcggcgggcatgatgctgcccccagtggccgtgacgccgcagccctcatttggctgtcagcgtccttggtcccaccggtcagcgtcccgtagggtagggttggctctagggggcggcttctgttccgacaaggtcgggccggttcggaggtcgcgtggggcccaccctgctggggcagtggattgtgcgctttggcacgcgcgcgctggatccgacggctgtccaccagaatccgacacgcccgggcctgcgccaccggtgcccacgaggacgatccgacggccacgatagcacgatgcgatgcgggctcaggcttttcagagagagtctgacctgtcgctcgtagcagcggtgcctggatttggctcttctgccaggacgcatcatatcctggcgtgcacgtttgattgcaccagaccagatcatccatccatggcagaggacaactggaatattcgtttaatttttactcatacaatggccagtctagatcctacaccaaaatttttcaccctatcacatcgaacgtttcaacatctgcatgaagtttaaatataggcttaaaaacaattaattgcatagattgcgactaatttgcgagacgaatcttttaatcctagttgctacatgatttgacaatgtgttgctacagtaaacatttgctaatgattgattaattaggcttaataaattcgtctcgcggtttactgacgaattatgtaattagtttttttattagtggccg

SEQ ID NO: 27743 - DNA, 317 bp, Oryza sativa
agagaggagcagtacaaacaactgcatgcatatccatttagcaattattaattgctccccaactccaactccatcatctccaccaccacctaaacccacaaaaaactaaaccagaaaaccgcttaaccgcaagcgccgaggcggagagcggaggcagacgcagacgcagcagccgagcacgcggcgacgcccacgcccacgcacacagctcggcttcccggcggaaaccctagcgggcgggcgggccccaatggcggaggagggcgacaaggccacggcggcggcggaggcggggggaggagcagccgctaccgccg

SEQ ID NO: 27744 - DNA, 550 bp, Oryza sativa
gatcaatctcggtgatttcatcgattcaatctccaatgtcattggctttgtcgtttcactagttagattgttctctaactgcagactaatctcctattacctttctttttcttgttttcacgcaccggctgagatcaagacgaagtcccggtgtgtcttctcgtcgcccagtacgatctgtataggtaccggcgtaaccttcatacgacacgggaacaattcatgtccatgggatcaacagcaattgagtgcttcacatgcagatcaactgatatgcacggcttaatatcaaaccctagcttgatatatgtattacacagttaagcatgtaatattttaaggctaatcaaattatatttgtttattttgcatgtatactggagcgatgcatggttggtcgcatgcccaggatggcaattgagatcaaaaaatcgttcattaacgagtgatgggatttggcagtgctgcggttcctgacctccttgtaatttatatatttagattaattactaacgcatattaatcttctcatgattttttattgcatgta

SEQ ID NO: 27745 - DNA, 332 bp, Oryza sativa
ctatgtactgtttaacttatatatgtcatttcatgtggttatattttgaattagattaagtaatttcatatagtggtagagtgcattatgtttaacatgctgatcaaagggttttactaaaagagttatagtctaattttagtgaaggtgcaaagtagactaagtggtatgctagatattttcagacttagctaagtggtagttcgagtttaaattttttttgtggttggttgtatcgtgatcctgagtgtgaaaaaacatccgaaaaaataaaaaaaaatgacaccgttgcaactccatacagagaaacaggaatggacaggaatggaggc

SEQ ID NO: 27746 - DNA, 248 bp, Oryza sativa
ctgtctaaagactttgcagtcattggtggagtgggaaccagaattgtgccacttacaatactttcttttccctagttcctcagccgatgggattatgtggccagcaggaagttgtatttgcttctcccgaagtagcaagtcaaaaatttatcagctttagtaatatcatttaagcaacaccccatcttctgtcgatatataaccttgaaaacatcttcatcggaatcggctgcgtcacctctatcagc

SEQ ID NO: 27747 - DNA, 337 bp, Oryza sativa
cccccttaatactatacaaaaatgcccagctagctaggtgtatacgtatacacatttaagctagctgcccttaatacctaatgattcataatgtatagccttttatttcttttgtccaaatagaacactaaacaattcaagaaatgataaagggacccacacatctcctatgaaggtttctgtgtgctgaaaccacgctgtttcatctcccagctagctaggtcttctgatgatatgaatatgaatcatttggacgtggaaaccgcagataattcagcacttgacctttgttttattcttaattacgcatgcaccctgtctaatcatctttgacagg

SEQ ID NO: 27748 - DNA, 391 bp, Oryza sativa
tgcattttgcttgcacgcgctcagtccggatcgcggcgtgcccttcttttcccaaaaaccgctactaaaattaggccgctttccccccttctctccctgcttgtgttcacagcaatagcagctcgggttggcttgggacacttaaaatattggagcagagcagcagcagcagtagtaggcaccactatgaattgcaagttgccttgtcccctgtttgcactctcacgaaaccgttagttctgtgcacatctttccgggcatgccccaccttgtgtggacaacagtatgttgtatgcaatgtgtgtgtggggtaggccaaagttggtggtacttgcaaacaaaaagtcgctttaatctcgcaccagttgcttgaccactacaggaaccgaga

SEQ ID NO: 27749 - DNA, 1501 bp, Oryza sativa
acacctcctaaatacggtttagtactcactccgtcccaaaatactgtttggattggatgtatcgtattactacaaatctagacatatcagattcatagtactaggttcgtcacatccaactaaaacttgctatattttaagacggaggaagtaaatcaccactggaacaatagatttctcattgaaaacaagcaccgactacaaacgggaaatctagtttttcctttcaagtcacccctggaaaatttttgataagtttgctaccatcgaatttcatgtaatctctaactcctactgtttgaatatattttttaattaatgacagctgaatcgagggatgacaaaacgttggaatttcgtaaaaatcgaccggttttcataaaaccactatgtcaacgatttatgaaaaccgatctgtattagcctgtttttgtaccatgttgattgaaagtcatcggtttttatcgattttgtgttggatttcggtgaaccggcgagaagcgatttttactttgaaatcgaaagttagaccctggttgaatctcaagattgatttggacataattaccacatcaaatgtttttccagatacactccatctgtcccataaaaaaccaatctagtactggatgtgacacatcctaatactatgaattaagacatatgtatgtgtcacgtccggtcttagattcgttttttatggaacggagggagtataccgtaataaaacagttttttttgtgagctgtgagggggcggccatgtcagggtgcatcagcagattcagcagacggctggcggtgacacgagcaatttaaaccgttgctttgccgattagttgttgtatagtagctctattgctgattttttttttcaactaattgccttgaaaggcacttcattttttttcctacgtgtctcttttttctatttgaccgtgtatacgcactaaatttaactattttatttttcttataaacacattacaatcgtaaacgctcacaatacgcgcgtactcatccatataaatgcacacaccctacctctttgagcatcttccgaagattgagtcggcatatcttaagattaatgaagtcaccacatatacatcgtctatcactaaaagaataattaggcataaatacaattcggatgggttggtttcaccacaggaacctaacgagttaagctatacttactttggtttctactgatactaagtatggacccacctatatttttatgtgaattcgctattggtcttggcataacgtggaccttaacctaaataaattactttaatttaatttaatcgtgcccaagggtggaacagaaaaaagaaaaactaaaaatctcagcgttcatcgaggatcttatatttatccccgtctccgcgctcgtctcggctccttctttgcccacttcctgccgccgattttgcatctcgcgagcagagcagggcgcgcggctgcttccgccacatcctggtatggatccggat

SEQ ID NO: 27750 - DNA, 1501 bp, Oryza sativa
tattatggcagttggaacttaagttcagatggtgctttattcagtactcagttgtcttcctgagttaatgacataacaaaatccctgaatttttatttcacctttttttttttctggaagcaagtctcattctttgctgttgtggttttctgcattattctgtcccctttggcgttggcctgtttttgtcagtcacaacagtcatgacatacaaaatgcaccagcaaaagggtgatgtcgatatgggttgctttaagtagtttagcgtttacctccccatccactgatccacattgttttctactgttctacagctctactttacctacacaggcttttttttaaagggaggatataaggtttggcctggtttagttcccaactttttcttcagactttcaacttttccatcacatcaaaacttttctacacacataaacttccaacttttccgtcacatcgttttaattttaatcaaacttccagttttagcgtgaactaaacacaccctttgtctcgtatgtacaaaggagtccttaggtaataagtttctcccaaaattccgaactcctagagtctaaatatatactcctactttcacccatgctctcgtttcctccttgatcttagctaggattgatgccaccgttaattgctgctttgtaacagaaaattcttacattacgtccgtaccatacttcccaaataccaggatcactagagttctgagtggttggtgagtgttactgaggagcacaagattccaccagtgttcgacaaacttgttcttctgtgcagcttcaggatacttagaccgtgtttagttcaaaaaattttcttcaaacttccaacttttccatcacatcaaaaatttcctacacacataaatttttaacttttccatcgcatcgttctaatttcaaccaaactttcaattttgacgtgaactaaacacacccttacagagatgaaactgtacactgcttgttcctttgagtggtctatcatctattgaaggcttgaagcagtattcttgtatggcaaactagcatgtgttttgtttcttgctccagatgcaacaccattttaccccccttttttttctgtgagaattgcgatctgggctacttcaaaactggaaggtactagtatgcacatcacatgcaggtagtgttttcctgaagaaacgtgtccctttccgtgctgatgcaacgcaaactcttttcttccatcagaattctttttaattttttgccttcttggtgttgggctgttcgtctgttcatgtcgcggattctcccaccccaccgaccctcttctccaccaaacacgattgcttgcaatttgcaaatctaacgtgcgggcggcaggtcgatcgatgcaaagcggcagccgcaaaccggtgagacctcggagatgacggggtccatttcgcttatacaaatgtttaccaactaaaaataatttatgaatataacttttatatacaccttgtctattt

SEQ ID NO: 27751 - DNA, 1501 bp, Oryza sativa
tgatggcaaagctttatagatgcaaaggatcaattattttgctaattctattcctttgctttgctaaatgtgctgtttggtggtcctttttattatgcaagaaaagtggtttggcctatcaagaggaaaagaattggggtttggtatagtgtgaatggttgtcttctcataagccctagctttttggccctttgacatgtgagcaattttgcattgataccctgtccagctaggaaaaaggacacctttccatgtgctgcaagcaaaaacttgttgatgctagttaccttttccgattgttttttcataccaaaagcttcagtttttgggactatatatttggatctgttcaataattgagttcaaattacaatttttcattcgttggtgaaaataacaagtggccttaacgcgttatgaaacatattccgttagatttcatgaatgttttttagataatggattggtaaaaaccagacctctatattagatttcatgaatatgattaatccataatagcggaaataatataatacttcagcttaggtccaaaatgatatgccgattcttttgttcttggtcaaacaatggttgtgcatgaggtattgaggcagtagtgtctaactaactagcccaatcatactgacaatggtccacagatgtcaactgttagtttcttcttttgtgtcctcgcataattaagttggactgcaactacttaggcttcgttctatcctctaacttcaaattacaacttccttgtcttcgttttccgttagaacaattatcaaactacaaactatgcatttttacaaaaaagaaaatatagaatttccttaaaaaataaatattttttttaagtttgtaataattgcttgtacttgattaattatacgttgatgcctgtttcatattgtgtgcccctaaaactaacctagaatttcatccctcgaatgcagctgtagaagttactcttatactttaatcaattaatatatgagtaaattgcataaatctccggtattatgatccaacttgcataaaactatagggaatttgatatttgcatataaccccaagtattatggcattagtatttcacaaaacaacaatattaacaaattttatttaaatctgaacatgcataaaactcttaaatgttgacataactacagtggataagagaacttgtgtagaccgcacaagtcggattttcgttaaattggtcaaattgtgtggtttagtgaaagcatcatagtaaccggggctatatgctacgtgacaaaactcctatgattttgtacaacttgaatcactatacccatggttttgtgtaatttattcttaatatatgaggacacgggcacctaattgtgcacttcctaaataataacatagtcatgcatttgctgaatctgattttaattctagcatgcaaacaagtttcatgtgacacatgggcagatctcaagtacttgccaacaacagtaagtttgataga

SEQ ID NO: 27752 - DNA, 392 bp, Oryza sativa
  unsure (1)..(392): unsure at all n locations
cggtacagtagatcaacncctcattataaggcgaattcgatctctgtaccccgacgtcatctattaaaaaacggagggagtaagttgtttctatttataatctctgtgaattcatgacataaatggagagataaattaaatgtttcgttgtaacccgagaagccatcttaatattcattgattacatgcatgcatacacttattgatagaaaaattttgctacagaacttcgcgactttgtgattttagctataggacactgcgtgaagtcaattttagggaacacactcacaaaagttggatatttactattggataccgcatccattaaaataataattttcggttggagaggagagagaaattgttgaaatgtcataccttggacctac

SEQ ID NO: 27753 - DNA, 213 bp, Oryza sativa
caccaccccacagtgccgaccttatccatccacccaccacccccacgcagcgccatccatctgtctgtctctcctccccccctctttctcacgggctggccaatttccctttacgcggcgggtgcgacggagtagcggtggtggtgacggagaatgatggcccggaggtcctcacccggcccgggggccctcccccttctctcctcctccagg

SEQ ID NO: 27754 - DNA, 159 bp, Oryza sativa
tcatgttaaactgtgtagttcacatgtgtagatctaatgatgcgttcatgctagttttcatctataatgtcatgatttatttatggaatagattaaatcattatatgtctataatctcaacaatccaaaaaccttattataggcactgtgattttacta

SEQ ID NO: 27755 - DNA, 445 bp, Oryza sativa
agacgtgatataaaaagagttggagaagaaaactacaaggaggttttttaccgtaattgaggttgagggcatgcaataccatatcctagctgtcgatctgggaggatccaacgactgaaattggttggtacctcatggtaccgtgtctctatgaggggcggtaccaattgtgataaggtggtgaaagggtagaattgtacattcgcattaacctttctcccgatccgcctccctccatgtttgatgaaatcaaaacaacgaacacacaaaaaatagggaaaccctatattttattaatcacgattcattaacatgaatattaacaaatacatgagggctcctacaggagtttgcgttttgcctttgcgagaatgcttaatagaaagatatgatgactagagattgcgtgcagtccgctgaaacccagcgcgtagcaatgaggctg

SEQ ID NO: 27756 - DNA, 203 bp, Oryza sativa
tcaacaaagcaatgcttgattaagccgataactgacacctatccaacaaagcgcgatgcaattcgcgcctggaatcggaggccatcatgaccagagacgagataacccgataccaggccgaaagcgttaagcgcgccagcatgccgccaatagtaaagcacagccagaccaaaacccaccagccacagaaggaagccgcataa

SEQ ID NO: 27757 - DNA, 166 bp, Oryza sativa
ggtggctcagcagcggcgcggtgacaggcggccggcaaactgcgatggcccacgcctcctctccctccccccccccccccggtctcccaccggccttccttcgctgctggccgccacgacaacgggggaggctggatccaccgccgtgacgatgggggtggccaga

SEQ ID NO: 27758 - DNA, 709 bp, Oryza sativa
aaaagtgaaggaatttgaaaaccgactcaaacacggatgacgtactaaaatattggcaaaaacattttcaatttttataatagtagagatttggtaatattttattcaaatttgaccaaattttgttcgaacttttggaaatttcggtatatagacaccctttgctagaaacgccgaaaacaaaagattgaaccctgccttttagtagtacttactaactacgtattactacactcttcatcctaaaatataaatatttataattatgaatttagacatgtatttgttcaaatttatagccaacattattatattttaggatgaaggcagtacatcatacaattcacaaactatagtagagttaatacctccgtcccaaaataatggtcgctttgacttttttcttgcgacatttgaccatttgtcttatttgaaaaattggtgcaaatatataaaaaaaataagccatacttaaagtgcttttgataataaagaaaatcacaaataaaatagataataattctataattttttgaataagacgaatcatcaaaagttaaaaaaaaacttaaagggacaagtattttgggatggagttagtagttattattcagaagtaattagtaattgattttgtgcaatttatcactcgcatgcattgccattgcttaattaccttgtcctaatttgtatttgcaatgtacttaga

SEQ ID NO: 27759 - DNA, 201 bp, Oryza sativa
atgggattatatggagagaacaacagattacaaagggaataatagaactcgatggtaccgacgagatcgtagtcgagttgattcgactagatcacccgtcgacctggctcctgtagtttccggcttcgtaggctgtggttgttgtgttggctatgagattcaatccttaggtccccctaggggtcccttttatatcgcagg

SEQ ID NO: 27760 - DNA, 378 bp, Oryza sativa
ccaatcgccaagtggtcactggagcaaatacagtacctgataagcctagcgctagtcagaagcaaccataatactcttatatcagtgttcaaatacttttgttttatagttgttccccgtcaatcatgtaataacagagaaacatgagataatgaatgagtttgataagcttatgaaggatccatgttaagagtgcaagtgctgtgagttgtgcacattttgttgttgattagggagacctagggtctcatttccgtaaacccaaaatctgttaggaatcaaatagtctagcgattgatggcgaagaaaatcaagtgatcaaccaaagaggcatttgtttggactaagagtttcagatgtgtctcttcggatcaaagg

SEQ ID NO: 27761 - DNA, 785 bp, Oryza sativa
caccgccgccgccacgcgcttcttcggcgtcgcgtcaccaccgacccgctgccctgcgccaccaccgagcgccgccccaccacccccgccggcactgtgcggcagcacctccagccgccccagctattaggcagcacatggcatggaaacgtagtaatccttcacaagaacatgccatgttttccatgttccatagctagctaagctttttagctttagcagcagcatggtgagtgagtgacaagattcatcggcatggtagcatctagcgatgcatgcaaagctactaacacagtgatgtttgtgtagccacagcgccacagatcgtgcagtggggccgtcgagttggggcggcgggggcgcacagtggcgccgccggcactcggcggggtggtggcgctcggcggttggggcggagtggcgtcgagtcagctgcggcggcggcagcgctcggcggttggggcggcgagctcgcctccccttcttctctttctactacaccataaatttttttaaaaaaataaagttagaaaaatttatgtatagaaatattatatataaaaatattgaattcaaattcaaattttaattggatatataaacttttgacttataaatattcgctatacaaactttagatgtgtaaaatttaggtgtataaacttaataaaagaggaaaagaaaaaaaaaacgatcgccgctagcgatcaatagctcagtaggactttcgaacaatttctccgtgcaaatcggttgctagcttgcttgacagttaatgtcatcta

SEQ ID NO: 27762 - DNA, 1321 bp, Oryza sativa
ccccccccccccccccccccacaaaaaaaaaattgattcttaataaaattggttggccaacctttcagaaaataaatctgataccccagaattgtttaattatgtggggatcatggaggggcaatttcttgtcctgaaggcaaaagaaattcggtatgtcattacaaatacacaaacagttactcactttgcatatataatacagatggaatcttcaaactaattgtcacctgagacgagagtatgagactctctgaaagtgaaatacaaattctaatggcatgagaaattctgtaggttgatgatacttatgccccctaaacagcttttttccaaatttacaaggcagtctcagtaattcacctatccatctcctaatagtacaaatacaacctcatctttcagtatatataaacatgcaacagtactttgccaccacatcgactcatcattccaacgaagcaattagcaattgccatccaacaagacctcaggttgtgagagaaatctaagaatgtgagagaaatcaaagagactgtgatacacaccctcggttgtaggggcatggagttgttgtttttgataaatatctaaaacaaagtagaatatatgcaatatggataggaggcatcaggcaatatgtcatgaaataatcttatcgccagagtcagagatatcttttaggaggcaccgcaccaaactggtcaagagtctcccaaatcagcacaggttgtttctccataggtgctaacaactgatagaaaccaacttctcgaaccatcatgcacaggagtacatgtcttcttttctgccctgactactcctacataatctccccagctgaatgatcatgcagttaggtgctacataactacagatctagcaccaaatctttcataaaagatagagtataaaaaactacatatttagtaacaaaattatcataaaactatacatggccttaaatctatagttctctgataaacttcgggctaaatctgtagttttgtgatagtatggtcaaaatacatgtacttttgtaaaatttactcaaaaaaatttatgttctatctaaagttttgaaatgttaacaattccttgtgctattggcgtaatacaagcagatgcgaatgacataatgaaaataaaaacaaatgcatagcagagtgtatgaagcatatgaattaatatccggtggatcacaagttaaggaaaccctgtctaccatgaaaagttgcaagtacaagtttcgcttttaaattttttttgggtgaaaccaggttgtttgctggactggatccatcgtttcattctacaggca

SEQ ID NO: 27763 - DNA, 217 bp, Oryza sativa
agatttacataaacccctctcgatcagatcaaatccactccccgcaaaaaaaaaagaaagatcaaatccctcaactgcacccgtgtgcatgtttcaaaaacggattcatcgcaacagttcgcattgaaattagactcggattagatcggtttcatgccattaattgatttctccgtgcaaaccggtcgctagctcgctggacagttgtcgtcatcaa

SEQ ID NO: 27764 - DNA, 401 bp, Oryza sativa
cgacgttgaggacgtgctggatgaattcgatgctgctcagctcatcaggaaccatcaatccaaggtacttccacatattgtcgtgtttgaataaatgttatatgcttcaactttacggatcagctgctgcacatgtgtgattttctttgtggaacttttttgcatcataccagcccgattaatttctaaaattaaaaaggaaattcatcttttccactaccatgccatttcccgatccatatcggactatcagagactagtctgagtagatgaaaattgatctacaaaggacactaatatagacagtgactttgactccaattttatttttcagctcaagttatacttttcctggaacaatccgctcctccagaaaatgaccatagcacgcaacatgaaga

SEQ ID NO: 27765 - DNA, 153 bp, Oryza sativa
cttgtatcagatgctacacaaaataaaaacacttgcactagttactgctcaatgtgctttcctcacaaacgatccagtgggaaagaacacatcaaggttgaaggtgcaaaggaatatgcaggaagtcaaatgatgacaacacgaagagaaaaa

SEQ ID NO: 27766 - DNA, 1501 bp, Oryza sativa
attctgaacacttggtccatcatgtacaggccgatcaatcagttgtgcctcagattatccctgaacatttggtacgtaatattcaaccgaacttctagaactatcaaggaagaaatttgaattatcaatatcagcctctgtcacctcatgtttagtatcagcaggcaggatcgcctcaacctcagtttgctcctcagttcaatcagtttgagctaatgcagcaacaaacacaaggagtacctcagcaaacatcatgggctgatatgattgccgatgtaatgagggagcaggttgggttcaaaccaaaagatactggaaatttgtatcggcatccttatcgaatatgcggcatattttttggaaattcggtaagtggtctcctagtagggaaggtccttatcgaatatgcggcattgttcgagggaacgcatattttttggagacacttcaaggggagccttttcagcgagcaatcaacgggaaatacttgaagaaatacttcccgagcgtttggcaagacgcttaggaggtgctatggccagtaattggattatcgccctaagaccaaaaacatgttctatgcttttggattcacgttgttcataaaaaaggtagggggggcatgtgtttacacccaaatttggcacctaaagattaaatagaaaaaattgccaaaatttggaagtctgccggtttcctccgagtagggccagtctgaccgccgtgcgttgggcggtcagaccgccggtttagggctggtcagaccggcggcatgtggccggtctgaccggcaggtccgagtccgactgtgtttcgtcgggtctcgaggtttccttgctcgggaaggcatgtttcgggtttcatttgatttctaccccgagttggacgtggaggagggcctgtagagggcaagaccaacccctatataagggacatggccggttcaattgtaactaatcaatctacaatcaatcaatcgaatcgtttttcatattgcttttaattttctcttagtttatccatctttgtcaatttgcgctgtaaatcgtccgccgccgctgcgagagtgcgacacccctttataggtttgtcctgaaaaccttccgttttgcccacgagacgggtagttatctagaaatcggctccgctagccgatttagttatcaaaacccatcttggtctagcttttggctagatcgaggtggttggcgactccatatcaccgcaagtcgtttagttgctgcgatcgtgcttgtcgactttttacgaaaagttgccaacaaacccctctggatcagagcaaatccactcaactgcacgcgtgtgcatgtttcagaaacggattcatcgcaacagttggtttacgatttcgtaataagttgaaattagactcggattagatcggtttcatgcaattaattaatatatactaataaaatagatgatcgacaaagcatattactaattgatttctccgtgcaaaccggtcgctagctcgctg

SEQ ID NO: 27767 - DNA, 1501 bp, Oryza sativa
cctgcacaattacaatgagatttaagactactacgcccaaggaacactcaacctcaaggttaataatatacaagtgggggtcttgtgtacctacaagttcgtgggtatcagagctcaatatatatctctactggagctgaagttagagctttgggatacacatgccatacaacctagagtgtttgccaggcaaatcttttgcttgtggcaaagaattaaccttgatgttcttcgatgtaatctcattgaacttgactcatatgctggtatggccacccttttcctgatgcctcttattcatattgcgctcttgagaaaaacacaaaactctctggaattcttgcctctgttaatccccagcaccatcatttttagttgtggattgctcgtatgtttctaccaatacaaagctgaattgtgaggaagagtaaagagtggcacctctctgtctgcttttttttaccagcaaagtaatacttgttgaccaaaagactggtttatgtgtatatgaggataaggtatccattatttatttattctctctgcatgactgttgaaaacgtaagtgtttgatagtataggagaggaatactgcataacgtgggacgattgtatcctaatataactctaactaccatatactctaatagtaaggaaatgtggactacaatattttcaacagataaaaaaataatatatatcattaagcagcagaacaaataagatgtgtcacaatgagatgtatgaaaaaaaattcttttactcaggaaacttcttccatgctaaaatatgtatagagcatatgcctgaagaatctgcattttacttgaacttgtttagacattggtggttgtcagagcattcaaacataagtggaaaggggtgatagaaaaaaggggaaattattgatgatggtaccgaaggcgattattgtgatgtagtgtgaatgttcataattaaaataaaatctattattgcaaagtgcaaaaccgaagaaggaccccaaaggaaaagcagaggttctgctcaccatgcctgtagaatgaaacgatggatccagtccagcaaacaacctggtttcacccaaaaaaaatttaaaagcgaaacttgtacttgcaacttttcatggtagacagggtttccttaacttgtgatccaccggatattaattcatatgcttcatacactctgctatgcatttgtttttattttcattatgtcattcgcatctgcttgtattacgccaatagcacaaggaattgttaacatttcaaaactttagatagaacataaatttttttgagtaaattttacaaaagtacatgtattttgaccatactatcacaaaactacagatttagcccgaagtttatcagagaactatagatttaaggccatgtatagttttatgataattttgttactaaatatgtagttttttatactctatcttttatgaaagatttggtgctagatctgtagttatgtagcacctaactgc

SEQ ID NO: 27768 - DNA, 469 bp, Oryza sativa
attcctgcagccctgatattttcccgtcggagctcatcatcttgttgatatcgtcttccgccattgatgacgacaactgtcagcgagctagcgaccggtttgcacggagaaatcaattagtaatatgctttgtcgatcatctattttattagtatatattaattaattgcatgaaaccgatctaatccgagtctaatttcaacttattacgaaatcgtaaaccaactgttgcgatgaatccgtttctgaaacatgcacacgcgtgcagttgagtggatttgctctgatccagaggggtttgttggcaacttttcgtaaaaagtcgacaagcacgatcgcagcaactaaacgacttgcggtgatatggagtcgccaaccacctcgatctagccaaaagctagaccaagatgggttttgataactaaatcggctagcggagccgatttctagataactacccgtctcgtgg

SEQ ID NO: 27769 - DNA, 537 bp, Oryza sativa
aacaaagttcaaattggatgtccttgttctttccttccttgtgacaaatctttgtctgtcctgctgtttaataatgtacatttaatgtgtgaaaaatatcttagaccatctgtcattacttttaagtatatgatgctgagagtgcaaacaaacgatggatactttactgctaaaaatagacacagtatgtcactctagcttactttgtcaaacgcagcccttctatacaagttaatttggataggatgcaaaaatgagaggacatccctaaagggatgcaagtctttcctgctaggattaattaacagagtagccaataattccatagagcttagttatatgttccaagaatgtgatgtgaacaaggggcattaagaaaatgatgactatactaccagccaagttgtacgaaatcaactgcaactacgcatatacccaactccttaaagtttcttgatcacaagaaaaaaaaaacttaagaggacatcgatgagggtaaccttaaccaccagcatgaccacaacagcaccattctaa

SEQ ID NO: 27770 - DNA, 768 bp, Oryza sativa
  unsure (1)..(768): unsure at all n locations
ttatatagtttttaaaagtcactgcaatttctaccccttacttctgccatctccttctttatttgcttgctagatctaccactttctattcattctccttgtaacctttaaaaattggatcttatagtttttagagtctattgtcttgttaggtttctttttataatttctagaagtcacatcaaacgctgccattatactattctacggttcgtccaatgtcttttttctgtttattatcattgggattttaaaattcgaatataataatcattcgggttcatttttttttactttttagaagtcccgccaaaccgttaacggctttgccactaaactcctctatggcttatctgctgcctctcttctttattgtcattgagattttaaaatcgaacatgattgtcattgggtttttttttactttttagaagttccgaacctttaaaaattggaccttgtagtttttagagtttattgtcttgttgggtttcattttttataatttttagaagtcctgttaaacgatgccactatactcctctacagctcacccgccgcctactctttattatcattgggattctcaaaatcgaacataactaccgttggaattcattttttattttctagaagtcctaccaaccatcggtggctctgcaactatactcctatacacctagtccgctgcttctcctttttattgtcattgagattttaaaaatcgaatatgattatcaatgtggtntattttttttactttctaga

SEQ ID NO: 27771 - DNA, 427 bp, Oryza sativa
aatatatatttcggtctaagggatttatactgtctcggcatggcgaccgatctatcccaattacttgatttaagtatatatcgacatgaagattatttatcattgatatctacagccgattgaatagatttagtttctttattattgcctcgcacagccgatcgatgcaaagatgacatcggctcgagtacaaatgatacgtcatcggcggctggtcgatcggctatcatttatggactaactactatttctttgtctttatttcttgttgattgcaggatcaaatcaactggcatgctcatgaacctcaaaggcaagattttggacctgcactagagttaagcagatctcccaggcctcgtgtttttacatcaacactctcttggcacgcccggtgggacctgagttttcaacgacttcatcccga

SEQ ID NO: 27772 - DNA, 1428 bp, Oryza sativa
ccttataggaatacattactgcttatttggaacataaaatttagaaatgcaagaatatgaaaaatatagaaatgaaatgtcgtgtgtaagcaaattccgcaggaatgcaaaacacagaaatttacaagactgtgtgttcggatagctcacaggaaaaaaggaatttggatggattttaaaagaaaagagagacaaagagataagaagtagtattgaacttcaccctaaaaaaggaggaggaagtattggacttcttaaacaaaaagttaaaatgaggttgcagcttacgtgtaaaattttctatggaatttggctataggattgtaatccaaaggaattttcctacgttgcaaacaaccaaaatttccttaggatttgaatcctttaaattcctaaggatactctattccaatgaagcgcttaaatttgagttgaaaatgagaggatcgttttggagtaagatataaataaaattaaatgtgatggatgacacaagcgcaaaccactagtacaataacgatttttccggcagccggaattgatttttgcatgcggaactttcactcgtcgggaacgaggtgtcaacgaaaatccgaaaatcgcaatttttgcgtgtgggttcttaagccgcccgcatgggagaataaaaaatcaaaacaaaaaaataaaaaaaattgaaccctaatctagcggccaccaccgctgtcgcagccgtcaccaccattgtcgtcgccgacgccttgcccaggcccaccgccgtcatccccgcggtcgccagcgacgaatctggcctccccgcggtggcctgcgacggatccggccttcccgcggtggcaggcgacggatccggcctccccgcggtggctggcgacggatccgctccgcagccaccaccctagcgcgccaatgccaccgcctccgccgctctaaccgatgccgccgccttcgtcgctctaaccgatgccacagccctagctgaggccgccgtcgttgtcgagattgggagatgggaggagggggaggaggagagagaggagtcaagggaggaggaaggagatgggagtcaagggaggagtcgaggtgggaggagatggaggagagagaggagtcgagggaggaggagggaggtgggaagagatgagagtgtgcgatgggcggagatggcggcattaaaaatatgggtaggtattttcgtgtgcgggtctcttaacaagtccggacctgttaaagtggcccgcatgcgaaaattgatttttcagtgtggtcattttaaagagccgcacgtgaaaatagagctcgatttttatagacgcgaccacttatggttcgtttgcaatctaaaatgagtcccatccaggacatcattcctgtactaatgaacactataaaactacttatattttgatacaaatttcaaatgttagaagt

SEQ ID NO: 27773 - DNA, 190 bp, Oryza sativa
gaagcttttggtgattcgaattggtggtgcaacaagtcgccggaatctacaaatgtttggacggatcactaaataggtatcttgattcatgcttggacattattgctaatttcgataattctagagcaaatgatttggcacaacaagcatctggctataatgtgaagaagggattatttctgatactaga

SEQ ID NO: 27774 - DNA, 295 bp, Oryza sativa
ccaaacttatctgtaaggaaattacataaaatatcctaattaatagatacaattgccttcttaaaactctatccatgtgtggcaatccatgtgaagcacattaactcagctcgataatgtaaaccgattcatattgtcggaatcggctgtatcggctaaccctatctgacttggactcagccgatctggtcgtagccgatctggactcttctgttccctgggcacaaatgtccgaattcacagctaattcggtctttgaatcaattgcggcgtgccccccatcgctctgtccaga

SEQ ID NO: 27775 - DNA, 1501 bp, Oryza sativa
atctgctggcctttcgactaatatttactcaaatttcaatcatgcgttgctaactagtgtggttttacagctaaatgagtagataatctagttggaaaaggagttctttagttacaaattctgggtaccacaatgtggtctgaactctgaaaatctgaaccagaaagtagtgtgtcgttgtgcatcatgaggatttagaagccagtaggcaatagtagataaccggatagccatattgatgtctctatctggttggatgtttcctaaacgtgggaatctctgctatgtgcagttcaactgaaggaaacaaagaaaagtgcgagctggtgcgtcccatgcatgctgctgctgcagttctgcctgtgatgggggcctggatatgcaactatcgtggtagttactgtgagttctgttcttttttttttctccgcccccttcgcctttgtttcgtgtggtttattgatgcaattctgttcctgtcattgtcactcccctgcaaaagtcactttccctctacctgataattgaaaacaatgccactatgtgtgtctcgctggcttggtgattagttagtccttttctgtagttctgctaatgtggtctattcagatacaaataccatatatctatatacgaatttaccttctgttatgtgatcataatcgtattactgtatgctctcttggttgattgcacattcaattttctgaattttcttgtagtgagactgtctgccactgccagtacttcccatggtggatcggtgccaaattaggctgacaaggagaaaatttcatgccgtgtacttgtttgcagggtcagcaaaaatatcgacttcggaatcgatgaacagggtaagcacgaatcttattagttttctgtcactaaacctgagttagaaaactattaagccaaggaataaggatggaagcgtcatgctattgtcctcatgccaccaaatcatggggagtggttgaactgtttacgcacgtacactctgtaaagtggcagtgtatcttactgattcccggtgcccttttttcatccttgtcaccagttgccatgcagaagaagctgagctaacaagtcaaagcaacaagattagcctttaaaatacctcatacttagccctgcattatacaagtctaggctgattattgtaaactccatgtctgcaagagatagtgtacagtgctataccttctcctttggctttgtgttgcattttcagtaccaagaatccatcacattaccctgagtgatatgcacagagcaggtagtgtttgacaactttgtttctgctttttgcagcttaggctcctactttgtgcacatgatgagcctccaaacctcagctatggagttcatagtttcatgctcaccttgtcatctccagagttccagcatcctgtaagttccaattcatatgcatcttagaacactgcttcagttgctcagttgatggtatcattggtcttagcaatggctggcaagctgatca

SEQ ID NO: 27776 - DNA, 393 bp, Oryza sativa; identical to SEQ ID NO: 27735

SEQ ID NO: 27777 - DNA, 1501 bp, Oryza sativa
tgcatatgtggttttctgatcttccatgtttgacaaagaccacatttttatggttgtatgctcaggagatatctcaaaccggttttgttcaagaaaggaaaggaatttacaatcttgatgagacattaaattttacattagaaaagatataaggttccttataacatgtacaacaacaataaagacgtttcttagctataccatgcagttgttttgctaacatgatgatagaataagtgagaaaaatgagcgaaagcaactcctctaacaacggagaagtgttactgattatgtggggctcactttctatgggcccacatgtccctctaacatgcgttagacgagtctcatcgctgacctgtctcttcactaagtgacaattgtgtaaaagatatagagatatggtattaaataacctactcactcaattatttttaaaagtttgttgatgatagtatagacaacttaagtgaatacactggaactcaattggtgttgcatgattgaaaaattccaatagatttttttttactatttaggcctatatgtatatgtggttttctgatcttccatgtttcacaaagaccacatttttgtggttgtatgctaagacaaaaaaaaaatatgatcttgaggagacttttttaaactttacattagaaaatgcagcacatcctgatatctcttcatgactgtaaatctgtcggtaaagtaacatctgtacagttgcatcaaaaccagattgttgcaacatctgaatgttttgacatacctttccccaaaagtttcagttcagttcaccccacattttcatggctcatcacaacagttacaatttccctttaacaaaagacaagcaaacacacacaacatcatcaatcaccagcttgagcttataactgatgcagtgagttaatcacaagattacaccaacaacaaaaaaaatcacaatctgccagatttgctcctcttcatttttactgaagctccaaaagtcagaagagaagtccaaggctgcgcctacgtcacgcatgcgcgcatcgcccccggccatggcgtcatcgcagcagccacaggctatggcgccgctcacgcgcgcgcggcgcgccaccggtaaccgacgtcgctgggggggcggcgcgccatggcgcgcccgggcgggcgcgcgcggcgctagcggacaaggcgagcggcgcggccagagcgggggagcgcgccaagtggccagctagctagcgcgcgcgatggcatcaaccgcgtctctctctctctctctcgccatcgtcactgcggctgctgctgctctcgcttccgtttcatgtcgcgtccagtagcgggcgcgccgcgcgcggggccttggaagtgttcgatcgcgagcgtctcgtctcctccttcgcacgagcggttcgctttgggctatagcctatagcgcgctctggacgcgacgacaccgagtcaccgacgaacgagcgcgacgccgacgaacgagcgcgcgacgcca

SEQ ID NO: 27778 - DNA, 1501 bp, Oryza sativa
tcactttgtgcagagattatgtagatcctcgcatcagcttcgctgttcatatacactgttgtagctcaaggggctctcttctaagcacactttgttactttggcccttagatcccaccccaaaattttacaccatgttatatcgaacgtttaaacacctgtataaagtattaaatataagctaaaaaataactaattgcacaaattgcgactaatttgcgagacgaatcttttaagcctaattgctccatgatttgacaatgtggtgctacagtaaacatttgctaatgatgaattaattaggcttaataaattcgtcttgtggtttactgatggattatgtaattagtttttttattagtgcccgaacattccatgtgacaccctatataatatccgatgtgacacgtcaaaactttacaccactcgatctaaacacccactttcttaaggtttcaaccaaaggagatgattataataatctactactataagacaagtcgacgcatgaccgggtcttcttaatcagacactgctggtatcgtgatgaagttgtcgtgatggagttgtgggtgcatgatatcctatccgtcaaagttgaaataacgagactcttaaatgagtgtgttgttagattgtgttgaatatgtgtacaaagtcgattacagtgtaaaacttgaagttataataggtattaggatagcaatagagttgtactctaccctaggctctctcttaaatagggaggtacatcagttgtaaccgcatggtgacttagcataggtgagagggaattaatggctaacaccggccaaggatcggggaaaagctcatgtaattaatgtcctagggatgaatgtttctgctgaacctcattaataaatatggtgcctctatatcatcatcagtttggatcttctatggtgttcttccacgttcggcacaccagttgtaaccacatggcgacttaaggtcataggttctctcttaaataaagggacataccggttgaaaccgcatagtgacttagcataagtaagaggaaatggctacggacaacatccgctagaggatcattgtaattctgatacgctataattatattggatcggagagaactcagagaggcataagcaattagtgcctccagggatataggttttagttaaaccttgttaacaaatattgttactcgatgtcgtcatcagtttgaatcttctatggtgtacttccacgttcggtttccgatgtactccctccatccacaaaagttagacatatttcacatttgagtttttctaaataagtagttttttttagtctttatgcattcaagacttaaaagaagagataaattaaatgtttaattagaatccaaggagtcatctaaatactcattggttgcatgcttgcattcactccttgattttgtaatatccaagatgatttaatttctcctttgtcttggtgacaaaaagtaatagatgtaacttttgtggatg

SEQ ID NO: 27779 - DNA, 1501 bp, Oryza sativa
tcgaggcatcttccacctccctgatggaactttccaggtgaaaatcatgtccatgaataggcgacagcatcacgacctttttaaggacgtcatctcttgaaagtcatgtggctacctatgctatctttagacaatttggactgcgatgacgcttaggatgttattatggcggtggccggtgggtctatacaaggcacgagtggatctttcttctctgttgccctctccctctacaacccttcactgtggtgttatccgggcgtgcattgtgatcagttatttggaagtgttggcgataggtggtgtgttcgtggctctattgtaaacctggcggcaacatccagtcacacatagccgcatccgacatagtgttaagtttcttcctcagcggggtgtgtgcacaagtgttgttggcacgtagtgtgttgttgttttttttttccttttttttctgattgtagtattttaggttgtagtttttttttcaaatgtatattaatagtaatgatgtgtcacctagtgttattcgtcaaagaaaatacaccgacgttaccatgtgacatgtatttaataacattcatactcttaaaacaagataaatgatttgttggtgcaaattttaaatatgtcagactaaattatatctgcttcttaataagttgtgatattgtcggtgcatttcaatgaccgagtgttgaaggtcgcacactgggatgttctctcgtacactttttaaaattaaatttaatgtaaatggttgtgaaaattttaaaataaaatgagtatattgatattcatcactctaccaaaaattaagtttaaacttatttgagaagggaaaaagatagtgaatagcactcgcgttgtttatacgttgtattttttttatttcttgatatgtgagttaagtttatatttaagattttatagagggatatgtatttgctatatgaatgtcgttgaattcttttcagaaatttttgtagctatttgaatatttaaatatttttaacccgaattgaaagagttccccgcttacagggtgttaataagttaattgataagggtgctgatggcaaattacgtacacacaccgtaaaaggaaaaagaaaaagaaaatccaatcctaacttacgtatctaaacaaatacatgtataaattaataattagtattgaatgttttttttattttacggatggagtatactccccccgtctcataatataagggattttgagtttttgcttgcaacgtttgaccactcgtcttattcaaaaaaatttgaaattattatttattttatttgtgacttactttattatctacagcactttaagcacaacttttcgttttttatatttgcaaaaaaaaaatttgaataagataagtggtcaaacgttgcaaacaaacaaaattcaaaatcccttatattatgagacggagagagtaacccacgtgaaccaactcgccgtcatatgaagacgatcaatggagagatc

SEQ ID NO: 27780 - DNA, 247 bp, Oryza sativa
gcaattttgaaaatttcagcccgaaattatatgaatttttaaataaaatttgatacaaatttaaacaaaatgttactaaattcatgaaaagatgaaataaataaaaaatttcagccaaaataatatcatactgggagatccaatagaactgaaatttcgatccgaaattttgaaccgtggcagtacaatggctaaagtggtttctccgcagcggcgttgtacgagctctgcaagctagcggagaaca

SEQ ID NO: 27781 - DNA, 315 bp, Oryza sativa
cagacagtccattcttatactacaaaaaaaacattagcaagtgctctaaagagaagtaaggacccaaaaactacagaactgagcttgcaggatgagattaccatcaattacatgaagcaatgtgatgatgatgaaaaattgctatcaagtattgatggcatacaacttacatatgaatttcttaggccacttgtcaatcccaaagactcacaaatcataagcaagtggttgaaaggcagtgtaagaaatacttaacttcttccatacaacgtaatattatcagtatctaaattttgttctttattctttcacagg

SEQ ID NO: 27782 - DNA, 252 bp, Oryza sativa
attcatatgaaacgcttctgactaggcgatgtgcagcccaattgtgagccacgtctagaagccatttaggtgttgtttgaacagtgacgcatctttggagaaccttacctgcataagttttaggcttcattgctttgaaaattttatgtatgttctttataagaatgcatgagcatatactagactaagtacataaatggtttgcttcattggaccttttcagaagactgttatgatgatttgaactactgc

SEQ ID NO: 27783 - DNA, 310 bp, Oryza sativa
gtcaaactcttataaatcacaaaagtatttacgaagtgatttgatagttttaattctttatgcaaactgcattcactagtgcggtgtaacatgcattagacccggactatcatatttcctgacatttcctatctaggggttcattctctccccctaaatgactggaaataattcttatttgtcaaggaattcaggcttcataactatctctgtaaaaggtttccgactttcggagagagccttttgcaatgcattatgatagtggaaaatgcacataaaccaaacaaatgcaatagcactagttgcagga

SEQ ID NO: 27784 - DNA, 500 bp, Oryza sativa
tgtatgcacatatcaattatctatcagcactcatgccaccatatgaaatatcacaatctctagtaagtaaggctgtccttacatatcacagagcaatcttggaaagtaataagcaaactacagtacattactaaaatatcaattcagttttctggtcgaatctcagaacgtttctgcttagaaaatctaatctctcccctaatacattggaggggaaatctgttctgtgctgcctactgaaaggcagaattattttaagccaatctcattgtcatccaaagtactacatctaatgaagtgacaatataattgaagaaccaaagcaggggacatacttgtagacgaacaacttgggtgaaatgagagagcttccatgcttataggcaacatatggaaactgatctgtaatctcctacaataaagaaaatgatttactctgtaccgatcgaccgtggatgagatcggcgaggcgggcgcttcggtggcacaggtcggtggca

SEQ ID NO: 27785 - DNA, 164 bp, Oryza sativa
caagaaagctcaaatggaggtaattacgtcatttattatgtctttaggaatcttgcaactcctatgtctgtcaatctactaagttaataacaactgtgataagcatgaagattttacctattatgttacttgtagtagagttacacttttacctctcctatagg

SEQ ID NO: 27786 - DNA, 1501 bp, Oryza sativa
acagctatttttggctatggctgcagatgtaagaaccgaacaggcccattttctgtcctcaccagttgccaacgaaatggctgactcagggcagtggtcggcctcccagccgaaaagccctccagacctcctgtgtggcatgccggccttcaccgccgccgtcggcctccacccccgacggccaagacacaagtgctgccaatgcctgaatccgattatattcgtcattggtttcgtgagtttgtgtacgatttgatctttctgactcgatttaccatcgattttctttctggattcctcaagattgaagattcgtatcggattttgtcttgagcaatagttgttgccgttcttatttgagcaataaattgttgcgcatcttattagagcaataaagttgttgcagatttttttaaaacatatggacggtgtctttcctttatcttcctttttaacctaacttcatctcaaacacttcttctattcctccctatcgatcttctcacacatgcgcggctgatcggcagccctagcacacaaggaggcacctgttccattccagtggtctcctcccggccctcttctggctctgacgcctgccctgcaggaattccccccacactgttgttctctctagcatcgcttacggagagacttaaggaaacttattcatatttccagaattccaggtatgtatgtatgtatgtagtgtctaacttctatgttattactggaattagagcataaaccttgccgttaatgacacagagccgattagattaaattagatagaatttggtaatctacgtgatccttatgtcaatcatactgtcattggaagtttagtgccggcaatactgttagattaagcttaattactgtgcttagccaccagaccaacgcatgcaacagtactatataagtatttaattaccatgtttgatgcaagctaaatcaaatgcttacaaccattgtgattataacctgaaccattatattttccttttaggataattcaggattcatagtctaaactgttaagaatacaggaccatctatgtaatcttgggagattgttttcctctcctaaatcaaaacttgacctaaattttagtctccatggtaaatgttatacggagtttgcatgtatctgtgcacacttattatacattgttatacctaaacaagaacaataaaacttataaatctgccactgtttgaactgttcaacaatttctgtatgttcatagacgtacatttagcctttgttttactaaaaatacattcacacttaaatattgctcgacaccaaaactatcacggcaccaaaattgaaataatgtttatagatacagcttgtgaaacatcgctagcatcctgaaactgaaatcaaatagagtaccactgaatgtttggttttaaattgagcatgttacttactatttaacaacttaatgataataagtgattagaaaataatattttctttgtaggataatgt

SEQ ID NO: 27787 - DNA, 441 bp, Oryza sativa
cttctcaagctgctaggtctttctccgcgccatgagaacgacgcttcctaaggtccagcagtcaggaatctctcttaaggagacagacaaggaacaagaagcgacgttgacctcggatcgattcgttggagtaatcgacattgatccccacgagccatcagtcctacacttgctcgaagactatggctcgtcatcttccagtacaacacgtgacgtatttgccattggtgggactagcacgtctacacatgctaacgcagaggcggagaaccagacggtcacgccggcccaacatctcggcaccgtcaacgcaatactgatagaagctccctatgactccgtgcttaacgatgatctcgcacgatggacagaacgactacgggaatcggtagccaatctcagtaacgcattcgaagaggccgctaccagagcagaaccaga

SEQ ID NO: 27788 - DNA, 1501 bp, Oryza sativa
ggaggaagaaggaaggctatgacaagtgggccccactgcatactaatccctttcctttttgtttcaatttcaatctctatagacacccatatttctcaaatcatagatccaattctagtaaattctttatctaaattcatctaatttcaaactctttattttgataccaaattttctatttttaaattttatttaaattttctcatttaaatccctttttattcatttatttatttacatttcgaatttaaaatttattttaattaaccttttttaattattctattttattcaaatacctttaaatttaaatttctgtgttatttaaaaacccttttttaaaaaactaaatttttcctttaatttatttaaacaccttttatttattcatttcaaataccattttaaattttatttctttaaaaacccattttgaattcaatttcctttgatctatttatttccttttatttctaaaaccttcaattatttcttttgctaatccaatagccactaaacagttgtcgtgcaaactttacgcttccatgagacattcgtgtagtctacaaaccccgacgtcgaatcgttgatcgtaaaacacggcataacctagttccaaggtcaaagtgttgcccttcacaccgcatgcctcgacgcgtacagtgattgaagcctcactactctcccgacctccacagcacactagtccttggactatgtgcaatcctagccgctttgctgtcactcacagctttagagtagcactttccatcttgcaaacccacacgaatttttcccaactctctagtcattgcgctgtatcatcgactaaataagccaaatatttagccgtaatgttgcttatccttagcatcggctaaccaactccaaatatctagccattgtgctactctattctagcatcgactataaaccaaaaccaccaaataaaccctacctacccaatctctctttttcctcaactttatttgaaacccaacctttagaaaccaaaacccctctcttttgttttccaaactaaaatttcttttgacccaactcctttttccttcgccttgctccaattttctttatttcttggtttatcgtttctttgtagcaatttgcttataggctctatttgctatctttttcgtattcgtacgttagaccgtacagcaaattctatcgacatccaaggagctgacgtggactcagatgattacgctaaagccgcgggaaatcttaaggcgcaaggcaagacataactaaaattttgatcatatagaaaacttaatataactgtcattttatgcatgaaatattactctttagatattaaatactttcaagcatttttgcatgagattatagaatgatgctttagtcatcattttatgtggttcactattccaaatatctttacaaacttaggaatccggttaaaatgggctttttgaagtgtgatttatgaagttggtatggaagttttgggatgttg

SEQ ID NO: 27789 - DNA, 428 bp, Oryza sativa
ccgttgcctcccaggctctgcgcggtgaggacgagctgacgtttgctgagcgcggcggcaacggagtggttggggcgaaacgggcagagggcgagtccgtttcgggcactacggcgtgcgtggcagcggcttatttggggttgaaggtggaggctggtggcatgaggcggtgtggaaattatgggtaccccatacgcacacggcatggttatccgactagttatagaggataacttgtatctatggaatatgtaatagatcattacttgggtattacgtttccttgtatattatggaacggcctagagtcctggtttggtaatattgtaaaatagatttaggaaaccgataccgtgttgcttaaggtttttatcttgtaatcatgcccccatcttatataaggtgggcaggaggctttctagggggca

SEQ ID NO: 27790 - DNA, 366 bp, Oryza sativa
aagcaattttttccctggatatgtatactgcaaatgtatcaatgagttactgttgttatatggaacttttgtactatcacactggtgttacatattgaaactagtcggttctagacttaccatggtagctatgaatggccttgagccatctcttcaccattgcatggtctgtcttttgtgcctgttctgcctggagagctggataaagattgcatataatggagatccaacaagcatttgcatagaagcgaggacttctccgtctaatttatgctcaataaacttatctgtggtgcttgctattcatcagttgtcacatctgaaattttctcgtccttggttgcccggaccattcccccgggcaca

SEQ ID NO: 27791 - DNA, 1501 bp, Oryza sativa
caaatcaaacaccaatgcaaactaaatgatctagtttgtggcaaaccataatatcgttcacgccgcccacgctgaaactaccgaaaaacacttgcatgtgtctatgtgtccaaatttatagtattaggatatatcatatcatgtattaagtgtatttacttggacaaagggaatgaaatgtattagtgcctgaatccaagctatctaacataaatagcaagtgcagtaaactaaaacggattagtgatttgcattcgtagaactatgtggcttggcaagcatttcaccgattaggtatgtatgtaagataagtaaaaggcagtgtatttttagaaactataaatctattaaggttttgcgttcataaaaaataattagattggtgggtaactaataattccatataaacagtactatagatgcatcaacaatgggttgcttatacattgggtgataagtgataacacaccaatctatccacagacaaggtcaacaatgtgttgtttatacagtttggcatgaaactacatcgtggggaaaaaatgggtccaatagcaactaagtgaattagatcaacgcgaaggaaaagtataattgacaaaataaaaaaatagtaatcttacataaattagttgagcaaactaaagaaatgcatttataaacaccgcaacattagttaaatgaacatattgtgagtttgtaaccagtgctacagcagtacatatctctactctaaggctgtaaaattcaatgcacaaatgtttttactctgctcaatataacaccaactcttgctggctcagttttttttaaaaaaaatatatagctagattacatttaccaaaccattggtttgaattacttgctgctaacgacatagattacgtactctcagcttctacatagcatctatcatctcaaatccaacctagtgtaaatacagtaattacaagtttgcagcagtgaaatttcgcaatatactactagtactatctacacaaataaaactggacccacattgaaatctccaattgaattaagaagccattttttttcttgagggaaggaagcccctacagtttaatatattgaaaaaataaaaggtagaaaattacaacagattaatccaatgatcaaacaaattaagcctatggagtaaaagggagataccattcttaaagagaactctccaagagaaaagagaaggagcgatattataaaaaattaaaccatttcttttctcccagatattccaagtaacataaagcaccttctcaacaaagtgtaaagacctataggtatttttggccgtaatcaacatttctccaaatttaaggacaaatcccaaaccacaccaaattgcgcctatcattcaaagctgaaaggacataaatagtatattaaaacaaacaatacacacccacattcaaatccagttgcacaacttacaaataaaagagagaaataatatatcgcgaactatctcaaacactcacagact

SEQ ID NO: 27792 - DNA, 379 bp, Oryza sativa
ttaaaaaaaatcttttgccactttgcctacgtgagttgctatatgaggtagccagtgtggaccagtgatatgcaatgtctgttttgcccctcgccttcgtttctctccttggagatgaaactcccaatttaaccagccgtctctcctctccgaatccgttcgcttggcggatcaactcgttggatgcaaatccaattccgatcaggagtaggcattcactctcgtttcctgccgatataactgagcgctagattggccatcgaccacatcaccaacaactctcgccgcctcacactcgcagatctgacagttgatttggggaaaaaaaattcaaaaaataaggagaaaatcttttcgccgccgacgaggaggagaggga

SEQ ID NO: 27793 - DNA, 1501 bp, Oryza sativa
agttattcggatagctttataaaaccatttatctccatctttaggttcacatctctatcccaacatatttgttaaataattttattttagaaacaaggtatgcagctatccagtatgtcatatttgctagttacaaatcatacactatattcggtactattatctataataaaaacattatttattatagtaatatatcaaataatttgtttttaatggaataccttattattttaaaaagagtaagaagtgtccatgtcaattacatttgttcattactaataactttgaaatgaaacaaattacatttaaaattgagattctaatatgaatattgaatacaacttcatatttacaattatattttttattaaaatctagaaaaccaaagagcctaatttagaataacatattatatataccacgaatttattttcttttggataaaactgcctatatttctttgttgactttgtaagaatggtaaaaaggtctttctttatgttccgataaatattcgtgcccgtattctaactcatattcattatgtatcagtattcgataatattcgactccatttgattttcttttctgattccaaaaattataggaacattatccccgtataaacaagttaggctatgttcgggaggtaaggttgggcacctctcgacacggaaaacaaagcacgcgattatagtgaaattaattaagtattagcctaataaaaaactttaaaaatagattaatatgattttataaagtaactttcatatagaatttttttttaaaaaatatattgtttagtagttttaaaagtgtgcgcgtgaaaaatgaggcaagtgagttgggaaagaggggaaaagaacgctatcttcacgggaggcagttcccaacacaaacacgaaaacggattggtccattagcacgtgattaattaagtatttgctattttttttgaaatggactaattttatttttttaagcaattttcgtatagaaacttttttttaaaaaaaagacatagggagagatgatgggaaaaggggcatccggacacaacatagtatatacgggtacaatacatagacacaactattcaccgatctagggctgtcaatgagccgagctcgagcaagctcgtctgcccaagctcgagctcgacacaggctcgagccgagctcgagccgagcctactgcactttcgagcttttaggcaagctcggttcaagctcgagctcggctaccgagctcggccataagtagtataatatatattttaataataatctcttgataagtataattattttttagttaatcacactaataaaagagtagaaaataattaaaataaatatattgtactaacatatgctaatttattgtgtaaatagatactaatatatatatttatctattagtttattatattaataaggtaaacatgcaatataaactatgcacggtcaagctcggccaggcttgataaagctcgagc

SEQ ID NO: 27794 - DNA, 371 bp, Oryza sativa
tacacagatgtgcaattctcacaaaatagttgggtcacagctcaccaaattcggtaattgtatggaaccacaagctgagagtgacggagttgccacttttagcattaaattctaacttactcattgtgcaaaacaagcaccgacacatggctaacgcaatacagatcaaataccgacatcaaatctagcagaaaacagctatacgcgaggaaatttgcatggtatcctctgatagaatggctacgctaaggctaaattaatccgtctcgcatccaaatcgaacgaaacataaatcgcattgaccagggtcgccacagtcagttcaaatttccgtacatccagatccaaacctcagaaacactgcctactca

SEQ ID NO: 27795 - DNA, 1501 bp, Oryza sativa
aaggcccggggtcttcccggctagcaacgcaagctgcgagctagccggtccgggttcgagcctcaccctcctccttatttcaatatcaatctagtccttcctagattggtcctatttttttaaacctgtagtttcctacatctacggagcttatcaatccgacacttttagatgcaaataacgtatctaaaaatgtactacaggataaagtatgtgtttaaaatcctttatacaataactgaacttcataagcattatatttgaatatactaaataaatgaatagtcagaggaaaaatcaaacaaaaaatcaggtagcaaagtggaaattctaaaatcaaatatcaatttagaaaaaatataaagagtaaattttataaaactgaatcggttggtacaacgacatttcacaaaactacaagaaaacatacagttttattgcaaaattttgactttatcctatacagtttctgatatgtgggcctaatttgcatgaatgtgcggatattgcatggatgaactgacagtgagcaacctaacatacagagttgtatatttctgttaaaatcagtgattatcatgcaatcaactaaagttgcaacaagctggtagttatgacaaatggttgtagttttatcaaatttatttatacataagaaattgaatatatctcgtagaaaatagagaacctgtaaaaaaaatgataaaaggtgtagtttggtggcaccgaaccaaaccgacggcttacaaacaaagaagaagccgcccgatctctagtcacctctcaataatgtagagtagttcgcattaatagttttgattatagaacatcctcgctgatgactcgacccatacattcacacgatcgcagagcacaatggtaagcacattgacaaagagtggaagaggtatacattttccatttcaacatgcccctcatttttcaacattgtcaatacttaaaggctatgttgttccttccaaagttgaaagtttgggttgaaattggtacgatgtgactgaaaagttgtgtgtgtatgacaggttgatgtaatggaaaaagttagaagtttggatctaaacacagccaaagtagctatgcatgtttgtgctgaaagattgcgttcatattttctacccaattattttaacttgtgaacaacaaattgaacacattgacttgtactacctgtctcatatgatggctacctcaagcattcaaacttaaaatgatcgaggcaactgtatgtgatgtagtagtactccctaatataagggattttgacatttgcttgtgttgtttgatcactcgtcttattcaaaaaatttgtgcaaatataaaaaacgaaaagttgtgcttaaagtactttggataataaagtaagttaaaaaaataaaaaataattctaaaatttttttgaataagacgaatgatcaaacagtacaagtaaaatgtcaaaatctcttatattaggggacggaggaagtagtagttatttcaa

SEQ ID NO: 27796 - DNA, 1501 bp, Oryza sativa
agccggcacgtggaaatcaatgctgcaggaagattaattaggtggacacaccaaaccctgtggttggtgacgccctgttgttaatcaactggggtgttcgttggacatggtttttgcaggaaaattaagcaagaaaattaagaagaatgctcaagctgacatgagaaaacgtaatccaatggaagcgaatttcaagtcgttctcttgtactaccatgtttagaatacataagacagtgccaacggtttgatggctcctattggctcgtgtgatactgacttgtgtcacaaagcatcaaattgcttcttggagtatctttattaccgaaaaccccaaagattattctattccacctcagggtaattgtgctgaactatgcaatgaatacaaattcgcaaaatatcatggttatctatcttgctcaaattgaaatttgagtccaactgagactgcaatacgatttttcttttcaaaaagaaattattaatttttttttcatgaaacgcaattcaaccgttcgagaaatatgctgtcataaataagtagtctagtgcagaaacaaaattaatatcacataaaaaagaaggttgttaattacaaaccatgtttcgtactacaactctaatttgtaaattcttatttcagtcacaaaattccaatttccaattaagaaaaataaacgtagacggctaagcccacccatctaaggctaagttcgagaggtgaagtacgcacgaaaaatatgatggtttattaatatgattttttttaaataactttcacataaatttctttaggaaacatatcatttaatggtttgaaaaacgtgcacatagaaaactagaacgatgagttgggaaacaagagaaaaacacagccttaaggcttcttgatcctctagttggaggttgattttcaaacgcatgataaacgagaaagctcattagcacattattacttagatatttataattataaacttgaaaaaaatatttatttgaattttttaaacaatgtatgcataaattattttttaaaaacacaccaatttaaccctttaaaaagcatcctaataggaaacgaggaagttaaagattcaccgaaggtgtgtttggataatggaaaaatggggtgggattagaattggtaaatgaatcagggttaggattaaatattaaaatgaaagagggagaatgaatggttagagtttaaatgtgtctttttggtgggtagaaaattatttgccatacactccccgagagcggtgcgtgcttgcgtgggcagaagcgtctttttcgttggaaaaaaaaactgcttaaaaaggaaacagaaagagcccagctttggttgtcaccgtctcaccagaaacgaaacaaaaagccccaccacctaaacctcctcgatccgaccgagactcctccatttcagcggcgcacgcggagagcacgcgacgcgagttcgtcgacgaacaaggctagtgcagtagttgttgctgcggaga

SEQ ID NO: 27797 - DNA, 1501 bp, Oryza sativa
aaggaatcaaatctgaaacctagatgaaaccgagcggagagagtgaacgtcacatgattaaacatgttttcatatatagtagtagcaggattgatcaggagggagcagtacgtctcagatcttaccaattgcattatgatttttctaaaacaaaagggccaatgatgttactcatatgactacttatgaatagatccaagctaggaagctagttttctcaaaggacataggacatctaagtaatgccacgaccaagaaacaacctagcttgctaatggttttcttcaacgaaaccaggtatcatgtgtgtcagcatcagatacatatcaatgcttgattatggagtcaagtcaagcaaatttgtcgtgaatataaattaactactcaattttatgttcttattgtacccaacctattcaatcatgtacatatgtacttgaaaaagttatcgatgcaggttcatgcactggttcacatcaagaaaatggacatttggccacgtacgaaacacggtttcgctagaatggtatcctgaaaacgcgtttcgttaaaatgctaatatgaaacgcgcgctcaccgttactttgccattttgaccgttttgtgcattttcgaaatcatgttcgctcatccgtcgggtggtgagacaaaattaaccatccggtgtgtcttgagtgcggtgagcagggacacaaccccgccgccggagttatctcggaggcccgtggggtcgagtggcagcggcggcgctagctagggttttgaggtgggccccatgcctacggcggaggcggagggagacgcggtgagcatcgggttcgcggagctggagaggcaacaatagctgatggcgagctagagcgcgggcctccgccgctatggactcgcttcgccgccaccgtatgccgatctggtcgcgctgtcggccatccggtcctccccgccttcctcgagctccgacccgccgtcaccagggttgccgcgcgcgaaagggtggaagggcaatttcgtctcattacctagtgaaggagcgaaaataatttcaaaaatgcacaaaacgactaaaatggtaaagtggcagtgagcgcccgctctatattggcattttaatgaaacacgttttcggaatagcattctagcgaaaccgtgttttgaatgtggccaaatgtccattttcttattcatatcagtagcatattgatcgaccatcggaagcagtcagagccagagctacagctagtgttgttccaatgttagatatggatgaatagcagtctacattcaaaatcaaatttatttctacgttaacacttgtactacagcatatacaagcgaaacggaatatttgcaaatgaatagtagtttgtgaataaaacttttatatatgtggtcttagcaatctaaaagcaaaggctgaaaaataaattaacttcgatgaaaaaaaacccctccaaatcagctctaaatttaaagttaaaaattcaaattttgcctgataagc

SEQ ID NO: 27798 - DNA, 1501 bp, Oryza sativa
gtgagattagatctaaccaggggcatgtgacagcctctgctggggtttttaagatccaatcctttctgtttatcctgacaagaaacagcctctgccatgcggtttatataattgttactgcatggaatgaactgtgttcttctctctgtgtgtcatgtgttaccactaagcacccagctgtgatgtccctttttattcttatttttcaactttcaactctggagattcttaccagcgcagttagttcaattctcaccctgcaatgatcataattacagtgcagggctttactgtctacttacacgatcacattcagaaatggctgttaatatgtaatcaaacaaggcaaaaaggtcagttaattgttgtcttatattccaatcaacatgactctattctttctaacatctatgtttttgagttactgacttgagactttgctgcccatatattcagagtttttttctgcatttctgaagtaccgatgacccatttttctcaagtaagaatttactaattcccatttccaagttgtcaactcttgatgttcttaattcatactagtaagttcaattaccaccctgagatgtgaaaatctacagccaagtccttacccacagtctgttaaagctgttgctctaactgcatcttatttaatcatatcccccttgacacacacagcctttccatgaagttgcttaacctgatgccattgccatgtctctgggggcaccatcttttactctcaagccagcaaagctgttgcttcagttaaaaaatttctgcatcctctctcactcccctctttaagctccaattggggcattgcactgcattgcaaagcaattagtcgttggtgatggctgtcaaaaatttatacacccaatcaccaatcctaacagcagcattaaccatggtgattatgtgcattgctactagaggccataagagattgctactaaagtagtcatagaagggacagagtgcagtgttagtactgtgctctgtggccttggatccagagattctgcagggacagggacaagtctccattgcttcattcaccttcatgatctcatcagactcaaaaactcttcaacctctcctacctatttagacacctcattcttgtttcttgatctcacctcttccctacaagcatataaaaactgtaccatttgagatggtctctcttctctctctctctctctctctctctctctctctctccttcatactaaaactttattaggacttcattgattagttagaggttagtagtacttagtactagtcttgcgacataagcaagaccaagatttgggagcaattaacacaagtacactagaatccctataggattagctactacactttgcatagtagtgtgtgttcttggatatacttgcatacaagtagaggtacaaagagtgtggttattagtgtatatgcgtgatgagtagcagaagcagatggagggcggcgccaatggcgtcgaggt

SEQ ID NO: 27799 - DNA, 1501 bp, Oryza sativa
aacacccgccatttgtcgatttgcgctatacctgctttaactatatgaaccgccaaaccatatctgctttaactatatgacccgctcatagatatatgcacatgctcatttttttaaaatatattttacaactctaaccctgctcttccttgtaaaaagtaaaaacaactaatgacccaagccaatttatgttatttaatctgatcaatagacatctaagattctagatgtttcattaagaaaaatttaactcatgtttcttaacaacaatatatttctagtgctcgagagatcaaaatagttttcctaagtattgctcttgcagctattttcttcttccaatgaggctaagttaaaagaagcaagtgtacttatccatgcaaatatatcgagtctaaccaatccatactaattaatctaacgaatagcttattaggaaaagttataaaaaaaacatgcagtcatttccacctaacaggttagcacttagcaatatttaaccaaccattttttgtttggacaaggggcgagggtgttgtcaaatacgtgtttttgatgtttaggggtgagttttagataaagtgaagagtttagaattgtcaaatggacttatcccacaatagtactttatatcgtttcgtttcagactcttcttgggtacatttgatgttttgtataacacgtgtatatttaagtggtggtgttatgctgaaagatgattacactttgttttgtttggaagcttgtataaattatgtcacgcaatgtgcaatgtctttacctgctttatcactccatattggatatttattccttgaacaaacaaaaccattatcccatatatcttagtagataattgggtgccagactatatatatatatatattgctaaatgcattgtcaaaataaaaatatttcattgatggttgctagcatcactgaaccgatggaaaaaccacccaaggttatttgcatagggatgagaccatacatgtagaggtcttataattacaggatgtaagagtaagcacactctttctattctttcccgcgcttttgttgtatttgaaattgtggaacggtttttttgtcgctttcgatggaggttgtcaatctattttagtatagtttaaggatatcacacacaccaccttataatataggttactttccaatatacaaaacgttaaacgcgtacccaaccaaaacatatcattctttccaattatggaaaatgcgcaaggcgacatccgtttgtcggttttcactatatctatttaactataaaccgtttatagatatactcacgtgtttcttttcaacatattatgcaactctacctctgctcctcgtaaaaaaaaaactaatgacccaagcaaatgtaagttgttgatatgatcaatcgacgtctaagattcgatatataaatttcatcaagaaaaaaataactaatgtttctataacaataatatgcataatctttcagggagatcaaattaat

SEQ ID NO: 27800 - DNA, 327 bp, Oryza sativa
aaatttgtgaaatatgtaaaactatatgtgtacatgaaagtttatttaacaatgaatcaaatgatatgaaaagaataaataattacttaaattttttgaataagacgaatggtcaaacacgtactaaaaagtcaacggtgtcaaacattttgaaacggagggagtactatttatgttttatcattttttttatttatgttttatataaaaggattttaagtaaaacgaacgattaaatgttggacatagagatctataactgtatttaaaatgagatagagggagtatcactggtcgtctcgttaattgattttttttatttacaga

SEQ ID NO: 27801 - DNA, 1501 bp, Oryza sativa
gtcttaattaatccatgaatgagctaccaaaacttcaaataatatgacattccccgttctgtgtagatcaattttcataacaaaataaatccgtaattgttcacaatttcatgtaatccatattaaaaacttcgtaacgaaacaaattcgagaagaatcgaagaacttatatatgttacggtcatttccttttcatatctgatagattgatataataccaggggacaaaattacctatataccctcccacttaatctctatttttatacctgcccacctttttttaagtaactttctatgggtaccttgtatcgtaaaccattggattgtacctaatcaatggttaacgtgattttcaagtaccggagaaagtctcttttcttttttctttttcggttccagtctgtaatgaactctgttatgctttgttagtaaagctgggcggaaaccctttgatctaaaaaaaatatcgctgttaaattgaggaacctccggtgaacttattccttttcacgtgaatggaccgggtttcgtgggctttcaaatcgaggcctagacgtgaagagagtgtgggcctaattgagtaaatatcgtattgggccagtgggagaaatgggctggtcaagttaggtcaattggagacgggcgctttgggagtcgggacatgtgtgtgctagaatagtcggtgcaaatcatggaaacttcacgtgccactgtcagctcacaacgtggtcaccctccccggcctcttgctccctgctcatcttggatctttgattttaaccttggtttatcgaatggtttgttaatcacttttgctaaatcgtgtggtattattttacatcatcgtattaatctatttttcaacttttttatgttgatatttagggcatgtttgattggtaactaaatttatcacataaaatcttaggtaagtcataattttaggaaatgtttgtttttttcctgccacaactcgatccacatgttatagagtggactatatttttatctaactttatataagtttagtttgttactccctccgtttcaaaatgattaacaccgttgacttttttaaacatgtttaaccgttcatcttattaaaaaaattaagtaattattaattcttttcctatcatttgattcattgttaaatatatttttatgtaggtatataattttacatatttcacaaaagtttttgaataagacgaacgatcaaacatgtgctaaaaagtcaacggtgtcaaacatttcaaaacggagggagtattttgtttatcgtaaaagtacagtaagactaaggttgaatatgtgttaaattaattacgcggtaaagggaagttattgaaacgatttgatgaaaaagttggaagtttgtgtgtgtagaaaagaccatgtttagattttaacttttttttcttcaaactttcaacttttccgttacattgtttcaatctcttcaaacttacaattttaacgtgaaactaaacacatc

SEQ ID NO: 27802 - DNA, 176 bp, Oryza sativa
gtctatctatccaagtatccaagttggtagtaatagaaaatgtcttatccgattttaagttcttatattttagaacgaaaggactacaaccggttcaacatattgacgttgttaattaaagggataaggagttgtaagggattattattcgatctcgatctctccctccccgaagg

SEQ ID NO: 27803 - DNA, 305 bp, Oryza sativa
ggggctttggtgggataggggggattctccgctatcaggttgagatcaatgcttacgaagacttgtctgatgaggagtacgatgaagactacgaatagcaatcaattgaaacttcagtgattccggtccgggaggagcctgtgctggccccgaacgcatcgggacaagaggaggccaagacgtccacaagatcatcggggaacacttaaggtccatgacatattgcaatcaacctgtaaacatcatatatttccatgtaccctgtgacgttggatctaatcttctatctttcctgtctttatagg

SEQ ID NO: 27804 - DNA, 185 bp, Oryza sativa
ctagattcattagtatcaatattaatgtgaaaaatactagaatgaattacattgtgaaacggaggaagtacgtatttttttttagaaaaaagaaaaacttattaacacgttttagtagtagtaactttatgctattgctatatagggtcgacctttaaatttggcacctatttcttcttggcagg

SEQ ID NO: 27805 - DNA, 246 bp, Oryza sativa
acattgggcatgccctaaattattatagcacttcccacatctatattgatatattcatattaatgttaatgaatctagataatggcttacattgtcggagggagtatgttcatatgcactatagctgtgtataatgttaaatcaaattcagttggacttggatcgtaattttcttattccaaatctctttggattagcgagaatcctgcttcaaaatccctgctctcctcatccgaatggattagg

SEQ ID NO: 27806 - DNA, 820 bp, Oryza sativa
aattaaggacagattagtaggatagagaaatgaccacaataaccttatttattgaacacaatacatgcacacattccatatataaatttaattaaaaggaatgttaagacaacaagttagagatgtgatggaaggaatggagattacaaggaaatgtattttgatgtaatcaatttgctagatcccacattagtagaaatacaatttttatgggacaaaggttcaaaggtagaaattcattttctatgggatggaggtagtacaaagtttagagtttgaattataaaaatcaaacataaaacggtaggttcacaatatcatgtaaaacctgaacaaaaaagttattaccactacaaattcaaaatctcaaccgagtgatctatgaagttgaaattaatcagcatacagtagttcccaaggtacatcatcttgtaggaaattggttttccataatttcggtatcgttcctaaacatatcatccaggcaatcccacgtcattcctataatttataaagttatcacaacttccctatctccaaaaaaaatccaatcgagacaagcagtctaagatacacttagttcccacctcattcctataatttataaagttatacacttagttcccacctcattcctataatttataaagttatcacaacttcccttctccaaaaaatatccaatcgagataagcagtctaagatacagttagttaaaaactcgttgctagacatctagcaattatcccaaactacactgctccaatcaaaagcagaaacagaactagatagagatagcagcatttttatgcagtcacat

SEQ ID NO: 27807 - DNA, 1175 bp, Oryza sativa
cttcccctccaccgccgctgctggtgtcgctaagccgccactgccccttcgcagccaccaccggcgctcctccgcagctgtcagccctccgtagttgcctcgccgcagttcctccgccgcaaccgccgctcctccctcagcaaccgttgccgccgccgctcctttgccgccagcgacggccctcctcatcgctggcccgacgcttcccctccaccaccgctcctccctttgcccctccgcaactgtagccgccgccgagccgtcgctcctcctgctgcccctcgcagtggtctcgtgagagagagagaggataagaatgaacaaatgagtgatagacaaatctgtctcaaatttgttaaaactatgccaaatttaacatggttaattgagcaggggtaaaaaggacaatttttctcttagttaacaccgttatctatcttcacaaaataggtcatctctgatctttagttttaaaaagcagggtcaaatgagcaaacctaaaaacagggtcatattggtagttagacattaaaacagggtcaaacgagcaattgctccattttatctctcctaatcaaatcacaaagaagaaaatagtgcatgacggtgtttttcgataaatatacatttttcggtagtacgttagtctaaagatttacttttacggtgtcatataagtaaaattttaaagttaggtggtgtttgggatggaagaaacttattataggaacttatgttttcgtgagagagattaaactatcccaaacaccaccattgtgtaaattttgcctttgtattcggttaattttttttttgtctttttggatgtcctaccaggggccaatcgtacactgcctgctcggaagagagaaattggacattctgccactgtaagagtgggtttcgccacaatgccattccccgaaatggcatcgttaaaatgccactgccaagacttggcttacatttgtttgccatttgagccatttcactctatttccacctaatttctcacccgggctaccttgggctgccatcgtcgcagtggcagtgccggcggcggtgtgccgcgatgacgagggactaggagaaggtgtcggcgaaggataagagcggggcggtgacgctggccagtagcgaggagcggcgcagcgccgatgagtatgcttggcgcg

SEQ ID NO: 27808 - DNA, 214 bp, Oryza sativa
atcgatccagtttattgttttttttaaaaaaaaatacatatcatttatttttatttttgtactctttactgaatcagcattcttatttgattcattctatcaatgtttaactttgtttttccatgcaatgatgcttttgttgatgaacatgaaatgcagcattaagtaactttttctgtcctttgcacaagctcatgtaatgattcatgattgt

SEQ ID NO: 27809 - DNA, 743 bp, Oryza sativa
tacagagttcatcacgagtggaaacatagtgaattttataatagaaaaaagggaatgctgggctccccaactccctctataaagcattaagcgatgaatatctacttatatataccaaatattgcaatgtagactttctaaaaaaacagatgaatttgaacccttctgtctaatcatacacatccccttccatataatgaggtaaggagattgtccagtgtgacatttgcaagcaagtcataaatactaactaacctgtgtacccaaccatccaatatggaaatcacataaaataagtgacgtcttattgaaaataagactgttataggagtaaatagaactctacaatagaaatgttgtcatgagaaaaactctggttactggacatgaggacacaaaactacaatactaatcacataatcccatcaactcattggtgccaaaactatgccacaaatcacaagcagaatgccagaccacatgcattcaacatgttggaatggacggcacaatgcacctgtctttcttgctatttcacacagagggacaccggacacggaaaatcacacctttttttcccaagcaagtccaactcaagaaccaaacttaagctgagggggtaaaccacagcgcaaggcaagcatctacctccaccaagaaagcaccgccaaataacgaattgaattggtgcaggttacctcgaacaccaacggtgatggatacgtattccgtaaggtggttca

SEQ ID NO: 27810 - DNA, 484 bp, Oryza sativa
gtaggacatttttgttctttgtcatttgtccatgatatgtcaggacaacaatgcacagctggtctttctactgatccttgatttggtaccaccagctttgcatagcatagcatatctcatccttatcttcaaacttttctttgattagtttaaccttagctcatgcagttatcttgtaaacttctccgagagagcaaaggaagctagtaattattaagaacaaatactatttgttaaaatactgtaaattgcaaaagaaaaaccatttccttgacaagtatgctggtccaacggcatcctctgatagtctgattaggagcttccaattttttattagacggtttccagaaacaacagtcgatgttctttggtagtagatgcattgttcagagaccacgtgagcttctcttaccatgaattaaactacaagatcacatgcctgcagtttgatcatgtcttaaaaagttactaatttcttggcaga

SEQ ID NO: 27811 - DNA, 1501 bp, Oryza sativa
atgagcatgtgcatatatctatgagcgggtcatatagttaaagcagatatggtttggcggttcatatagttaaagcaggtatagcgcaaatcgacaaatggcgggtgttgttcatgcactttccgtaattggaaagaatgatgtccttagttggggagttgcacgttcgttgcattatgcgtttttaacattttgtatattagaaagtaacctaaattatgagattgtgtgcgtttgatatcattatattatactagagtcacttgacaaccccgttgaaagcgacaaaaaaaccgtaccacaatttcaaatagaacaaaatcataggaaaagaaaaaaaagaagagtatgcttactcttgcatcttataattataagatctctgtatatatggtttcatccctatgcaaataccccttaagcacttttaccatcggttttcagtgatgctagcaaccacctatgaaataattttatttttaaaatgcaagtagcaacatatgaactgaaatgtctggcaccagattatccaccaagatgggaatttatggtttaatttgtttattcaacgaaaataaatagtaaattgcacattgcacattgcgtggcataatttacataagttgtaacaaaacaagcgtaaagcatctttgagcataacaccactacctaaatgtacacgtgtcatagaaacatcaatctgtacagcagaagagtgtgaaatgataaagtacgtttgtcacacccacaactgtacatatcacactttccctgatcctcggcctttcttttccatcaaatctagctagctaaattctaagcttataatgatcaaaacatggtgttggtggggaagcaccgatgttatgcacatatgcgtcttccatgtaatcgaaaagatcacggtgtttgcgctcttaaaaaatcaaatgaaaacggatctctggttccagattttcagatgttgtgtgcgtatacgtcttccatgtatcaaaaagattattatgtttgtgcttttaaaaaatcaaatgaaaaagtctctttggttccggattttcagtccaaagttcatgaacattatattacatgttgaatgaagtatttaatttatagaaaaaggtctcaatacaccaaaacttaaagttggtcccgtttgtcgatgcttattaactatgcatacaagttaaaataaaattataagtttcacaaaaacaaactactttttatttggacagttttaaagccaaaagccatatatgagagcagcttttttcgctggcgttattatgcgtaaagattgcttatgcttgcagttttgtacttttgcataactcaaaagtcaaaggcatatacttggtgaggttgcttctcgcgtttcaaatttcttaatttttggcagatagcagctggccagatttttgtgttggtaatccaaaatgatgtaataaataactaataaaacaagatgaaggcagggagaaatccctccactacgaattta

SEQ ID NO: 27812 - DNA, 1501 bp, Oryza sativa
agtttatatgtgtatgaaagttttgatgtgatggaaaagttggaagtttgaataaaaagttgggaactaaaccagtcctaatttacaagacgaatattttaagcttaattgctccatgatttgacaatatggtgctatagtaaacatttgctaattatggattaattaggcttaataaatttgtctcgctgtttactgatggattctttaattagttttttattagtgcctgaacaccctatacgacatcctacataatacccgatgtgattaaaaatttacactcctagatctaaacatggccttagaccggaggatgtattggattaagttactcaaaatctcagacgaatccggaacaagttttgaaaaaaataaaaggagagtaatgttaatgaacaaaattaagtgcagcatagcttcggtttgtacacttatttcgtagcaaaaaatgttgacatctcgatgggaatagaaggttctgacttaaagggactctctggttcgggcgttcaatggtaggaggttaaaatcggacgctgatatcagcataacgtcagcgctcgactcacgtgcaaaactattttaaactgttttttctcttaaattacttatccaaatcatgatccgattgcaccattaaattcgttgcaattaaatcttcaaaacaagaccacacatagatatattccgactgaaaaattttagcttatcattgaattatttttaaatgttacatgatgtttcaccaggtatatcggaattgtttcactaagtagattgaaaatgtttcattcgtttaaatcgggtgttgtttcaccttatattaaaacaatgtttcagcaaacagagaaagaatgtttcagttcactgcaacattagatatgtacatagtgaaacattgtgagtacactaggtgaaacattttttgtggaacaaaaaaataaaacgaattcccttaatagagggttttcaaaatatatgggtgatttgttgcaatggaatatttcagttcactgcaacattagatctatacatagtaaaacattgtgagtgcactagatgatatttttttgtggaacaaaaaaaataaaccaaattcctttaatagagggttttcaaaatatgtgggtgatttattgcaatggagtatatggtgcggctacgcgtcagggaggggagcacctgatccgactcgcccgcgccggtcgcccggcgtataaaaacacgaaaagaagaatttttacgcaagaaaactgttacaggtataatcaacggtgtatagtcatcaggtattttggtctcactatattggattggatgtggatgtgtgcgtcactgccctcgtggattcgtggccaatctcgcgaagtcgcgatactttggcgtagaggcgcgcgcactccacaaattccgctgtgcacacgcgccaaaaaagaaaaaaaaaacaatttctggaggcggaggagccggtcgtccaaccgcgagtggtccgctccga

SEQ ID NO: 27813 - DNA, 1501 bp, Oryza sativa
ctatggggagtcttttctagaaggaatcagttaaggattgctctcctcatcctggtcattgcgcacttcaagaacaccctaggctattgatcgaaatgtggcttaatcacgtttgttaattaattattaatatagcaaaaggtggtcaagtattagtcctcttgagcgcacacttgtcttgtcaatgtatccatacggtttaggcatcgttgaaatcttgggcagatcacctgaaatttttttcgaaacacagagaacaaacacatacatacacgctcttacttatgaacacctttaaaaaattaaattaaataccactaaaatattaaccatatatacgaacacctatattaaatcagaataaaaattaataagagcacccttattaagttggagactaaaagtcgggcgggtacgtgattaaaaaaaacccaactgagctaatatactcttcctacataaatatcctcattagctgtgattatatgtggccacatcgtcgagaatgtcaacctttatatcattgagcttcttagagcaggtacaatagcaggctataaaccagctacaaatatattttaagaagataaatgagaagagaggaggggcagcgggctacagatttgtagccagctgtagcacagactacaagacacagtgtgtgtatgacaggtgggaccatgtattaatagtgtagtatgtaactattgtatgaatgagctattagattggctatatatgaattggagctagtaggtggctatactattgaacttgctcttatatatcagccatggatacaacaaaaaagctattaatgcatggtccattcctctcattaactgttgtctcataaaaaactgaaattaatctgctttattcctgatattgattgcttattactacatactaactaagtattgatactgacttaatgctgaaataaaccatcaaataatcactcactagatacctactactcccatttcacttcaataattcaacaatttgagcacaaatccacctcaatggctcttgctcccaggctacacttttattaccccttgtttcatcccatataaactttataagtgtagtctcaaatcatgattgttgaaacataatatgattgtttatatttaaagttgtccgggcataatttgagagcattagtgagatcgaggtaagttctattgagagcaagtttaatagtatagctaactaccggctccaaatcatctatagttaatttaaaatagccgattcatataatagtcacctataagagtaggtacaatagcaggctataagctagctgcaaacatattttaaaaagataaatgaggagagagaagagcagcgagctatagatttatagccagctgtagcacagattctaagacgcagtgtgtctatgacaggtgggaccaggcattaatagtgtagtatgcaattattgtatgaatgacctattagattggctacagatgaattggagtta

SEQ ID NO: 27814 - DNA, 1501 bp, Oryza sativa
taaataatagaaaaatatatctttaaataccatcgattgttttcaatagtactacagacgtatgttttttaaaggaatataatttaaagaaaaataaaatgtgactttttacataacgttaatttgatactttatattttttatgatgtctagttgatgtatatttgtggaataacatatttttattttatcttttatgtagaaaattatattttcgatttgtttggatggtactacatacgtatattttttggctttattttactcgtggctttaatttttttttctaaatacgctggcatattttttccttcctaacgaatcgtaggtgagcagcataagctttactgctcttttcccattcttaggtacttatatttattttgccagcgaaccgatgaacaatattagagttttattgatttttagtcgtacgtatactttggaattcttatgttttttttcggccaacattaacatagtagtttctatttaaataaaatacatctaatctaatctaatcgtctaaattatcgggtccaccgatttaagtgaaaatcgacgatgagattaggcattgccacatggcggtctagaagcgtttgtagaagtgtcacgtgacggcttgagagcgcttgtaggaagattaatggacttttagtatataatagatagatgtgtagacttggaggaattttaaaccgaggtagagcgagcaagggcgagtttattccacctctgccttgaaggttataacggttctattgggtgaaatttgattgtttcgattacgagtagtggtcaaaaaaatgagtagacttactaacaaaagtctgcaaaagaataatattatacagaagccggaagtagctccttgatgtaattatcttgattttaataaagcttccttcatctgaaaaaggaaatactgaatgataaagagagaatacttggcatttcactgggaaaatatttttttgtcaaacctaaaagttgactaaaaaccatcttgcgctgtcatcttcaagaaattccgcaataactattgaattacaagacacaacacacgaactcctagagtgactcacaatgtggcatcaccgtccagtaccagtaggataaccttttcatagctcaaccatacatattgtgtatttatttatgttaatccatcgtgcagagcaaatgatgccattacgtgatcaatgaattttttttattatcaagtcaaccaagcctcaggaaatttaagtaagttgattcaagatcacataaactatcttttgtttattcaaagcatgaaaccagttacaagttaattactcagatatgcataagcagagtaaaaaacacttcagctgctgacacagcccacatgacaaacggcctatataaaccatgtaccattgctatctccaaactcaaacaaaagtttgtacttccaaatccaacaagcaaagcctgtctcatctctttcagtgaatcacatctctccagatca

SEQ ID NO: 27815 - DNA, 1501 bp, Oryza sativa
aaaaacattgacttttctgtagttgacatggtgctagttatcttgaagggtgtatgcttaagtaatccctagaccagacagccaatgttgtgccaacaaagaaaaatctcgatggtaggctgcagcaaaatacttgaagaaaacttatttattttcactctttggggatcaattaaccaaaaactcttgatattagggaaacaccagtagtttatgatggagtcattgatgcatgactctacttattaggtaaatcttattaccaaaatattatacacacaatgatgcgttttcgataggaatttaatgaggctagagatttgttgttaatctccgtctctttgagagtgttaggggatgcattcaccaatgggtggtgacgtggtgtgcgtctcccgtgagggtgtgtgtgggggtgtgcatgcatagtggtatgtgcgtgtgtacacctttcatataatataaaaaattaatcttaatattggctgcatacgtgagctatttattcgcgatgcaggtccgttggtgcggaaaaaggaaaacaatatgcatataaccctggaataatgaaaaggcaaataattaaatttctttttccagcagacattgaaattctgatatttcttcttcttgtctaaaaacgtggatttcttagatcttttctcactatcccttagtcacatttctctctctctactactgatgtctggtcaacattcatattcacctggaaaagaccatcaaccgttagggacttggagtttgcttccaatgaaaagttttaaaaaatttgagtttgtaacacaaaaggtaagaaatattaaaatttggcatcatgtgacatcttcaaaatttaactagtgatttttccatgaaattcagtagttttgtgtgacaatggtccctggttgtttgtaaggctcagtatttgcttattttttcatgggtagaatatgagatggttcctcacttttttgaacttttgttggaaaaatatttattaccatatcctttgcagctaggaacaactttaaagggcgaaagagccatctctgagatagagtgacactggtggagaaatgctttttagtcccggttcgtaacctccctgtagtctcggttttccaaccgggactacgaatccgggactaaagatcgctatctttagtcccgctgggactaaaaatcgatttttagttccggttagtaacaacaaccgggactaaagatattttttctttttttttctctttttcattgttttagtattgaatactgatttcacaccatcccctaatcatgccaagaaatcccaaatccaaattctcacatatcacagaacatctctaaattctcaaatagatcatctccaaatacatcacaaacttttaaaaaattacatcacaagttctaaaaaatacatcacagatccgcatcacacacaaatcaaatacatcacaggataaatcgtaaaaaagaaaaaaagaaaaaaaagaaaagc

SEQ ID NO: 27816 - DNA, 1204 bp, Oryza sativa
tcaatgtatgttgccccgagaacgtgaacgagaacgagaacgatcgaacgaacgagagcgataacgagaacgatcgaacgaagacaagtgagaacgagggaacgaacgtgaacgagctagggaacgtgaacgagcgaacgaacgaggacgaacgttaacgtgaaatgcaatatatatatatatatatgtatatatatatatatgtatatatatatatatgtatatgttacttcgcatttgactatatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgaatatatatataagattactttatttgtaattagacttagtatataattattgactacggaagtggtgtgacaagtagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttaaaatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaagtttgtgtagggttctaatgtatgacatttacacttagcatacatgacttagattgttaaaacataaatgtctcgtgacttagcagatgtttcttgtatcaacaga

SEQ ID NO: 27817 - DNA, 1501 bp, Oryza sativa
tactgcaggataattaagaagaagatcagattaatttacaccgttagatcaaatataatggcagtatatacttgcagtacaatgtacgtaaaaatcctcttcacttatacctgcacaagaattcaacgatcaaacaatcggttcatgatctgcaatatttggacaagaataaatgatctctatcaacaatgttcgtgcatcctttctttcttggaagaaaggcttaagggggattttactctacatatgcacagggtaaaggtgtcaaaaaaactactttggcaatcatggattgattctcttatgtaacctcttgttttttcttttctttctgttgtacgtatcgttctgtaatctgtaaattgttaatagtagtatactagtatagtgcagtagaaatcaaaaaaaaaaatcggtgtgttttttgtttaaaaaaaaatcggttcatgctgtggtaacggtatcaaatcacataaatagttatgcttagcaatttcggttttgatcgattgattgttgaaatggtactgcttatttgtatatcagaactaattcactctgatatcacatctctgttatatatacatatggagaagtatagtaattttgaggagatattgatgcttcatttgaggctgttttacccacagaaaggtattcctgagtttatctgttcttttgtacaaaatgaatttccaagttattgtgtcaacacatatataattgaagtgtcaacacatatataaacgtatatgcgtgcaatcatgcatagggctggtggcaagttattataattgaagtgcaaacaaaaattgagaattcaggagtacttctacaagtcaattgtgcaaaaacctgatgtgaacgtaggagttgtctgaaactctgaatgaatattgccctttctgctcagcagaggccaaaggcaagtgaccgagacactgaagcaagaatgatactacgcacttgtgtaatacataaaaaaaattatacaaatacttagaaaatattcactcaatttttactcaaaaggacttctgtaaggacttctaatcagcaaagttctactctgaacatttctttagtcaaactatgctttatattttgattgaaggagcagtagccacataggagttcctgaaacgcacgctacttgggatatatcatcatcctatataaaaaattgaagagatttattattcacaattgatgatgccatcttcagatagaaacaagagtacccgcacgggataacttgtaccaatattatctatccatttttctactcacaaattaaaagcactgtgttcagaaaccacaggtgtcacaggcaatcaaaccaagaacatagaaaatcaggcgcccacatgattcccccaattgccagcagatgctgcagaagattccaaacacatctgtctctacttttatctccttttcctctccactagtattttatttttttgcaatatttttcacactccaaaaccccatcattttt

SEQ ID NO: 27818 - DNA, 1501 bp, Oryza sativa
actcggccaccacgtcagataaaaccggggtcaataccaccaaggatgtggctacacagctagtggtagctggtttgtctaaaccagctaccactccatctattaaagatagtatctacctatacttcaaataaaattttctcttaaactactcatccaatctatgatccgattacactgttgtgttcgtaacaattaaatctttataacaaaatctcacatgattatattttgatgaaaaaaatataaattacttggataatatatctaaattacatttaaatttcactaaattacttcttggacataaaaaagtaattcaataaacctaaaagttattccatcaatgttatttacaatccatgaaaggttttatcttcttttctcattctatatgaaaagcgaaaacgaaaggaaaaaaacaatcggtgattaaacggatttacagagagttacttctcaaccatgcaaaagttacttccaattaacattgaagttacttttaaaaaatgttaaacttacttgtgttgatatgtactgattaaatttaatttctagataaaatcatatttttatccctacaatgaatttacttctaatatcgtgataaaattacttttgtgttgttttaagttacttttataatatatgtaaattacttttagactttattgaatttatttttatatgtctaagaagtaatttagtcaaatctaaaagtaacttatatatatatatgataaaagtaacttacgtatataataaaagtaatttacaaatataaatattttttcatcgtaatataatatgtaagatcttgttgtgaagattttgtcagggttatggataccacatacctaacagtagttgactaaatctcggcaggacccactacatatcatgtcctatacggaagcaaccttcggatataggaggagttccggataaggaaagacgaccaccacgatcaacacacacaaaggatcaacacccaacacaatcgacatagaagccacaacatagaagcctacatacgccaagacacgccgccggatatcgacttcagggataagcacggctagtaccctacggtgtctccggatactgtcaggagagacggaagcgctatctttgatctcgctaggcacggattcaaggaggaagactaccctgttgttgactacgagtcagatcttcagaccgccatgtcgacaacagttagataggctaccccaaatattgtactggtgtgattatggtgaataagagcaatactggcttcggccaacaggatgtagggttattacctgacaattcaggggcccgaacctgtataaaaatccttgtctccatctcttttacctcagtctcgcgtatatcctagcaccgacgatccccatgccatgcaaataccgtagtcgagatatcgaatgtcgacagttggcgcgccaggtagggggattttggtgcttcaaggtttcgatgagatgggtttgagata

SEQ ID NO: 27819 - DNA, 334 bp, Oryza sativa
tgttcaaaattttcaaatataccatgtttgttcatcgctacaattttttccaaacttgcttacagccacagttatcaggtaatgctattaaggcaaggatttgatgaaattaacaataagatagatgtgggcatcaaaagaagggcctccaaatggatgttggcaccttctttaatcaactgtgtatcaaacccgtctggattcatagacttgagtatgactacgtcatcatgatgcctgccgagtaggattgaggacatcagaccacattatgggtactcaacaggccaatactaacataaccagtcatctgttcagccttatcatctgcaga

SEQ ID NO: 27820 - DNA, 563 bp, Oryza sativa
ccatgtttttgttctgctcagctgcttagaaatcctgaagattttgatagagtgttagcatatgctcactgtaaggtaacttctctagcaatgtgcatgaatccataatagtatggtatgtcatcttccatgcttaatctaccattctagtggattttaagaatttgagtgcttggacttctttagcgtgatgatgtgctctttttttttcgcgtgtgtgtgtcagtgtatgtataatagtatcgtatgatcggtgaatttcatcatgacagagatcgagtcggagatgcaaacaaaggaaagaaacgcacgcgcttagtcctctctaatcaaacatcattagttcgatcctgattcggaaaaccgcgcgaactttgaatttgatggattccttcacgcgtgcgcagcctgatcagagtcggatcgtggcacgaggataaaaggcgagagtgcggcaccatccttcctcggccaccaccacgcgaccgtccaagtttcttcccgccaccgcctcttgactcctctcgctctccctcgatctcgcttccgggctccggcgacca

SEQ ID NO: 27821 - DNA, 386 bp, Oryza sativa
taaaccctgtgcctgcctcctcgccaattcgccgttgcaacaaaccaaaccttagctcctctcgcttgggcttctcaccccgcacagccaactcttcccgtccatctcaatctccactgataatcgagacacaggccatgccgtgggtgcgcttcctcgtccggttggtcgtcttcttccgcgtcatcgtgtgagtagcgctcttttcttcccatcacccatggctgcatgcagctcttgttagacatttgacgcgcgccattagtgcaatgaatagctaaaacgatcgatcgtgtttcaatttacaggtgagagcaagctaaagctactcgatccgtcgatcggccggcggtgactgactgagaatgtgcattggtttccaaggg

SEQ ID NO: 27822 - DNA, 1501 bp, Oryza sativa
actataaattgactgaaatgttctctccgcaggcctatcgatgcccttagatgtcattacaaaatctgacagatcaacaccatctggaccaaatctaatatttccttcaccgagaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttataggggagaggcaaaaatcgcccttccccagggcggcaagggggccgcctgcaaaattccatgccccctcgccgcccatttgcaggcggcccccccacagtacaaaatcgccctagcggagggcggcaagggggccgcctgcaaaattccatgcccccccttgccgcccatttgcaggcggccccccgcacagtataaaatcgccctagcggagggcggcaagggggccgcctgcaaatttcgttgacggccgtcgcccgagagcgaacggccgtctgccacgtcattttcgccgccctctgagagggcgatttttaaaatggaaaattattttttgtaaaacttttaataaaaaaaattataaataaaaaaaattcctcctccttcaacctccagacacacagaagcagagctatgttgtctacattagttgtttacgaggacataaattccgttattaacgttttattagtcattttctgtctaaacggcggtataattgcatggttgcaagacccaaccaaaagcatgacagttcattagctttgctatgcatgaaatttttttagaaatatacgtatttctgtagaatttgcaagaaaataccgaacgcgtgaagatttgcaaaaatatactgccggtaccgctcgttcagtcagcgaggacggagcgcacgcggtggcctaggcggtgcaacgatatcgctttgccgaatagcgagagcgcacggtgtcgcactctaaaagtgcgagagcgagccagtgggccccacaactgttgcgaccgcgacccacgcggtctcacgctacaggaacacgagagcggtgggccccctgactgcgacggcgcggtctcgcgctagaggaacgcgagagcggttaggtgagcctcactgcgcgcctaatggtgttaaggtta

SEQ ID NO: 27823 - DNA, 899 bp, Oryza sativa
ccgctatagttcggggggggggggtaattcgtactttttccttttcttaattattttttatagagggttctcctttggttatccaacatgtttttctatcgtaacagaggataagggagtattttctccatcccataaaaacaaaattagtatgacacgtgatgcatgctagtactataactctggacatgtgcatgtaaatgtttatatttaaagcataccccaaatttcagatattgtacattatatttgtgcttggattccaatttttcttgatcaatgtgtggatctctagttctttggagcgaatatgatcgcttctttttccacaaatttattaagttaataatagatatatgggaaaaaaaggcatgctctcgtatatttgtttttgaagaaaaggcaaaagctttgccttatgtatattaatagagcaggagaaaaataaacataagcaagtgtatatacagggttagtcgaggaaaaagactagcccgcaaaaaaggaatcgagctaagtgatatctcctaggattccaaactcctgcagagttgttgccccttctttgacccatgctctcagatattgacacgttgatttgctctataacgttccggtttcttcagaaaacatgcttgggtgcagtactgaattcgacttcagaaaatgaatagcggttctattccacacttgtgacttcagaaaatctgaaaatgaatacaagaagtttggccaaaatatagatatcattgcacgttcagttgtactgtgccacacgatgaattgctccttgcaatttgggaagcacgttcctagctccttgaccagttgacgacggaccacactcccgtctctgtacgtacgtacgtacgttcctctttggtctgctgttccctagg

SEQ ID NO: 27824 - DNA, 1501 bp, Oryza sativa
cttaggctgtgtttagttgagggagaagtttggattttggttgaaattgaagatgatgtgactgaaaaattgtgtgtatgacaggttgatgtgatggaaaaggactgaagtttggatccaaaatttggatctaaacacagcattaaccttaacaccattaggcgcgcagtgaggctcacctaaccgctctcgcgttcctctagcgcgagaccgcgccgtcgcagtcagggggcccaccgctctcgtgttcctgtagcgtgagaccgcgtgggtcgcggtcgcaacagttgtggggcccactggctcgctctcgcacttttagagtgcgacaccgtgcgctctcgctattcggcaaagcgatatcgttgcaccgcctaggccaccgcgtgcgctccgtcctcgctgactgaacgagcggtaccggcagtatatttttgcaaatcttcacgcgttcggtattttcttgcaaattctacagaaatacgtatatttctaaaaaaatttcatgcatagcaaagctaatgaactgtcatgcttttggttgggtcttgcaaccatgcaattataccgccgtttagacagaaaatgactaataaaacgttaataacggaatttatgtcctcgtaaacaactaatgtagacaacatagctctgcttctgtgtgtctggaggttgaaggaggaggaattttttttatttataattttttttattaaaagttttacaaaaaataattttccattttaaaaatcgccctctcagagggcggcgaaaatgacgtggcagacggccgttcgctctcgggcgacggccgtcaacgaaatttgcaggcggcccccttgccgccctccgctagggcgattttatactgtgcggggggccgcctgcaaatgggcggcaagggggggcatggaattttgcaggcggcccccttgccgccctccgctagggcgattttgtactgtgggggggccgcctgcaaatgggcggcgagggggcatggaattttgcaggcggcccccttgccgccctggggaagggcgatttttgcctctcccctataaagcccagtccctcctctgtgaaatttcattatattcactaaaaatccaaaaaaaacgaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 27825 - DNA, 815 bp, Oryza sativa
  unsure (1)..(815): unsure at all n locations
atcaaaatgagaacaaatactagcaatttttggcaattatattatcttgatgccaagagatactttaacttcagtatgccaaaatatgaaatgtttatgttacctaaaaatttattgaatttccagggagtagagtgctaatcacaccaaatgctaaacctagcaaggagctttgaaaagtttagtagtgactgctcatggcaaggtatacgcttgttatatacctctgttcaaatcaatctgaattttcttttggagcactttccttgtctttggtaatctaccctttgttgcattcatttattctgtgttgtcatctcaactatctccagattttagatggtacttgtttctgcaacagtatgaactttccagctgcttagaagttaatgcacataaaggacttcaattcttcacattgttatgtaaagtgcacaaaaatctggaggcattgtgtttgtgatgcaacaacaaatacgagtaggatcaacgtggattaccatcaatctggaacattttctagtgacctgtgttttttacaatggagatttctagtgacatgtgtttaattcaattttgttgttgccaatattactggatttggttcaagatatagctaanaggtgtgatgaaagttatcaaatgatttgtggttcgtttttaattgcattttctctgttaagaacactacttcattacatgccaatatgttaggatcccatacttggatacataatttccatttcttaaattgcttgcacaacgattacatttgttggtttgccaggtgttggagagaaacgcaatgtccaaga

SEQ ID NO: 27826 - DNA, 169 bp, Oryza sativa
gggcggagctatgtgtatcaagggggcgttaaaagtgaccagagaacccatccacttcggcaattacctgccacactaactcacatgtttcgagttgggcaaggctctcactatcatgcaagaagcccagaacttgaactattcatccacaatgacacgtaaatgagta

SEQ ID NO: 27827 - DNA, 1501 bp, Oryza sativa
tataatttatgacttgaattaagcaaatatgcaatattgatgctagcatatggtttaatttataaatgctttatatatatgctttattgaattgttattcctcaaatagctttgtaaatgctcattgtgcaagagaataaacaaataataaaaaaatatctatgaaaaaaatgaataccgaatccttgcaaacagtcttgacaacaagtatgtattcgatgtgagcaaaagtaatgggtgccgaatccttggaaacagtcttgacgacgaggacgtgcccggaataattgaaaaaaaaaagagaaaaaggctcaaatcaaagtgaaaaaattctcttgattgtttttgtgctaaagctaatttgagaaagagtaatacatgcaataggtctatatgtatagtgtttatttttcagtctatgtgcttgttaatatattttattataaatcgtttgaagtcatgaatctttagtgttgatttgatctttttgacaatatcttaggttcatgtttacacttctatgcatgcttgttaactagattgtcatgccatctaccttgttattgcaacacatgttcttgaattacttttggtatagcaaagctctccggaaaaaaaatgttgatgaactcattgtcaaaagggggagaacaaggtaacaaattgtgcataattgtcataagtagaaggaatttctttcttttcaaaagtgagagatttttctttgaaaatttttttttggcattgaagatgcattttggatttgcttcacaaaacaccacaaaccatttgttgtttgccaatgattttcatcaagagggagattgtagaatcaaggagttgatttagattttgtgatgaaaatattgctggtttgctaatgttaatttagagattttataagatggttgattttgtgaagtgagctgttttggttgaccctggcggtcagaccggctgagtgtcgccggttagaccgcgggtgttgcggcggtcagaccggccggcccgacggtctgaccggcatgatcctgatcgatgtcggtttcgggttgatttgttggatttggcttctagatggtttctatgcgtatggatactattgttatactaatgtgagtcaagttgggacgaacttgggctcggaatatggtctcttggttgttgcatgtgtaggtgttgcttgaggcctcgggagagtgttgccggtgaaagatcggagtcaacttgggagaagttgatgtccaaggatcaagagatcatgcgggatacttaaggctagaggacaatgcatgtggtgatgaagaaatccatatgatatacaagaggaattgtgtacgtatggaaagaggagtcgaatttgtaagggagtccgaattcgggaagtttgatagagataaggaaagagataagttgtttacttgcaagagagggtttcctacatagttaggagtcctagctaagttgtgttagattcgttggctttgcacagcctacctca

SEQ ID NO: 27828 - DNA, 1501 bp, Oryza sativa
cgacgtcccgtcggtcgcccggctcgtcgtctcgcggcgccgcctccgtcatcgtcatcgctgcggcgtgttccacgccgtcctcgtccccgtgcagccgctgccggctgtcctcgtcgcctcctcgccggtcccggtcgtcgtcgttgccgtcgtcctctcgtcgttcccggtcgtcgtgacgttcgtccctccgtcgagccgttctcgttcgtcgtccgcgttcgtcaagcgagctgctgcagccctgtcctcttcttcgtcctcgcctccgcgtcgtcaagccccgtgccggccgcgtctcgccttcgttcaaggatcgccgccgaagtcgttccctcgccgtccgtctccgccgcgcccgttcgtcgttgtcgttcccacgcctcgtcgcgtggtggtaaggtttcctcctctcgttgccccgtcctcgtcctttcggtgtcgcccgtgcccgttgtgcggttgtcgaccccggtacccgtgtaccggtgtcggtagtcgttcgcttgtgtgtgtggtgaccctgttagtgtgcccactcggaagccgcgtggtttcacgtgtgcagtccgcgtggtgtctagtggagtccgtttgtcggccactcgcctcggttgacacacggggtccgcttccgtcgacccgtggaccgtctctgtgtactcggtctaccgcggtcctttaggttgacatgtggggtccgcatgtcaacggcgcagccttcctgtcttttccaggctagcgcttccacatgttttataattgcaaagcttaattataataatccgcaaatctccatataacagcattaaacttcggatgatcatatcttggtcatacgaactccgaatcgacccgttcaagtctcctaatgtttgttaaaacctaaagaaccctgtgctttctttttatgtattgttattgcttctttataggcttgtagctttgcttgtgtgcttcgcgtagctttcgtcgttccggaggttcccgaagcgtggttcgcggtcgtcgccgaaggttcggaaggccgttctctctgagcaaggcaagtcacatcatccttgagcatattgaatcccagtttataaaattattttgatttaaattaatgcattaccgctttatttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtggttttataactttagactttgggaagtctcatatcatttggacactatggaattgttggattatggtggaattggacatacacctctcttcctctttcaaaacccctaaaacctgttttcgatggggtttgggtgcatgccagttgtgggaagtagcaccccggccactataaggattaa

SEQ ID NO: 27829 - DNA, 1501 bp, Oryza sativa
tgagtacaggagtactcagcaagccatgggaattaagtgtttaatgcaggcttcaagggaaaggctgttgtttttttacaattgattttatttaaactcctttttgaaacaactaagtgagtgcttctcaaacgacacggatgagacagtgtgtctcgcccggtcggagtatgtgcaatgtatcagccttttgaattgatcaaggttggcacccgggcaacagctttcaaacagccacccgggcctggctgatcccatcagccgcaaattttccaaacatcgaacccattccacaacagcaatttcacaaaagcagtagtcaaacaaaactacgctagtaatcacctcacatccgcctatgaccgtgggcacggctgtttgaacagtttaataacctctgcagagggggtatactttacccacacgacattactaacccggatcatccagcccgtgcagaacggccacgtctggagaccttgaggctttcataacaaggcatttcgaaagccgacacaggttcaccatatgccaacgagaggggtcccaaaccaacaccaggttaggtcccggaccatactatgccaggaaacccgggggttctccccggcaccaccccgttgaatccacatgtctcttggcatcatggctcccttgattagctaattactcagccaggggcgtcccattccacccatgtggtcgcacttgccttatgttcggatgaaattccaaggaaacggtccttaagtgcaagagcgggaaaccgtactcccggtacgttcaccggtctgcgattttggaaattcatttagttcgcaagcgccgacctaggtgtcgagtttttccaagtcttttgtaaaaccccaagttttacccatcattggatattttaaatttgaggagaggtgttccgatgcgcgtgcccgaaggcccgtgcatcgaagcacaacagttgacaaaggaggtttaagtgttcaataattcacggagggtatttgcagcaatttaggattgggggccggcaggctatctcgcaagccgcggccgaattactcgtgataatcctatttatgcaatatttgcgaaaaagaaatacttagatttaaattataggtgcaagatgatcaaaggtgacttgccttgctcgagatcttgagcttgatcctcgaaatcctcgcactgcgggtcttcgggctccgaaactacacgcgaaacgggacaactcaacaaacggcgaaaataaagccctattattgacctctaagcgtgccattagatagatctcgagatctgaggaattttggaagttgaacggagtcaaacggacatacggttgaggagatattgaatttctaagattattggatttttgatctagaggaaaaggatttaattaaacccttttgaaaaaggaaaagataaagggaggagaaatagacttccctcgggcggctagggcgcggcccgagagaaaagggcgcggcttggctgagcttaa

SEQ ID NO: 27830 - DNA, 540 bp, Oryza sativa
atacagttgtctaatggaagctccatgacttgatcagtttccaggcctttcttgccaagtttgtagtttgagattgtaccttttggcttaaactcatctggattaaatctcttcagaagacgtaagcagtgaacaatctggaaaagggaatgatttatacagcttgtaggtgcatgaagtatgcaacagcataaaatggttgcagctcacaaagggtactgcatagtaattaacacctttcatgcctaacagattgtattatcgcttttcattgcagtttcaaaataaaatattgcataggttgttgcagtggtaaaaaagatcacattattgaatgcaactgatacaatcatagagatttgttgacatagttttatcttgaatagcagtttttttcccttcagtatgagttattaattgtcaattcatagttttatatctcagggaagtctctagtccagcttttattgtctttcaaataagaccgttttatttggattcagggtctcagttctgtcaccttgtgcactccgtttcaga

SEQ ID NO: 27831 - DNA, 561 bp, Oryza sativa
ccccctcgccgcccatttgcaggcggccccccgcacagtataaaatcgccctatcggagggcggcaagggggccacctgcaaatttcgttgacggccgtcgcccgagagcgaacggccggctgccatggcattttcgccgccctctaggagggcgattttttaaaaatcgccctcccagagggcggtaggcgactacttccgtcaattttcaaaatggaaaattatttttgtaaaacttttaataaaaaaaattataaataaaaaaaattcaaggaggagattttcgcgatttgggccggctaccaaaaactaggaaaaaaagtacacccaaggtccctcaacttgtcatcgagatacaaaatcgtcccctaatcgcaaaaccagataccaggcatcctcaagtaacaaaatcgttcgttttaagtccctcggtggttttgacccctgttttgtctgacgtagcggctgagccagcgtggaacccacgtgggccccacatgtcaggatgccatgtcatctatcccttcctcttgtctcagttttctcctcatctgggtagg

SEQ ID NO: 27832 - DNA, 175 bp, Oryza sativa
cagagagggttgagagaggatgcgtgtcgggggctgatccaacatttgggttgaacaaacagactgttactttattaaggttgacacaagcaaattcgagacaaaagtacttccggttggggagagcgatggatcagaaagagatgtggatgctcaccaggatgcagcgggacga

SEQ ID NO: 27833 - DNA, 239 bp, Oryza sativa
tgagtggtgataaaagattttaccactggacccacatatcataaacacatgaggccccacatatcatagatagtgagtagcaaataattaattgctacatcttaaaaaggtaaaaggttaaatatcccaggaggctaggggatccatttttaaaataagttttattgaggtatatttgaaaaatatgtttcaaatgataaaaattgaaaaacacataaatctggagtactggagtattt

SEQ ID NO: 27834 - DNA, 206 bp, Oryza sativa
ccgccatcgccctgcccgccgaagaagacgagagaagagaagaaaataaaggagaaaagagaagaaaggtgaagaaagaagggatatggggcccacatcggtttctctcacttgcatgtgggtcccatatactttatttatttatttttgctgactagtatgccacgtcagcgaaaccactcatatatactatcatgtgccatagg

SEQ ID NO: 27835 - DNA, 1501 bp, Oryza sativa
cagtagaaaattcaacccatttcccgttagaaaaatctacccgaggccggtctgaccgctgaggtacctgtggtctgaccgaaggcttaccgccggtctgactgggggtaaagcaccggtctgactgcctgtctcgggacaaaacgcagtttttgccatctctttttcgcaaaagcaatttcccgttcctttttctgttttctagcaagtctaaaacagaatccaacaagatgaccatcttttccacaaaacgaacaagtatatttatcatgatgattagaagcaattatagaaacatatggcttagcaacacaagcactaatagaaggttttgcatgcataacattggtttttgaagataatgcacttaaactagtcatgatgccagcagatttaaacacagtgttcttaggctcaggtttaagcaaaatttcaccacctctagcaccagcacctaaaacaacaggaggatgtctagtatgataagcataaggattaaaacctaaagcacgattgtgtgtgctaaccctagattgatcaagaatcatgttgagtttctttttaccatcagaaaatctttgcaaagaacttttcaagtaagaaacctcttgagtaagattagcacaatttttgcaagcatccaaaagacctttttgttttctacaatttgagcaagaaaacacctcatcttgtttgacaatttcttccatgtgcttaacacgacctagtgcatcttttagtttcatctcattagcaacacatgtcaaacaaggtttttcactagattgtttaatccttttagagctaatcacattaaacatcgaactagcaaacaaagcaaattgacatttattcaaagctctcttagtcaaaaacaattcatcaaccaatctagtgttcatgacaaaactcatagcaagacaagattcagatttcttaatctttttaacatgagacctattaacatatctaacagcttcaatttcctcaaataaaacctcacaagatttacactcatcattatcagaaacaagagattttattctagaattttaagcattaagagattcaatagtagcttcatattggttaatctttttctcaaatctagaaatcttataaccaagtctagcaataacttcttgaagatattcaacactaggaatatgagttacctcattatcacaattagaatcttcatccacgcttctagccatgagacaaacatcattcttgcctttgttccccttgccatcatcctcatcactttcaaactcaatatcgcttgattcttggacagctacaaatgcctcatcaagcgccttctgatagaacttcttcatcttcatgttcttgaattgcttcttgtatcaaaataccggcaaaaatatcttcaatttttataatactatatatatatatatatatatatatatatatatatatatatgcatggggtgtttgccatgccgaagtgagaaggtccaattcaaagtatgca

SEQ ID NO: 27836 - DNA, 527 bp, Oryza sativa
agctttgccgtgacatgtctcatgtgttgggacgaggctcatgtgttgggcagtcgcggagtgcgggtaaagtgtacatccactgcagtgtgagtaaaccaaatctattcgaatagccttgctcgcagttattgagcaccgggacgtgtgttacacttggctagactctaaattcttaacttgtgtgggatgggatattgcatgatgatttttatgctgttggagccacttcctaagaggagggaaggtggacgtcctcagaaaaccatgacgactcaatggcgggaagctatccttgggatcacaatggatggtggacagaaccgtcgttgtttaatgtgaacactggtattaaaatttgatcagtctatgctaggttttaggcttgtgaaaagatttgcaaaacttgctttgcgcaaaagaacctggagccattccttgaaataccctctatcatatgcatcgttgctgtggtggcttgctgagtaaggttggtactcaccctttctatttaaatatcttttagg

SEQ ID NO: 27837 - DNA, 1501 bp, Oryza sativa
atgagactctttcttccacatcatcgcaagatcatcttcacttgctatggagtggctaccaggtccctttccaaatactatttttagatctttcactgtagcaatcacaatttttccattacgatgtttaggcctagtacggtggtctgtggtctgccttctgtttaaaatgtttgcctttctttcgtacaggatagcttacaacaagaaatcgatgatggcccatgtacacaactctcctacaatgtttcaaatgcatgctgtcagtttcacccataccacaactgtagcagcaacgtaaaagttgcagttttgtgataatttcccatgctatcgttgtagcaagctgaaacatgtcgctaatgttatagcaaactaatagtttgatcaatttaagttgtagttttctaaaatttactcataataatattaaaatagcctacacctgttgcaacgcacgggcatttttttctagttttatctacaaatttattctctgtaccctttttccataacctatttgtaagagaatggcgtatagaaacatagctagaaatgtaatatgttaaccatacatcaatagaggatgtagtttccccttaaacaaattgtttttgattggctacaacttttgtaatctctttgttttcaacttgtaacttatactctacataaattcctgaaatatatactgttgggcaaatgtggggtagtttccccttttaaaaaaaaatagaggataaagttactaaccttttggatcttttcaatttgtctaatatcaccaaaatactgtagcaagaagtttgccatgacatctcttcctcctcttcttggcagcaatggctagacgaggaacatatataggaaatgatctttagtactaggggcctaacatggtctgataatattgaatcgggactaaagattgtacagtatcgttggtttaccggtactaaagattatctttactaccggttagtattagatcagagaaatttgaggttttggtaacacaatgaaaaatcagttctccagtagtggtgatgcacagcttgcgcccgattctgtagaggggatctaggcatcgtctactgtgaagaacggcagcacgtagggaggacaaagtgaggatggggaacagctcttccgcgtgatcgattgggctcaggcagcacaacggcgagccacctctgaatcttgttagtcaactttgctatcaacatacaaataggggtcagaattcttttcttttaatgtgatcagtactcttaggaatcaggaagatcaccccatcattcagtcttttcagctcaagggtaccattaaaaaacactatcaaacatctcaaagggctctacagaagtgcacattgaaaccatctgggcttggtgcagtgtgtatgtatatgcatagaatcaaagcaaatggttaacatatatttgtttataaaggataatatcaaaccaaaccaactcttattatattacataatgaaagc

SEQ ID NO: 27838 - DNA, 1501 bp, Oryza sativa
tagtggatatgcacatccgtcggaaattgcacctaatattattcgatggaagagtcgaagtgaaaaggacaaagatgggatcggaggaatggaacacacaatatatatgtgtgtgttaacttcgttttattttgtacaatgaacatgccacctttagcagaatgaaacaagacagaaacgttacaaggaaatgagcatcgatggagtcacaggtaagtaatgttcatgaagtaaattaaggaaatattcccttccattgccacatatatacagtgctagctctcttcattttcaatcgcttttgaggtgcctctgtcgagtgtagtctatgccaaatggcctaaaaatttatatgctatatttgtgatttgcaatttgacctgattatttctttcctcagattcattctttcgttgcatatttatatttcaataattcataaactggtccatagtcaacagattatgtattattatatgtgcttcagaatttcagatcaccatataaattataaagatttcgcaattaagcatatcatgtgcttcagatcaccatatattatatatatgacacttggcatgcttaaccagaagaattttcaggggattaccaaacccaaattgacatcaatcttctcgccgaccaactagaggcaaaactatgcgacgttcctttggacgacggcggccggcgacacggctcgccggagtgccacatttccatcgtgaagccgcaagtccgcctcgtcgacgtatcgcagtacgctccgcaggtgctgctcgtcggcgcctaccaccacaggtcgctggaccggtgtgagctggacaagctggcggcgctccggcgtgccctccccgacggcgacgacgagcgggcgtccacgctgaggcgctacctggcggccatcgccggcctcgaaagcgaggcgcggagctactaccgcgatgacacggatgacatgggcgcggaggagtttgcgttgatgctgctgctcgacgggtggtacatactccactacttcggcgtcggcgtcggcggcggcgggagagcggtggacatcttcgccgtgcgcgacgtgttctacctgctcgagaaccagatacccttcttcatcctcgagaaggtctacgagctgatccactctccccctccttctccgggagctacagccatcgccggcggcgggtcgtcgtcttcctccgtcgtggttgtcgatgggttcgtgcgccatctccggtcactcctccgagaccagggctactcgaatctggaggtggacatcaccagcacacgcccctgtcacctcgtccacttactccacatgcacttcacacccatggcgatggcgccggccgccgacgacgctgccgctgtccccatccccaccaggcgcgcgcgcgccaccgtgtaccgctggcgcggggcgacgcagtaccacgccgccggcgtgaggttcaagagacgggccctcggcctcggcgacgcacggtgcgtcctcgac

SEQ ID NO: 27839 - DNA, 1501 bp, Oryza sativa
ggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatattttccttctctgccttgctaagagtgtagctagctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacttccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacacctttcttcttccacaactgtttaagatcttcgaccagtggtcttaggtacacgtcgatgtcattaccaggttgcttggggccttgaataataatcggcatcattatgtacttcctcttcatgcatagccagggggggaggttgtagatacacatcgtaacgggccaagtgctatggccgctgctcatctctccaaaaggattcatgccatctgtactcaaaccaaaccgtatgtttcgtgcgtcctttccaaattctttaaattctctgtcgatgtttcgccactgcgaaccatcgtcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaactttcagtcctaacgggcagactatcttcttagcctcgtacgttgtctcgggcaatttgtttccccccggaagaatgttcttgacgag

SEQ ID NO: 27840 - DNA, 1501 bp, Oryza sativa
aaacaccccatgcatatatatatatatatatatatatatatatatatatatatagtattataaaaattgaagatatttttgccggtattttgatacaagaagcaattcaagaacatgaagatgaagaagttctatcagaaggcgcttgatgaggcatttgtagctgtccaagaatcaagcgatattgagtttgaaagtgatgaggatgatggcaaggggaacaaaggcaagaatgatgtttgtctcatggctagaagcgtggatgaagattctaattgtgataatgaggtaactcatattcctagtgttgaatatcttcaagaagttattgctagacttggttataagatttctagatttgagaaaaagattaaccaatatgaagctactattgaatctcttaatgcttaaaattctagaataaaatctcttgtttctgataatgatgagtgtaaatcttgtgaggttttatttgaggaaattgaagctgttagatatgttaataggtctcatgttaaaaagattaagaaatctgaatcttgtcttgctatgagttttgtcatgaacactagattggttgatgaattgtttttgactaagagagctttgaataaatgtcaatttgctttgtttgctagttcgatgtttaatgtgattagctctaaaaggattaaacaatctagtgaaaaaccttgtttgacatgtgttgctaatgagatgaaactaaaagatgcactaggtcgtgttaagcacatggaagaaattgtcaaacaagatgaggtgttttcttgctcaaattgtagaaaacaaaaaggtcttttggatgcttgcaaaaattgtgctaatcttactcaagaggtttcttacttgaaaagttctttgcaaagattttctgatggtaaaaagaaactcaacatgattcttgatcaatctagggttagcacacacaatcgtgctttaggttttaatccttatgcttatcatactagacatcctcctgttgttttaggtgctggtgctagaggtggtgaaattttgcttaaacctgagcctaagaacactgtgtttaaatctgctggcatcatgactagtttaagtgcattatcttcaaaaaccaatgttatgcatgcaaaaccttctattagtgcttgtgttgctaagccatatgtttctataattgcttctaatcatcatgataaatatacttgttcgttttgtggaaaagatggtcatcttgttggattctgttttagacttgctagaaaacagaaaaaggaacgggaaattgcttttgcgaaaaagagatggcaaaaactgcgttttgtcccgagacaggcagtcagaccggtgctttacccccagtcagaccggcggtaagccttcggtcagaccacaggtacctcagcggtcagaccggcctcgggtagatttttctaacgggaaatgggttgaattttctactggttatgctcctgttggttctggtcatgtgtctcagtat

SEQ ID NO: 27841 - DNA, 1501 bp, Oryza sativa
aaactttctatatatgaatttctttttaaaaaaaactgttttaaattcatttttaacttgataatacttaattaatttcactataccttggaatggtgatcacaaaatcattcagctattatccgctccgtacaacataaatttctctttttttccatgtaacttgatgttaggaaatcggatttgctacttcaaatgaccatccccctccaccgatcgcaagggtcggggattgaatgggtaggattgaaaaacaataactaaacgtaccagagggggaaggggcaaatgatagtaacacaaaaaacctaaaactcttaacggaattaaaagttaccctcaagattcgatgaagatccgtttgaccgttgcctgatcattggtttgatcacatagatgtcgccggtctgaccgaagaagattagctgttccgaccacccttcatgtcatcgtcacttgtcattgcatccggtccaaccatcgtggtaccgccggtctgaccaccggtatggtggtatcccgctgatgtgaccatcgcacccaagaaaacacaaatcgaaaatatcttgaaagtagattgaactttactacttttattcgtgtttacaaagtgtaacaataacactcctcttacaaaattcgactaaactcgaaatcctaacttttctctaaacttaactcccacaaaattaataccaaaaggtctcaacccctctctaagtatacccgaggtaggcagcctagagtcacgaatctaacttgtacaagaagtcctaatccattggaaaacttcccctacaataaacaaacttatcttatcacaattcgaatttcaatcttcccaaatttggactcttccctaatttgactccgcttttcatacacacacaatcttcaatcgtaggccgcatggaatctccatcaactacatgcattgtttttctagcctaagcatcccgtaggatattccgattgtttgggcgtcaccttctttcaagttgattcccaatccatcaccagcaacactctcccaaggcatcaagacacacctacacatgaatcaaacaagaaaccatatccgagcacaagttctttctcaacttgactcaacattagcacaaaacaatattacacacatgaagaaatcatctagaactcattatcacgagtatactaataaacaatccgaaaaccgaccctaatcaggatccagccgatcaaaccgtcggttttgccggtttgaccgcacatacgtacgacgccagttgaaccgacctaacctatgtagtctgacccgctccaaacggagatcaccacttcactaataatcactaaatattaaaatcaattatatatcatgtcaattattcatcgcaaattaataataaaaaactacactttgatttcacagactgttcacaaggagctactcccttcgtctcatagaaaaccaacatagtactggatgtgacacatcctagtataatgaatttagacatat

SEQ ID NO: 27842 - DNA, 1501 bp, Oryza sativa
tattagtatactcgtgataatgagttctagatgatttcttcatgtgtgtaatattgttttgtgctaatgttgagtcaagttgagaaagaacttgtgctcggatatggtttcttgtttgattcatgtgtaggtgtgtcttgatgccttgggagagtgttgctggtgatggattgggaatcaacttgaaagaaggtgacgcccaaacaatcggaatatcctacgggatgcttaggctagaaaaacaatgcatgtagttgatggagattccatgcggcctacgattgaagattgtgtgtgtatgaaaagcggagtcaaattagggaagagtccaaatttgggaagattgaaattcgaattgtgataagataagtttgtttattgtaggggaagttttccaatggattaggacttcttgtacaagttagattcgtgactctaggctgcctacctcgggtatacttagagaggggttgagaccttttggtattaattttgtgggagttaagtttagagaaaagttaggatttcgagtttagtcgaattttgtaagaggagtgttattgttacactttgtaaacacgaataaaagtagtaaagttcaatctactttcaagatattttcgatttgtgttttcttgggtgcgatggtcacatcagcgggataccaccataccggtggtcagaccggcggtaccacgatggttggaccggatgcaatgacaagtgacgatgacatgaagggtggtcggaacagctaatcttcttcggtcagaccggcgacatctatgtgatcaaaccaatgatcaggcaacggtcaaacggatcttcatcgaatcttgagggtaacttttaattccgttaagagttttaggttttttgtgttactatcatttgccccttccccctctggtacgtttagttattgtttttcaatcctacccattcaatccccgacccttgcgatcggtggagggggatggtcatttgaagtagcaaatccgatttcctaacatcaagttacatggaaaaaaagagaaatttatgttgtacggagcggataatagctgaatgattttgtgatcaccattccaaggtatagtgaaattaattaagtattatcaagttaaaaatgaatttaaaacagttttttttaaaaagaaattcatatatagaaagtttttatggaaatcgtgccaggcatgtacaatggttgtcaatagtgatctcttagcgttgctaagtaggaatacttgttgacatggaggaaagagaaagaggagagacaaaacatcgttgttatgtatgacaacggcttaacaacgactcttagtcactataatatggaaaaatggttgcatgaggataaacatatggaaagaatattaacaaaaggaatattttttcagttaatgattagagcctttgtcgtctcaactattgtaaagacatggtctctaaataatcttgtattgtttaaaagaccatacccgtctctaccatt

SEQ ID NO: 27843 - DNA, 153 bp, Oryza sativa
aacggcggttactacctccccgtaaaacgcatctccgtgtcgtggcgcgggcccgcgacgtcccggtgtccctgcccgccggcgcgctcgacctcaacgcccgcacgggccgcggcggcgtcgtgctcagcaccacgacgccgtacgcgatca

SEQ ID NO: 27844 - DNA, 935 bp, Oryza sativa
tttttaaaataagtctatttttcgtcccttctctttgggctattacatatgtatagctaaaataagtcttgtcgacggtggtacccgtagaccggatatagagggtattggggtacgctggtacgaggatctacgtatacgacatcaaggaaacaagagacaaagattatactaggtcaggccccttaataggtaatagccctaatccagttgatatgggattatatggagagaaccacagattacaaagggaataatagaactcgatggtaccgacgagattgtagtcgagttgattcgactagatcacccagcgacttggctcctgtagtttccggcttcataggctgtggtcgttgtgttggctatgagattcgatccttaggtccccccgggggttgtcacatcctgatttttgtttcaggatttataaattatttaataaattattattagaatttatattaaatgttcattaatttacaagtgaagttaaatgtgggaaataaaatttcctaaatataaagcatggatggatttaattttttattaaattctccatggttaattatactctctggaatattctcggattttttggagctcaattcctaatttttaatcatacaaagagcatttcagtaattacccacatattaaattaatcattaaatggtctggtcttaatattgttaaatactttgggtgtccaagtatgttcaagatttttcttggaattatttgagcataggaagtatttttaacaattcaaagatcatttcattgattaatttaattggaaaagtaataataatcctcttcctagtcttgggccctttccggcccatctccctcttttgtgtgcacggccgtgcagccctagtcggcccagccgagtttcccccttctctttctttctttgcttagttttcagc

SEQ ID NO: 27845 - DNA, 1501 bp, Oryza sativa
agttgcatcaatttattataaaggagttataatgacaagcattaattaagcgtcatccaaaaaaaaaacatactcaatctattcgtattagaaaggagtacagtacatgttcggtatggtttgacggccagaaatagttagtagttgagctgctaccaaattagaactatttttcttgttttctcaatctactcgttttattgcacacaatcatacaggggaggctaatatttacttctactgactattgtggtgaaactaattaaggctgcgttcgggagcctgatatgaaaaacagagtagcgattagcggatgattaattaagtatttgctatcttttttaaaaaaatagattaatatgatttttaaagcaacttttgtatagaatttttttaaaaaaaaaacacaccatttagcagtttgacgtgcgcgtaaaaataagagagggaagttggaacaggaggtaactaacgcagcctaaaaaacgtgatgcagtgacgaattgctaatcttgttcctaaagcaaaggcacgtgacattagcaagggtgcaatattaattttgtggtaaagtacttagagtgggcttgttcagctgtcatatggctgcaaccttgcgttgtgcggctacagctgtgttgccgtgcggctaggaaaaatggcagccgaacagccccagtgtcattcctccgcgtccgcgcggacgatccaggagcgaacccgtgttctataggacggacggcgacaacaatcttaacatcgttttctatttagagacatcgtttagaagatctatttgtgaggatgttgtgtgtttgttttgtttttttagcatgataaaacgtagacgaatggtttgtttgtcctttttttctctatgactatagcttatgaggactatagacttgtatttttttttctgctatatcaatagaaatatcgcactatctatgctgagtgtttcaaaaagatattaatttgtggtacatacatgctattcttatggttttattttttttaattttttaataaaaggatttgctacacatctgctgatcagttcacatgtaaggacttccataatgcgttagtgtttagtaacgcaaacctcagcgcaaacttggcccaaggacagggccagcaaatggcatccgtggcttccatagcccaatccaaacttggcctgtttctaggaaatgcatgtatacatatggaagaaggggatttatatagtttaataacatacgaattatatattatgaaagtatttttattgtaatataatataaaaacataaatatttatgatttatgtaatgaaagcatataacttattagatatttatgatcaaagacataagcgtttaacttagtaaaaaagctaaattggcaagtaatttgaaaagaaagagtacttcgttgttctgaatttctggttaggccatccacctagtgggtggtttcttttttatgcttccaacaatagtgctacagaaacaaca

SEQ ID NO: 27846 - DNA, 1501 bp, Oryza sativa
tgtttaatgcaggcttcaaggaaaggctgttgtttttataattgattttatttgtacacctttctgaaaataactaagtgagtgcttctcaaacgacacggttaagacagtgcgtctcgtccggtcggagtttgtgcaatgtatcagtctttagaattgatcaagattggcacccggccaacaactttcaaacggccacccgggacaacaactttcaaacggccacccgggcctagctgatcccgtcagctgctgatttttcaaacatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatattgtgctaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaacccaagttttacccaaattgtttttcagattttaagttcgaaggcgtccgtcgatactcgcacagggtgcacgaatatcgagacgcatctagatggttacaaggggacatgatataacaattaacaaagggaggatcaatgcaacaaattaggtaggtccgccaaactgccttgcagacgggacaacagattaagtgcgatcctatcagtgcataatattttcaagcaacataattaaatttcaaatataggctcaagatgttcaaaggtggcttgccttgctcgagatctggagcttgatcctcgaaatcctcgcactgcgggtcttcgggctccggaactacacgtgaaacgggacaactcaacaaacggcgaaaaataaagccctattaatgacctctaagcatgccattagatagatctcgagatttgaggaattttggaagttaaacggagtcaaacggatttacggttgggaagatattgaatttctaagattattggatttttggtctaaaggaaaaggatttaattaaatcctttttggaaaagaaaagaaaagaaaagaaaagagggagggaaaatagacttttatcgggcggctagggcgcggcccaagagaattggggcggtccggccgagctaaatggg

SEQ ID NO: 27847 - DNA, 832 bp, Oryza sativa
tcaaggaagcagacgccgccgccgccgccgccgagaaagaagccgccgccacagccaccgccgtcacggccaacgagtgatcgatgacgaccgatcatggtgctttgagaattgtaatcgagttgtgacgcgcaagaagtcgtgagtggttacgtgcatgtatcttttcttcttttgttttgttttttcggtttatgatcgggtctgcatatatatgtaatcacgattaatttctgcatgaataaaatcaaacaaaatattgcggacgaatttttagtctcttgagagaagacatcaccaccttgtgcgcttttactcaccaaacacaatatattcatgtataatggagtatattgttataggagtataccaaaccactatgtatactgaaattcaattacaaaactcaatatacgcagtagaaaaaaaatggataatttggctgtaaatagtgcattctagtttaaggtatagtagacatggtttacatcgccttcatatgccaataaatacataataagttctgttgttgggaaaaagaataccaagtgatgccaagaagtcctcaagaaaagatagctagcttttttttcgaaacataatataaacatagacgcccatatgcgcacgcgctatccatatgaacatacgtatgcatgccttatacatacaccccacctttataagcacctcaaaagattaaacggcatatcttgagattatgaagtgtccacctttacatagtttatcattgaaaaaataattagctataaatgagaacacttatgtcaaatctagagttgaaacatcactggtggagaagtgattttta

SEQ ID NO: 27848 - DNA, 504 bp, Oryza sativa
aattttttcatggttatatgaagactaggtaaaaaaaactagggtgcctagaactactcttaaaaatcaaattaaaattcgcccccaaaaggagagggaaacttagaaggtattgtcatgaagaaaatattctttccattctactagtctgaatgtaggatcttaattggcattatagcatatgactgaataaaaaaaactgacgtatgtatgcattggttacaaaacaggagctctgaatttaaaataattaatatgaacgttacatccttggcataagaaaaaactcgtccattcgcattaacaaagaacatagtaccacatggttttaattagcatctccctctggaaataagttcattaacttgatggtacaccctgtgattctgcctgttcaacccaacacaactctactccttctgaaacacagtcaaattaacttcgaaaacctgaaacaatctatgttaatttgctatactgatcttcccctttgatatattccac

SEQ ID NO: 27849 - DNA, 343 bp, Oryza sativa
attttgagtatgaatataataatcaaaatcaatttagtacatgcacgctgtatccaattcagtttaaaactgtacagttctttacattatagtgttagtttttgtttcactcttgccaatccagtttaaatacacttcttttttatgtttagcacatcgactggtgactgatatgattctagtatgtaaaacggtgttcctttttcctatttttctaatgcaacaatgttgagattgcttttgtctcttcccagtcatttgtaaagcataggcagtcattcccagtcaattttggtgcttgttgtttggtccataatcctaatcaaggttgcatcaacaggac

SEQ ID NO: 27850 - DNA, 1501 bp, Oryza sativa
tactctttcttttcaaattacttgccaatttagcttttttactaagttaaacgcttatgtctttgatcataaatatctaataagttatatgctttcattacataaatcataaatatttatgtttttatattatattacaataaaaatactttcataatatataattcgtatgttattaaactatataaatccccttcttccatatgtatacatgcatttcctagaaacaggccaagtttggattgggctatggaagccacggatgccatttgctggccctgtccttgggccaagtttgcgctgaggtttgcgttactaaacactaacgcattatggaagtccttacatgtgaactgatcagcagatgtgtagcaaatccttttattaaaaaattaaaaaaaataaaaccataagaatagcatgtatgtaccacaaattaatatctttttgaaacactcagcatagatagtgcgatatttctattgatatagcagaaaaaaaaatacaagtctatagtcctcataagctatagtcatagagaaaaaaaggacaaacaaaccattcgtctacgttttatcatgctaaaaaaacaaaacaaacacacaacatcctcacaaatagatcttctaaacgatgtctctaaatagaaaacgatgttaagattgttgtcgccgtccgtcctatagaacacgggttcgctcctggatcgtccgcgcggacgcggaggaatgacactggggctgttcggctgccatttttcctagccgcacggcaacacagctgtagccgcacaacgcaaggttgcagccatatgacagctgaacaagcccactctaagtactttaccacaaaattaatattgcacccttgctaatgtcacgtgcctttgctttaggaacaagattagcaattcgtcactgcatcacgttttttaggctgcgttagttacctcctgttccaacttccctctcttatttttacgcgcacgtcaaactgctaaatggtgtgttttttttttaaaaaaattctatacaaaagttgctttaaaaatcatattaatctatttttttaaaaaagatagcaaatacttaattaatcatccgctaatcgctactctgtttttcatatcaggctcccgaacgcagccttaattagtttcaccacaatagtcagtagaagtaaatattagcctcccctgtatgattgtgtgcaataaaacgagtagattgagaaaacaagaaaaatagttctaatttggtagcagctcaactactaactatttctggccgtcaaaccataccgaacatgtactgtactcctttctaatacgaatagattgagtatgttttttttttggatgacgcttaattaatgcttgtcattataactcctttataataaattgatgcaactcacatgaagacaaaaaaaacaaaggaaaaatgttgtcagttattcactagattaattaacgattaggactagctattatgcattttca

SEQ ID NO: 27851 - DNA, 302 bp, Oryza sativa
tatttttactatatacttgtgaaaaaaaacgaatacctcaataaggcattacttgtttatgcaacctggcttagacaatattggattgctattgggcatgcataatcgtaaatatattatctccaaaaatcattcaaatgttttcaataaacttaaatactgagttaaaaaaaattctgtttacctttatcttcatgatttgcagaaatttgctacatgtttgcaatgaagcatgaaaataaacatttctgttacattcaatcgattctaagtttctaacattttgtttttgtatcctcagt

SEQ ID NO: 27852 - DNA, 1250 bp, Oryza sativa
tggttgagatgaggagataggtggagaagtagctgtatttgagataaatttaaatacttctaaatttaaatcctagaagtagctatattttaagataaagagggagtactatgctagactaaactgctctttcatggatacatatataatgatatacatatcctgtggtgtggagtgcagactctagtccatctccatgatagtgcaaaatctgcttttatcttttcttgttgggagcgttgccggtgcttgtgcctgtcgcaatgccatcttctgctccgtgtcatttcacctgtatgtcggcgtcgctgccggtcagaaaggaagtgtagtgctgctggccggtggtggacttgccagatcttgtttctgattgtattgttgtgcaagatgccggtgtttgttggttgctgctccagcgctgtttctgttgctgctgcagggatcgcaacatggctgcacaaatgcacaatgtccttttgttcacatcttgatgtcaactggctttgttttccagtgacatacattagtcagtaagcaactgaactggtcccaaaaaaaacatgaagttttctgtagagacagcgaaactcatctgtgttcagatcaggttggtacagtgagtgaagaggtcttcatgggaaaggcagatagatatatctattgatctttcttctcggttgcaatgtcaatgtctctcctcacaggcttaattgctttgcagttcgtcactaataggactcttttttcttctttagaggtttttgctatcacgatgcatgagttttgtcacgaaaggagagaaatgttgatgtcactcagatgtgatccgtccaactaacacatacagaggtcatgcactgtgccaattggttttctgttttgcacggcacctgcttttattattgccaactgtggctggatccaaagaggacctcactcctctcaagggaagagacctcgtttacagggtagtttacaacttgtgttaacactgataaggacaggtaagaagtaaacagaatgctgaattctctgaagacatatacaattagtggcagagattgtgatggaaagccaataagattgtacatacacatcccaaatatttagtactagtagcaatcataatggttagtacagcttattacaacatcaaccacacaacaacaaattcagccttataattagtaggaagttcagataaccagcagagagagagagcaggaaagatgaaatgagcgaaacag

SEQ ID NO: 27853 - DNA, 1501 bp, Oryza sativa
gagaactagagacgtttagcaaatacagggtatagttactaatgaataactgacgcgctagaggtttaatttggaagcagtttgtgcggtcaaataaaatgcccaaacatgtaatccggcttcatttcaagtagtgaagcttcataccaatatgttctgttcgtacaagatcaaagcacatgagtctgctacaaggaaaacactgccagtttctttcgaattgatagcaacagtttctacacacacaacaacaacaacaacaacaacaacaacaacaacacagtttctacacgatggagaaatcaaccatcaacagggtttgattaggatttaggattagagaaagtacgcacagggagcattggcggagcacgtggttggcgatggaggagaggtgcttccggccgcccactcccggcgccggcgaaggctcgccgccgccgcccgccgccgcatccatggccgcgggtcgggttgtttggttggttggggttttggggtgtgcgcgacactgcgcggcgcagcgtggacaagagtggacggggcgtgtcagcgaacggagtctagtagagtggtactagtagtatgggagagtgaactcgctggttggtgcgttggtgtgcgtgcatgaggcgcatgcagctcgccacctcggcccgcgtcgcgcgggaacgcgtcacctgctctcgccgtccacgtccccaacgccactcttctagagcttctcgtcggctcggctcggctcggctggaaccataggaccggaccggagcagcggttggatcggaaccaaagctttcgtcggtctgatccagttaaaagaccgtctacgcaagtgaaccggtaaaaaccggctagacacatagattttgagaaaaccgcttaagaccgataaaaaaatcggcaccgaaccgctggacaggtgcatgtgagtctgtagcagctcagaatatagttattgagatcggaccagtcgttgaaccggcggccctcggttcgatagttaattggtttgaccgtttggaccgttggttcattcattgaggtcctcgccggttcaacgacccgtctgacctcaataacctggaactgcaagtctactgtacagtttcactcggccagtgggccgggcccggcccaatggagaacgggagatggcttgacaaggcggtgtttcacgcacatttttttcttctttctttttttcttttaccgtgccgactgccgacatcccgacagtgccgcccagaacaaaccacagaaaatcgcaggaaatacttatactgtgagaacaagaacaagtaacaacagcacggttcagattccttgtgggggaaatctgtatgcgttggcgaaggctagacaaggtatatcaccgagggagcgcaaccaaattaattaagcaaggtagcttcattcccgcggccggccccctgcagacgccgtccaatgaagcaatccttcctcctgcatcgcactccaaacaaccctgaatccacac

SEQ ID NO: 27854 - DNA, 1501 bp, Oryza sativa
ctgaagattcagaaatcagcatgaacagctagctagcaggtgctcttcttacttctgcggtcctaggcattatatatagtattacgaatctaaacaattttataaatctgaacattgtctaattattttatgaatctgaacattgtctaattgaatactagattactatatttcgatagtaagtatttcttagaccttttgcttcttattattggagtataaccttctcttgttaaaaggacccaatacagattaatcctatcctaatatccatctaaatactacatacttctgacagtgatactaagcaagcagagcatttgctttctgatggcagctattccaggggtaattggtgactcacaaaattcctgaacttattctggctcaaaacacgtaaaagaattaacaaaagatccaaaattatattagaaattcagaaaggtgccacagaaatatccactcggccgaatagattagcaataccaaacgaagagtccaaacgggggattaatcatcgatgacgtcatatgattaccaagtggtactagtataccccagtgatcctctcacttgaaaacgccgaagattcagaaaggcaaccaatgcatttgggattcctcacgtctctataaagaaagatgcatcaaccgatcaacatgggactggaactaaacagcttacagctttattgtagaaacacaactagaaaacataatcaaatgaacaaggatgacaaactagtacagtacaagtttgacatatcgaggtattcaaaaaggattgttgctgctctgcttaagtattgacagaacaaagtcaaatacactttctttgtgatttgatcgtagtcacctttggtactcctggctttaaggcagatttaccaaacgtgcggtttgaaatttcgaagttaaatgacatttttgtttagaatttgttggcttgcaacaagaagctgtcgcactcatctctgagtgagtccagtccactccagactgagacacagcaacaagtaaaaatactcttcgccaccaaactcaagaacttgctcaccaacctccagaccatgaatactaacaacaacctggatattgcatcccaatctgaagaattttctgctggaagaatcttacataaaccgaatgaatgattgtcgataagtctctataaggaaatgataaaacatcagaaccaaccaaacttgtttgttttgacagaactgtaaccgagctaaaaattgtacattgttacataagcactgaatcaagagacagcatgaacgacacgggaatgagatcaaacaggaacagaagcagcatcacgaaagttaccggtaatttaacatttcacccccaatctaaagattttctggtagaacaatcttacatgatccgaatgaacagtcatcggcaaatatttctcaaaggagaaaatgattacacaagaaaaactaagcagaaatgatcacacaagaagaccaagcaaccttgttattatg

SEQ ID NO: 27855 - DNA, 1501 bp, Oryza sativa
ggttgaatcatcaatgacgagaagtatgcctatttcagatgaagatttaggtctgtcacaagtgagatcctaataagtttagtcatcactgaccacttatcaataacgaagagtatacctgttaaagatgaggatttggatccgtcacaaatgactagatccaacgtagtgagatataccctcctcctaaaaaaatgaatctagaactgaatgtgacattttttttagtacaaacgaatctgaatatagatatgtacagagttgtaatactggaatgtgtcacatctgatattattttatttttttatgggatgaatgtagtagtcgtgttggcaaccaaacaccattcgcctatgcgctcgcgcgtgcgaaccagactttgcttgtgcaccgacgcgcgctaaccatgctgtgcaagtaaacaaacacgtcgtccatagcgttgcatttaactggctgcaggacgcacaggtttcggatgctttaacattcgcaagctgtcttactgaaaacttgatactgtacatcatgctgttcggggaagattggtggccaggctataacaaattaaaactgtttttctttgtgaaaaacacgatacatcgtgctcttcggaaaagataagtgttcaggctatagtaaagttaaagcaaaagtttaaaaaaaaaactgagaaactatttttgtttgtgaaagacacgatatatcgtgctgtttgaaaaagattagtgtccaggctataataaagttaaagcaaaagtttcaaaaaaatgatcgaaaatattgtcagaagtgggatttgaacccacgccctcgttagaggaccagaacttgagtctggcgccttagaccactcggccatcctgacctttgtgctaaaatgttactaacatattattttaagtctaatcttcccgatatgattcaccatcattttctaagcttttttattttgaaccacccagcaaatagtacttgtgaattcttaccgttcatgaccaccagcctacttcgtcgctgcagtgtgttcacaatctcggcgagtttcgagcatgtccagctcgaatgtctagttgtaaatcgaccacaaaaacaattgaaatttgttggtcaatcacgaagtgatccgtagttcaattggttagattcattacggtgtaactagtttacttgaactcattcactagttcacctaaacacattcaagtaatcaagttctagatttaatacgaatgctcgtatttacatttacaattagactaatcgagatagtaaactttgttttatgaaaatgaaatcgctggctaaaccctgcagtactgcggggaagtatcaggtgtagtcatctaattcagtgcaactatgcaactctcatcttacaccgttggatcgagaaatggacgtccgagagttaaaatttaactcgcagattcactcatgagttaaaatttactgggagttaaattttttaactcatggtgacgtgaatgaatctcggacg

SEQ ID NO: 27856 - DNA, 905 bp, Oryza sativa
  unsure (1)..(905): unsure at all n locations
gccgtgaccgacgccaccccgtgcgagcgctctctgagagagaaaagagagagatgaggagagataggagatagagctgacatgtgggcccaagagcatttttgacatttcacgctatttctctctcctccccaaccggaaagtattattttaatcggagcggtgcccactggcaaataaccacgtttatggagtgttttccccaaaagtaagtttaggcagtgtcctagggctaaatcacacataacaagtgtcctgtagcaaaatttcccttgtttttattactcgtagtcatagctgctaagcatagagatcttacatctactcccttcatcctaaaaaatacaatgaatttgaataaaagattatccagatttgttacagtagaaatgttcacatccaattaggagtagagccactaaccggttagcccggacagacacgtaggccagccggtgaaaactccgttaaattttaatatttttgaatgatctgatgatgaaatttctatagcaaatgatagctatagtgaagtttgtatgggttcaaaattttctctctctgtgactctgtcacttatccctatctaagaagtagtaggagtatgcatctataacgtgcaatgcatgattgcaagttcggtcggagagatacagtctcgccggccgcttggtttctggttttccatttctctcggagatgagttgacattgacnactccgagcaacatgcacgtttctactcaggaaaagaaaggaaatgactcatgcattattccttattcttcaggctaattacaattaatctgcgtctttaattttacccccctgtgcggtgcagtagtacactcacgatgcagtagtaggaggataggagtagcattgttcaagtttctgtgaacagaa

SEQ ID NO: 27857 - DNA, 1501 bp, Oryza sativa
tttaagaattacccatgatattgcaaagcaatgtacagtggcacgaaaagtggcttttatatatccttatctagcagtaaaactaacctaaaagaaggtcgactaggtgagaggtctgctagatttgctagggcggtaattttgctttgctcaactatgaccactgatacttgacaaacaattctcatcaaaacaaagaattatggttgcaggcttgcatgttgcagctaatcattccaatacaacaactatcataagtatcagcatcacaattcacattgatgagattaactcaactatggtggtggaattctaactaaagcaatagttaaacatcgaataaaactctgcaggcaacagagcaattaacactcaacgcaaacacgactaaatcgaactgatacggtacatgtcgtgagatctgaatggactgcatctccacgaacctgtacgacgaaccctgggcatccgccgatccgatcccgttcctctccccagacgccgccttcacgccgctcccggccgcgacctcgtggtcctccttgagctcccgcatggcgaacgggcgggacccctccgccccgagcaccgcgttcgcctcctcctgcttcaccgtcgccgatcgcggcggctcctcctcctcctccacccccacctccaccccatccgccgcgccgccccgcgccgtcctcacctgcgcgggctctttcatcgcacggacggatcagggcacggcacccgcgctgcgctaccgcggcgagatctccgagcgcgcgcgcgccgcggcggcggtggtctccactcctcctctcgcctcgcctcgcctcgcctcgcgcgacgttggacttggcaaaaaaatcaaatggcgaagcaaaaagcggaggagacgactgactccgaggtaggggaagccgccgcctacgtgtcaacggttacgtcaccacgaggcgagccgatgggccgggcccaacggaaggcccacataagaagcagccatgctgaggaagggaagggtatttgggtaaaaccacttgtcgagtagtacggtacactggtgcagagcgaggaagagaccacgaggcatgataatgggccggacccaattacccaaagcagccgtgcgttgcgtagtaggcagggaacgaagggtatttcggtaaaaccacatgggcaagcaagtaaacggtggactcgggtcggggtgcgcagcgtctcaaataccgcggggtttccggcgccgccgagagagcggagcgtgtccagatcgcgtgactcccccacactccgctccgctccccccgcggccacgcgctcctcgtcggcttccgcttcctcccaccacctcgcaggtgagccagccgcgcgcctctttgcgtggcggagttctctcctttcttctcgggtgcgcgaagaaggggggctgattgtttgtttctctggtgttttgggggggggaatttctctttgcagcgttgcagggcgtgggcgtgggcggcggaca

SEQ ID NO: 27858 - DNA, 1501 bp, Oryza sativa
gataaagtaatgacgatgccacaacatgaactgctctcataagaatgttacagatctagaacacgaagagtccattaggtgaatctggcaatggtggtaatctctcctctccctcacagagcagacaaaaaatcctgcaatcatggtggccgtccgaatcgactatcccaagtacatcaagagatccaccccaacagactgaatttgggggaaaattttttgcaacttgcatgggagaaaatgacccaaaacttgtgattccccaaccagtggttcttccagcaagtgtgtggagcataccagaaacggtggacctgggaatgcatcccaccatggcttgcacacaagcctcagcacggccaaatccttcaggcgaagagcaattgcgaacaacaaatcgtatagaatggtgctccatcgcgatgatgacatagcagctgaatgcatcccccctctccaccctgtggccgctgcagaactctctaagggagggaaagagggggactcacccgatgccatcgtgagctcctcgaggagaacgttcgcccagtgatggcacaggaacaccatgtggttgacgtccttgtccgcaagtccacttgctgctgtgatcctcacgactgcgcaagcagggagctcaccccagcccgaatccataggacccttggagaagcgcttcatcaatggagacggacgcatcagagctgaagacttctccgaaggtggagcagtgaactcacagagcgcccgcctagcgcttgcacacgaacgccatgtgggcgatgtcgttggtggagattccacgggctgctgctatcgtcgccatggcccgatcagggagctcactctagctggagtccttggggcgctcgcgcttggaggagagttccattgatggaggttgaggcggatgcggtggagtaggagtggaggaggaggaggaggaggcggtgttctttcttgagttggcgatctgggaggaggagaaatttcgaaatgtctctgagaaatctcaggcgggggaatatttctctttttcagtttttttcccttcagctttacagtaagtggtggaatacttggagatgtcaattcagagattcatctcttgtccagcatcaagtgactgaggggctcttcagattgtaaccaaaataaaccttattaaattttggcaggatttattatgtatttaccaaagattgataagaaactaaatatatgcacatctttgacaactttacctaaaaattagtatggtttgaaatgacctcaatctgaacagcactggattcctgcggctggatcctgcggctcgagattgtatacacgcttagattatgaaacttcaaggagcaaattgcatacacgctttgagcctttgatatcaagtactgacatgcatgtccaaattatgtctgaaaacaaatgttcgctaagccgaactgtgtacgtgtaacattgtaaataatatgtggttttcctttccgagaaacagaga

SEQ ID NO: 27859 - DNA, 343 bp, Oryza sativa
ccgcgcgtgccacggctgcgccgcacgggaggagaggcacacgacagttcgctaatcaacattcgctgctaatgcgctgctgggcgcgcgcccagcctcccgcgcggcgtgccagtacgtgctactactatagtactagtactatttactacctctataactagtacttactgctacactgataccactactataaaacttatatttttatatgtataaaaaatatatacaagtatgcaaaatttatgtatgtatgtatgtatacacatatataaatataaagtttgcatacgtacgtatacaaactttgcattcacgtatacaaactttataaaccaaaaga

SEQ ID NO: 27860 - DNA, 1501 bp, Oryza sativa
cctttttccttatcttcaggactttacaacataagaaaaaaaaagagaagatatgaaatgtttgcctttttgtgaagaagaaacattcttatttgatttaagtggaagaaattcacgtcaatgcaattaatgaaatgggaaggttcaaaaaaatatggagttgtgccataccataaaaatgctatcatatgggttgtagaatgtagagaaccgtttgtagaggccttacctttacatttagaatacatttttttaatctaaatcctaatatgccctttaaggaaaaaaggcctcactgaatgttcattcttccatcaaatggtccaaaagaagaaattttaaaattacatccactgagaaaccaaaacttgatatacctcaatcgtaatactgtacaattcatgtcacttccttttaaccattctcttcattcttcattttgggcaaagctatgagttgaacattgacagatcatatcaacttggattttctttccacacactccccctattttcagttctcacttgagaacccatgccattgttgcttatattagttatatctttgattacaggctcttaataattggggtcttggactacaggtaatcccacatttgacttcttgttattgtagccttctcaatctgggatattccttagctctctgctcttgagctatatttgctatgctgtattttttttcagctaggagtatgaatttgtattgcaggaactgagtgcaattgttccggctcgtgagaagcaaaccatcataaaaacagctataagtaaggtagatgcaatttctattactgtgcgagaatcatttttgatgattgtatcttctataaactattgggctgttgacgccccccttctgatgtcttggcagtttcgagctgcaattcaactgcaatttgatttccatcgggcaatatacaatcttgggacagtcttggtatgattcctgacttccattactcacctagcaataatctattgttttaatgtagctgcagtgacttgtgaaaaccttagctgattaagttttatgataataacaagaatctgtcttcttgtcttattaaatgtctcagtatggtttagctgaggatacaatgaggtctgggaagccaggtgtgtccgctagcgagttttacagtcagtctgctatctatgttgcagctgcccatgcactgaagccaaattactcggtatttctttttgtcttttaattttctaatttatgtatgggacttcttcataaaaactttatagctgacaatgtccctttttgtataattcaggtctaccgcagtgctttgcgattagtccgttcaatggtaagacactaattttatttcttgacaaactcttaatttattgtttatttttatcagttgttagccagcagtagttaagatatggctagaatatgtttatttcttaatttattatcttagaattcacttatctttttttttgttaagtcgttttta

SEQ ID NO: 27861 - DNA, 1392 bp, Oryza sativa
ttgctatgatatatcccaattaaactagcttgtgggaaaccaaaaaacataaatctgctaatggtgcattttattagagcgcgcacgataggtgatgtgctgtgttgacttgataattaatcaagctgctggaattctcgcttgctggcttgcactggtagttgggaaaataggtccctagaatccgttgtaattgtgatcctacaacctagagaatgtgaataaggtttttgaaaaagcacggtgcgacattcgtccatcacggctcatcttcctctatgttgaatagctaaatgggtgaatatgttaaacatgcaatattaattattaaatatattagattttggagggatgcaacactttccagtactatgattctggataggcttatctctatattcatagattaggaaatatgacatccctctaaaatcccttaattatgggaaggagggagtacattattgtgttggaattaatagatgggctaaggcccattcgaagattaattctttgaaaaatcacaaaagcccacctcatcggatggcatgcatgtggagtttagtaccaccttgcttattctaggagagggggatctccttaaaagggaggataccctcctagccacttgaagcatgtgtggtggagagaagaagggaaatacacacgcgctcgctggcctggcaggcggcgcgcgtgcacgacatacgtgttgaattgtccacaaaattggcatcctcacccttgcgcagatgcagcctccttttgcagttttgttttgctgcgggaaattcggattccgaaaaatccggtgcgtgaaaacggcgtggagtccggataagttacgcgtgacttatccggttcggttacgcgggcgccctgatccgccttcacgcaacacacgcgaaatcaatctagggtttgcctcttactctgtactgcgccgtcgctcatagactactccatcccgctcgccggcgtgcaccggcgatcgggagagtaggtctccggaacctctgccttcgacgtcctgcaccgggagaaggcggtaataaggtttttgggaaacgcttcacgcgactgctccctgttcgtccgcgacggctcgccttcctctccgctcgtgtgctgcgcaccttcatcgacgcccgcaaccgtgagtagttcctgccgagcaaccggtctttccgccacctcggtacgtgttcgacatattgtgcatatttgatctgttcatgttttactgcttagtttacatgtgtagatctaatgatgcgttcaatctagtttacatctgcaatgtcatgatttatttatggaataaattaaatcattatgtgcttataatttcaacaatccaaaaaccttattataggcgctgtgattttacta

SEQ ID NO: 27862 - DNA, 792 bp, Oryza sativa
cgattttcccagatgcgacgagttaccgtctgcacgcaatctgaaggtccctgtccaggaaaatcgtttctgtggcagtgaatattgtgtagctgtaagattgttacacgtgcgatcactggatgtatggccatacgatggcatattggcatatatcataatattgcatgtttaacatattcacccattcagttattcagcacaaaagaacctgtggttgttgcctgcagtcggtgatcaagctaagtcgatgatgttcttttgtgctggataggttagcttaattgcgttcatgacacacgagatgcaatattatctggacgatgacaagtagcatcggaacacagagaaagacgagccgtgatggacgaatgtcgcaccgtactttttcaaaaaccctcacattctctaggttgtaggatcacaattacaatggattctagggacctattttcccaactacctgtgcaagccagcaagcaagaattccagcagcctgatgatcaagttaacacagcacatcagctattgtgcacgctataataaaatgcaccattagcagatttatgtttttttggtttccaacaagctagtttaattgggatatatcatagcaacagggttgtaatgtgttactccctccgtcccataatataagagattttaggtggatatgacacattctgtctctgtctatatagattcattgtactaggatgcgtcacatccacctaaaatcccttatattataggacagagggagtatcatttatcatagcatcgagggagtaa

SEQ ID NO: 27863 - DNA, 1501 bp, Oryza sativa
ctgcacttcctgagctaccactgcacgctcatgttctcaccgccgccggaccctgcctgcttcgccaatacttccgtcgcgccactggtggattccacctgtgtagctttgcccgcagtgccgcctcgccggtctacctcaccgcctttccccaacatgtcgctcgtcgttgagagattcctcgattggcccagacggttcgccagcacccgcgtggaggcggccgctctgatcgacaccaagaacctcaccgcgcatctcatgtagatctcggcaataaccatcatgtcctgcgagggaagtaaggcagaggtccatgatagctccaccgccgatgcctattgtcggaagaagaccaggagaagggagaagaagatgagaagggagaagaagatgagggcaaaacaaacattttacatagtttttctctcatcaattgggtggatattgtatttttatgcgctcggtgtcctatggcaaattaccacgctttcgaagtgtcattaggaaaaaatcacattcttacgacgtctaccagcaaagataataagtttttaagtgtcatgtagcaaattttgcattttgattcaacaatatgtagtttacatgtttccactatatatatggtttgcaatatatattttgccagattatgaacttatgtgagacgtgtgtggtaccagtagtgtaattattgatgttctacttgttttcaaggatgagatatgtacctctagaatatatatttatggagttatgcgctttttgaggaccggagtctagttaattatatacatagtcaatgtttcatttagaatcttgaggctttctagttttacctttaggacatcgcaagagtaacattataggggaaaacactattaatgtggtaattagctaatgaacattgtgcctattattttactgtatttgtgctaacaacgtgtgagagggcctattttttgacatagggtgaccaagttggccctaagtgtatcacacattttgacaatttgaccctttaaaaaaactatttttacaaatgaaccgccgccaaacttattttaaaaataacatttttttcagcgccacatcatctggcgctgaacttgacaccttagcgccacgtctactggcgctgaatgccgtgccatcgcggatgggaggctaagtcagcgtgccaacgcacattcagcgccacactatttggcgctgagatgtctaagttcagcgccacatgatttggcgctgaaaaaagggttatttttgaaataagttttggcggaggttcatttgtaaaaatagttttttcaaagggtcaaattgtaaaaattgtgtaagcgtatccggctcaaattgagatggtctggctcaaacatgtctgtcgaggagtgatcctctctagcgggagatcgtgagatccccctttttgagttcagccggggaaaagggttcgcctctcgagatcgtgtatccaccctcagggtttccagatcgcgta

SEQ ID NO: 27864 - DNA, 1501 bp, Oryza sativa
agtcaaaccccagagaggtcgaaaatgctacttggatgttgactgtaagtgtttacctttattgccttctatcacttgcagtctcattaacatatatattggtgtgggtggtacaatttaactgcaagagttttttttatccatgtttaaggtgatatttgatacttatttattatccttttaggtctttcactgctttgggcagtacttctgcttgcatttcgaggccttccaacttggagtggctccggtttacatggccttcctccgttttatgggcgacgaaaatgatgccaggaactatagttatagccttgaggttggcgcgaatggccggaagatgatatgggagggcactccccgcagcataagggacagccaccggaaggttagggacagccatgacggcctcataattcagcggaacatggctctgttcttctcaggcggagagaggaaagagttgaaattgcgggtcaccggccgaatctggaaggaacagcagaatcctgactcgggagcctgcattccaaacctattcagctgaactgaaataacaagagagaaggattcggattcggattcggtttaggtgtatattgggtgatgcgtgtggtgcacctgtgcccgcttctgtaatttgtttgtgttgcttccacttttcttccacgtagccgttgtggcctgccctaaattagttagggctgacgtgtgaggaccatgaaaaaaaaatacggcttgagctttgtgggttctgattgatcacatgataagaaatttctcgatttgtttcttttgcccttgtgccccattttgagatgggaggccattatgctctttcttgcttgtaatttgcaaccattgatcagagcattttctgggtttgtatgttttcatctatgcttgattgggtattcgggtgttaagtatccatccatgacgaaatggtgaaactgtaaaatgttaaaaattcaattacttaatgtcgtttataagataatatgcacatgttcctttctcagaaaaaaaaatgaaagggaattgcaaacccatcatgttcagaaagctctagatatatactcttagtgagacgagaaagtgactaaatacacctaattaccatgcagcaaatatatgttactcttgaacaattaaaagagataacatttaacatttaattacggtattctgcaccctcctggatcttgtatgatgttgatacccttgtgtactctgcgatgatgctgaatgttagccttcactaatctgaagtcttcagaaatttaatttacagctagagtaatctcatcaactgctgttactgaattcaaaagttccaggcgtccagcattgcataatgtacatcacatctaggcctatgaagctaccattgtgctgcgttgcttccaaatatgcaactctttctaactgtattttttcaagggtacgaaaagaaatcatcatcatcatcatcaacaacaactcaaacagttcggggaaa

SEQ ID NO: 27865 - DNA, 1501 bp, Oryza sativa
gtcagattaacagctcaacactagcattgcaattgggacacagtgctaggagcctccgcgcctttccgaagccgaccgccgctccatccgccgagctccttacattcccgggcgcttgtttcgtagcgagtcttgacccagacagacgacgccgggaatgcgccggccattgagagcgccgccgtggataccagccgtttgacgtgagatgaagacgtggggctttgccgtcgccgtgttgccggcttttgccgccatgccgtggcgctgtgcttttgctgttcgttcaacgtgttaaagcgcggccattgttgcagggcgaggtgccgacgttttcttcaaggactgacttagcaattctcttcattctttgggtttaattattccatagttcatcactagaacagcttgacaaatgtgtactgtatgtagcaaccaaaatcttcatgtttgtcgtcttcagagttcagacaaaatggcgtccggtttttgttttgcaatcgattcaaccaaaccttgtcgaaacgatgaaacgatcttaccatgtcaaggaagacaaggaaaaaaccagcaaaaacgtttgctatctgccattaagaacttgacagctagatgagtcctcagatgaatcatgatggcattatcagcggtatcgagtcgtttggctgaacacacaccgtgccaacttggttaacccttttgtttggtagcgcaaacaacagttaaaaaaaaagtactacttcaatttacagattttttttcccagtctatccatccaattaaccaacttaacgaccattgcatgtagtcatgttcagattcggacaacgcacatcgagaaaacgtttgctttgcatcagatatgctaaaattgcccccacacacgcctaacttgttggagatatttacccgtcgagctgtcccaatccaaacgaactctcatagtatatgatggatgagatggatgcatagatggattggggaaaaaagttgagttgcgcatgaacaatccatgaacttggcgaaggaaaaggccacatccatccactaatcccctcatccaccattccacccacacgccgagcgcgaggcggaggcggccgcgtctataaaaccagaggcgcgcctcgccgcgccgcgccgcgttctcttcctccccggagtagaaaccgcccgccatttggatccccccaattcccctcctcgcccaaaaccctagccgcacccccgccgcgcgccctccgcctccgcctccgccgcggcgtgcgggctccgtcgtccgtcggctcctcgccactggcgtcgcgaggcgtcgtcaccggaggtagcgggagctcaggggacacgatctcgaaggcgcgcgccaggacgaacagctcgagcgcgccgcggggggccttcggttctgagataaatcaccccgtccgcatcatcgacgcctccctccccgcgcttggcgccagctcgttctagggggggaagatctcggcgacgagcagct

SEQ ID NO: 27866 - DNA, 1501 bp, Oryza sativa
ctctatagcggcccgaacctgtataatcttggcgcccatacgcgatctggaaaccctgagggtggatacacgatctcgagaggcgaacccttttccccggctgaactcaaaaagggggatctcacgatctcccgctagagaggatcactcctcgacagacatgtttgagccagaccatctcaatttgagccggatacgcttacacaatttttacaatttgaccctttgaaaaaactatttttacaaatgaacctccgccaaaacttatttcaaaaataacccttttttcagcgccaaatcatgtggcgctgaacttagacatctcagcgccaaatagtgtggcgctgaatgtgcgttggcacgctgacttagcctcccatccgcgatggcacggcattcagcgccagtagacgtggcgctaaggtgtcaagttcagcgccagatgatgtggcgctgaaaaaaatgttatttttaaaataagtttggcggcggttcatttgtaaaaatagtttttttaaagggtcaaattgtcaaaatgtgtgatacacttagggccaacttggtcaccctatgtcaaaaaataggccctctcacacgttgttagcacaaatacagtaaaataataggcacaatgttcattagctaattaccacattaatagtgttttcccctataatgttactcttgcgatgtcctaaaggtaaaactagaaagcctcaagattctaaatgaaacattgactatgtatataattaactagactccggtcctcaaaaagcgcataactccataaatatatattctagaggtacatatctcatccttgaaaacaagtagaacatcaataattacactactggtaccacacacgtctcacataagttcataatctggcaaaatatatattgcaaaccatatatatagtggaaacatgtaaactacatattgttgaatcaaaatgcaaaatttgctacatgacacttaaaaacttattatctttgctggtagacgtcgtaagaatgtgattttttcctaatgacacttcgaaagcgtggtaatttgccataggacaccgagcgcataaaaatacaatatccacccaattgatgagagaaaaactatgtaaaatgtttgttttgccctcatcttcttctcccttctcatcttcttctcccttctcctggtcttcttccgacaataggcatcggcggtggagctatcatggacctctgccttacttccctcgcaggacatgatggttattgccgagatctacatgagatgcgcggtgaggttcttggtgtcgatcagagcggccgcctccacgcgggtgctggcgaaccgtctgggccaatcgaggaatctctcaacgacgagcgacatgttggggaaaggcggtgaggtagaccggcgaggcggcactgcgggcaaagctacacaggtggaatccaccagtggcgcgacggaagtattggcgaagcaggcagggtccggcggcggt

SEQ ID NO: 27867 - DNA, 1501 bp, Oryza sativa
agatagaaatcttataataaacaaaatatagaataagctccccctcaagatgtgcatacatatggatatgaaggaacgcatatgcacataatcaataaagatcaaatagaaagctcacactatattttggatccacaagagagaccaagttagaatatgtgaagtttaatacatacctctcatcattttttacttttatatccaaatgagactagtcaaagaaaggctcataaaaatgattagtctcatatagttagatttgtcattaatcaccaaaaccaaattaaggcacttgaacttacaaccgccagatccagatcccccgaggttggcagccatgagggagttgagtccgagccagatccaccctaagctcgctatcacatccggcggcgaggacatgagctcgtcgacagttgggtgcggcagcgatttggtgcggaggtggtgacgcaacagcaccccgaccctgacggctggatctggctgccccgctgctgctccacccggtgtcattgccgcttgggccgccccgtcggtcgtcaccgtttaggccgctccacccagcgccttggcttcgtccgccggtgaggaaaggagtagaggaaagagagatggggtgggagatgaaaaatggaagaaatggtacttgtggaacctactacaagcaacttacaccgttgagtatgtagctttaacacattcttggtttaggtggcatgtgaggttcgacaaatctagaggacactactattgtcctaagacttcccacttgatttacttgaattctaaaatatttagttataaaatcgaaaaattaaattaaaaatcagaagtattcaagattctcgtcagccgattactcaccaattgcattttagaatctcgagcttggctacagcagtactactccctatcaggacacccgtaatggttatctatagactctctacaagagatacatgtcagcatattttcctacttggaagagattaaatgaagagagagaacaaatatatctactaatctgaagatagtctatagagaaaaacgaggcaatagattaatggtttactattaatctagtctattactgagatgtacatgttttatagatagcacattactttactattactggtgctctcagtagccagttgcttgtcttggcttggcttgccgtgccttgctgaaattccccagctcgcttccccaagtcgaagctgaattgcacacatctcaatcaataatgctcccccagatctaggtgaatcatcaaatttttaattactcacatcatcatacatataaataattcttgcatcattagccgccatagaaatgacagtaatagtagcatccagaaatttgctcatttagtagtacttgaccagtgacacactgacacctagtggctacttgtccgaagaaattttaactccaagctcgagaaatccacacccaaaaagatctcaatttttgtagtctgatgatttgatga

SEQ ID NO: 27868 - DNA, 1501 bp, Oryza sativa
gccgatatgactccctcaacgcgtcgaaaactgcttcattctcctgagtctcaggaacccactccccagccatcaaagaagccatcctaatactccgcatcgccaaagaggcaatctcctgctcctcatcctcatcatttgcataattgttaaatttttcactctcgatgcgaatgatatccaacccattgcggatctcatcaatcgcggagcggatttcagccttaatcgctgccaggtttcggcgcaactgctcgacctttgcagttaagatctcctgcgtgcgagcctcccgcgcggcacgagcctcgacggcggcacggaggccggggaactggacccgggcggactccttgaggtactcgacggcgaggcggagctggcggtagtgcgcgccgaacaggtggtgccagcgctcgagcgcctggacggcggccttgcggagcagggtcgcggaggcagcgggcggcgggagcgggtgggcgcggcggaagccgacggcgagcgggaggaagccgtccagcacgtcggtcagcagggagcggaagagcttcgagcgcatgaagagctcgtcggcgatgatgaacgcgagcagccgcacctgaagattgggcgagttagggtttgggcgaattcggcaagggaatcaaaccagcagggaggagcttactcacgtgggcgtggggcttggacatgagggagaggaggatccggaaggcgtcgcggatggcgccgtcggaggcgcgggcggcggacttgatggcgcggaggagggccgggtcgacggagggggaggtggtggaggtggcgcggtctatgagggacgcgatggaggactccgcagaggaggtcgcgcggctcgaggccggctcgccttccggcggagggcggctggaggaggaggcggcggggcgcggcatcgccggcgattgggggcggcaggcagaggaagaggagtaacgatgcgatttgttggggatggctgaattgaagttcgttggctctatgacttgtgggcccaggatgatggaccatgtgatcgtgtcgacgtgtccaggtcggtttgtttgaggctagtttacgctcggccgctcggttttaagagcgagatagtgcaactggctccaagattggcacatcagcttattataggtagcgttaaaaactaccaattttaactaattaaattaaatgattcatataattcctttcgtcacatctgtgattgcgtgctttcgtccgtcattaatcgcgctaatttttcctcgtgcgctctccgattcatccgagtgttcttcaggcaactgagcccaagcaaaaacaaattaatgggctcaacatatgaaggcccacacatacagatcgaggcccaggtggaacgtcgcgtgggccacgcacgtcgcggactccgttttgtccagggcggcctacacacggactttgatgaagccatcagggagagggatctacacacgtctcctctgcttctgcagtctgcttg

SEQ ID NO: 27869 - DNA, 768 bp, Oryza sativa
tttccaaagaattaatcttcgagtgggctaaggcccattcattaattccaacaaaaagcacgccttaatcagtagtagtacgggagaatgacagtaacagcgcaggatcgaatcgaatctgccaaagtaatggtcctgcttgaattatgaatgcttattactccctctgttttatatttttaattatttaacttttttagtcaaaattctttagattttttcaaattgataggaaaaatagcagcatccactatatcaaattagtttcattaaatttaacattgaatatattatgataatatgtttgttttgtattgataatattagtatatacctctataaacttgatcaaactttaaaatactaagaaaaaaaattaaattaatgacttataatataaaacggaagtagttggttgtgttcgatttttgtaatttccaacgtgtatcgcgtcattctaagtggtactcctccgtttcacaatgtaagactttttagcattggccacatacatatagatgctaatgaatataaacacatacatatgtctagattcattaacatctaaatgaatatgagcaatgctagaaagtcttacattgtgaaacggaggaagtccgtactagtgtgcccctatctgataagcatgtgctaattcactccactctatccttcagtgccattctcatgaaagcaagttaagttgtctggctttagatacaccggttattccattgaaaaaaaagggtttgaataaattaggacaaa

SEQ ID NO: 27870 - DNA, 899 bp, Oryza sativa
taacggacgagaacgcgccgcccaaattccgcgcctcgtcgacctcggctccggccaccgatcgatggctctgccggtgaccaccagggcggcgccggcgatgcccttcgcgccgcagccgcgcaccgccggcggcggcctcctccggcgaccgtcgccgcctgccgccgcgctgcgcatcgcgccgcccctcttctggccgtggcagaaggtcccattcgcaacaaacccctcttgatacctgcatgattacactagttaaattagtctagttcaaattctgctgcacttcttggagatttgcacggccagttcgtgtgctgtgaaagcttaactctaccgtgttgtcttcttaattaaggaggcaaactgttttggtgagcttgtagccatgtacagtagaactcaagctgcagttttttttttttcttcttcaagacagtactgctactacattcaaggctggaacagagccacagtagcttttgctcgggaggccctgcagtaggtttactgattttgtgacatgacatgagctaaatgtactacaactttgccattaaacaagaacgcaaagtaaatgaggcaccagtacaagcctcatgttctgtctgaatgtgcacaacttttactgaccgtagatttcgtgcctccttgagcacaaaccacaagaaggatccgatgaccatgctctctctcccctaccatggagctatctctagcaaagaaccaggaatgtgattagattagtagcactgacagtctgctcctttttggtaaccagctatggatcaaacgaaaattatttgttaatgtttatcactgatgctttcgttcctctttatcgaagtcgagcacggaaacccaaaagttccacgctgtgtgatttctgttggaaa

SEQ ID NO: 27871 - DNA, 668 bp, Oryza sativa
ttaattaatcatatgataatgaggtttctcattacgtccaacaaaaatctatctccaaaacgccacatcgaacgaggcatcaatgattatgatcgagcatgagaaaggtccaatggttagtattatttcaaggtgaatgtggctcgatatatgttgatatttacagtgataagaactgcactgtaaaatcacatgacatgtggggttgtgatcaaagcatgagagaaattcaaaggtgaattaatacatattaactttttgggtccgacaataaaatatgtatagatagggttgtaattacatgaatacggcaaatattttcagtgtaacatagacttatttttctaaatgggcctcttaagcggccccatgcgaaaatacatttttataagcggacctcttaaatacccacctacaagtctgacctcactcctgttctcccactcaacatcttcaaaaagaaaaaattaagtgttcatccttatcttcctcaccttctctccctcacatcttctactcatattatgtctcactccctatcctccacccctctcatttctaacctcttatctctccctcgacttcctttcccgaggagtggccagcgggtagtagcgaggaccttgtgtgagcgcgagcagggttgagtatgtctagaggtggcctca

SEQ ID NO: 27872 - DNA, 1355 bp, Oryza sativa
cccactttttatacacattttggtatgtgaaattacaatgcaagagagatatcggtagatgaacactgtaaaactatgtctttggatgatacgaaattcatatatgttgagaaaatatagggaagaaaattatttatttactgaagtttgactgctttaccacattatgaaattgacttacattttagaattttacacgtttttataatactctctttgttccagaatatagcttacctttaacttaactatgaaataagctatgaatttgaacaagtatagaaggtgttcagatttataggtaaaagtagctatatatttgagacagagggagtgacacacgctcacatcacattttttggattttttaaaagcatatatttttactatagccttttggaacaaaggatttatgcaggaattttgtaccatcctgtaagaaaatttcctatatggccctttggaagagaagactgtagcttttcaagtaatgtaaaattccaagttaggaataatacatagtgtgaggattttggaaaaaaaatagttaccatgaggtcaatttcttgaaaaatatatttgaagtctatttatttcatctaatttctttgtttttttctatagcctattcaaacggttattcaaatatcccttgttcttctatttgtgtgttttgccatttttgtatttcaaataggcctaagtgttatgcacgttttcattgaattggtgcttgtatcctgctagttttttttcttttttatttattttaaatcacttctaaatttcaaattcacataagtatatagaggcttttggagctattttgtgcagaattaaattccactcttcagttaatatatgaggcacatttcagattctttgaaaaaaaacagaattttagatgatctttcactggaaatacactgtttgtacagtttcaattttcgagagcgattgagcacatatactccctccgtcccatagtataagggattttagtgggatgtgacgcatcctaatactgtgaacttgtctaaatttatagtattaggatatgtcaaatcctactaaactatattcaaaaagatcatctcaagatttattgtcgatgggtttttctcgagtggagtagaaaaacaactcagatttgtttcactgacgtgtgtcccgcttggtagtgagcccatatattactggctcattttagagggaagtagtatacaaatttacgttttgattgagacaaggaaaaaatcgagaaaatacataaaacgagataaataattaagtattaattattttttattagaagaccatttaacggtttaaaaattatgcgcaccgaaactaga

SEQ ID NO: 27873 - DNA, 602 bp, Oryza sativa
aattcctgcagcccatccagcaatagttatactacatggtaacaagcacttaaaaatattaaaactctcttctctctcattctctattccacctaaccattattctaaatgtgagttccaatttactatatacatattgtgaagataaattttggatatcctaagacatacttcctccgttttttaatagatgacgccgttgactttttctcacatgtttgaccattcgtcttattaaaaaattttatgcaaatgtataatatataaatcacacttaaagtactatgagtgataaaacaactcataagaaaataaattataattatgtaaattttttaaataagatgaatggttaaacatatgagaaaaagtcaatggcgtcatctatttaaaaaacggaggtagtataatatatttacactatgtcttatagaaagtaacggagggactgtaattatgcattacaaaaataagcttattactctcggagtccacacgaatgtgaaatgcccaactagccacataaaagtactaccccacttctaaggcaagcccaatcagtgatgaaagctttcactcaagtgattgcttgccacaaaaca

SEQ ID NO: 27874 - DNA, 1501 bp, Oryza sativa
aaatctacatgcatgaaaatgaaacaacgttatgttttgtcaattatatctgactttattttaatttttgtgagattaagattcttaatttttttggatttttcagaattatttgataggtatgcacaggcaatgatcatgctacaatacaactccttaatccatcacaaaaaatatggtcatttacattttttttgccaaataggtttggtaacaaatgaacaatcttataacatgtccataaaactactcatgatatattttcttacacttgagaaattataatatgttcagcataagtgataattgataaatgtacgccaaacagcccactgatgtaactataactgcacttcaacaaattaattattataaataattttgagaaaataaatacatttagaattagtaaaggtgtctcatacaaaacataaagaaactattttttatgggaataaatgaagaactattttcatcacatcatattctctttgtttccatgaagggcaccgagcatgaataacagaacttgctatgctaccacaagtatagcagggggcacacatatggttgagttgaagcaagcccagaggaggccaccattgataagagtgctcaactttcctacttatcaatgcaatcttcttttaagggtgccgataactaactatgattaattaaaattatgctccacactaactgtgagaggcacgactatgtcgactcatgcttgaaggcagcggataaataaagctttgatggttccacccattagaggggcattcatgcctatttcttaatgacgttatcctattaaccaataggttaataaaagcggtagttttagaatatttattaataggtttagaaataagtgttgagataaatatttaggtatgtagtggaaataaatgtcttatgtattaatggcgtattaagtttatttggtggtacaaattaagttccatttattaaaaagatatataccttttaagaaaaatgataataaataatggtgataataggcaagtttacatgtaacccggataaaagtgattttttaaatctaagagacattcttatcatttatattaaagtttatgatctatttcacaatatagatttttgttattatgagataaaatctataattttttaaatctatttgatgagatatgacttaattctaatagcattatttctataaacaaaacaataaataagatgcccgcgcatttgcgcgagcttttttctagtttccataaaaaggctagcgccaatcttagaacagttatggcccataactgccacgcggtgttcttttccacctccatctgtcaccaattccatcttttccccactcattacgagcatgatctttaagccgctaatataattttagaaaaaaagtctatgaagaagtttcttaaaaactaaaaggaaaattcaagctttttaatagttaatactccacttaatatttagtgttttctctggtagg

SEQ ID NO: 27875 - DNA, 1501 bp, Oryza sativa
aaatcagattgggcctatccgaaaagattgggcatgtgtcccatcaggcctactacggcccatcacgagagaagaatctgaagggccggccccccagccttttaggctgattaggtattactcaatccgtttcagattacaaccatctgtttcggattacaaagtcgttttgattttgatctaaatttgagtaaattgtattggtggtacacaaactattttggtgggtgcaattcagtacataaacttgtaaaatgctcgtttcagtatataaacttgtctagtttgtgcgaatgaggaccaaaatatgttggcaatgttaattttacgaagttgacgttgattaggatgtgacgtgcatacgtgtagtgagtatgcataagacattcaatatttataaatttggtctatattgtatccttcatcatggaaatgatgaatttcatatatttctaacatttatatcattgctcgtcttttaatctttttctgctatcactatatcctattctattttttttattgaagaggtacatctctaatagcaaccttctcaaatatatgccctaaatcaataagattatccatatagtgtctttttcgccttcctccgcacgcaatagacaagttcatgcacaaagacgagaattttacaagtttgtgtactagattgcacccacctgacaagtttgtgtaccgacgatgcaatttactttttgttttattaaagctatctctactattataaaaattgaagaggttttactttttggtatgtcatccgtatttgagttgattttttaagttcgtttgcttttggaaatgcagatccaacggttcatacggtttaagattcgtgtatgagttggattttaacttcatttgcttttggaaatattcttttaaaaaaacttacataaaacttgagatgaaagtcggacttctaattgtagctcatgattttcttaaaaaagaatatacaagcaaattcccacattaaatttcatcatagctaaaccgtataacaataataagactaaaatagcattcacccgttgcaacgcacgggtattttttctagtaattaaatatattttgggatgaaaacatttatttttttaatacaaacttaattaaatttaaagcaatttgattttaatcaaaatcaaaacgaataaagggagggagtactaaggccgtgtttagttgcaaaatttttcttcaaactttcaactttttcatcacttcaaaactttcctacacacacaaacttctaactttttcatcacatcgttccaatttcaaccaaacttctactccaattttagtgtgaaataaacacagcctgatctaaacgagcatgtgagtcacaacacagttacacagcagcagaggccagaggctgagggcaagtagcggtttctccttccttcctcccgctctccccgcccgcattaacctccacgagcacacgcactgttcctcccttcccaccaccacc

SEQ ID NO: 27876 - DNA, 1501 bp, Oryza sativa
ctcctccccgaggacggtggcgatggcgatggcgatgccgtggcgtgcaccgtggtgaccctggtgagcagcgagcgggaggtcttcgccaaggtggagaagatcttgcgagctggggtctgggacgtcgcgcaaacctcggcgcccattgagctaccggcgcactggaggagatcattgagccggggttttcttgtcaatggcaagctgtatatgttgggcacaacagggtacattcttggattggaattggtgtccatgagcttgttcttcatcgaggtccccgatgccgtgcgagatgactgccctgaaagctttcagctgagcgttaagctgtcgcaagcggagaaatctgggctttatctgatccatgtggaggggtttaagatccatgtttggcttcacggaacagatggaaacagctctgccgattggaatctagtaaatactatttgtttgcgcgaggtgtttggtcatcttgtgaagcctagttgggagtcaggggattcacgcattagtctgcctgggtctggggacaacgctgagtttgtgttcttggaggtggatggtgaggtcttttgcatggatattatcagcaggacagtggagaaggtgtatgagatggcaatgaaggatgattttctatttgagatataccccttcatgatggtttggccaccaatcttcccagcattgatcaaaacacatgaaccagagtgattcgacaaggtttccctcgagatgatttgcataatcaagtgatgatatatgatgattctgctacttctgtagtgaggtaattgtacaaaataaaattgatgaaaagtttgatatccaagttgatttacctcatgattgcccatactgtttaaaccaaaggtcttcttttcaatgccataatcataagtcgcatgtcttttctaaaaatacgtaatcccagcctatgctactgtttcaatgatgataggcaaaatttgcatcccaccctcaagcactagtggaacaatcgatgtgaagttaaaatcccatttatgtagctagtagggaacaatgcactaatatggttcacctatataaatgtccattcttgagggactttagctagaaatgatagttaatttgtcagattttgatgctttactgtctgttacaatcaccacaacaaaaaatattttggcatcagcatatctaaatcactagagaaactcactcgcatttttgttagtcatcattgtcatgactttgttacaagggaaaaaaaactctcatgcttggtggagatacaataaattaactggagcagggctgctggagaactagataacagcttgtacatatctgtatttcaagacatctcttacctgattattgtgagaagtcaataggataaatgcatatttttggtatacgcacgatgcattgttttatctgaatagattggaaccggtgaactgttatgagaatctctttgttcagaaataaatctggacagtaaacattt

SEQ ID NO: 27877 - DNA, 1501 bp, Oryza sativa
gccggcagccgctccctccgccctgtctcgcctccctcgcccctcctcctctccatctcgcctccctcctgtggtggatacggcggtgatggcggcgggttggcagtggccgcgagcggattcgagggtggtggcggcggatccctccaccccctctagcctccctcccgtggcatatccgccggcgatggccgcgggcggatccagcggtggcggctccctccccctacccgccttcctcctgcggcagatccggtgtcggtggcgtccgtggtcggataaggagcggcggctccctccgccgcaactcttctccctccggcgacggtagcggggttggcggcggccgaagatggatccggcggcggtggcaacggccgagggcggatccggcggcaggcgagtgaagttttgtgatgtatattgttgttcttctttttgatgtatatttttgtgaagttttgtgatgtattttgtgatgagtgtggttgattttttttttgcaaagagtggttgagttttggttgtgccgattttgggaagtgtttccatgtttctgattctaagagcgattgggattcgggggctacgaaggcgcaccgccgacggacgaagacaccttcgtccgtcttgtgatgaacggaaaattacgaatattttaattagttaagatatactccctccgtttctaaatatttaacaccgttgactttttagcacatatttgaccgttcgtcttattaaaaacttttgtaaaatatgtaaaactataagtatacatataaatatatttaaaaatgaatcaaatgatagaaaaaaatgcgtcagatatttagaaatggagggactatatacacagcaagcagactgcagaagcagaggagacgtgtgtagatccctctccctgatggcttcatcaaagtccgtgtgtaggccgccctggacaaaacggagtccgcgacgtgcgtggcccacgcgacgttccacctgggcctcgatctgtatgtgtgggccttcatatgttgagcccattaatttgtttttgcttgggctcagttgcctgaagaacactcggatgaatcggagagcgcacgaggaaaaattagcgcgattaatgacggacgaaagcacgcaatcacagatgtgacgaaaggaattatatgaatcatttaatttaattagttaaaattggtagtttttaacgctacctataataagctgatgtgccaatcttggagccagttgcactatctcgctcttaaaaccgagcggccgagcgtaaactagcctcaaacaaaccgacctggacacgtcgacacgatcacatggtccatcatcctgggcccacaagtcatagagccaacgaacttcaattcagccatccccaacaaatcgcatcgttactcctcttcctctgcctgccgcccccaatcgccggcgatgccgcgccccgccgcctcctcctccagccgccctccgccggaaggcgagccggcctcga

SEQ ID NO: 27878 - DNA, 1501 bp, Oryza sativa
cggattctaggatttccttttttgaatttttattttttttggaatattatttttctgtgcgggcgacataatccgaccgcacgtgaaaatctaattatcccgtgcggtccacttaacccgaccacacgggaagatggatttttctgtgcggttgggccgcccgcacgtgaaaatatttattttcacagacacctcggtgcagacgggcaagacctccgcatggaaaaatccttttcgtagtagtgtcaacaacttgtgacatcatatggccttgattgattcgtcggtattcaacaaagcacttgctccttcaccactgcatcatgtccttcggcgccaagcctccacttgcccttctcccatgcatggtccatcgtgtatccaagtgttgccaacccttcattgcatcttgccatcttccgtcatttgtagctttgcatcacaatgaaaccacaatgtattacatctttctctacatcatcttcattggactaatcccttgcttatacactcaataaaagcattagacccttaatcatttgccatcaattaaccaaaactcactaagggcatagatgctcattaaatctcccactttttggtaattgataacaacacgattaaagcttacaaaagattgataataatgcttttgaaccaaaagttagtttgagctcccccaaaatgtgtgcatacaaatatatggagtgaatttctgtgatgagtgataccgaaaggaaaacaagacacataactcaaattcttgccaccgattcaaaatgtatcaaatgaaattcttaatgccaattgcaaaaacttgattttatgccaattgattctggtaccgattgagaaatcacgagtaaccaaatttttgaatcaaattcaaataccaataaataatgtcaattgcatctggcctagcaatcaaataataagcatgaaatctatcacaccatgcacactccaattgacaaacattttcaaatatactctccccctttctcatttactctttggcatgtccaaagcatgtctttcgataatttctcacaattatctcaccctttgatcaatcttttcttcacccccttccttcagtatactccccccccttgaaatctaagcaacaaaaagggcatacgcagggaaagaaaagcagagggatcctcgtcgattacctttctctcaattttatatttcatcacttgtgattacgaattaaacactaatttgacacaagtgaatcaataagcattgagatacaaattttgcacataaaaagctcacattcgaagggtttaaagcataaaccaaaaagtatccctttgaatgtgacattcttcttttcttctaatttaatgtatccctcccccttagtcctctcccactttgtcatttaagcatggcaaggagagggcatgatatataatgaaggggatcattgagatttgaacatgccaaaccacttcttcacaaactagagtgagaattaagagtt

SEQ ID NO: 27879 - DNA, 1501 bp, Oryza sativa
agagtttcacgataggctaaccaaatcaggaaagtttggatctgtttctccatgcacgcggtagacaaaactggaaattttgaatccgttcgcgtcttgtatatctcgcgtgcgtccgtgcagtagacctcccccgatgacgacgacaacaatacatcctgttgttgttgtttttaataagatgaacggacaaacatattataaaaagccaacggtgtcaaatattcagtaatgttaggagactgagggagtacattgttcagaaatcagagttgacacatgaaccctttttaagtgcacgaggcctgtgaacgaagggcatacagtatatcaaagctagcataaacaaatcatagcttaccatggcagcagcatccggcaatcacttgaccgagagccggacgcactttgcccatccacagcacccgcttatcaagacacagtacggcggcggcggcgagcggcagccgatcagcagccacgtctgccgcatctgcgggactcgatcgcgtcgtcaccggcgccggctaccgctgcgaccactgcgacttcgacatccacgaggccaaggcctgcgccaacttcttcccggagaaaatgattacacccccgcccaacttcttcgggcatccgtggtcgcacattaatctcacgctcagacagatcacggcggatcatggcgaacgaccctgtgccggggtcccttccagcacggccacctcgcctaccgctgcgcgccgcagcgttgcgggtgaattcgccgcgcaccccgttgcgcacgatgctgccgggagagatccgcagcccgctccaccgggagcacgcactcacccactccgggctcatctcgtcgtcgtcccagagcggcccgtgcacacccgccgagatggcccgggtctgctccgtctgccgccaagattgctccatatgcgcacgcggcactaccgctgcggcggcggctgcatgttcgtgcttcacatcggcggctgtgtttccggcgtcccgccgacgacgacgccggagcagagtagcagtggtcgtgaggacgacgtcggagctgctgctgctccagcccccgccatcgtcgcgaggtttctcgatcgtcgtggtcgcggactcgcggagcagcagctggcggcggatttccagctgccaatggcatggtggacgtctttaacgccctgtaagcttcgctgggctcgggtgattaattactagtagctatataaacgtacatccgagcgatttgtccagttacgtataagtatatacgcgtgtgcttgttgtctgtaataatcgcacaaaacattcttggcgtttgtcgtaacgagttcgatcatgcgaacgtgccagtttgaacacgtgacatatatagctataggcctatagcagccgagctagctagttaaagtatatatgtggaccgtttggtctttagtttcagaagattagtggtgaaaacgagcggtagatatacacggtcggattatgacattatcat

SEQ ID NO: 27880 - DNA, 1501 bp, Oryza sativa
gtttgcatgcaaggttgggaagccaaagcttaaaggctaaatttgaaccaggatgctgtgcttgaaggacaatcatgtgatttctcaagagaaacaactggtttctgctcaaactccgcacaaaaggtgaatagctaacctcgtctacattttcttctaagatgtgatatgactaccagttatatttgcaaaactagtacagattttaacctctgctgcaattgatgcaatttattttttttattactgactagaaagctctgatgcaaagtccttgtttgtaacacatgaatcttccctatgtcctgtgaaatttcagaattagaaactatagtgtttcagacgtgtctcgagtccatctaaaaagcatgtcttaaaaaagcattggcatttaaggctgtgtttgagaaaggggagatagagaagatttgggagatacacaaaacgaggtgagctattagtgtatgattaattgagtattaattatttcaaatttaaaaaatgaactaatataattttttaaagcaacattcctataaaaaatttttacaaaaaacacaccgtttaatagtttaggaagcgtgcacgcggaaaacgatgtgcattctacctccaatctcccagaacgaacgctgcctaaaactagcgtgtttcaaagtaggtcatcgccggatcggccaaatttgcctgttgctggttggtaggtccgtaggtggatccaatttgttacagcggatatcttgtctagccttttaaagttcctgcacttgttctgttgctgacaaggccaaagttggcatccattgtgcagacaaagcattggcgaacggctcctgtgctgttcgtgtttagttggtactaaccttgtactaattgacagcaaagcgcttatgtcatggctgcacttaccaccattgttataggcttgtgtgatttgcatcggtatccactaccaagcgtggtggtgacattttgttttgcagcgtgaacatggacacatgatttagatacaaagatgcaatcatacaagaggggaaaaaagaagaaatgtcactgccatacccccaggtcccaatccccaagcctcctatggccaggaacatgcacgtcactgtcctgcccaaatgtttaacggcgcgagagacacgtttctggttactggttgctgctgaattagcggaactcactcgcacacgcggaatcctatgatttttagattagcaatttactccatcatcattgagtagggtcgaactgggggagggtggttgttgattgattattcaattgcgtttgagaatagttcttgtctgtttcaaacactactagatcaccttggtcttggttgtgtgcactgcatctaaaaataccgagatggaatattcaattcagtttaagctttgagggcttgaggttgccacgttccaagatccaacatgcttggaggttactgtattactgacgaaataatatgagacactggaaacgttttaaacacaag

SEQ ID NO: 27881 - DNA, 1501 bp, Oryza sativa
gaactcgttacgacaaaccccaagaatgttttgtgtgattatattattacagataacacgttgaaacagcactcgcgtgttatacgtacgtactccctctgtacttgtagaggaagtcgttttggacagtgacacggtctctaaaacacaactttgacttcttgtttctacaaaagtatctattgaaaagtgatatatgtatacttctagtaaagtatttttcaaggtaaacctatttatataatttttaaatttttaaactcaataactcaataacttgatttaaacattgtcataaacgaattgtagtatacgtaactgacaaatcgctcggacgaaagttcagctggctagctgtaccagtaattaatcgttcgagctcaacgaagcttgcagggcgttaatgaccgccaccatgccattggcagccgggaaatccgccgccagctgctgctccgcgaccacgacgagaaacctcgcgacggcgggggctggagcagcagcagctccgccgcacgaacccctcgcgccgtcaggaccactgctaccctggtcctcgccggccggcgccggcggcggcgggacgccggaaacgcagccgccgatgtggagcacgaacatgcagctaggcggcgcagcggtagtgccgcgtgcgcacggtggagcagtctcggcggcagacggagcagacccgggccatctcggcgggtgtgcacgggccggacgggatgagcatgagctcggtgtgggtgagcgcgtgcttccggtggagcgggctgcggatctctcccggcagcatcgtgcacagcgggtgcgcggcgaacccgcacctccgcgcgccgcagcggtaggcgaggtggccgtgctggaagggcccccggcacagggtgcacggccacgatccatccgccgccgtgacctgtctgagcgcgaggttgtgcgaccacggatgcccgaagaagttgggaggtggagttatcattttctccgggaagaagtcggcgcaggcctcgtggatgtcgaagtcgcagtggtcgcagcggtagccggcgccggcgacgacgcgagtcccgcagatgcggcagacgtggcggctgctcggctgccgctcgccgccaccgtactgtgtcttgagaagcgggtgctgtggatgggcgaagtgcgtccggctctcggtcagctgattgccggacgctgctgccatgataagctattgatgatttgacgtttgtgctagctttgatatatgtgcttcattcacagggttcctcgtgcacttaaaaagggttcatatgtcaactctgatttctgaacaatgtactattagtagcttacggtttttcgttctgatcgaaattggttttaacttttaagatgtgttgaactatgtatgaaacagctggcgctaatagtgtaatttacaagtaaagtcaattttgagatcgagcctgatatgtaggcagttttaattccctctacgcactgatcgaattgaagcggc

SEQ ID NO: 27882 - DNA, 1501 bp, Oryza sativa
caccgtcctcgtggcgccttctgcaggacgttccacagccatctccgctctggtgctcttggccagccaagcgaccacagcctcccgctcccgctgcagcgctcggcgcctcggccgcttgcccgcagccatgcagcctttgcttcaattccggcggaacggaacggcgccttcccctgcaggtagtgaacaactgcctctactccccttcctttggctgactagctcagtagttatgtctctgtaggtaatggcttcaaaaatagatttctgatttgtgagtctgtgaataagtgaataactgaatatacaatttgtaagttgtgattattgtttagtgaatgtgtcattgtagtttgtaggattggtaaagcatgaagaggagcagggattttagcttgttaagtaagccacttatcgatgttataagacattattattatatttctaacatattttcactaattttgttcttgtatatgatatcttaggtgtagaaaattttagtatatgatgtgaatttgtaaactatgactacccaaggaaaatctcctggctacgccactgtattgatatattatggcggcgaggggcgccctgtccgagtgcatcatcagcagtgccggctaccgatgcgtcgagtgcgcgtgcggcggcttcgacgtccaagatcagcgcagagcagtttgttaagtaaatgtgtcattgcagtttgcaggattggtaaaacatgaagaggagcagggatattgattagtgaatgtgtcattttagcttgttaagtaagccacttatgatgttttaagacattataataatatcatattttcactagttttgtacttgtatatcatattttcggtgtagaaaattgtagtatgtgatgtgcatttgtgaactagtactgcccaaggaaaatctcctggttacaccattgacatatgttacggcggcgaggggcgccctatgcaagcgcatcatccgtagcattggctaccgatgtgtcgagggagtgtgcggcggctcctgttaggaagcgataggcaaataaacgataaaaaataatagatcaatcatagaagacccgagatttaacgtggaaaatcttttcaaagcaggagagaaaaaactatgagcatcagttagcaaaatatcttcactttatcggggtaaggttacaacaccgaacgacggcttacaagaagtatatatgaaggtgaaatcctaaaaggataacgacgggcctccgcttcgctctggcagaagctggtcacaactcaacagtttcaatgtccaagatcagggtagagggctgcctctccctgccgatggcgcgctcattctctctctctctctctctctccccctcatggctagccggccggtggactcgaaaacttcaaatgtggcctcaaatccattaaaaaaagtgaatgttagaaaatgaactaatattataaataaaaggggtgagacttcaaatccagaccagccagcccac

SEQ ID NO: 27883 - DNA, 551 bp, Oryza sativa
ctgttacatgataaaaatgcataaaaagttagtttgttatgagctcataatcttctggtacatgataaaaatgaatagaaggttagtttacatgttatcataacttggtcctaggataaataacttatttgatttagcacacaattaacatcaacttgaaattgaattgccctagacaattggatagaataatttgcaacacacttcttgctatctataaagttttccttgttggtaatttttttatatcctttagatctatgtaaaattctcttttaacttattttaatacattacagctggattatcccctaccatctcctgtcaaaagcaaaaattatggcacaacacaaccaaaagaggtagtcggtcatttccatattaatttatggtttttaaaatagaatataattgaatttggaactttaccagtgttttggtcttctaagcactgaaatacagtctccaaccagtgtctatgttgaaccataacagtctcattttctggcatgaaagagaaattgcgaattatattggaggctgcaacagca

SEQ ID NO: 27884 - DNA, 1501 bp, Oryza sativa
tcaggtaactcgaactgtctttaataaataatttgtacctttttccttatatcttctatgtacctaaaaaacaataatccagctatttatcctggctggtgcctggtaagtgcatagtaataccttttgaggacagaccattttccattctgctttatacagtcagcgctggtgattaatctttccaacaatacctgtcaaaagatcttggagtcataaaagtcaaatgcaaaaaacttgtgaacagtagctgcacactgtgtaacaactttatggccatggtccagggcaacatagttcatgtgactatcaaacctaacatttgccttttcttttttctccttctttccccaagccaatcatttctgccataccctgatcaggttaacccctatcagcaaagctgtactagtacagtgctacctagcagaatagaaccatatccaataaaccagaaaattattgagtaagttctcccctaatattctctatctcttgtggtgttgacagagaagggagtggtcacagaaatgtgatgtgattggtaaacaaaaccaatttattaaaaaggggaataggatagggagagatgctgcctgcctgctgctgaagaaaaaagggatatgctgttgaagagagaagtgaaggggcaatactgatatggcatgacagagacatcaccaccttatcgtttagtattagagaaatgggaacagatcatgtactgatatgcaacttttattgtataataagttgaattattattatactactccatctgttacaacggccctgttcagctgccacaacaatgagtaaattatacccacggtacaacaacttggcgggtggatgtgatataatataagaacttgagaattaaacatttgaatgcaacaacttaacaagtgtgtacgttctagtacaagaacttggcaatttagtattttggtgcatcaacttagctaagcatatgctaggtgagtttttctcacgatgtcaatatgccattacatagcaatcctacggtattaccttataatattaaatttaatctttaagaattatcatgcacatccaatttagatataattacctttaagaatttttgttttttttcaccttcctaaatctcaactgaaatataataatttttatatctagtttaattgacttttagttattagttattatgataaaaatataaatatgcttatatacaaatccacactagtatattgtcaaaataagtacttaaaaattgaatatgtataaaaaaagtgctccaaataattaagttgtcgcatagcttctgaacttattatatcaaaatcgtacatatcttataagttgttgcatttatgcgatcaactatgtactaaattgcacatatctgccaagttgttgcactagaacgctcatttcttaagttcttgcaccaaattgtacccacctgccaagttgatatactatggttgcaatttactcaaaaataatatac

SEQ ID NO: 27885 - DNA, 160 bp, Oryza sativa
atcgaattcctgcagccctcctcgattatgtcgctctacaagggaagacccagatctatcatgactgcaaatctcttgtcaaatccatcccctccatcattggcattagcgtcctctcctctattcctcactttccttcataactatgcacatgcctaga

SEQ ID NO: 27886 - DNA, 1501 bp, Oryza sativa
taacgaagctaagaacagaatcgacgcggaaccaccagatctaccaaaacgcagccaagaaaccgcctaaaaccatccagatttccgcaaccgcagccgagaacaaccaagaaaaagatgaaccgtcgcgagaggcgcgtcggggaagggagagagagaacctggatcccggcgcgggaggagcgggagacgggcgccttcttgcggtccttgtccttgtcggcggcggccttcgccgccgtcgtcttcgccgcgagcagccccttccctcccttccccgccattgctcctcctcctcctctccctctccctctctcgctcgcgttggtggttcggctgcctcgcgtccgctctctctccctctctctcccccttcctcgctgtagaatttatgtcggtttgggaggagcgcgcggaggttttggagggaaattttcgcgggcgacgcgggggttttgggcgaatttcgaattccaccgcgcggcgaggaattaatttcgaggaggattttcggcggcggcggcggcggcgtgggtgggagattaagggagacgtgaagggtagagagcgtgggccttgttaacccagtaaaacacggcccattaattagacagtacaaactgggccttctggatgagctggaacttcggcccattaacttgtaggcccattttgtttgggctgctatttttttcaatttcctggcccacgtcaggaaatgaatggactattcaaggttggatgggctaggatgagtccccatccaacaaaaggaaacaaaagcccttgagtgttggactgtttcaaggactagccttttcttttttttttcttttgctatatatttttcgactctaatttctcttttcgaattaactacaattttcaatcggggcctcaggggctattacgctctcttttcccaaatttaagtcgttttatagacatattataagaattaagaaaacaactcaaaagattttggccaccctgcatattgcattgataaagataaatcatttgactgtgaaaaacgagcatttaaattttcatggaaaatatgaaatcatagttaaaagttaaaacaaacgtctgagctctaaaatgacttacattgaggatacctttaaaaaagataaagaatttacatttaaaatcaaaggcggttgctgggctacttggctgccgcagcaaatacgaatggtactcaaagcctgcaaacaccaagccagaagcacaactacaattgcagccagggttcacaaaccatttaggatgtggttatcgccacccaacaatataacaattaccgtaaggtataccgtggtttcaaaaactaagaagattaccgcatgtgataaccgcgttgtattataaaccttgattgcagcatccgcctgcagaacaggcctagggtgtagtaaataaaaaaaatggtgttgctatgaaacacacacacacacacacacacacacacacacacacacacacacacacacac

SEQ ID NO: 27887 - DNA, 1501 bp, Oryza sativa
tatttgcaagacgcgtacgtacggctgcgggcggcatgatccagccgcgtccatatgtaacaacaaaaagctcacctgttgacagggacacaccagctaatatgtacctggagtactacataaaaagtcaaagacttcgccgtcgcagtttgcttagccctcaggtatacgcggatggctcgccgcgcgcgaacgtaacgtgtaacggtggcagggatatggctcgccgctcgccgctcgccgctgcttgcctgcctactagagcttcccggcaaaggcacgtataaatcgctgaactaaattaacacgcgcccagctgtgtttgcttcagttcacacatatccctgccactgccgtactgccaccgcgtggatcttcactgcaataagtgttgaagaaaaatacaaacattggtcatgcaatttctggtcacatcagaaatttagttcgtgaaaaaaaaattagggtgtcacatcagatatttgaccggatgtcggaaggagtttcggacacgaataaaaaaattaattttataaattgcctgtaaaccatgagacgaatttattcagcctaattaatctatcattagcgcacgtggattactgtagcacttatggctaattatggactaactatacaattaatattttcatgtaaactatgtaattaatatttttctcacatttagtgccccatatatatgtccaaacatttgatgtgacgtttttggcaaaaaaaaaatcatctaacgttgtgtttagttacaaaataattcttcaaacttccaatttttccatcacatcaaaacttttctacacatacaaaccttcaacttttccgtcaaatcgttttaatttcaaacaaacaatttttaattttggtgtgaagtaaacccagcctaatcaaggcctaatattgtcgctggcgatttgcttcgcctgcgccccttgcccgcacgctgtcaggcacgcggcggccgtaacggcagcggccaaggcgcgtaccgcgtggatgggatggatatacactgtgctgcctagccacctgccttgctacgcgtgcgtgaggcttgcctggctgctgctaccccgcggctaaagcaaagctgcgtgcgctgtggtccctatgtttcagtttcacatgttcatgcctaggtcacgcgtgaaatgactcggttagtttgctgcaaatgttaatgaagatgcctgtaaatctcggggggatgaacttttggtattttactttatatataagtattgatatatactctcactctgttctaaaatataaaggattttgcacggattggatatttcctagtattcgtagaaaattcaacaattttcgagcaaactttggaaaccaaaatttgaatgtgaaaaattgaaatttcattagaggtgatcagttttcgatcgaaatggcttgaaatcctaaaaatttctatcagtttaatttgtccaagatgccacgaggagataaaccaggggggcagtgcaga

SEQ ID NO: 27888 - DNA, 1501 bp, Oryza sativa
tcctttgttgtaattttccttttttctgctctcctcccccctgtctttccccttgtcaccattggtggtatttgtacagtgcttatcttctgaaatataaaaccagctaagctggcaaaggttttaaaaaaaataaaccaggggatttattgctcgaaattcgatcggttgcttcaaaatccaataggaaagtgtggaataatatggaaaagaatattcaatactccatccatttcacaatgtaagtcattctagcatatcacatattcatattgatgctaatgaatatagacatatatatgaattatgctagaatgacttacattgtgaaacggaggaagtatcattttttgtaaaaaaaaaaatcgtgtacgtatgccacttagttctacaaaaactttccactcaaaaaaaaaagttttacaaaaaccatagtattaatagttgtttttaaattttccagtattttttcagaaaaaatgacaggaacagtatttttcaattcgatctgaatataggattttgtcccaaaaaaccttaaatttctaatcgagattgagatgtcaatatcttacgaaaaccagtaagttttggccgagaatgtaaatgcatgaccaacagaatctcaaaatactaatcccaaaattgaggatttctaataaatcaaatccaacagttgccatgctcagatgctgaatgctttcgcggttgccccacagccaacatgaattgaatagtgccacattcactgtgcgcagcccctgtagacggcctgtcgaacgatcccttagaattcccagcttcagtttttttagttctgcacattaggagagtctacgttctcaatccgtgcgtaaagattatgttagtagattttcaagatgggattttaaagatggactatctcggtgagggaagggtattatcatactttaaatttccattacagatttcctaaaataagatttaggggattaaattttggatatctctctggtcaaacccttaaaccccgtagttacctttcttaatgcgctaaatataatttggatcgaaatggtactaaacacggttgtatgaaatggtaaataaaatacacacggtaaatttacctctagttacttctcttggttaccttccctcccaattactaaccttattctgttcaacaatttctatttttaactcacaaacggttgatctttgtaacagacatagtaataatagtggaggttatttccattacagatttcctcgcagcttcttggtagcttctgttaaaccgtgatatatatagggggcatataggaatccatccttccaccaccaattaaattcagtttcgcaccaattcagcaaatccttggaccattttctttgagagtaatcgcttgtgtttctcgaaattgtgagtagtttgatccattcatctttgttggtcgcttgattcggcagcgcctgatcgatcaggatcgggtactggatggagtgcgctgactac

SEQ ID NO: 27889 - DNA, 159 bp, Oryza sativa
aggtgagaaaacagcttgtaaatacggttctaccctttgaattttttttctttattctttcctctcttctctatattctttcttcttgcttctctctcgatcccctttctcaccatgtgagtgcacgcctgagcgggaggcggttggcgcggggcggtg

SEQ ID NO: 27890 - DNA, 949 bp, Oryza sativa
cctcgcggtaaccgtcaaaccgcttggtggcggtaacctcatccccaaacggtttggtaaactctgctacgaagaagcagatgctacaaaattagatacacaaaccttatactttagagtttttttttcctaaaacacactacaaatgcatgatactcataacacgcacacacttatccctatgaatacacacgcacatcctatctctatgatcatcttcgaaagactaaaccaatataccttgaggctgacgaacactactacagaacaacctatcaatgctggttcgattaaacccggtgctaacaagggtttacccggcattgataagaacccatcggtactgggttttttataggatcgacactaacaagttgagccttgagtggtcgagccgagccaagccaaaatgtgtagtagcgcactagcattctctctgttttctttttccatgtatctttcgatccccttctccccatcgctctatccttatctccttttctttccctctccctccccaggactggcgaccagatcattggaccctccccttctcttccttattccgtgtcacgcccagaaatttagcccaaattttcagactattttgtgtattaaatccctgtattacaaaatattcccggccatgatttttaaagggaattttaaattccctctattcttcacttgattaaattgctttaacttttatttaatttctaaaaatgcattatttaataatttttaatcccgaacgaatatcggggcgtcacattccgacaagaagtagccccctctccagctgcaatcgcagcctacccctagacgtcgatggcttgctgcttgggggaggaggaaacgacgtcatccacgttggtgcgcaccctgtcgatgagtaggctgacggtgtaaagttgcccaccaccaacctcgagtagaaggacatcga

SEQ ID NO: 27891 - DNA, 688 bp, Oryza sativa
tagcctgcctccccatggcatatgttccttctgttcctgcattcgaacgaatttggatggatttgatcaaaaacttcaatggaatccgcatttttaaatttcttgtgtttaaaacgtttccagtgtctcatattatttcgtcagtaatacagtaacctccaagcatgttggatcttggaacgtggcaacctcaagccctcaaagcttaaactgaattgaatattccatctcggtatttttagatgcagtgcacacaaccaagaccaaggtgatctagtagtgtttgaaacagacaagaactattctcaaacgcaattgaataatcaatcaacaaccaccctcccccagttcgaccctactcaatgatgatggagtaaattgctaatctaaaaatcataggattccgcgtgtgcgagtgagttccgctaattcagcagcaaccagtaaccagaaacgtgtctctcgcgccgttaaacatttgggcaggacagtgacgtgcatgttcctggccataggaggcttggggattgggacctgggggtatggcagtgacatttcttcttttttcccctcttgtatgattgcatctttgtatctaaatcatgtgtccatgttcacgctgcaaaacaaaatgtcaccaccacgcttggtagtggataccgatgcaaatcacacaagcctataacaa

SEQ ID NO: 27892 - DNA, 1501 bp, Oryza sativa
cccaccatagagtacgcatttcatcaattcctacacgcacgatatgcccaccatagagtacgtatttcccgtagggaggtcgaatttcaactggcagaccggcaatagtagaggacgattttcggtggagtaaaaaaggactggatattttccgtggagcaaaatagggctggatcttcactgtttgtcctcgccgcgaatacatcgttcccatccagccgctgaaccgcacagctcaccccagccactcacccagtcaccactcaccactaggatgaaaacggatcggatacggtcgaaaactagctttattatattcgttttcatatttttttctcggaatcagaaacccggatatgaaaacggaatcgaatattatcgaatacagatacgaagcgaatacgaatcaaaacgaatacggtaacgaatattaatcggaacataaaagcccctcaaaccgaccttcacaaatcaacgaataaatataactcgttattttttctaatagaacatatcaacattttcaaattttagtgttaataattttgttgtattcgattttttggttgagggagacgattcaatcaagagtaagacattacgatgctattattgtgttctaaaattatgttctatcgagttattgtgttcttactgctattattttggccatattttcttgtgactttgttttatcaagtaaaaaatttgaatttcaaaaaatagcaacttcaaataatattttgaagcagtaaataatttcaactgaaaaagttatgaatataaaagttgtagaactcgtcaagagctacaacttttattttagtcatttcttcatccgaccaagtgatagtaatattgtttataaaatttgcatatctctcttatatcttatgaaaccatatacaagatatgtaaattttgtaaacaatgttactataactttgtcggatgaaaaaatgactaaaataaaagttgtagatcttgataagttatacaactttgttgttggtgactttttcagttgaaatcatttagtatttgaaaatgttgtttgaaggtgtcatattttgaaatccaaattcaaactatttaaacaaagtcatatagaaaaataacccaaacaaaagttgttgatctcgatgagttatacaactttgttgttgacaactttttccatttgaaatcatttactacccgaaaaattatttgaatttcttatattttaaaattcaaaatttatatagttcaatcaaactcggatgaagaaatgaccaaaataaaattggtagatctcaataaattctacaactttgtttttgataactttttcacatgaattcatttagtatcataaaatttaattcgaagttgagggaggacatatagacttaatagctaattcttaggcccgttggcccatttagatggagggatatataaacctaaccctagtttctcccacacctcccaatctcctcccagccgccaccctttcctc

SEQ ID NO: 27893 - DNA, 1501 bp, Oryza sativa
actttttaaaaaaaatacaccgtttagtagtttaaaaagcgtgcgcgcggaaaacgagggaaaatggttgggaaccctcctaaacgaactcagccttaagccttcgattttacctacgtcacatgatatgtgatccctattgaacgagtttgtgtaataagtgattgtaactcttgttagcaaaaaaaaaacggatttattccattattttaaaaaaaaggcactatgagaaacgaatcctataacgattttgctaaaaatctggcgacaaatttttggctcgaaatcactcggatttactatccttgtggattagtctgtgcatgatttaattagcggctatgatgtgtttccttcccacgcacgcatgaggccagcaacatctaacttggcacataattgatgagtacatacattgcacgtcgttgcggctaggtgaagagattgaagaaataaaatataaagttacagatctatataactaaaattacattcgtaaattcagttgatatgacatgtaagtgcactataattttgataaaaatgttgtataagtaaatatatacttgttatttcctttaaaatataaaattacaatcctatataactaaaattatatttgtaagtttagttgatatgacatgtaagtgtacagttacactgtaactacactatagttacaataactatagtgtagttacaatgtaactatagtgtaattacacggtaacttttagtagatgggttggtgatatatttttttcaatataaagatctaacaaataaaatatatgcaatatatataattaatatatgttgatacatgtatagactcttctaatcaagtgatcaaatgagcctaatccaactaatctaaaatctgtgtgatttgcacccaaaaatctgtcgtgtgatggatagctagtcccacgaagggtaaaaaagcccataaagattccgtcactcggaatcttcaatcttggacacgtgagctgggcttctgggccgtacggacggcctgtaagctccgtcacggacaagtgggccccattagcagcttccatctcgcgaggcttacctctccggccagtttggtcggagggagtttgtaggagggagtgagagtgagagttcagagggacgagactattaagtgttttgtttggttagaagacatgttaattttggtgggatagagatgaagaattgatgaaggacctttttaataccaaggtaggggcagataattgggagtgaatgcctcctttattttattttgtctaagcaaatctcagccatccgtttttattaaagacctaatctccaactaaactccctagcaatgtccatcttctctaccaaactaaatattaggattaaaaatcaaattatcaccttaatctcatcatcaattctgtcgtaaactcccagtccccttccaactcccaactcccaaagccacacgctccaactccggcgatggcttccatctccggcgcgg

SEQ ID NO: 27894 - DNA, 1501 bp, Oryza sativa
tgtcgaggataaggtgcaaaactctggcccgtaggatcggagggagggtcacgagatcgtatcgtatcctgcaggtgtgcccgcgtacgtgcatcttatcagtgcgtggtatatatggctcagctggcctctcgtatcggcgtgcaatctgatccccactctgtcctggtagtgcttacattatttgttttattttttctttgcaaatttgctaactacctttagagtttggacagacatttgagaaacaattctcatagttttaaaccattagattgatctcaagactcgtgtgtccgtcctctttcttctctcgctccgacaacgaggatgtggcgataatctcaccgggttaggtttttggggtcggaggattgattcaaaggagggttgggtttagagcgagtctagaagaccagtggacggtgagcaataggaggatgatgagacggtgggggcgccactaaagccgtgagagtgaaggagggcgatgggaggtgaaagatttggttggagatagtaggggagtcaagacggtacgtattaaagatgacggatattgatggccgatccaacggcagaaaccacaagaagtggaggaagatagctcaggagcaccgacaatgagaaacatgatgggggagagagaaaaatgaagtggagggagaagatctgtagtgttgttctcggcttctcgctaacatcagaggtgaagtcggagagacaaagggatgacagcgcgtgaggcagggagaaaggtgtgtatgtgatgatagcaggaaagtcgatgcgagtgcgtcgctcaaatcctaatcgatgggccgggattaggggacgatgtgttggagacagatgaacacagatagcgagggtgatgtgtgatgcatttgattttaattaatcaaatgattagaaaatcataacattacattggggaatttctcaatgatgtcttataggtagtatttttcccataaggcttacggtagaattggcacactagacactagtaaatataatatatgcatataatataattagagatcttgagggtaaagaaattaattaataacaatttagtgaagatgatgtgttaattagttaattgtatgtatgtatgcacgtcttatgtaatgaaacatctggaaaaaaataattgtatgaaatgaagcacaacttaaaaaaaaaggataaaaggcattagggtagattatagtagtttcatcctactcttgatgagtaaactctggctccgccagattcacgatggaattattgacggtgcctgatatcgccattacgccctaggcgcgcagcacaggatggcctcagcacaagatgatcatctcgctgcacctaaccaaactcctccgtgtgcccgtgtggcttacctcacatgtacacttcgtgcggtttccaccaaaccgagctcccgtacattgtacgtgcactaattttgccgggggcgcgcgcggtaacggagcccaaaaaaaaaaacgaa

SEQ ID NO: 27895 - DNA, 1501 bp, Oryza sativa
ggaactggaaacatgctctaatgtgctagtgctacgtgccgtatttctatgttgagtcctgctatacgtatgacgtttcagttatacaactcatattcaactagataaatataattataaataattaaagaagaacatgtttatatgcactgcaaccatttacaaccattgatcaactttagttgtatgtaagttagacaggtcgtacgcataacaattttcttctatgttccatacgctttgagatcagtgcatggttcctcgaagacccgtctgggaagcgggacatttattttaaagcattactagaaaggcacatactacaagtatattatattcatataccccatgaaaacgtttttctaatatgttaaatacatattagcgacaaatcaatagcatcactaaaatttgaaagcgcatccgcatatgcgtaacatttacgaacactaggattcaaacacatggtggatggagttatgcatggcctccttttagaacgagctcgggagtcctaggataaattcacaatcttaccaatttttttgtttaaagttaaccgtgtgatataaaaatcgttggtattaaaatttaactcctgatagatgctataggacagaaatgtttccccttcatttgacatttttgatgcacccattcatttgacctttttgatgacataggacagaaaactacacccaagctaccttgaatacagatgtttggactttggaagggggcagataagcgactttctgtgggatacacatcaccatgccagcatgccccatgactaaatgctcataggccatgacagtagtttatgaaaacagataattttgatgctatgcgtgtattgataggcaaagctggaactggaagcagtcatgcttggcttttcgttcatgtatgggtacgtagcaatccatcagtccatggctccatgcctctagatgagccaaagggacacgactaacacgagtattagtgatgtttcagctcagttccccgaacctgtgggaagttaaatcattaatcatactagttcaatgaacattgtgcgttatttactcgtcaattctgatcgcaatcagcgaccaaacgcgctctcatcattgcgcagttggcatgttgcctatgtgccgaattcattgcatccatttttatttttgggtgtcattccttctgaacatgtcacgcacatgcgatgagccatgtctctgttatcttttgttccactgtccccttaggcccttatcaaatttagatgaacaagaagtagtacatagccatgacaaacagagatactgaactttgtggaagcacttacaagttacaaatcgctacatggctgacacttgtgagatttgttcaaattcatagtaccaggtaactatattttaatacggaagtagtacatagccatgacaaacagagatgctaaactttgtggaagcacttactttacaaatcggtatgtggttgacacttgtgagatttg

SEQ ID NO: 27896 - DNA, 1501 bp, Oryza sativa
cccggtttgcagagttggactcaaccttaaaatcttaatattattggatgtagaggttggatttttaattttatttttttttaaaaaaatggaagatataaactcattatgtggagagattttgcttcatgcacccacttgtttggttcattgccctttctcaccatgccaaaaaaattggccatgctaatggactaacatgttcatttgctttctagaaaaaccagcatgttcaagatgctagctagagtgataaacaagaggctatacatataccaaaaattttgctgcatcccaaacaatcattttttaccaaaaatttgacgataccaattctttcgacaacccaaaacaatagttcttttgaataattaatgctagatcttaccattacaaagatctaaacacaggcccgttgtgtttagatgcaacatgtttcagacaatctcttctgattgtacatgcaactgtccttgtgactctctccaagtactgtactggttccatccagctctttagccgcgaggaagtttaggactagtagtagtgtagtacttataaaccgtgagctaagttaagctaatctcctactagtcctagatgtattgatccaatgtgtaacctgccggcctatcggatggtagtacggcacagtccctgaagcagtactctgacaaagaaaactgcacggttgctacgtacaccggtacacgcttaactgatgccggaagagtacaaggacagcttctcattctcattatgatcgtttgctgtagttttcttttctgacataactggtgaattggaagcaaaagattaattaggaaacacacaagacaaagtggagagtaagggtgagtttgagaggagggaaaaagagaagattgggaagatacgtaaaacgaggtgagctattagtatatgattaattgagtataaactattttaaacttcaaaaatagattaatatgattttttaaagcaactttcatatagaaaatttttacaaaaaacacaccgttagtagttcgggaagcgtgcgcacggaaaatgaaacaaactaactgacaaactcctcctgccgaacgctccctaagcttggctagttgcctgctggaaggcgctctagtgcatatggagatggattatattcgttctgctcaattaagtggggattaaggagccaaatccaatgatagccagatccgtctgcaccatttgcctgacaatactaatactgagttgtaaactttgagcttgctgggtttgaagtcaattcttaccataccaatatgagttttgggactaccaaatttaccgcgggtaaaaaattgatagaaaactaaacatgcatgagacactattgaaattgtcaagaatttgttagaacaaatattggcatcaatccaatcaagcccttttaactccaaactataaattagttgttttccatcagcgcttcccgaacagctaattaatacgttttcgttttgtgcagaaa

SEQ ID NO: 27897 - DNA, 973 bp, Oryza sativa
ccccccccccccccccccgtgttgtacttttgcccgcccccgccattattgaagccatccttgatggccacttcgagactgtagacacggccgcgcgcgcgcggcctggtggtggcgaggcgtgcgctagcagaatctgaatggtgcaaagttttgttttctactgcacaccccgaccccgaccccgaccccgagccgagacgagacgagacgaggcgagagagaaatgctggtgttgcgcggcaaggtggtagtgggcgctgcatgcgtagtccgcactgcacgagctaggtagatcggcgtacgtggaccacggcgccgtgccgcgcgcggccgcgggtccccgtcgcgctcgccccccccccccccctcccggccggtgccgcgcggcgcgcgaacgtcgcggtctcgccaagctggccgacggcggtgtatggctagctaagctacttgggctatagctgctggcattaatggaatccaacatcctggtccggtacgacgcgtgggtcaggctctcgatcgatcgatcgatcggtcgtgtagagcgatcgagtagaggagggagggggatttaattgggaagaaatctggttgggtttcggatggcggttggagttggaagtttgctgtctgagcgcggccgctctcacatgtccactggttgcgccactgggttcgacgcctgaactgtgtgcatgcatatgtaatccttagctatatggcgaaagggaagttgtgtctacagttgacctgtactaaaaatttaggctatatttcagtttcatggtagggaaatttgaacagattagggtcaagaggatatcggcggagcaggacatgcccagttggcattgttctgtcccattggattgttacgtgcacaggagttgattttaaactctcgaggggatgtcttttcgttgcttgcatgttacttaaattattatgaaaaattttgaaaaaattgaga

SEQ ID NO: 27898 - DNA, 608 bp, Oryza sativa
cgaatctttgaacatatgcatgaagcattaaatatagataaaaagaaaaactaattgcacagttaggggggaaattgcgagacgaatcttttgagcctaattagtccatgattagccataagtgctacagtaacccacatgtgctaatgacggattaattaggctcaaaagattcatctcgcggtttcgagacgagttatgaaattagttttttcattcgtgtctgaaaactccttccgacatccggtcaaacgtccgatgtgacacctaaaaattttcatttcgcgaactaaacggggccttaatgcagtaaacaaaactggtgttcaatcattacatctaattttatgtttttttacgaagaaagtactatactactttttttgatgtagtacaatctttgctattgaatttacacgcccccggtcctatccacgtcaccatcgtccctaccaatcgttttctcgttctcgcaacgctgtacccttttatgacgtgcaagtgtgtaaaccccccatgccgtgtatatccacaaccggtggccgccgttcaccggagtccggcttgccgcgcgtgacaaaaaaaaaacgtacaacagcgacgcgcca

SEQ ID NO: 27899 - DNA, 1076 bp, Oryza sativa
cgaatctttgaacatatgcatgaagcattaaatatagataaaaagaaaaactaattgcacagttaggggggaaattgcgagacgaatcttttgagcctaattagtccatgattagccataagtgctacagtaacccacatgtgctaatgacggattaattaggctcaaaagattcatctcgcggtttcgagacgagttatgaaattagttttttcattcgtgtctgaaaactccttccgacatccggtcaaacgtccgatgtgacacctaaaaattttcatttcgcgaactaaacggggccttaatgcagtaaacaaaactggtgttcaatcattacatctaattttatgtttttttacgaagaaagtactatactactttttttgatgtagtacaatctttgctattgaatttacacgcccccggtcctatccacgtcaccatcgtccctaccaatcgttttctcgttctcgcaacgctgtacccttttatgacgtgcaagtgtgtaaaccccccatgccgtgtatatccacaaccggtggccgccgttcaccggagtccggcttgccgcgcgtgacaaaaaaaaaacgtacaacagcgacgcgccatggccggagcagccgctcgtctttcgctcggacgagatcaagacaacacacccaaggaatatccggttccaccgacggtggggcccacccacgaggtggtccccagctgtcagcgtctctctacagtctatgccacctacctagtgataatgaagcaccgggatactaatttagggtgtgtttagttctttgggtgtaaaatttttgaagtatacggacacacatttgaagaattaaatgcagactaataacaaaacaaattacagattccgcatgtaaactgcgagacgaattattaagcctaattaatccgtcattagtaaatatttactgtagcatcacatggtcaaatttttcccacatttaatatcccatgtatatgtccaaacatttaatgtgacgttttggctaaaattttttaggatctaaacaaggccttacttcttatcttatgatgagaggagagta

SEQ ID NO: 27900 - DNA, 269 bp, Oryza sativa
attggtagttaaccgttacatatataaggatatgtatatctggctttagtaataattcatatataagtatgtaacaaactgcgtcaatgttgactaattagaaggtagacttgatcgtacaagtcaaatacatttattagaaataattgttttccaagatttgttaaaaaaaaagagaacccctaaacatttaattaaaaaaacatcttacttttaatttgctacacatgtatgctaaacaaactaagtctatcttctttctttttaga

SEQ ID NO: 27901 - DNA, 1501 bp, Oryza sativa
cgcggccgcgccaagtaccagctgatccacacggtgcgcacccaccgcggcgcccacgaccagagcttcgggtgcgtgacccaggaggaggacgacgccggcgaggtcggcgtctccctctccaaggagctcatggtggtcgccggcgaggccctcaagaccaacatcacaaccctcggccccctcgtcctccccatctccgagcagctccgcttcctcgccaccgtcgtcctcaagcgcgtcttccgcgccgacgtcaaggcctacctcccggacttcaagctcgccctcgaccacttctgcatccacgcggggggccgcggcgtcctcgacgagctcgagaagagcctcaagctctcgccgtgggacatggagccgtcgcggatgacgctctaccgcttcggcaacacgtccagcagctcgctgtggtacgagctcgcctactgcgaggccaaggggaggatcaagcgcggcgaccgggtgtggcagatcgccttcggctccgggttcaagtgcaacagcgccgtgtggagggcgctgcgcaccgtcgacgccgcgggcctcgacgccggcgacaacccgtggatgaaggaggtggacatgctccccgtcgacgtgcccaaggtggcgcccatcgatgagacctcctaccagatcccaaactaataaggggatatatgaggctatatagctattataatttataagtagtagacttcttgttctgtcgatcgatatgatgatctcaagaatatggagccattgctaggctgcttatgtatgatgatgatgatgataggcctttattattagggcttaatttggctattaatcaatcattgtgtttgtgtgtgtcctgattaattctatggacttgcaagaaatcctggtgggatcttgatctccatggtgttgttggatgccctggatatggaggttgatcaccctagatcagtgggagaacatgcatcaatctgatcctccacattgtactgtgatgaggccatggaaaaaaggtaatacaacttgggtttggcttagacttttattagaagaggtgttggatcattagcttaatgtgcattgaccataggaaatggacaaactaacgaacttacaaggacagaacagactgtcaacaatggtgtgaagaagaagctacatactcatagtacatatatatcaccacatccacagaactgacagaagacatgttactagggtaggttatctagacaaactaatcaaggtccgcatgctccaccagcaagcaattaaaattaacacacagatcatcaccagacacaaattcaacaaaacaggaacaatccaataatgacatacacaacataagcatgtctgtacgtataacacggttggggttttatcttaaattccagctggaatgatgcacggctagatatatactagatgctaattcaaattcgtatttcaaatttgagttgcttattttcatagtacagctcttgtgatctttgtt

SEQ ID NO: 27902 - DNA, 1501 bp, Oryza sativa
cgcgcaatgacgagctcccttcagtctcttcgtgcaagtgagcaagcttgagttctgttttgtggtctctctacaccgtcgacgttgcccctagttgttgtcaatcaagctcatcctcagcaaccaccctcgagctctctccccagcctctctgtattcgaaggaagaagaaaagaaaagaaaataaaggattggtgaatatgccacttcaacggagctgtgacaatttaggaccagaaatataagtactttgacaagtcatgggacttggatttgcattgtaagagtttgcgggaacctagatggcacacccctataagattaaaaatcatctgtgtactttacttatatttgaataatacttatgtacgactataggatcagaatgatacgatttgatttacgggatccaatatgaaactattacttagtatcatagtgctataaggttttatactatatgacggatcaatatcgttttggttcagtaggattggaacatcagccatattcactttattgccactttcaaccctaccaaattttggtaggttaacaaactaaatatgatattatcaatgtgtgtcctatcaaaatttgatagtttcggaactttcctctcataaaaacactaccaaattttggaaaagcatcaaactaaatacatcatatccaatgcaatgctattaaaatttagcaacaccaaaatttagcatatattgctaaattttgatctattgctaaattttgataagatcaaaattgacaacaaagtgaacaagtccattttgatcaacttgtaacacgtgtgcacatgtcccaaaaaaaccacgtacgctcatgtgtacttgtgtagtatagactatacatatcagtacagggtgaatccagcgtgggtgctaggggattcaagtcccctaccccgctggatcaccattgagagaaggaagaggggacgggaaagaatcaaagaagaggaagggaagaaggagagataagataagagccatccatcatttttctagaactgcccatttacatagtatctccattttgatttacaagtcttttgactattttcttagttattttttttaaaaaaattgatcaagtttataggaaaatatagtcaaattgtcaatacaaaacaaacattgtatcaaaatatattcgatgttaaatttaatgaaactaattccgtgttatagatgttgctatttttttataaacttgatcaaactaaaaatactttggcaaagaaatgagtcaaacgacttgtaatatgaaacgaagagagtaccgtatactgccacgttggatgtacatgcgtgcattcagttaatgcattcgctggttgatagctgcttctcactaagctccccctctcccctctaaaccctataaaatccaccctctcgccattgctcccataccttcctcctcctcctcctcctcttcttcttcctttgcttccattgaagactagagaagagagaggagg

SEQ ID NO: 27903 - DNA, 1501 bp, Oryza sativa
tgcaaacactactggtgataagtaaaacgatatcactggttacaaccaaaggagttgttaagttctgatatcgcactctctagtgtcgctcgtgtcttatctttgcatgtaataggtcaatgcaaacgtaatatctgccttgtagaggcattaccttgatgccggtagatgttatgttcattcttcattgcttattgaaatgctattttctaaaaacagcacaatgatctgtcactgacttgttcttccatcatgtgcagatgtagtgaagaagatctgctactttgttattcaatctcactgacttgccacatgcaacgatcatgggccttaatccccgccaaaaaatgtggtgctagtgggagggttggtggaagtatcattggcttatgatgacaactacgacactacaaatcaattttcacaatgaatctgctcttaatttagtgagagcaaccatgaggacgatgcttcacaggcaagtgctattgctctgctagcctgctacatgcagttccaattaatgtgtatctcaaacctttacagaacatgtattatttatgagaaaaagatgtccgcatatcctttccaacatatcggtatctcatctttttaagtcaaaattgttagtatcagaacagaatatctatcagatagcaggcctaactttctgacctactccttatatcttagttcagggttgttcacagaagaaacagcccaatttagcagctgttctttccttttctcctgtcactgtagcaagagagaaagaaagtgaaagattagccccactattcacaaactactgaaatagatccaagaagaaaagtatttcaaaaagaaaatttgaaaaagaataatgttttttttctcctgtcagtcatgccaaaatccaaatgagacagtgtagttgacctttgcagtcaaccagtttggcctctgtactagccctgctttggatcttctggaagctgtccctgtaaggtttacttcagtttgtggatttcaaaagttgggacttttctttgatatagttagttggaagagtaagacagaagtgtacctaataatcagaatattgtgaatttttttagtcacatattctctcttcacatcttaaagattatcctgcatggcaaatcaaataagagtcagccattgaggaacccttccaacctcatccaatcgaatcagttgaaaattttgaccttatctcctacattcaaaccttggttgagcagtccattcagaaggctctgtttcttcagcaccatttaatttttcatttgacaaaatcttggtggttgatttgtgagccacaaaacaagttataaattcagcgttcttctgaagattgcagcagcgtcctcaaccaatcaattgcaagcaatttctccatcacagaagtcaccaatgggctccgccaagctcattgctgtagtcctcctcccggcccttctggccttccaagctccaatggccacggcagtaaactcca

SEQ ID NO: 27904 - DNA, 1092 bp, Oryza sativa
ttgtacacgttgttgttttcttcttcttttttactttcaaccagtaatattgtaatcataatccgtattcagattgaatctaagtactgtacttaattaaccaagacgatccgtaatgcttctaggacggaaatgcatgcgtgatgtgatcgagtacatgtcctgctcctggccatgtttgtactaacactaatcacagtgtttgtatagtttttacactatatctgtactgggaaggaacaataatatcagacacatttgtgaatgattgtgttgtgttatatcatcaacaggccaattgcatttgttgcagtagattgtaattgtagttgagcaaaattaaatactaactagcagatcgagctcctctcacagtttcacaactgcacggggccaggcatttcatacatgtctatattttacacaagtctttaccaaaacaggaatactcctggattttgctgtacatgtctttaccaaaacagagtactctcctagattatattgtacaagtctttaccaaaacagagtactcctagattatattgtacaaaagtcttgtccttgttgcttgaagtacatgtacatttttttcagcataatttttatcctgatgtattgatcaaaattaggcttgaaattaaatttgtgatgtgattggtgacaccacatatactatagttacttgctatattttagaatagatgtagtagcataattttacaatcttgtagaattgtttgtgacttgtgaggtcctcataggaatatctaaaacctctcattttgcatttaagagcgtcaccaacagatatccaacactcctccctttgagaatctctaaagagaatttgagcattaacttcctaaataaaaaggtggctacttgaaaaacatagtttctcacccctcctacgtggttgtgcgcccttccttacacgatatcccgagcaaagactctgggagcgagagcgctcccacatatgtcgatagtaagaactcttggtgaattcaatttttgattaaattgcctctatagactataaatgcatgtcggattcaactttatatatatatatatatatatatatga

SEQ ID NO: 27905 - DNA, 1501 bp, Oryza sativa
gccaggtatcaatagtgtagtatgtaactattgtacgaatgaactattagattggctatagatgaattggagctagtagtaggctatactattaaactattaaacttgctctaagaccatgagcaccgcattccctaggaaataaaagaaggggaccttgtgacctgtcagcacgaaccttgggaagacaaacttaacaataccatgcggtttcagcgttgagcatctgtctctttgttcgaattagtaggtgcttctgttagtattttactccttaatttaagggctaaatgctcaatcatctaaaaagaacagttacatagggctgtcaagagtatgaatggtcccatgccgagttgggttggatacttggatcctatcataaagaggtccaatttgttacgtaaaaaagaatccatcgagggagatgaaaataggacaatttagaatttttcttcaaaattgaaaataatatttcagtaattttgttctctagtcatcgagggtgattggcggcggcgctcgaggacttgcggtaactagcgtgcctcaccgtggtgaatgatgacgacaaatgaggaatgtgattgagcaaggaaaactcctagccttgtttcactgtatgctacgaattcatagatttaccaacacccggtagtatagaaacacagttttaatccttttaactataatatagttaagtgagaggacacattaatctaaacctttatatcacttatactataagtatactagtatattgtagcgtaaaagttcttaaatattactccctccaacctaaagtatggctgtctctaacattacactgtcattaatcttttataatatattattaacaaatacaaaattaatatcatataaaaatacttccaaatgtgaatataatgatacaatatacataacaatagaaatacatttattggggttgtttggctgcactgtaaaaatgttgcattgcagtcagctgccgcttgacatgactgtggcgcagccaaacaacccacttgttactgacttgctagttaaagactacaagtgttgttttttcttaaaattactgaaaccttatgatatgggatagagggaatatgagaatggaatataactcaatttataaagaaaattctagcactagcactttataagaagcaattcattccccacaaaaatgagaaagagcccttagtttttatttttggctgcaaattgcagtgatgaactctcaccggattggaaatttcactgctcattcaaactagaagaccaaagactttttggctttgtgcccaacagtggaggctgaagatgtaaagttgtaaaccatttccattatctaaaattaaaattcaaacttggagacttaagaaaattggaatgatattgtaagctagtcactttaaatatatccttacacattctcttataatctactacatgtgaaattccttacattttaaaacggtacatttgcattctcaca

SEQ ID NO: 27906 - DNA, 1501 bp, Oryza sativa
caaaattaagaaaaacatgggaagaagagtttaaggttaatataggaatacaaatataggaatacaatttagaagtaacagaaattcgaaattaaaaattaaagaatattgaaaaatgagtttagagtccacatagaaatacaattagaaataataaaaattcagaaataaaaataaataatattggaagaagaacatagagtgtatatagaaatacaatttacagaaaattcgaaattaaaaaaagaaatatgaaaagacgagtctagagtccatataggaatatatataatttacaaataactaaaatttgatattaaaaataattaataactaacacgtatataaaatatatatgaatattacacattagtagttttgtaaagttattgcaaaatttaaaattatgttgtcattttaatatatttgaataatataatgagaaaacacatatgctgttatataagagaaaatataatgatgttagccgcgcaatttgtgcggaccaccatactagttgtatataagtcattacaacgtactagcaaaatacgtactacctccgtcccaaaatataacaacctaggactggatgtgacatatcctagtccaataaatctgcacaacctcttgtctagattcattgaactatccactcccaaattactatattttgggatggacggagcgtgtggttgctccttagaaagccatataaagattgcagaagcaaacaaaattggaggacttctctgaagtctgaaatccggaaatcttgtgaaacaatggactggttattaattgttactactactattgaactcttacgaaaaatcccagtaggacacatcacgcccgtttccaacatggggctaaaaacacggtactactaccgtaccttcaaactccaaatcatgcgttagtccaacacaaaatctactttgttatgatggggataacgagtttcaaacacgaagcacctgtcacaatcaaccgaaaaacactcctagtacagccctaaacccccatttttaaaacgagttggagccaaacccacttccagtagcatacaacatcacacggatgccgccgagcggagacgtgtacttactacatactactgtacatcgcgagacaacagagatacacttcactcacacaccgccccgtcattgccccggcgcgacaggtgcgccccagacaagtactactagtaacactctcactagtgagtgagagagagtttattgcatcatctagctagctactcctactagctgaagggtacagcagcaacagcagcagctgctgcttgcagcggcgcgtcaaaattagcaggtgtgtgtccacagtttcacactcccctatacttgctcatagcctcgtctccttcctctattactccctaagcttttcttaagctcgccaagaacacacccgagaaatccaaaagggagggaaaagaaagggggtggccggccggtcggtcggtcggcggcca

SEQ ID NO: 27907 - DNA, 1501 bp, Oryza sativa
taccaacagacatctgtcggtaaagataaacaattattgataggctatttgttggcaaaggcttttggcaaattatatgttgggaatactatgtaataagacatattatatgtcagcaattctaaatttttttggggtcaaaataactgtcagcaattttaagactagaaaccaattatatgtcaggaaaacttaatgataatccatctgtcagcaatacttcgtccgtcagatcttgattcaacggctaggatagagcgcggtgaaagctcaggcaggaaataaaaaaaaccgccgatattctgtgcgccaaaaaaaaaacacgccaaaaaaaaccctagctaggtcgccgcctcctctccccgcttccaccgcgcgccgccacctctcccccttccaccgcgcgccgcctcctccccccgcttccaccgcgcgccgccacctctcccccttccacgctcctccccatccactgggcgccgccacctcctccttggccaaatccgccgcgcgccgccacctcgctccccatccaccgcgccccgcttccccctgtgcctcggcgaaatcctcccaccttctccacaccttcatccaagtcggcggcggcggcgagttcaaagttcgaagctgcaaggtacgtggtagaaacgaaatcatattttcccgcaagatcatcatgatgattttctatgtgtgccatgcagcgcggtggttccctgagccagagaaggtgtgtttcgatttgggaagaagaaggccttgctgtccagtgagcaggtacctcaattaactctcgatctgattagctgtgtttctgaattcgatgtgattgcaacatgtacagcatttcctccctctcctattagctgcgatggcaataagttaatcccatgcattttttccccttggattgatgtggtgtagctagctagatgttttttttttggatattagcttctttggctaatctactcagtgtactggaaaacatctccgcagacatagcctggaaatatgacaaactaagttacataataaaattaaaataatgcaacataccaagttgtttcacacttcagagttatgcactttgtttttttcactgccacactgtgagtattctgaaataaatccaaaattagtatgtttaacctttaaaaaatttagatcaacaagatttttatcagattagtacctatatattctcccattattctataatctgagtacataaaaatcatactatttatacttggtaagctgcaatgtagtgtatattgtctctagctcagttgcttctggaaaaaatacactgcaagattactcaagagaaagggaccaatatcatgtcttaatttgtgtatttagaaactggacttgtatataggctagaaaaaaaatcacagttgctcaactacgtttatgctactgtttgctgattctgtcaactaatatatcaactaatatatcaaaagattactgtggactcaagttggac

SEQ ID NO: 27908 - DNA, 826 bp, Oryza sativa
ggggggagaggagagcgcgacggggaaaaggggaggctcttcgcttttctctcccccccttctgcgctgcgctgccactgcacgcagtgcaccagcctagctagctcaaggccgcagcagctaatcctatccacgctctcgatcacgcgccacgccagcctttcgcacggcgcgcgccgccgctgtcgacgacgacggcgaaggcaatgcgcgcgggccggtgaaaagcaagaaagtggccggacggacggccaaaagagagatcaccggagttgttttttttttctccctctccccgtctttctctcccccggcctttccttcaaaagataaaggagaggcagcttgcaaggctggctcccggcccccggccccggcacggccgtctccttcctttccggccgtggagcctaccattttaccttgcgagccgcgccattggcggatgccatgatgctctcaattcctatccctctcgccaagcataccgcatggtgatcatggccaggacataaatgtgcatgctagcctgcgagctagtagacgggaggagctcgtcgtgatcatcaatggcgtatcacgaattcgatcgcaatgaatgcaacggcctcgtttaataaaagcagaaaggtggatcgatgttgccacgaagtaaatggcatgagcagaaatgcacattgctgcaagcaagcaaagagagtagcaagacaacaagcagtagtgtagagtaaaagagaggacgaggcttcattgaattcacataggctaaattctaaaaagtccccggccattgctatagcttctgcaagctctgcgtcctaacaca

SEQ ID NO: 27909 - DNA, 1501 bp, Oryza sativa
aacctctttgggtcatctagtaagttatcctatttagaatatgtcaacgctaacacgatcacttcatggcaccacctatcacgacaatgtagaatttgatttgaagacaatcttttcattttccattttgcaaaaataaagcttttttttccaaaagtgtacacgtgacgtcctcgtaatgggtaactccaatatgtctcccttccttccatttggcgacattgggtacgtcatgtcgcggttttagtgagtgataacaactttgacaatgaagttggataagatggggttttttttactttgatgattcagtatattttttgtaaaaaatttcaccattggattatttattttataaaaaaatgaaggaaaatactttttttttaaaaaaagggaaaatcctgtgattactcgctattaccacaagaacacaaatcccatagtacattggtgttagccgaatacgaaacagatatcctaaattcttactgctccctccgtttctaaatatttgacgccgttgacttttttaaacatatttgaccgttcgccttattcaaaattttttatgaaatatgtaaaacaatatgtgtacataaaaatatatttaacaataaatcaaataataaaaaaattaataattatttaaattttttaaataagataaatgattaaatatgttaaaaaaatcaacgatgtcaaatacttagggaatgaacgagtactcattttctcctgtcgatagaactagtgaccactccacaagtgacggtggcccaccggccggacattcaccggcgcgtgtttgggtccaggaaagggagaaaagctctcgcgcctctcatttttggcgcgggagctgctgctgaatccgaatccgatcgaattgtgtgcgagtcgcatgggaccccatagccaaactgtacaaactatcgggtaatgtctgatttgtcttatcattgttactactacaatatagctagcacacagtgtgtgagagctatagagtggaaacagttacgagctagcaggccctcacttttactatgtgcgttgaagctaaacaggtattttatctgatctgccttggaaaaaaaagggattgtgtctgcctgtctggtctctgttcatacttgcaaaattgcaagctggtcaatatctcacattctatccatgcaataatctgtgtagaagtaggaattgccatcatctggtccataaattcatcccacacgaataagttattatattcttttgcctaaaaaaagtgaagttcaaaggataatctaattattttttttagataatagaatgaaagaatcccggcctttgctcaaaagagctgcagccaattattagagtctagcactctcgaagagtgacattcaaaataatctaattaataaaagagtgaagacatagacattcaaggtttaaaagatatggattccaagtttcagcgtggatggtgagtattcgctagggtttacaaaacatgtac

SEQ ID NO: 27910 - DNA, 1501 bp, Oryza sativa
gtgtagcgagatccttcaattctccagtggcggctcgtctcacacatatctggccatatatatactcattgaaatgagaaattcaaacaaattaacgccgttgataaggcctcatttcaacaagtgacattgaacacgctaatttatctacaaaatgacattataatccagtatttctttccctaaacgcccaacaataatactacccgttagcgttgtagagtagtactccatccgttaagtcgttttgactttggtcaaaatcaaagctgcttcaagtttaatcaacaaaagtaatacgtaacatttttaactcaaagacaaatttattatagaaatatattcaattattaattttgacgaaactaatttggtatcataaatattactatatttgtctataaatttaaagtagtttgacttggcatgtaatccctccgtccctaaatatttgatgctgttgacttttttcttattcaaaaacttttatgaaatatgtaaaactatattatacataaaagtatatttaataatgaatgaaatgataggaaaagaatagataattgctgttggggggatggctccggatgacggagccaccctccgtcagtaggaagactcagctcgaagccatccaccacgagagaatgatcgaaggctgtagctaccatgatggttgactccgataaggggcttcagaatcaattaggagctcacgaatcatctcggagccgaccacgggtaccggagtgggccaacgactccggagcgagtcacgggcccgcagctaaccaatggcttcggagccaatcaaaggctccggagtgcccggggaactagagtgctcatcaagcatggaggaatggtccacgggtgtagaggggcgccattaatacgcactacgcatctgtcaaccacctctgacatcctgacagtggcaagaggcatccgctattatccggaagcatgcctttgcccaaataatagcccacaccctcggaaagcgtcaccacctccttaatggctagggattttaccagtagccctacgactggctcactggccagtcactccacatctgtttttagctagggtaaagatgtaacttccccttgtaccccttatatataaggaaaaagtacgaattaccccctgaactattgggtgagtacgaattaccccataaacccgaaaaccggatatttttcaccctcaactatcaataccggatgaaaaacccccctagcagctttgcaagcggttttggtatacgtggcagtctagtcagcaattcttttttttttaaatcagcggggcccacttgtcagtctccaaaactactatcccatagactagcgtggcactggcacaactggcgagcgacgggtacagcctgtcgactgatgaaccgctggcggaggagcacacggaggcgacgaagcggccactcgacgacggcgtggtcgagatcatcaacctcacggacgcgtccctcccgtcg

SEQ ID NO: 27911 - DNA, 1501 bp, Oryza sativa
agaggatgcgaccgtcaagccagggaggcgggcgtcatcgcggcgccggcttgcaccctttcttgctccctcaccgccgcggccactaccgccttccatctctgccacggagtggggatgagaagtggcggttgggagtgtgctctccatctcccctgacgccttcctccgcaccattgttgtctctgtcgtcggaatcgtcctgcctgctgcattgcgctgcacgatgccttgtgcactccccaaccacccgtccatgcctgcaccccttgccgtccaccgagaaacacatggggagagagagtggggtagagaagaaaggagagaaagactatggagtatgacaggtggaccctactttatttttttttattttatttgatgactaggatgtcacgtggatgccaagttagcaaatactactatcaatactagcttaggagttaaattagaccggttttcacggttaaggagtcaacatatttggtattgcgagggagggtcatgaattagatttggtccactttaagggagccaaagtggacttactccttttcttaatgacagaagtggattaagattgatgttgggccgtgacctgatgctgcttagagaaatgtcagtccaacgttgcttagcgtattacaagaggccaacaatatgttctacaaagtgttgaagaacctcgtacctcatgtttccgttaatcttcttctgatgtatgttcccgctccctcggttcttaaatgaatgacgctgcttactaattgtttttggtgcaaataaaaaataatgttttaattgcctttataataaaacaaatcactacaaaataaatgataattatgcagtcttttaaataaaaagaatggttaaacgccatatctaaaattcaataacatcacacaattaaaaaaacagaggcaatactttgcagctaagaaaattcaagttgtcgtttgccatatgacttacaagctctcgctgaaataaaattttgaaaattaattttgaagttgactttgatgttttttccaacacagattcttttaagtcgttaagaacacgtatgtaaatatttgtcccacaaattatatttttatcactaataaaccactacaggcaaccgatggagccctcagatttagcgcagaagcacacacgatttagaagtacggttagcctgactagtattttttaatttgttttccatcctctcctcggttagctgatcactaacgcgagatctgatgccatcctcttctcggttagctgatcactcaccaaccttagatctgatgcagattagcatttaaaaaatccaagaacgaggagttagtcggccaatcggaatcttcgaaacgagaaatcctaaacttcattaaatttattcagccacagccatttttagtcgtactctgatgagtgtgttcgttgtgttcagttgcagtttgcaaacttgcagtatcatcttcacttgtaagaactgaaaagatatcaa

SEQ ID NO: 27912 - DNA, 1501 bp, Oryza sativa
cgccgaggcgtgcgcgcgcgcggcgccgaagacgagcgcctagtgggccggcctggtttgctccatacgtatgcgtgtagtagttgagttgggctttatggctatatttatgtgggcccagataggtgggccatggtggtgctgtgtaaaaatctggaaatgttttgtgggcccagagagttgggccatgctgttttgggaaagatggccgaaactatttagaggaggctttcgcttgcaatgtttaagatctctctttgaactcgagaaaaaaaaaaaaccctgtcgagtcattgtttatttttgggagtatctggaaaaattgtcataagttcttgagtcaaaaactttcaaatataattataatataattaaaatgtaactatattgtaattacattataactacactataactatgatttaacttataaaaaacttgcattgaattacggtttagttagctagcaataagatcttacgcatgatgcgtgtgaaaattttttgtagcaattttatccttcacacacaaatcttaaggtgatccgatgatcacaaatctcaaggttttgtgggaataaaacgtacgaaagttttctagcaaatcactttcttaacgtgctttcactaatgaccacagtactacagttggtaaaatgcataatacttaagaatctccttcgtcgaaacagattattcatcggattatcgacacggatcatttggaagctaacaaagccctcatcaaatcagcttagctgtgaactcgaccaatatatcaacatccggcatgacgtccacgacggccgggtgcccgcagaagcgatccgcccaggcagccaggttggggaccttcgcgccgccgaggagctcgacgccggcgatcctctccaccgccctgatccatccgaggtgcgatccgagggcgatgtccaggtagccgatgctgtcgtcgccgaagtattgcttccctttgctgcactcgacgaatgcctcctctaaatacagcagagcggttgtcatttcgtcggacgcttcgtccttgtctccggggacggttcctctcaatatccgaatccttggaggaaactgcatcgaagcaagagtggaaacctggaaattattcgagatacaaggagaagaaaaagtttgaataaattcagtttgagaactcttgttttcttaccggtcgtaaccaaaatttgatttttggtaattgactttagagttgatttcgagggtttttcatcgtagttttgttttttacatttacttttaaataacggataataaatacaatataagaaactagcatggtagcgtcattatattttctctcatataatagcatatatgttttctcattatattattcaaatatattaaaatgacaacataattttaaattttgcaataactttacaaaactactaatgtgtaatattcatattgtattttatatacatgttagttattaattatttttaatatcaaattttagt

SEQ ID NO: 27913 - DNA, 1501 bp, Oryza sativa
tttggaggcaattcaatatcagtaaaggtatgtacttaaaactaaaaatgagaacaaatagaattcaacatcacaagagccaacgcttcaaataaaaaaaaggagccatcataatcgtaggataaaattaaaaaaaatagtacaacaaccaacgtttaaatcaatctattttttaagagagagagagagcgcttcaatatcacagaaaaaacaatattcaaatcgaactccttttaatagagagccatcataagttcataaccatgggataaaatgataataagtgattttcttcaattttaaatccttttaaaacatatcatcctcccactgccatcctagctagtaaccgcaaagcatcaacattaaatattctccaaaaataaatccaaaagaaacaaaattgtctccccctccatctccttccactccaaaatccccctcctctcaacttccgccttcggtagatctctcgcatcagagtatcctctcaaaaatagatggataatgctaaataaggtgatatttttccctatttaacgattgtaatgtgtaaaatgggaacgaacaccgaataaggatggtaatcagtagaaaatatatatccaatcatttcaaaacgtattcctcagcacattaaacgattatatctccaaaatatgcttatcacttggtgttccacctgtcacgttaaacatcaacaatagctagaatatcaaactcattttaagagaaataaaacttgatgttccacatggcgcattaaacttaggcaacgactagaattgacaacggttaaaaacacatggacaacagctagaattaacaacggctagaaataggagcactgaaatatttattctagtacattaaatcggcacaagatatgattacgtgtgttattcattttgtgtatttttttagtactcacatatactgaaatacattcactttttcgataattattatttggaagccaagaatgagaggaaaattattttttgtaccacaaaaatcacgttgaagtcgaactttttttttaagacaaagccattacaaaccatagaatagaatgataaatcagccgatcctttcaaatttaaaccagcaaatccttttaaatttgacaaatggtaaaaaaaaataaaaataaaagagtgtatgcgggcccagctgtcatcctcacccctgccagccaaactagtaaccgcaggcacccgcattaaacatcctcgaaaaataaatccaaaagaaaaagaaaaatataaaccggctcccctccatctcctttcactccacacttcccccctcctcctcctcctcctccttcggtagatctctcgcggcagcgcagcctccacctcctcctccttctccggccacggcggccggcattagaagcagcggtgggggtcccggggcgaagagcggcttgcggtggcggtggcggcggcggttgggtaggtgcggcggccggcctcggctgcggcggcggcggcga

SEQ ID NO: 27914 - DNA, 1501 bp, Oryza sativa
  unsure (1)..(1501): unsure at all n locations
aggattacaaatggaattattctaagactgtaccagatcagctgaatataattgtagtaacactaggtatgaaaacggttggaaataatcggaaacggtacattattttattactttttntgaaatgaacgaaaacggtcaggaaatttccatatttatgaattcatctatttagtgtcaacttcaataccacgctgacagaaatttaaaaaactaaaatttaaaaacggtaaccatattattatattagttttgtggaaacggcatcggtacgatcggaaaatttcgatacttttttaacactgagcttaagcagccgaaagtgtgtgtggggcgacacgagcctccatgccggtggtgccggtggtagctacctcccgtcgcacacgcacgcacggccggctggacggacgattggcaattgccaagtgcccccacatgcgtgatgggtggcatcgagggggagcatatttcgaaaccaacgagggagcagcagcagcaaaagcgatagagagtttcacctctccgcgtgccgcgtgccacgggccagcaggtgtcggcgtctccacgagcagatcaacatcgccgtagggagatgagacgagccaaagcccaaccaggagaggaggccgtgccgacatcacacgtcgcccgcgacgccagctagctaggagcgcgcgcccgcgcgcatcggcggccgttgcagcggatgtcgtcgcgcggcggcctcgcgtcgtcctacgtacggcacgcgcacacgcgcgcggccgcgcgcgtcgcgtgctccggtggagcgcgacgacccggtttcgtcacgttcgatctttggccgccgcgcgccgatcgatgggcgcgcgcgcgggcggcgtggtcggtcggtcggtgggtgcgtccgtgcgtggtttgttgccgccgacgcttgtacaaagggtaacgtgatgttgaaatctggtgagccgcggaacgctactatggctctgggagcttaatattattcggagaaacaactggggaaaattcatagtagcgggattttacgatagcatttctcagaatctaagtgaaaatctgaattgtttataggagtttctgccagctggagattttataagaagctgttgctgctataagctctctaaacagacactaagtacctccgttgggatggatgtagtacatgtctagtaatacatcagcatcaaggggataagagaagtagaaaaccaaaacgtttcacttggcgaagaacttatgtggtggacatgtagttcgacatttttactagtagtatatacgataccaacaataataattgtgaccgcaggaagtagtaacatactctctgtttcttaggtacgcggtgttattgacttttgaacatgtattcagctatttgttcattaaagtagcatgcaagtattatttattttactgtgactttgtttcatgacttatgacactttaagtttggcttataatagtgtgatgtttcaaaattatc

SEQ ID NO: 27915 - DNA, 886 bp, Oryza sativa
attgttcactattattaagatcaattaatattaattagttcatcactcgtctttaccgttctgttccctcttaactaatcatcgcagtaatcatatctcacggattcgctgttcaatcgatccatcgatttgggggagaaacgatcaaacgaagaattaatcgaacgcgaaagtggggagaaagaaaaggggggagcgaaatgtcgacacctcgcattaactaggttagttagcgcacactcacacggagggagtacttaacggcaaagcaagagagaatatgctcgcccgctttgctccccagccgagccgagaccaccgcgcgagaaaacgacagctccgttcttgcaacagtccaagattaatggtaaacttgtcaaagttataaaaacgataatcgaaacgctgtggataatacagaaattaaattgtattggatgggacatgctggatacaagtgtctagattcatggtattggaaaacgtattatccaattctttctccgacttaaaatattatggtacgaaacgttataaaatataagaacccataatcagattagactttttctatttagattcataatgctagaaaacatttaatccggttccatattcttatattttgatatgggtggaataaaagattggttttactatttagatggaaggagtataattggggatggaagtcttcggtgtgtttaattcatgttaaaattgaaaatttaattgaaattagaatgatgtgacggaaaaattgaaagtttgtgtgtataaaagttttgatgtgataaaaaagttagaagtttgaagaaaaaaattgagaactaaaagtctcagcgaatattcgccgcggtggtgaaggaaaaggtaaaaggagaga

SEQ ID NO: 27916 - DNA, 1501 bp, Oryza sativa
cctcccctcgcgcgtattttccttttttcctgcgttttttcccgattaaaaaatcgttaacacacgtgttttcgaatctcgatatgaaagttttccaatctgaagaaagtttcaaatctagagttgaaagttttcaaattttgacttgaaagttttcaaacctgagttgaaagtttcaaatttgagttaaaagtttttcaaatttgagataaaaagttgaaagttttcaaactttaacttaaaagaattcaaatttcgagtgagagttttcaaagttagagttgaaagtttttaaaatttaatttcaaagtttaaattttgagttgaaattttcaaaatttcagtttagagtttcaagttgtaagttgatattcttaaaatttaggtatggcttttttaagaaaaaaaatagaaagtttttttcacgtatagatttcttctaagtttcaacctttagggaaaaaaaaggaaaatcttaccttaatttctattattatgtaaaacatcatcagccctttagtacagattaaaggcccattcctgtttgtgggccatgaaattagtacataatccccatccggaataagttcactttgagttccttaaaagtgaccagaatctaatccatgaccctaaaccgtaataccggatatctcgacccctcaactattaaaatcggtacaatttgactccctcggcagttttggatggtggtttcctaacatggcgtctacgtggcagtattgactaggtcttcgtcctatgtggcgttgacgtggcgcttaagtggcattagaattaaaaatatatatgcgggcccatttgtcattcacaaaaagaaattgtgggcccactgacatgtggggcccacataaatccctattcctcctccctctcttccttctttctctttctctccctttctcatcggttcttccccttcggccggcggcgggcggtgagggccgaagctgcgctgggtgacgagagcgagcagctggcgggcggcgacgaatggctcgactgcgctggcgtgcacgggaggcggcagagagcagcgggccagctgcaagccgacagtgacgccggcaagcaagcaggcaagtctgcaatttcattatcaccagcagatagatgctactgtagctttgatggggttactagctcagctcgggttcgagctcgtagaatgaattgacgagcacgtcgtcggcgagctccagcctgtcgaactgcttcatcaccaagtcgaagtacgccgggtacgggccggggccgaccttaatgaaccacggcaagccctccagctccagcgccggcaagccgatcagcgcgatggcgccggcctccacggggatgtgtacacggccgcaccacgcgtggccgtacaccacgttgacggcgcacgactgcgtgaagaacgtgaacgccaccgccgctgcggcgcgccacggcgcgcgccaagaggaggaacgcgtcgtagaggaggacgcacacgggg

SEQ ID NO: 27917 - DNA, 1501 bp, Oryza sativa
gctagaaacacaaagggcttgtgcttttgcaccgggctaaatttattttagtcgggcaccgtcccaagtttccaagaaaaggagccgaaggtccttttccgttcgtgagtgccgtcatccatccacatcgcttttgttccttccctatccatgcggctatcccatcgtcgtttgctttgatttgatgcttgtttcgtggcagcttaccactggaacggaaaaaaacccgcaaagtttagggggcgtgccaatggtgcggggactaacagaagaaattaatcaatgtatagttgattttttagaacaaatcaatgtatagttgtgtactagtgtcactcacgccacccgtctcatatccattcgcatggttgaacttttagggcgtcacggcgtggaacaagcaaaagcacagcactgtatcttggatagtaccaagagctagatggatcgatcgatcagtgagcttaaactgtggtcaactctgcagtggattggagtattctattaaccggtaagagacggcaagccatgcccattcccaaattagactctgtctgagattcctgcgaccaaacaacccacacaccaccacacagatcacaacagcaagttgttttgttttttttttcgtcagaaacagtagaccgaattaagcaacgtgaacgagacgagagcgagacggcgtcaccgccacacatgtagcgtgctgcgtgcgcgccgcatcaacaccaccggaaaacagcaggctccccccggccagtggatcggagtaggagtagtagtacgcgaccacgcgcgcacctgggtgatcgcctggctaagcccacggtttccccgcctccgcccgcggcacggtgaataatctccagcctccgggcgcgccgcaccacgcaaaaacgcaacgcaacgcgcgatttgttatatatatccacccgcgaagtccaacgcctcgatcgatcggttgataaggggaggagaaaaaatacagtagtggagcgagctagctagcgcgcacggggtttcaccctcttctctgtactgcacgacgactggatcgtggtggtggtggtggtgcagcttttgcttgcgtgcgagggggcgtgtcgcgtgctggcccagcttatatagagttgagaacttgagatagatagatggccgtggcgttcccgcctcacatcatggtgctgagcaagatgcagcggctgtacgacgcgtgcgacatgatcttctcttcgccggcgtccgcggcgccgaccatcggggagatcaggtggcttcaacacctccttggtacgtacgttcgtgagttcttcccggcgcatggagtgaagagcgaatccataatatgtgatggcttatgtggtgtgatggtggatctcttgtgtagatggcatggaggcggcggacgtcgggatcgatgacggcgagtcaccgccgtcgtcgtcgtcgtcttcgtgttcgtcgtcggacgacgaggtgagctcgaaggacggccggctcc

SEQ ID NO: 27918 - DNA, 1052 bp, Oryza sativa
agcacacaatcagcttacaaacaatcacttgtcaaactgaaaacttggtaaaaatgttgccaaggatcaatagttggctggttccaggaaatttgagacaattgctcactgcacaaaagcattgcctagattattgcattttacaactgaaaactgaaggaaacttctttcttctctacaggctttgggaggaagtctgagaggatggtggttcagatacagagtgaatgagcagacatgtacaagatgatggctttttgcaggagcaacaaatgttgatctctgaaccattgtatattgctgatgtaaccatttggtcaaggagtcctggtgtggcagctcacatttatttttatagctcaagtgaatcatgacatagtttcatctttttctttttttattgtcaaatttcactactatgactgtatttagttgtctctgtattgtcaagtgacctcaagctttgttgggtgatgcctccttgccttaaaccggatacaggccttgatgatactgcaatatttttgttttaatgattaatcaatgtggttttcgcgtaattgatgaggttactgcaatatttttttactgaagtgtaatttcattcatgttgcacttttcacttatacaaaaatatcggtttgcaatatttttttgctattctaaactacctacctgaaaacaattttgctattctaaactcaatggacagcgtgcaacgttgaagcaggaaagcaccaatccttctattgttgccgttgtctattgctgccttgacgcgggatttaagcaggcgcaccaagtcaaaaccgaacaaacgttttgaagacagggattaggaaaatcaagggaattcatcccacagagattaagtgacatgggaaggatccacttaattcctccctggataggttccccttgggggtttaattccaaggaaccgaacatagccttaagatatacatgtacttcccacaggctagcatgtgctccaggctaaatctaaagtgtagcttaacctaatcaatataccacggcaagggtggacgtga

SEQ ID NO: 27919 - DNA, 1134 bp, Oryza sativa
cgtcttataacctaaaacagatatttgaatatttcatcactacaaataccaattttcattatggtctgggagtttttttttataagaagttcctatttggtacgaacacaatttagtttctacacagtcccagaattatatatatatatatatactccatgatggagtttacataattacagtacgtactagtagtataaccaacgtaatggcaatctatatctggaatttcttttagctacaactcctcctactactaaatagtactccctccatcccaaaatatttgacgcattttactttttttaaaaatgtttgaccgtttgtcttattaaaaaaaattaagtaattattaattcttttaatatcatttgatttattgttaaatatacttttatgtatacatatagtttttcacatttcacaaaagtttttgaataagacgaacagttaaacatgtttaaaaaagtcaacggcgtcgaacatttagggtgtgtttggttggagggatatccctagatgggatatgacgacccagtttttgagtgtgtttggttggtgggcgagggaggatagggcggcccggagagggaataatccacgaagatgttggatgagtgtatccggacaaattggccagatgaggatatccaccttagctaatcttgatcattagttcttgattagcaataattaaattatattgttgttaattagtaattaacttgtcaaaattagtgctaattagatataattactctattttattgttaatttgtataaactatagctatattaatgataattaacatattttattaataattaatatgttgttgttttcattcaatccattctcattcacccaaccaaacaagaaactggatggccatatccatctaaccaaacaaaaaaactgaaccaccatatcccttaaaatatagatgacaatatcctatctagccttgaccaggaaccaaacacacacccgcgggaaggagggaggagtagtatctcttggtgtaataggattacagtatttgcgtaaatttcgtttcagcacctggtgatctggaggggtcacgagtgatatagacggagctcatgattagtcacttcatgtctcggcttagc

SEQ ID NO: 27920 - DNA, 1501 bp, Oryza sativa
ttgacgtcgttgtctctcgtggcccatttttgtagtaagagggggataactagtactttaatagaatatggcgtcaacgaagcagataccaaccaaaacaagttcaaaatgttgtgcaatcaaggattgcagcgccaaccatggtgatacatatccttgcaacacgaacacgtgaactttgcaaaaatgaagttggatacgatttgactgttttgaaaagggcattaattaagcatgaggtagatcaagattgaagtggaaagaacttgggtatcgcggtcactttgtggttagaaatcgacataatatactttgactaaatgaactgaaatccacctctttaatcacgtatgttgcaacgcctttatgttgttggaagtgaaaaaggatggtgggtaatatatgagaacaatattagtgaggagctcgactatccttatgtggtagaaaggaatgacaccgacctaacaaacacaaccgaatgatatggataagaggatgtgacgaaggcaccatgctttaggctgataaaattaatggggcatagcagtgaaggtggtggggggtggaggaggctaagtaggggttgcataagaggccatatgtgctggtgatgctgagggaggtgttgcacggatggatcggtagggcaaagttgggttgcttgcacaaaaactatcataatttggaccatccgtccattgacacttctaccggttataatcttttggaaaaagtacgaattacccccccctcccgaactatcgaggtcagccgaattacacccccgaactcaaaaaccagacattctataccctcaactattgaaaccggacaaataacccccctgactcaatccagagtgattttgagtccacgtggcagcccagtcagcattttttagaaaaaatattagtgggccccacctgtcagttctccacccctctctatctctctctactctatcccaatctctccccctctcttgtaaaatcaaaggtgtttttgattattattctgtgatgaacaattggcattggagattattggttttgatatttggaatttattcacgaagtggttttggagatgactggatttacaggtgaatcacaggtactgttatttcatgtgaccgatcagaccgggcaggtgttgccggtcagaccggcggtgatcgagtggtcggaccagccagcccgcggtctgaccggccgacactgtgtcggtttcggtttcgggttgtttgtttggatatccgtgtttatttcatgattatggcttctagatagatactatatgtatgtaatactgttgtttgctactaatgagtcaagttggagatagcttggtctcggaatatggtttctttgtttatttcatgcgtaggcgactcgatgtctcgggagagtatttgcagtgatggaccgggagtcggcttggggataagacgacatctgtagtggtcagagatcatgcgggatacttaggctagagttga

SEQ ID NO: 27921 - DNA, 1501 bp, Oryza sativa
tgtcacccggcctgatgcatcacgcgaacgatgtcaagcgccgtcttctcgttgatgctgttgctctgctgcatctccatgtagtccctgtacctgatcccccggaactccaggccccggccgtccgccgccatctccggcagcggctcgacgacggtgtccatgcacggcccgatcaggctcacgaacgacatcctcgactgctcgccgccgaccaccgcgcggtggagcacgcccttgtaccttccgttggtcacaatctgcacgcatgttcacaccaacacaagtgcatactgagctgaatctcgcacactattctaaattctcgataagatatcccctctgtttacatgctatccaaatggttataatttttttaaaaaaaattaataacatagattaatatcaatacaccactccgtaaacatacaaggttaaatttaacatgttataatgaacaaacaaatttgaaagcgaatataagtttaatttttttgactcgtagaagttgaattttagtttgtatgtttgtggagtaatatattatatcatatattaattcatctttttatatatattttttataactatttagatgatatgtaaataacataaagatcattatctaaaaaaataacataaagatatcccttcaagagtttaaaatccatttcacagtttcataaacttctcaagaacacgcatagtgattgttgatccaatacctccaactgatcgccggcgatgacgaagaaggagcccgggaggggcttcgcgaggagccattcgccatcgtgcttgacctggaggccatcgacgccgttctggaagagcagggtgaggaggccatggtcggagtgagccgataatcccatcgcctgctcgtccggtctagagcacgcagggtaatggttccccaccaagatctggaagcaggactcgaggttgagcgcttcagagaggcggccgccggcgaggcccaggctctcggagatcgccttggtgagctccagcaacagggctctcgtgcaggtcgcgtactccgttgcaatctccctgacattgttgacacatcacaaatctttctttagaggaaggaaaccacaagaaaatcttcacattacaccggtcgatgatgtcaatggcgaagaatttttacgattggtaataatgatcatggatgtacctcagctttgcgggcttttcggggcagtggaattcaggatgagagaacatcttcaggtagtccctcctgcatggtacggcgtcgacgacagagtagaaacctgtaccgatccgtataggatccatcggcttggcacgcatgtactctttcttctcctccaaaggtaatctgaacagctccttgcaggcgtccatgattgcttctcggagagcctcgggcaccccatggttagtcaccttaattcattcatgaaagattcagatgagacgatctagcaatcaatcatgtcactgacgaattggagttgttactgat

SEQ ID NO: 27922 - DNA, 1501 bp, Oryza sativa
agacgggtggcgtgagtgacactagtacacaactatacattgatttgttctaaaaaatcaactatacattgattaatttcttctgttagtccccgcaccattggcacgccccctaaactttgcgggtttttttccgttccagtggtaagctgccacgaaacaagcatcaaatcaaagcaaacgacgatgggatagccgcatggatagggaaggaacaaaagcgatgtggatggatgacggcactcacgaacggaaaaggaccttcggctccttttcttggaaacttgggacggtgcccgactaaaataaatttagcccggtgcaaaagcacaagccctttgtgtttctagctttgtcatcttgcttggattcgagagacgttcacactgtcttgactgtccggttcaggggtcgttctaggatcacgtctctccctagtttcattaccggtgttttgttgctttttttttttgctgcaacgtttgtgaggcgtgtaaaagtaatctataaacaatataatatttcattcaatcatctattatcattgtataaactagtccacatgaaaaaaaacaaaagttactcatatgtatatagacgactatgtgggataaataatattatctactctctccatcccaaaataagcgcagctatgagtttccgtgaccaactttaatcgttcgttttatttaatttttttgaaaaaataaaaaacataagtcacacataaagtactattcatgtattataatctaataactataaaaatactaatcataatttttttcaaataaaacatacgattaaagttggacacggaaactcatagttgcgcttattttgggatggaggaagtatctctactcctctctcttatacattgcacagattgttactccctccgggctgataatacttatcgttttggataagggtgaggtcaaactttagaatatttgattatgaaccatttttaaaataattgtctttcaaatttggtgactacatgtatagattagtcttaaaaagtactttattaagatcatatatttgttaacatttttatacatattataatagaaaataatggtcaaagttgttttctggagaccgtgcccttgtccaaaatgataagtattatcaacccggagggagtataggaaaaatctatttatatgagccacatctatatggatcactttaatatatacattggtgatgccctcacatagagcattacaatcattaataataaaatgcttaacgagacaatttccaaatagccccaatctctaatgccatagttaggcctagacacttaaggcggacatagcaagggttgaaagaatgagttgtgatcgagcttgtgactatccttataaacctgacaataaaacattaaatgctaatgttcactataagctcgtggtttggtcacaacagaaaataaaataaaataatattgctgcccacaggagggagttagttcatcgatccc

SEQ ID NO: 27923 - DNA, 1501 bp, Oryza sativa
gatttttttttgattgagggagtccgccgggtcgccggccaatgccagcgaagaactcgattcccccacctgctgtccgttcataatcgatcaaaccgtgctccggcttttaattacagtcgatgagattttaattccgtttcaaatgtggtgcagacacttccatatgattttcgctgcgatttctaaggcaggaatcactttaccaagagaaactagaaaaaaaaaacccaaagaagtaattaattgttgtttaattaccagaaaacttactcggtcaaaactagtgaaaggttcagctaaacccactcatgcttcttttgaccagaccttggagataccgagcttagtagactaattaggttaaaaccatattaccctacatctttttattagcaaaatgttatgcaatatgtttgtatgatgttggattcgtgggccatacagcgtggttttaaatcctagtgcgtattgtgcataaacatgcatgtgtgtatccctatttgatgcagagaccgaaagtaattttttcattacctaagaatatgtggtaaaatcaatgaatgtgtttcattgcaggtctggaccaaatcgtagtcctggattacagtcacagaggaaacagaggtacagtggaagtgcatgtgtgctacagcgaggctcaattgctcaagtatggccagatgccatcgcccaatgggcttttggcccaacacatcgtatgcattttcaagcccaaaaatggacgcgtgctgcctcgctgcttgggcccaaatggtcttaggaccagataaaggaaaaagtgcacccaaggtccctcaacttatcatcgagatacaaaatcgtcccccaatcgcaaaaccagataccagacgtccctcaactagcaaaaccgttcgctttagatccctcggtggttttgaccccggttttgtctgacgtggcggccgagtcagcgtgggacccacgtggggccccacatgtcagactatccatgtcagcctcctctcccttccttctctcttcctctctcctacacacaccgagacgagtcgtcggctctgtcgacggcggcggcggtagcgtgtccgcgcgtcggcggcggcggcggtagcgcgtctgcccaggagcggctccgtcggcagcgacgactgttgcgcgtcagcagcagcggcggtagcgcgtccgcgcgtttgccctggagcggcttcgtcggcggcgaaggcggatgtagcgcgtcggtgcgtcttcgtcgtcgtcgccgccgccgccatcggcgacaacctcctggagccggcaccgtcgtcgcgggcaccatcgaagaagcggcaggagcggatgaggacggcggcggcgaaaaatcccacatgcgaagtaattaagatcgatcgacagccacatatttacaacagccaccacgcacatcatctcttcatcatgcatatatatacgcacgcatgcgaagtaactaagatcgattgatcgatcgaattaacaagga

SEQ ID NO: 27924 - DNA, 504 bp, Oryza sativa
  unsure (1)..(504): unsure at all n locations
tagaactgattatccaaaagatttattagcgataanatattatttataggaacaacttttataggtgtttttaacgacttaaaacatcaatgtgaaatttaactttaatttcaaattttaaattttggatacggctaaatgagctgaagcaatgcaactccgtcaagtaaagttaaaagaaagaaatcctaagggtgtgtttagtgctttgggtataaagtttttaagtatacggatacacatttgaagtattaaacgtagactaataataaaacaaattacagattccgcacgtaaactacaagacgaatttattaagcttaatcaatccatcattggcaaatatttactatagtaccatattatcaaatcatgacataattaggctcaaaagattcgtctcgcaaaagttccttaggttccttgtggtggaaccagcccatccaagttcaaatcctagatttgacacgggtgctcgcatttacggctaattattctttcagt

SEQ ID NO: 27925 - DNA, 1501 bp, Oryza sativa
atccattgtacatttcccgaatagttctatattaaccttcaaaaattacaagtacttctctctatgatgcacaacatgaaaacaatttccctaaaaaacagcatccaaatcataaattaagcaataaacttataattgaaactaaagaatcaaaatcaagcatgtgggcaaagggcttatagggcccattgctgcacacatattttgagaagacgtttgaagtgacaaggagtgatggagggcaccactgttttctatggaaagtacttgacatttaactttttctataatcttcgagattcaaatttctttatgattttatattagagttggtctataaaatcgaataaatttacgagattatgatagaacatctcaagacaaatcaactcatgccgttttcaaaatgtttctatgttttccgactatgtatctttagaaatcaacatattaaaagttcaaaagtttattagatcttgtccaaaatgcaagtatttatgattggatagtagaatattgcatcgttttcttgttggcttgtagcaaaatttgaattttgaaattaattttagagttgatttggaagttttttttctcatagtttattttggagcattggattttgaatcattgagaacacagatataaaagttttactcagattattttggttgtttcattcacgggttattagtctaatgacgagaggaataagaccaagttccattttgcgttctgtggatcttaacttgtagcaataaaaagtttatgcaattgtgaaacatgtaaattaataaccttgtactaatagcggaaaaagcgcctagactggtgtagattgaataaaagactacacaagcaatcggttgaatcaatcagttcagcacataattggacgaaaaccaaagttgttcgactgggtaaagatattttctattaggaataaagcctagtatgaagcagtattattgattttgaagtaaaataaatttacttaacccaatcctaaaaataaaataattctttttttgggatggtggtcgaaccagaaccagaaagtatcactgatggtcatccaaaggttcaaccacctgtcagagtttaataactatgcatgcctcctatctaacggtaaccgatagtagataagaaaaggttagacgagtcaataataataattaaaagcgccaaaaaatatgttcaatatataacatcaacctccttccaaactgggggacagcaacgcaaagatttactatttgctatcctcccgaaatacacatgcccaaatatcacttttccaaattttcatttgttagcgtagcggataagggaaacaagactgaattaacctgtcgcccctcctttcccgccatctcctcccctcatgcatgcatccaccactatttatccccctcctccccctcctctacaccttgtctccgcctcgcgggagaccacacattaattcctcgcgccccatccatccattcccctgcca

SEQ ID NO: 27926 - DNA, 810 bp, Oryza sativa
gtacttgtcttatgtttggatgaaattccaaggaatcggtccttaagtgcgagagcgggaaaaaccgtacacccggtacgttccccggtccgcggttttggaaattcctttagttcgcaagcgccgacccaggtgtcgggttttccaagtcttttgtaaaactccagttttacccaagttgttactcagattttaagtttgaaggtgaccgtcgatactcgcacagagtgcacgaatatcgaggcgcaactggatggttacaaggggacatggtatagcaattaacaatggaaggatcaaatgcaacaagttaggtaggtccgccaatctgccttgcagacgggacaacagattaagtgcgatcctatcgatgcataatattttgcaagcaacataattaaatttcaaatataggctcaagatgttcaaaggtggcttgccttgctcgagatctagagcttgatcctcgaaatcctcgcactgcgggtcttcgggctccgaaactacacgcgaaacggggcaactcaacaaacggtgaaaataaagccctattaatgacctctaagcatgccattagatagatctcgagatttgaggaattttggaagttgaacggagtcaaacggatttacggttgggaagatattgaatttctaagattattggatttttggtctaaaggaaaaggatttaattaaatcctttttggaaaagaaaagaaaagaaaagaaaagagggatggaaattagacttttcctcgggcggctagggcgcggcccgagagagatggggcggtccggccgagctaaa

SEQ ID NO: 27927 - DNA, 397 bp, Oryza sativa
ctgagtaataggacccatcccacatgatattgtaaaagaatgcaacatttaatagaaatgcgggatatttgtaaattgggtacaatatgatcaaacgtattgcatgacttgccttgctctcgcactgatgagatcacagcaacgtcttcgagaaactgcggatcgacgaaacggccgaaacctacgcgacaaacaaagcacacaagcaaaacatgctataagactatagaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataaagc

SEQ ID NO: 27928 - DNA, 162 bp, Oryza sativa
caaggaagagtggaggagataggtggcgggtgactagggtgggcgaagaccacacatgctgtagtgcggaagtaaccggcaaacatttgcaacttacttcaaggtttattggaaacaggttacaggcatttgtgcgagctgaaccaactttatctccagcag

SEQ ID NO: 27929 - DNA, 684 bp, Oryza sativa
gcatggatgaatctcaccctctctcaagtaatgaatttaagaattcatgtcattctttctcgcatcctcatgttgtaaaaaattaaaatgatataggtttgaacctaggtgactctagtactagttgctgatttggttttgctctaaagggagggtggttgtctcaaatttgaaaacttaggtgctttggcttctcttttggtaaaaaatcatggtggggtcttgtagtaactcagacttacttcatgaggaggatcgggaggatagttttttgcttaacctttcatgtggcgaccttgatggatgaggttatggatgaagaggacattcacctaagttgagatttcgataaagtcctaataaataattatcccaaaaaaaataggaaatgacctaaaaaaaatgagggagggtacggttttaaagtaggaagcaacaaaaggtttcaatgaaaggaattttttggaatagcagaggtcttaaagacttggctaaaatgagattcctttcggaaatttctaaaaagcaaaagctagactttatcgctcttctagaaacggggaaaaacaagtctgttgattcatggcttaaaaacatatgtggaggaagagattttttgtttcactgaacgaggccgaagggtagaattgggggatttttgcttcgagttaatttggagctttt

SEQ ID NO: 27930 - DNA, 1016 bp, Oryza sativa
aaagaaggatctagaactattctggataccaaaaattgcctctatttttggtactaaagtttaaactagtgtgaatcacgctagctactaattgagttcgttagtaatttattatgtttctgttggttagcaatcttccattctgttctcagattcttctctttttctttttttccatttgtggcgtgcaggaagagccgattatgctcgtatgctcacatatatctcatcgcgttttaagatttagagtcccctttactatcgtgataactcctgtattttatctattttttgtaatatagtagtaaggtttgtcctcgtttctttgatttagtaaaaaatataacataattcacgtagtgtgacatatataaaccatgtgttatgtacacacacccaaaaaaaaagtgctccctccgtttctaaatatttgacaccgttgattttttagcacatgtttaaccgttcgtcttattaaaaacttttatgaaatatgtaaaactatatgtatatatataagtacatttaaccatgaatcaaatgataggaaaagaattaatagtacttaattttttttaaataagacgaatgggcaaacatattttaaaaagttaacggctttaaatattttgaaacagagggagtaataatgattctaagtccaattagcgtacgaagtgtaacatacgtatacacctaggatgtgtttagttcagcgcaaagtttgaattttagttgaaattgaagataatatgactgaaaagttgtgtgtgtatgacagattgatgtgatggaaaatgactaaagtttggatctaaacacagcctagactaacacgtactggtagttaactatagcagctgccgctatcagcagcaggaaagtcatggtaggccacggtgacgcgcgaggtggccgtgttgctgcgcacacttgcgtgcgtggttgcacttgtttaatccgcgtggttggtcgatcggctcgtccgccgcgtcatcccacgaccccgtttaagg

SEQ ID NO: 27931 - DNA, 1501 bp, Oryza sativa
tttattttatttgtgacttactttattatccaaagtactttaaacacaaccttttgttttttatatttgcacaattttttttaataagacgagtggtcaaacagtgcaagcaaaatgtcaaaatctcttatattaaggaacgaagtgagtactggtagttagcttggacgccattgatgattgatctcttgtgctgttgaagcgttgaactgctgaagcatccgtccatttcatatccatctgccacacacacagtgctgatgatgtgaccatctaccaaatgagtatacatatataaacgtaagatggtcataaacactccaattattttgtgtgttcttgtgatgtgagcaccccattgttcggcacatgtattgttggctgttgagcattgtcaatataggatatgcaattaagcagacaaacatgttaatttcaggtcactcgataactgaaacttgggtgtgataactgaactaaccgcagtcatatgcctcgatcttacaacagaacatgacagaaaacccaattttcagattctactagtgtacacttctccctgtcacattttggtagcatgtcatataatgcaaaaagaaatggagcaatgaatagtgagttcatcaatgttgccatgaacacatgcttcacatggacgctatggtgctctctaccacacccccatcacgcagaggttgagccgtacagtaatggaggtcgccatcgggatcgctgccgtccatgtcaacgctcggttttccttaccgagatcacgtctctcctaaaaacaaatcaagaggggacagttcttctttcacctgtgtatttaattgcgtggttcaagattttgtaacagaggttttcctcctttttgtttcaccgatgggatcttcttcttccaccagataggtgatcgcctgtgaggagatgtcgtcggcgacggacggcgcggcgtcgaggctcggcgtcgccggggctctggggatgtcggtcacgtcgtcggtggctattgtcatctgcaataagtaccttatcagcaccctgggcttcttcttcggtcagtgaaaatttctttttttactttcagagagtttcagatactgtactccgtccgacaaattttttgtcaagtagttttactggttgtaattttgtaaattgtaatgtctggtctctggtgtgtagagatgtttctgaatgtcattttgtgttttggaaatgtggaaaatgcagcgacgacgctgacgagctggcacctgatggtgaccttctgcacgctgtacgtcgcgcagcggctgcggttcttcgaggcgaagccgatcgatgcgcagaccgtcatctccttcgggctgctcaatggtatctccattggcctcctcaacctttgccttggattcaactcagttggcttctaccaggcaagcaccattcactttgctgaccccaatcactgcattttggttttctcacttctgaaatcatgggtgtttttctctgcaga

SEQ ID NO: 27932 - DNA, 1501 bp, Oryza sativa
acacgactgcacgagcggcgccaacgaaaacaacgggcgcccgcctctccgcttattcgctgcaccacatagttaggatctacggagtatttggcatagctcagctccggctcggcgaaacagttcagctttaataaattagaggtagagctatggacccaactccattctagacggagttggagtaccaaacagatccgtagttttctgttttaaaatacaacaacatctgacaatgtgtatatatatactaccactatttcttttagagataatcccttatatgccactaaaaattggtctgatcccttatatgccattgaaaattagctattcccttttatgtcattggtctaattttgcgctcactttcatgccactcccgtcagttgactgtaggttgactgctaaatccaaagtaaaaaagacgtatttacccttctgagttgttaggcatgtcctatgctcagaagggcaaatatgtcttttttactttagatttaacggtcaacacacagtcaactgatggtagtggcatgagagagtgcgcaaatttggaccaatggcatatagggaaagagccaattttcaatggcatataaggaatcagaccaattttcagtggcatataaggaattctctctttttttatgattttatgtttgatcatttgtttaaaaaattatataaatattatttatgttgttgtgacttgttttatcataaaaagctataatattaacatatattttgacatacatatttacgctgaatttctaaataaaatgaaagattaaatgttatgaaagaaatcaacggtgtcattagaaaaacagaggtacttccttcgttcaaaattaatatagcaaaatttaagaatggatgagatacaccttaatagtacaacaatatctactgttgtattatgatatactccctccgtcccaacatccccttctagattgaggtttttttttttgggacggagggagtcccgttttatgttcttatgaagtgtagtatatattttaagacagctatagcacgtcaataccatcctgacaacgccgatcgaaacatcaaaactcggacgcgcgttggcagagcctggttggttggtgatttgggcatttggccgggcaagcagcgcgcatacttcctccgttaaaaaaaactcaatctcatattaggatgggacacattacacattctagtacaacgaatatggacataggatgtgtcttatccttttttttttgaaatttaggatgtgtcttatcctaatacgaggttaagttttttttttaacggagggagtaggttggaggttggaggcagaaggccggctggcacgtccgtttctgtttgggactttggacgccattttggcagtggtggtggtagcgcccgtgccagtgccgcaacgcaatctcgtttaccttctggcttcgtacaggtgcggcggcctaactcccaccatccaccacacgtaacacgcagt

SEQ ID NO: 27933 - DNA, 1501 bp, Oryza sativa
  unsure (1)..(1501): unsure at all n locations
tcatagtcctttcgtctgaagaacacacgttacgaattgttcgtagactttgtacggcaacggcgtgccgtcacgtgcccggacacgattggggagcgaaggtttttgctaagctgctgctaaaatataggtgtcgttgtgaactaacggcagttgaggtgaggcaatcgatcggcgcctttcgttttggtgaatgattgatcaattgatgtgtccacctcctcacacgagaggttaatccaaaccatgtaatccaaaataggagtatatagaaagctctaactttaagcttataaaaccatttctacctcctcgtaggagtattgaaaaaaaaaagtagagcaacaatggcatttttatctctacccattgtcaagtgctggacaagcttcgcacttgacaagcttcggcactatgagatattggtaatgtagtgttgatagcttgtacatggattagtactaataagggataaatatatttataataccaaaaaaaatagtaggggaaaatttgagcggatgtttggtttgcacatgtagaaattttatgggtattagcttacctagtggattttcctgcataattttatctggagctagatctgagatgatgtggtgttagtactatacaactgttagcttgcatatccacaatttcattttgtgtataactattgattacacggttaaaatgttgtacttcttttgtcccataaaaccaattcctggagtcatggagatgaatccggatataatgtatgtctatatttattctcatgacaggatttttttagatagaggaagtagatattttttttctatttctgtgatttacgttgtataatttctaaccttcaaagaatatagcagtttcttttaaaactacctgaacaataaatacaataacaatgatagataagataggataggtagatagatagatagatagaaatgaaggagattacgcagaattcatgtaaaattaatccctccattaaaagtaaaaaagagctaagcttatctccctctacttacaagtaggcccataatttaggtggtgtttggatctagtgacttaactttagtatatgtatttagacactaatttagagtattaaatatagactacttacattttagtgccatctaaacagggccaaagttttagttccacaaacgacaaaaaggatcctcaatggcctcatcttttgtggggcccacatgccatagagagagggccatgggcgacggcgcgcggacgggtgtgtgcatgtgtgttttgagttgttcaccacctaccctccatttctcccaacaacaacaacacgagtacacanncgactcgnnatcctctcccctttcgctgggtccctccaacaactagcttagctagctagcttctcaaacccagcgacgattaacaaaaccacaaccattattaatcctcctcctcatccatcctcttcaattcctctccgtattaatcgaaaccacaagag

SEQ ID NO: 27934 - DNA, 1501 bp, Oryza sativa
ctgattatgtcgcaacagtttacaaatgcctgatgatctatcgtttcttacaggtctcccgatcgacgagttctcaaggaagaagatggacgcgactgcccaggagctgtcggaggagaagacgctcgcttactcatgcctcaactaaaactaagcaatacccagagggacagatagtgagcgattgcccgctcccgtgtttttgaataaaagagacttttaagttccatcacatagaaactgtttatctcagaccgctgcacatcgcgagatgtggagcgcagatgccgttgctggttttactccagtgtgtattgaggctttgtactagctcccttttttttgcctggtgattcgcaggacatttgctgaaaacattgaacccatttgacatctgatggaatcatggaccagtagcaagtacattttgcgaaagcataatctgcatcgggcttgggctggtggttgaactttctgccacatggcccatggaaacgtgagtcgcgctgttactgaatttttttcattttaaaatttttattttttaatatttacagaaatattgtaccggtaaaaatatttacagaagtagaccctaccgccctctccggtagagggcggtagggtgacgtgatgtgagggacggacaagttgaaaaaaaactagaaaaatacatttttggtagggcgaaaattacatttacccctttgaagcccttgtagagggcggcaagggacctaagtgtaaaatgtgcacaccttgctgcaaaaaaatgtgctgtaaatttatattttagatgatataatatttttgtaaatgttaaaaaaaaattaaaaatgaaaaaaaatgtgctgattacgtgttgcgttttgttcgtggaagggatcatttgtctgaacctgaatgtgtgttgtgcaccactaagcgaattgacgtgaccgaattgtatgacctgccgcaacctattacagtctacgtacagactacgactagtcgactactattactagtactcgattttgaggggctgcctggcgacgagcctgcatggagccaaggagccgtcggctggatgtggctgatacggtgcacggggatttgagattgttgctatgactgcaactttagcagttgcaaggtagctgatggatcaaaaaccaacagctcagatcattagaaaatattgttcacgaatagtatgcaatagtggctgtatcgatccaatggttataatgtgctatgttaaagttgcagtggatcgcgcggtgatgtttctctaagaagacaatttattcatgaattctcctattccattcgtcctaacatacatctgattttgagtcttagaagagatttttcagattttgccgttactagaaaaaaaatttagatttcaccgttactaaaaaagattaggagagagaagagaggaaatgacgagatagaggagaaaaatttagaaacgagtgttgtgcgagtgtccatttttttcagccaaaga

SEQ ID NO: 27935 - DNA, 1501 bp, Oryza sativa
ctgatggtgggttgtattagatctggttattatggtcgcttgatctggttttcgggggactgattttgcttagtttgtgatagttgactcgagtttgtgttaagtctgtgcatgaggttttagtgggggtttagtggagatccatgtgtatttcttttgatctgtaggggtttgagtggtttgaaatggatcatggtgtcgatttgatgagtgggagtgtgggattccatagttagaggtgggaggttagtcttataggttaaaagggtttaggagggtttacctattaatctgttaatcaaatgatccgatgggagctagtcacagttgtgagcttggttctcaaagacatacactgataacttgagatgtttgtcttgaaacatgcatttaatttagtttagctctggagggtgtgtcccttcaatttggccccacaaaactgtttgggatcgggtttgtattccgtcaagttctggcatgtcttatcccagctcaggattcaactgcaaaaattatcatgcatccatatagtgatagtgactttgatccaaaattccgtcgtagattctccatctgggatttggcaggatatcttggcatttaaacatttaaatctaaataattaaattgcattgcacatgcttaataagtgggattagcaccaaattgtagggtactaataaggaaaaggctatgcatactaactttttcttactaaattcttattactaacactgatatgtcatgctatgagtgcgtctaaattttttataacttccatctactaaaatcaaatggttgagatgattgttagtaaaagtttagtaagaaaaatttagtatgtgtagcagtgctcgtgctaaaaattgatctacacaagttggggttcttaaaccaagatataaatggtttttgtttatccatctcattctaatctcttgtctagtgtgatccatagttagaattgctaaattgctataaatattttctttcaacagctgaaaactatcactgtcttgttaacttaaactagtttgccttcattgttatgaaagcttcatttttctgatgtatgcttatgccagatgggaacctagctggcaattaattgaattagttagttcaatctgatgtggtgtgcacttcacaaacacttttgtaatgtggtctgaggtcctcttgtacgtggaaaggggtgctttgttctccacttaggagctcgggcattggaaatgtaactgattgttggttagtacactctgaatcccactcttagccaggttggatcaggtgaagccctgaggaggggccactagctttcttttgggtgctttcacgaatgatgataataggtgatatggtaatcagcatgaaaacaaatgtatttttttatgctcatctggaaatgtagcagtatttgaaagctgatggtttgcacttcatatggaatgcaataccattgttgcttgtgtgtcttaagaaatttgcacccaggggc

SEQ ID NO: 27936 - DNA, 785 bp, Oryza sativa
tgttagttcgttaaaaaatgcatgtgcttgtacgatactgtgaaataggataaattaattcatgcaaaactgtatttgtgcaggtggtatagtttgcttacatacctagcttctctttgtttaacttggagtatttgttggaagtaggaactgcaccggatctggggcaacaaatagtatagcagacctttgctctcatagattctgacaaagacatttacaagcatttccttccaatttacgatgccgcagcaggaatccacaacttctattccggtacaaaacaatttactttgatttcattttgtttctttcgagatggttggacacgtgttcatcctgtttatttctgcaaaataagggctcaacaggtactccataaaatatgaaaatagcaccaaccaagacccatatcatcaggacaatgacaacacaacagcatttcttaaattaattaacatcgcaattagttctttgttccatgtgcttgtgctctcgtgtgtcccagcactacgcccatgttctgatcgttcgaagaggacaaggataccactacaacggtagcttcaaaacgcatgagacaagatgaaaaagcgtttgattaagcatgttaacgtacgtgcgtgtgtgtgctgtgtgagcatggaatttgctcggttttagtgtaagctcctcggttattgcagcttaagagaaaaggactaatcagggtgttgttaaatgctgagatgagtacctgtgaatcgtgtgagatgctgaagccaacaaacataacgggacggaca

SEQ ID NO: 27937 - DNA, 556 bp, Oryza sativa
ccccgtctgcaaggcagaccggtgggcctacctaacttgttgcatctgatccatccattgttaattgttataccatattcccctgtaaccacctagttgagcctcggtattcatgcactctgcacgagtatcgacggtcgccttcaaacttaaaatctaaggaacatcttcggtaaaacttgggttttacaaaagtcttggaaaacccaacacctgggtcggtgcttgcgaactaaatgaatttccaaaatcgccgaccggggaacgtaccgggtgtacgatttcccgctcttgcacttaaggaccgtttccttggaatttcatccgaacataagacaagtgcgaccacataggtggaatgggacacccctggctgagtaaattgctaagcgggggagccttgatgccgagagacatgtagattcaacggggtggtgtcggggagaacccccgggcttcctggcacagtatggtctgggacctaacctgttgttggtctgggacccctctcgtcggcatatggcaaccctgtgtctgctctcgaaatgccttgtca

SEQ ID NO: 27938 - DNA, 802 bp, Oryza sativa
ccgaactagtcccgactgaaactagcccgtgacgctccaaattaacctgttatcgataccagtcccaggaaatagtgctggtatcacaggaagacagaatatccagcaacagaggtctctttattatagagtaggagtacagtcatgttgggctgtggacagatcccgagctcacaactgcattacaaaaggaaagcggaagccaggactagaccaaacaacacaggcgcgacttgggaactaggccgagaccctaaaactcatcgtagccggcttgctcctggaagaactcctcatcagcaggatccgcttcatcttcttcagcaactgggggggattatttatatagagcatgggtgagtacgggagtactcagcaagccatgggaaataagtgtttaatgcaggcttcaaggaaaggctgttgtttttgcaattgattttagttgaactcttttctaaaaacaactgagtgcttctcaaacgacatggatgagacagtgcgtctcgtccggtcggagtatgtgcaatgtatcagtctttaaaatttaaaacaaggttggcacccggccaacagcttttcaaacggccacccgggcctacaactttcaaacggccacccgggcctagctgatcccatcagctgcagatttttcaaacatcgaaccctttccataacagcaatttcacaagcaatagtcaaacaaactacgctaggaataacctcacatccacccatgaccgtgggcacggctgttcgaacagtttgttaacctctgcagagggggttcactttacccaca

SEQ ID NO: 27939 - DNA, 895 bp, Oryza sativa
tttgcatacgtacacatggcagcagattcttcctcttatctgtattttttttctccatgaaaacatgtccagaatgcaagcattgccaactcagtactcactctaaatatgatagtatctcattgtctatacataacacatactcctaatgttataactgagtaatattaataattgtgcagcacatctcaaccacgaataatgaaataattctctcactgcatgccgatgatttcgctcgagatcaactacatctatatttcactagagatatgatatacggatggtaaatatataataatatcccatgtccaacaatcacttaagccaagatttggttaagtgacttgttgacatacatgtcacttatgtgatcaacaaaatagtctggttatcagcagcatcaatcacatacaaagtaatgcaatagagcgaacaagagttatgacagtggaaataaataagcatatacatcatttagagagatggtgtatcacatcataagaagcaaaatttattgaagaagggaaagagggaggaggggagggggggggatggggattaacaacatttatctttaccagaaagatagctacatacctccctttcacttctagttttcatctagggcgaatatgtttcatctcaaaacacatatgcacacttaataacttttctgaaactaattaagcagtatatatgtagactccaacttcaacaaaacatcagctgaacagcattgagtaccaacttaaacagactgcatagtctcaagcatgaacttaaaaagtaaaaacacataaatagctctcaagccttacttgcaatggccaagggggcacccacataccaacactttattcttgtctcacctgagtcgcttcctttgattaga

SEQ ID NO: 27940 - DNA, 396 bp, Oryza sativa
agagagtagagagagagagaaggcgtgatgaagaagatgagatgggggaattacgtgtgtatcacatttttgttttatttatttatgagtgaactgcactttgtactagctgacttacgtttgttgcactttgaaccaccgactcatttctctagccatgcctatcctttactccagaaaatgtatggcctgctcataggtggacgatttcgctagcgtgctggagccaacatccttgagatcgttgatgcactaaagaagtggttacgtcggccgagggcatggctcatcacggtggagggacttgggggagagcggaagaggcgaggtggtgtgaggaagagggttttctccatgagaggggatgtgagggaggggagcaacttcgtttccagc

SEQ ID NO: 27941 - DNA, 1501 bp, Oryza sativa
ctgacttctaatgggtcccaccaagcgtgccaaaagcgtgttgatgaaaaactccagtgcaggtccaaaactcgccttcgggtatgcaagcgtgccacttgatttgatcctgcaatcaacaacaaacgaagacaaagaaaccgcggttaaacctataaaggatagccaatcggctaggtgccgatgacatatcatttatctttgagccgatgtcatgtacgtatcgatcggcagttataaatagataataaaggactaaatctactcgatcggctgtagatattaacaatatataatttctatgtcgatatatacttaagtcaagtgattgggatagatcggtcgccatgccgagacagtataaatcaattagatcgaagtatatactaacaatgaaactatataagttcatagcatagcagatcagatagatctagcatgtatcggctaatactccgatactactctatactaagatattaaagcaagtaaaatatatcaaacaaaagccaaatatacttgaatgcaaaaagatcttgatataaagggcatatttaacatatcactaaagcatatggaacaaatatagttaaatcaggtaagatcggctgaaactccgatactaccctaatcggcaaccaagaagcaggctagagattgagattctaatcacgactcataagatcaaactcaactaatgtagctataagtatgaaaagaaggacaatatctagacaatcaagccgttggaagtttcatagagtggtggataccttatataatctaagtcaacatcgatatctaacctaatcggctgccctctaccaatagatgttagccgattgtagattagatagcaatattgccagagattatgcaagatatatgataactcgacgaattacgtaaacaagataagagtatcataaagatggaagcactaatcccgagaacgcaagccgtcataacaagttttacctcttgtgaagatcgaaaccgatgcagctcaacccgaaagcaagaactcgtcgaaataaaacgaaagtaaaaagagtggcgatgcaccgagattgtattgaacgtgtgtttatttaattacatggggttcgaggtctatttatacccgagaattacaaactatgtccatatcggacacgactcttatctctaacaaacactaagaaaccataagtctttacggcagacttttgcccaaacatatctctaaggaaattacataaaatatcctaattaatagatacaattgccttctcaggactctagccatgtgtggcaaccatcttgaagcatatcaactcaacccgatgtcgtacaccaaatcgtattgtccgaatcggctgtatcacctaacccagtctgactcgaacttagccgatcccgatcgtagctgatccgaactccagccgattcttactctgtttccgcgacgatcctcatttttgattccgcttcgatctaatcttcttctccgataccaata

SEQ ID NO: 27942 - DNA, 1213 bp, Oryza sativa
gcaaaatttgcctttagatgtaatgtgggaatttctagtttttctgattaatgagagaatttatatcttgtttatgttttagattaatatgtatggattctagtagacctttccatctgtatatataaagatgcagcccaagttttacagttctgtcaaaaagatctatactactggaccattttttatggtgtgatctctatagtacctaaccttaaccaaatgaatgcttactatagggtgaaaagattagattggtacacaatatgtataatatgtctgtagccttttttacccaatacaaattttcaacaataactatatatgacaattagtgcaaggtaagaataataacaaaataaaatattactaatgaaaatggtaagaataaaaaaagagactaggacaaactgttgcaaattttctatcaatattacgaaatattattatcttaatacccaaaaaacattaaatagataaactttaatttagggacaacaatgcaaaaattagaaggaaaattcctttttttttcatgtctacccctccatgttaggattcttcacaacacaaaccttgtggtcccaccccaattaaactcatattctccaacacaagccccctatctttttactaggaaacaaaccccaaaaagctatctaacaatccaaataaggacacaaataaacatgcttgcaagcaacattcacacacctttaatttcagcctcaataagcatccacagttttcctagtcagcatggttgttcacatctggtcatagttatctctagcccccataaaagaccaaataggaagtgaggtagagtgaaattaaccggttgtatgagcttccaagaatggaaaagcacagaactgaacaaaacatggcattgggattctcatcccatcaacacaaacctcaatgctatctcaccagccatatcttggagatagagggagtgtgtgagggccagaaacttgcaaagggagaaagtgaggttgaatctccgtcacgtcactcacagttgcccatccatctgataaaggggtgtcccctgggctctataaatattgtccctctttgcctccatcaacatcactgcagtgcctttgagctttcgttctctagagtgtctagggtgaatcttgagcgagtgagcgagcgatctctgtgttgtgtagtttgtgagctagggtgatggctaacaccg

SEQ ID NO: 27943 - DNA, 326 bp, Oryza sativa
tttccttcttccttcatttttgcatatatctaccaagtactcccaatcaaggatcgtaatagagttgccccgtttgtttgagcttaaaagccattgctaattttgaactttagaattaattatggtttcctttgtcgaatttgaaactcagccttgattttttaaccgccacgagtacaagtgtaaaaaagtcttatcctaaaattacttttcactatatcggtggtgtatcttccttgtcttgtcttatgcagccaaaaaagaaaaaagaaaagccctccaagcagaattgccataaaatctgctgagtttaatttcttttcagt

SEQ ID NO: 27944 - DNA, 1501 bp, Oryza sativa
acagagatttggatatgatttgccaataatatcccaagcttgctgctacgactgccgctcacaaccatcaacttgaaattccaaactcctaaaaaccaaaatctatagagttcattttttcgattgccaggtttctgaaattttaatctctactcctgtaagtcggtaccagtaacaccaagttgaaatcatgattatctgcaacaaggccggaaaacaaccaaagttttgtattgatgcttcagtaatttttctgctctatatgaaaaaataaatatggttcagactatttatcattttttcaccagtacatgacatagcggatacacaatcttatagtggccttccatgtggggtctacgtagagatagtaggagtgtgtgtgtgtgtgtgtgcgcgcgcgcgcgttatttgatcgtaaagataatacatgatcacagacccaagatccacaaactaaagagataatacatgatcacaatttagtaaagcagtcccttttaacaacatcgttttagagtaactttgataccttgaataactggagtgaagtagtcaccagcagagcaggagtcctcaaatattagatccttcaatcagattttttctgattcatgcaacactgtaaacgtaggatacagggaaaatttaataaatgatctgtgaaagaagataagtgccgaatggttaagagatcaaatttcacccggatggaaaaatatattacttttattgatatggcatgaaaagaaaataagaagccgtctatggagagcagccacgctatcaatcaccaacaaaaaaaagatctataaaaaataaattagtgtactgcattgcacacagtaagttgccattttatcataggcgacgtatttttcactttgttcagaaaaaataggaactacatgaacaatctatttaaatccatggttgtggaagtgcagcaggttaggctcgtaaaaagtggttaactcaaataccaacactcttcagttatttgccctagagaaagaaaaataggttcatctatcttctgtagaatatagccatttatatgaactgaacgacataagaatttagagtcaattgcaagaaaaacaaatggtactgcatataccatcaacttcttagatcccagatcgattaggataaccgggctttaacagggaagcatatatgtgaaatcaaaatgttgatctgtcaatatacttgttcacaatgtgatgtgcatgtcacactgtgaaatcaaaatcattaatgcatgactacactgtggtgtgcatgtgaaattgagcaaaattgcagtattacatttggaacagggttaagcttttacaagaaaaagatttggtcaatccctcgaagaaaatatggttggcacagtaatcagggcatttttttttcttgatttgcaaaccggatgcaggcaattttaaacatcagattctacaacagtgcgaagattgacccacggagtatatatttgcactatttgtaa

SEQ ID NO: 27945 - DNA, 1501 bp, Oryza sativa
atctccacaccaaggacacaagtatcatcaagcagatactcagatgatttcagttggtcttcaagggaaatcaagcatatattccttgagtgtgtgttcttgacgtcgaagttgtagctagctgctcatggttaaaatgtggcaatattagagaaatgtagtctaggctgcaacataaatagacctcacaacaattgaacatttgttcttaagagggggggggaatcatgtatgcactatacaacactaccatatgttaactgcaaatatcgataggttgatgaaaccaaagttggtagcataagacaacacaaagtgaattaaacaatgtggaaactatttgatcatatatatttacacattgaattaaagcggtggaattgagataatatgttcaatactgctccaaattcaggaaattacctttgactacaagaaaatttcccttcgaatggttgtacattgacagcacgaacactgcattcatggtgtaatctggcttaaagcttagtcgggacagcacaagagaaagagcaacatgtggagttccatcaccaagggttttatgcattggagacactttcaagtacctgtataatgagaatcaatgagcataataccaactcagattaaaaatcaaggctgaagtaataacaaatcctaatttcttcattcatcctatcaaacatccccttgcaatttccattttatagggcgctgagactaattacttagctacattgatttttttaagggacgtgaacatgtaagactatttcgcaattcttattgtttataggcaactattttatctcttgaacatatcaaatgaactgatgaatgacgcatggtatctgcctagtcacatgcagttttaaatctaatgcatattaccgctgtagtgtcttcacagctatacgtaccagttgtatccagagcaatgaaatgcagcagacttggctgctaaagctcccctctgaagtagcgctgagaagccataaaccttccataagaacactggattatggatctttaccagcagtgcatcggctgaaatcaagatgtcaagtgtattaactcaaactacacaagggagaaaggaagaggagttactcccgtgtaaggcaggaaatctgctgttgtgtatgtcacatcattgtttggtccacatataagagcatatctaatcgtatgagaacaaagacaactccgaaaaactatccgttctttgcagtaaagtcagaattagtacataatactattttttgtcaagtcagctgatgaaaaaggccgaccaaatttcattaagattagggaggtataggttatagtaatattacatcgacaagttgtcgaaaccagtgtgagattgatagtaatcccacctcaaaggcatgaagacaaaaaccttcacactacaaacacttagtcatcagagacaatgaaaaactctgctttcttccacactgtgatctcgtccttaatgtcaccaaagataaga

SEQ ID NO: 27946 - DNA, 1501 bp, Oryza sativa
atactccgtgggtcaatcttcgcactgttgtagaatctgatgtttaaaattgcctgcatccggtttgcaaatcaagaaaaaaaaatgccctgattactgtgccaaccatattttcttcgagggattgaccaaatctttttcttgtaaaagcttaaccctgttccaaatgtaatactgcaattttgctcaatttcacatgcacaccacagtgtagtcatgcattaatgattttgatttcacagtgtgacatgcacatcacattgtgaacaagtatattgacagatcaacattttgatttcacatatatgcttccctgttaaagcccggttatcctaatcgatctgggatctaagaagttgatggtatatgcagtaccatttgtttttcttgcaattgactctaaattcttatgtcgttcagttcatataaatggctatattctacagaagatagatgaacctatttttctttctctagggcaaataactgaagagtgttggtatttgagttaaccactttttacgagcctaacctgctgcacttccacaaccatggatttaaatagattgttcatgtagttcctattttttctgaacaaagtgaaaaatacgtcgcctatgataaaatggcaacttactgtgtgcaatgcagtacactaatttattttttatagatcttttttttgttggtgattgatagcgtggctgctctccatagacggcttcttattttcttttcatgccatatcaataaaagtaatatatttttccatccgggtgaaatttgatctcttaaccattcggcacttatcttctttcacagatcatttattaaattttccctgtatcctacgtttacagtgttgcatgaatcagaaaaaatctgattgaaggatctaatatttgaggactcctgctctgctggtgactacttcactccagttattcaaggtatcaaagttactctaaaacgatgttgttaaaagggactgctttactaaattgtgatcatgtattatctctttagtttgtggatcttgggtctgtgatcatgtattatctttacgatcaaataacgcgcgcgcgcgcacacacacacacacacactcctactatctctacgtagaccccacatggaaggccactataagattgtgtatccgctatgtcatgtactggtgaaaaaatgataaatagtctgaaccatatttattttttcatatagagcagaaaaattactgaagcatcaatacaaaactttggttgttttccggccttgttgcagataatcatgatttcaacttggtgttactggtaccgacttacaggagtagagattaaaatttcagaaacctggcaatcgaaaaaatgaactctatagattttggtttttaggagtttggaatttcaagttgatggttgtgagcggcagtcgtagcagcaagcttgggatattattggcaaatcatatccaaatctctgtcaattacgctatcctgcag

SEQ ID NO: 27947 - DNA, 1501 bp, Oryza sativa
ttcacaaagtttcaggttcagcttttccatgacagatcctgtggaatgaatttatatgcagggactgcttcatttttttgcagcatctcattcttagtttgtctcaatcgcaggtcgctttgtctttgctagtaagaatggctggggatggtccaacttcatcgcgtcaacaaactcaaggatcttgtcggatcaagctgcattgtcaaggcagacatcaccatcatcgggtcatccagtgagagtcagattgtggtctgaggaagaaacaatgcccttgcatccttctggcaagaacacctgccaaactatctatgataaaattatggtagcatcacaaagaacttgtctgatcaatggtattcttatggtagttaagatacctgagcaatggacgctgagaaaaatgtaagatatgccatgctatctatctatgtagaactggagagtaatgttatgttctgaaccacttttatgcatggatggtataagcatttgccattatatattgtcatctcggtgtctttaaattcagcatatgttaatctgctgatcagcctgtgttgttctgcttgatgatgcctctctgaattacattatcgtttcgagtttttgacaacttgtgtttgttgcatatgctgccatatatggtttaattggtcaagccctgtacgtgctaaacgggcccatcaatcttggccccaaaaaaatcaatctactgggcctcgtttttttttcctgttccctataaatctcaggattatgtgtgtgccggtggaggcgttgatcagttgagataaacgcgacgagttcgtgtgtgtttgtttgggcggcgactgcgagggcgatctggctgtttgctaggtatgtacattgtctttctcgcagatgacaaaaaatggtgctttcttaatttggttatctgatgccattatgatctcttggtaaaagaaaatccttttcattgagtggattaaggtacactgatcctacatctgtgatcttgtcgtttcactagcaaaacctagctgctcatcaatccattgttttctagagttcttggttatgagatatgcgattgttacatcagtctggctggactgaagctttgagatatatattttatcgtgaaagctgagacttaatctcttgttattgattatcacctagtatatgctgaggttaatttactggagacgggatctaaaaagggagctcgaagagagaaccatgggcaacgttgctggacgtgctgcaggtgcttgtaagtattcttttctgaaaaattgctctctcaacctggatctcatttgaagttttctttgttcagattagattagacactagtaacacattagtcattctaacctgtacatcggtatgtatgggtatttcaagttagtgcaaaagatatttgagcaaatgggcagtaacattagttttacttgtgtgtactgcaattgtcaatgggcagacttgtattttggagtataaaacatag

SEQ ID NO: 27948 - DNA, 723 bp, Oryza sativa
aaaggcttattgaaacataaagtcatataagcttaggtagctaagttgggagtgggtatttcagcaatgcccaccccattaatcaaaagcaatgagaaactaacacacaaaaatagtgcacaattagtgaattgttatggtgttagtgaccaaaagttagcgagatgcatactggttgtaaatgatggagtatgcattatagtgcaattaactaatagagccaatgagacccaacatctaacaattcgtctgaatcaaaacacttgaaacatgaggcaaatctaacagcttgcccacatttacaattggtacaaattaatgtcctgaaaggaatctgaaatgagtaggtggttagtttgttggataagtatgtaaatagctaccaaggaaggagataagtagatttaagatcgatgttgtgttccacacgcatgctcgactagctgctagcttgttgatacagcagcacttgtgcagatttttaattcacgcatgggcagaggcaggcaggcatgtatccttttgaatctcaagatggatagatttatcgtcagttgcctatatcaacctataatggtatctagctttagacagagtaaccacaagtaatttaccttgaacagggagtgcacattacaataaagcttaagtgaaagctaaagagagggaaaattgtacaatttgaaacgaattcggcgataatctagttatgaaatggtacca

SEQ ID NO: 27949 - DNA, 1501 bp, Oryza sativa
tatgtgctttgtagcgtggaggatgatggcttggcagtatagtttcggttttctgaaaatcaattcgctgtacagaatgtagagtactccaacttcagccttgactttttatattcagatttataattttaagtactagtatatttatacattgatagtttatgatgttcctctaagatttgatgggtcagagtttctatgattcttggacagttcagtgtgaagtctgattcattttcagcttaatgtgagaacaaggtatatatccctgttgtccagtaatataaaaaaatcagttctatctctgttgtgaaactccaaattttcaatttttgttgcttactgatcatcagatcatgtcaaacttgttggtttttttttcgtgcaatccatttagatgttgtactgcagagtgcagactggagtagctgaagcccccataaataaaattttgtactgatatgaggaagtggaccgattagcatctttggtcttgagatgaactaatcctgtcgatagggagaggaacaatcggcttgacacagaacctgattgcttaacaccagcacttgaatttggagcagaacttgtcatgttatgtgataataatgcaactttatgtttctcacatgttcaggtaagggatcacacctttgccttctgtttctctacacgttgaagccgccggcgacgtactataccggcgaacagaaaacagagacaatggcgatgacgcgatgtactgtagtggtgaggccaccgcgagagaacgctcttatgcgtggggcgtatgagattgatatcagtaccgaaccagtccactctacaactaaaatattgggatccaaattttaggtgtctcttggagtatgaggtgatttttaggtctaatttgttttgggatggccccaatacaagatttttaggagttcaatattaccaccatatttgcttgttcccttagtctaacccgcttaatacatccgcctcaccccaacttgtggctagtggtgccactatcactgtgatgatgcactgccatatatatcaccggccatcgatcaacttcctaccccatgcagccatacctattattgaagccccctttgaacacatccttctttctctctaaaattttcctcctccgaacccctatctccccccccccccaatactagctaatcgggtgtccaagtcagtctgtgggcaatatttatttttattgaaaatattgagcactaaaagacgaatgagaggttgaccaccacatcattgcaaggggagctcgattgattcgcaaattggactgacttcaaacttttcaaccggattaatagtcaacgactttgatagcctttccttacaaggtttttaatccatcgccccattatatttttcttaagtttaattacacttaaaaacttaatgaaaaattagaaacgacttataattaaaacacagaaggggtaccctatatagactaagtcaaaatataagcttc

SEQ ID NO: 27950 - DNA, 1501 bp, Oryza sativa
ccaaataactctgtcgcgccacgtacagctagtgtggtattattggcctgccacgctactgtaattggcatggccaaaatgttcaaaatgttcagtttttgaaaatattttttgaaaaggtctattaataaaatggggcaattgcaaatgtaccagtaatttgaatcgttattgcaagactgccactagaaaattgcaaaaatgccactagaaccgtcactcgagtggcattcttgcaaaattaaaaaaatcggtggcaaatttgcaaatgccccctaataaaatttaaaaataaaaggtctaaaaaataaaaaaaaaattgagacccagtcagactcgcattatatcaacggtattatttaggttacttttactacaaagcatacaacattttatcgaaaagtttacaggttcaaaaaaaaagataagaattgattatttatttagattttacctcagtacctgttgggttggtcgtcacttttctggttcaagcatacaacattttatcgaaaagtttacaggttcaaaaaaaaagataagaattgattatttatttagattttacctcagtacctgttgggttggtcgttacttttctggttcaatttcttttttattttggcattgacatccatctcaacttacatatatatattacgatcgtacacataacctaaatgatttgtatggatatttcttacattgtcgtacagccattaagatcagtggtaagtgtccgttcatacatgggccctgtttggatccggagggctattaaatagccctctagaatcttgctatttaggagtattatagatattttcattgatggtggttttaagagagaaagttccagctgtacacactagaataaccttgtattagaatggcaacaaaagaattattatcactactgtagttttatttatgatgaacctttagggatggtgcactctgcaaagaaatattggagaacatcgtaactcttgccagttactattggattgtaaatcctacacggagcacaacgagtgatgttacaagatactctcggtgctgcactcttgcttgtttccttctcatcagacgttctgttttgtttggtttaatttggtaatcttgcgtgttctcgtgccggacgagctacagtgcatgttctgttgcgtgcgtgccagataagctacagtgtgggtcctgctgcgtgcgtgctggatgagctacagtgtgtgttctgatatgctacagtgtgtattctgttgcccgtgccggatatgctacagtgtgttggtgagtctgttcaactacagtgtgttcaggacttcagggcgtggagttacaaggccaccattgccatgtttagctgtttaacgaaatgagaaagccattagcacataattaattgtgtatagtatatagtaactattatacccttgcaaattagatctatttatcttttaacaaaaaaaattatatagattttttttttgcacaaaacaca

SEQ ID NO: 27951 - DNA, 361 bp, Oryza sativa
ccacaatatgacggtgccttcgaaccaatgtgtgatgaaccaaggaaggggttggagtttcgatcgatggatgatctgaaaatatggctacagagttattctatccgtgtccaccggccgtaccatgtgaaggaatctaacgcgtcagtaaagtatactgtggcttgtctcgatcgccattgcaaatggcagattaatgcaaggaagagtggaggagataggtggcgggtgactagggtgggcgaagaccacacatgctgtagtgcggaagtaaccggcaagcatttgcaacttacttcaaggtttattggaaacaagttacaggcatttgtgcgagttgaaccaactttatctccagcag

SEQ ID NO: 27952 - DNA, 529 bp, Oryza sativa
aaattcatgtagcctaaaagtaatctacatatattatagaagtaacttatatcaaaaagaaagtaactgtaatgaatgtcttttttaattggatatgactacacagctagtggtagctagcttggactccatctagtatctcctttcaacttgaaaaatacaatagtatcttttttctcattctacatgaaaaacaaaaatgaaaggaaagaaacaatcgatgattaaacagatttatagagagttacttttgaaccatgcaaaagttacttccaattaacattgaagttacttttaaaaattgttaaacttatgtgtgttgatctgtgctgattaaatttaatttctagataaagtcatatttttatccctacaacgaatttacttctattgtcgcaacaaaagtacttccgttttgttttaagttacttttataatatatgtaaattacttttagactctattaaatttacttttatatgtctaagttttatatgtctaagaagtaatttagtcaacttaaaagtaa

SEQ ID NO: 27953 - DNA, 1501 bp, Oryza sativa
ctagttacattattactatatttatttcacactgttactgcggggttgcagtaacatatagtacaaagcagtaacgagcgggagtaaatactaaagtttagaaatcgttagttatacaaacaataatcaatagcgtggtggtgaccactactcatgaaaattcaatgatggcatatcatgttacaatagtaatctataattcataattctgatggtaatattgctatagctgtgtagtaaaagatttgggatagtgcagtaagatggtttgaagtgtatactaacaaccatcctagtaccattactacatgttttgtgccaaatactacaggatttagcacgtatgagaagataaaaatttactaagaaaactctatcacaattgagaaatagcctattagttagtgccctgtggtaatttgagttgaaggtcttgagttctattcccattgaatgcaaaatttttctttatttttttctctctaaaaaaaagagaggtggaaggggatggggagaaaaaaaaggagaggggaggcgcgcgagaaggtgggcgagggaaccccaggtgtagaatagtcttaccctatatatatatatatatatatgaaaatgtttatgtactcccgggagtacgtactcctggtccgcatccaccgtccatccgcgtaccgcatagatcgatcgcacacatgttcctgcttatcggatcccaccagacccaatttgaattttctaaaaagaaatactggaatatttgattatcccttgatgatcggatctggcatcggtgtatatatatatatatatatatatatatatatatatatatatatatatatatatatatatatatatatatatatatatatatatatatctcctacatatataataaaagtaatttacgaatataaatattttttcatcttaatataatcatgtaagatcttgttgtgaagatttaattgtaacgaacacaatggtgtaatcggataagtaatttgagagaaaacttgtttgaagaggaaaaggacgtacatgtatattaaaaaaatgcatgcatgtagtaccatgtattagatggacttctccacgtttctctgtgtttaggcgtcgctagttaagacaaaatcgagagccctctccaattagatgttacgtcctaatctcgtagtaatttcatcgaacgtgcgattctgactaagaatcctactccatgtcgaagaacttcacaaatagggccaagaataaattcggaagaaggcccagattgtcctctaaaccaagcccaatacataattcaagctcattccacatctccacaagcccaaatccaagcccagcccagaccaaggcccaggcccgcctctgcggtctccttcgtcacccgcgcgtcaaccaacctccggcgtctcctccccccgattccccattcgccctcgccaccgccaccgccaccgccacccctcgccgccgccgccgatccgcgccgccaccgcca

SEQ ID NO: 27954 - DNA, 186 bp, Oryza sativa
gtgtgttgacagtaactctgggtctgtcagaaataccaaatgattttgaggatggcttgaggatgctaaagaagaaactaaaaacaaacctcacaattgtgttcgttgcttggttctgttgggggatttggttaaatagaaatgagtgggtttttgaaaataaaattgctaaatcacctttgcagg

SEQ ID NO: 27955 - DNA, 289 bp, Oryza sativa
cctccatcaacatttttttaaacatttaaatttttttactatgtggttcagaaatagtacagtctttgctctccattaattggcatcttgtagctattttcatattcctattggtatccactcaaatattcctgaattgtctacaatctacattgtacttaatgtgttgtatggaatcatattacatactcttgttgatttgccagcagcattttagtagaaagacaagtaggtatatgatgtggatagtaacgatcattctcacactgtaacaagtattttttgccct

SEQ ID NO: 27956 - DNA, 1501 bp, Oryza sativa
cggctgttttattttgacttgttggccggaattgcgtcttcatctggcccactaggagacaattggcccaaagctctgcccaattaagaagagacgcccagctgcccgggccatgcttccccttacttcgtcacacatgtcaccatgtccagttgtcgtcctcgactccttcctgagtcgttggcttcctcacgcacgttgctgccatcattgtcgctccagtgtccccggcctccctgccagtgggtccagctacatgaggggaagaagatctgctagatgtgaggctgtgggtcattcttctcctcttcctctctgctctatccctagtctccctgccggcggatccagctggctagaggggagaatatgagttgctgtcgtgcgccatctatctctcaccacctctctctctctcttcctttgcactctccgctctgtccctggcgtccccaccaaaggatcccgccggccggaggggaggatgcaagttggcggtaaggttttgttttattttaactggattctcgtttcttgggctcgtttgaacatgacatgttagcattcttttttcaccattcttttgtgttttagaggatgcatgtcatgtcattttctaattgcaagaaaactagaagaaaatcttgcttgtttctgttagttgttacatgctcactaattagaagaaactattttttgagctcactaattacgtgctcaatttgtctgaattgataaaattaatttgctttaacttgtctgagcatgaaataagaagtttaaattgcttccttcctgctcatactatatattttcgaattaagaattctggcagcagtgtgatggtttatagctcaaaccatatgtttgaactaagaagatattgctaaaagttctgatgaaaattaaggatttgaactaagaatttgtcatgtatttttgctttgtaataataaagcatagctttgttaatatatttcagaggaaattagtagttacaatattcattagttttgttgcttctctctccccttctctttctgttggactagcagaactgttatgttttttgatggcatatgtttcgtatcagactagcagtgtgtgcaggcgtgccaaaatttagtttcttagttctctatgtagttatgtttcccagtagtaattttatttaggaggggtttagtaattctcagatattttaaaaattatcttatatgaatcatttaagttttgtgttatatatgttcagaaactacaatccttttatgtttgtttccatcaattttcaagtgctcgtcaattttatcaccatttgcaggggtaaaccaaccaaactaaagtgcatttttaattcaactctactatatatgttgtttacattgtttccagagatatatggttctgaattttgttttccaactaatagccctaaaatgtaatcattggaattattttgatctttcgtgcttcaaggcatattatactagttataatatat

SEQ ID NO: 27957 - DNA, 1501 bp, Oryza sativa
ccctcctgccagatccggcggaggggagggagcccgccgtcgcccgccgcctccactcctgccagatcgggcggaggggagcgtgccgctgcccgccgtcgcccgctgcctcccctcccgccggatccggcggaggggagggtgccgccgttgttgcctccaccgggacgccacccgactgccgccgcgcgctacactcagaggcgagagagagagagaggcgagagagacgaggcgataaggacgagactgatatatgcgtcggcctggatcagctggatcggctcggctcgatagctcggctcggtttggataggtgctggtttttttaaaaaaccgacacctataatttattattggtgtcggttttaaagaagaaccgacacctatagtataagtgtcggtttttctatagaaaactggcacctatactatattaaaggtgtcggttcttcttagaaccggcacctatagttggttaaatgtgtcggttttacgtgttttgagtccacggatgagagaaaagcattataggtgccggttctagctgtttcagcacctatagtaccgatctctatgaggttttttgtactagtgatatgaaggatatgcagtcaactgaaaatagtggatgaacaaaaataaatacaaagtagaggttatttgcacatgtagcatgcctcatgacccgcttaagcatgcggattctattctaatgtaggttccaacacattattactagtcataatgtaccattttagccttatttctcacgcatcatgcaagtctgtataccaaaacaactattttgtaagtttatgtattgcacccacctatcaagttattataccataccaatgtaatttactctatataatatatccaaataaccctaacaaaatattatgaccatccattccaatatttttctccttttttttaagaaaaccaatggtactattaaacgtaaccactacttggtagatcctaaaaataacaacttataggaatttaataggcccaaccctcaagtaattgaattatcatgtgtaccagctgatttattgcacgccactccctcatggttacctgattagtctaacagctgacaaacaatattaagccaatcaagagttgtctcgtgtgtttaatgaggggcacgatagacttttgtctttgctacttagtccaaaaattgtgaagtgttgttatattttggcaagaagagagtatttaaggatgcatgcatgttttttgcacctgtccatgcaaaatgatagcacaaattaaatgtagtgccatcttttaattagaaacagaaatgtaggattttgagaacatgaccatgcgctttatctaatgaaatagatgaggacacaactaccatgactaacttatgtattcatcaaccaaagatgcatatgttctatgttagatttacttattatatatttgaacaaacgttactacaccatgagttttgtatcttttcgtttgcaga

SEQ ID NO: 27958 - DNA, 1501 bp, Oryza sativa
ggagaaccgaatccgaatccaaaacgtgtaaaactttatctcttgtcttctatgaaccaaaagtgtggtgaggtagaagtagacttggagaagatcttggtttggtcccgaatcaacttctttgatcatccatacattccttacgctcggtttcttttccttcacccaagcaagtatctctgcaaacgaaaagatacaaaactcatggtgtagtaacgtttgttcaaatatataataagtaaatctaacatagaacatatgcatctttggttgatgaatacataagttagtcatggtagttgtgtcctcatctatttcattagataaagcgcatggtcatgttctcaaaatcctacatttctgtttctaattaaaagatggcactacatttaatttgtgctatcattttgcatggacaggtgcaaaaaacatgcatgcatccttaaatactctcttcttgccaaaatataacaacacttcacaatttttggactaagtagcaaagacaaaagtctatcgtgcccctcattaaacacacgagacaactcttgattggcttaatattgtttgtcagctgttagactaatcaggtaaccatgagggagtggcgtgcaataaatcagctggtacacatgataattcaattacttgagggttgggcctattaaattcctataagttgttatttttaggatctaccaagtagtggttacgtttaatagtaccattggttttcttaaaaaaaaggagaaaaatattggaatggatggtcataatattttgttagggttatttggatatattatatagagtaaattacattggtatggtataataacttgataggtgggtgcaatacataaacttacaaaatagttgttttggtatacagacttgcatgatgcgtgagaaataaggctaaaatggtacattatgactagtaataatgtgttggaacctacattagaatagaatccgcatgcttaagcgggtcatgaggcatgctacatgtgcaaataacctctactttgtatttatttttgttcatccactattttcagttgactgcatatccttcatatcactagtacaaaaaacctcatagagatcggtactataggtgctgaaacagctagaaccggcacctataatgcttttctctcatccgtggactcaaaacacgtaaaaccgacacatttaaccaactataggtgccggttctaagaagaaccgacacctttaatatagtataggtgccagttttctatagaaaaaccgacacttatactataggtgtcggttcttctttaaaaccgacaccaataataaattataggtgtcggttttttaaaaaaaccagcacctatccaaaccgagccgagctatcgagccgagccgatccagctgatccaggccgacgcatatatcagtctcgtccttatcgcctcgtctctctcgcctctctctctctctcgcctctgagtgtagcgcgcggcggcag

SEQ ID NO: 27959 - DNA, 1501 bp, Oryza sativa
acatgtgcaaataacctctactttgtatttatttttgttcatccactattttcagttgactgcatatccttcatatcactagtacaaaaaacctcatagagatcggtactataggtgctgaaacagctagaaccggcacctataatgcttttctctcatccgtggactcaaaacacgtaaaaccgacacatttaaccaactataggtgccggttctaagaagaaccgacacctttaatatagtataggtgccagttttctatagaaaaaccgacacttatactataggtgtcggttcttctttaaaaccgacaccaataataaattataggtgtcggttttttaaaaaaaccagcacctatccaaaccgagccgagctatcgagccgagccgatccagctgatccaggccgacgcatatatcagtctcgtccttatcgcctcgtctctctcgcctctctctctctctcgcctctgagtgtagcgcgcggcggcagtcgggtggcgtcccggtggaggcaacaacggcggcaccctcccctccgccggatccggcgggaggggaggcagcgggcgacggcgggcagcggcacgctcccctccgcccgatctggcaggagtggaggcggcgggcgacggcgggctccctcccctccgccggatctggcaggaggggaggcggcgagcgacggcgggcagcagtgcgctcccctctgcccgatctggcgggaggggaggcggcaggcaacggcgggcgccctcccctccgcccgatccggcgggaggggaggcggcaggcggaggtgccctcccctccgccggatccggcaggaggggaggcggcgtgcgacggtgggtggcggtgccatcccctccgccggatctggcgagaggggaggcggcgggcggcggcgcaagagggcccgccggtgacgaagcagatgaagccttgggccagcctctcttcctccctcttctcttgtagattttttagatgttttggtggatttgtgaatgattttattggagtatgttcgcgatgtcaatcgattttggtgacgatgaatgattatttgtgatgtcaatcgattttggtgatagatttgtgatgatctgtggatgatttggggatttggggatttcaatattatttgggcgcatggcgacggtggtgctcagtgaggtcggctccattcgagccggctctctttttttttttgctcgagctaagctaaaggtgctggtttaataattgtcataggtgccagttttaattattagtgctgaccaataggtgtcggttgggaaaccagcacttatagccggttcccaaccggcacctatgcccctttttgtagtagtgtatatatttgatattatttctctatataattaacagccctattatacataggtttgattgagcacatgtacatgtatactaagataactgtgaaattgttatttgggcttgggttgcatgcaccaaactagtttgtgcat

SEQ ID NO: 27960 - DNA, 183 bp, Oryza sativa
tggccaggctggaagaaatatggtgggatggcaggatcactcgatccagtgttccgttcattcaagatctatatatgtcaaacacctggatgggaggtgaaaaggagaagtaaacctgaaaaactgcaaggcattaaggaacgaacaaacttgctctagctcgctctctgttctttcttcaga

SEQ ID NO: 27961 - DNA, 1501 bp, Oryza sativa
aatgaaataaattaaaagtgagagatatacttaacacgttaacagggcccatccattacagaaacctaattaaaatctttaacgaatatttttctctccatttcatgaaagcagttggcccatgggaaaacttgtctttaataaacattatatctccatttctttcttatataataaatatgccacaagtgaccagcaaccaattatcaattttttgcagcacactccagcagaaatgcattcttgcagtaccctccaacaaggagcacaaacattaggtgtcttatagcaaaatttgcctttagatgtaatgtgggaatttctagtttttctgattaatgagagaatttatatcttgtttatgttttagattaatatgtatggattctagtagacctttccatctgtatatataaagatgcagcccaagttttacagttctgtcaaaaagatctatactactggaccattttttatggtgtgatctctatagtacctaaccttaaccaaatgaatgcttactatagggtgaaaagattagattggtacacaatatgtataatatgtctgtagccttttttacccaatacaaattttcaacaataactatatatgacaattagtgcaaggtaagaataataacaaaataaaatattactaatgaaaatggtaagaataaaaaaagagactaggacaaactgttgcaaattttctatcaatattacgaaatattattatcttaatacccaaaaaacattaaatagataaactttaatttagggacaacaatgcaaaaattagaaggaaaattcctttttttttcatgtctacccctccatgttaggattcttcacaacacaaaccttgtggtcccaccccaattaaactcatattctccaacacaagccccctatctttttactaggaaacaaaccccaaaaagctatctaacaatccaaataaggacacaaataaacatgcttgcaagcaacattcacacacctttaatttcagcctcaataagcatccacagttttcctagtcagcatggttgttcacatctggtcatagttatctctagcccccataaaagaccaaataggaagtgaggtagagtgaaattaaccggttgtatgagcttccaagaatggaaaagcacagaactgaacaaaacatggcattgggattctcatcccatcaacacaaacctcaatgctatctcaccagccatatcttggagatagagggagtgtgtgagggccagaaacttgcaaagggagaaagtgaggttgaatctccgtcacgtcactcacagttgcccatccatctgataaaggggtgtcccctgggctctataaatattgtccctctttgcctccatcaacatcactgcagtgcctttgagctttcgttctctagagtgtctagggtgaatcttgagcgagtgagcgagcgatctctgtgttgtgtagtttgtgagctagggtgatggctaacaccg

SEQ ID NO: 27962 - DNA, 253 bp, Oryza sativa
tcatgctccatcataagagaatcacagctagcacttccatttcaatgatgtttttcctaacatgacatgactgcagaggatacttgtgattgatcaacaacattttgcagcaacgttctgtcccgataacgctgcaatggaattgatcaattggtgttcctacttattggaatgaatttcccattgtggaaaaaaaatggaaagactggtacaagctgctgaaaaatgaactgtcgttactcaagttgaaaca

SEQ ID NO: 27963 - DNA, 533 bp, Oryza sativa
ttgaaaaaaatgaatgtccgatctgctcacatgaccgaacgtattgtatttggttgtttgtatacggccggcctgactgcaactctgcaagagatgctattagtcaaatagaagcatctctcacatggtcggcactcacgcatatatccctagaaagaattatggatcatatgcttaatgtgaagcattttaatggattagatcatctgagacgctcaaggaaaaggagatttttcagtcaaagagaaacagcactattattagcttgtcaatttgaggtctgcaaaacaaaactgaggtctcagggtggcatgttccagacccacttgatgcatggctcctgtcttcttaacaaaatattccacagaagctaaaatttacagggaaatgtgtggcatgttctctgcatgttcccaagtagtggatgcagcgtgcctgcacattgcatctgcatgttactactacaaacaagctagtctgtgtaacacaagttacaagaacaatatatataagccagcattgctcccccttga

SEQ ID NO: 27964 - DNA, 187 bp, Oryza sativa
ttaacaaccaaaccgtactgcctgtactacaagcaacatgtcactctttttttttgtagtagaatttagagttgagaatattaatatttctgcatcatggaccactatatggtacataaacctagtgttaattgttgtgattgcatgtctgtctgctgaggaatgtgaacaagctggacggacatca

SEQ ID NO: 27965 - DNA, 414 bp, Oryza sativa
tttttttttcttttttttgctttctccatatttgtatcggatgagactagatggcgcattgccaccgtgctgctttgttccaaggataacaaatatgggctctttagcctgggaaagagagaataatttggttcaaggataacaaatttgtagagaatatctgaatttgatttaaggatttgtgaactgaagttggcatttaaacttgagaaaaattaaggctcagattatgggctaagaatttgaatttaggattgagcagatccaaatggagtccaatccctattaggatggatgttgattatttgtggatatgtttccctgtaaatctggaatgttccccattaggtatattgataaaatgatgatgagaagaaaaggttggaagagggaaacttgtgtcgtgtgcataga

SEQ ID NO: 27966 - DNA, 248 bp, Oryza sativa
tgttgtgtcttgctggaattgttgggttacattccctgtttgaacagtgactctggaattgttgggttacattccctgtttgaacagtgactctggaattgttgggttacattcccagtttcaacagtgactagtcatgaactggatatcctagtcggtaaggaggtcttatagtgactcaacttgaatttatgactgcaccttcactgggctgctggaatttcctcaacctttgtgcttgttgcagg

SEQ ID NO: 27967 - DNA, 1501 bp, Oryza sativa
gcaaccgcttaagaggtccttcttaagaattaagaaataagtctattttttagactggtctcttaatggaccgcatgcaataatatattttcgctgcgacccttgaagcacccatcgggggagcaattttggcaggcaatagtagttatggcccgcctacaatctactggccatcccacacaggaaaaattgtttctgtcgtagtgttctctttgtacatatgtaatatatagaattatcaacattggggatttcgatctgcataaataaacaccgttacaccgtcctttacatcctttaattaaagaaggctaaagggtgatcgattacatagatgataaatagtgatccacattagatcccatataataattgtattctttttgctcaagaggcctaatatcctatgtcaaatagcatctctaagctgcatgtgtactgctggagaagtgtacaatagtactggccggttagcaaccccttctagtcccagttgtgctatcggtacgcataattcatgactagaaatgggtacctaaaaaaatagccatcaataaacttcttcaaccgtcggtccgcggtatacatccgttgctagttcatttgcatcaaataaaagaaatttaaaggaagtctgcgaaagtgaaaagaatgaaaaaagctattaataattaaaaatatctgtcacgccccgaactagtcccaactggaactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaaggaaagcggaagccaggactaggaccaaacaacacaggcgcgacttgagaactaggccgaaaccctaaaactcatcgtagccggcttgctcctggaagaactcctcatcagcaggatccgcttcatcttcttcagcaactgggggggattatttatatagagcaagggtgagtacgggagtactcagcaagccatgggaaataagtgtttaatgcaggcttcaaggaaaggctgttgtttttgcaattgattttagttgaactcttttctaaaaacaactaagtgagtgctcctcaaacgacacggatgagacagtgcgtctcgtccggtcggagtatgtgcaatgtatcagtcttgaaaatttaaaacaaggttggcacccggccaacagcttttcaaacggccacccgggcctacaactttcaaacggccacccgggcctagctgatcccatcagctgcagatttttcaaacatcgaacccctttccataacagcaatttcacaagcagtagtcaaacaaactacgctaggaatcacctcacatccgcccatgaccgtgggcacggctgttcgaacagtttgttaacctctgcagagggggtacactttacccaca

SEQ ID NO: 27968 - DNA, 981 bp, Oryza sativa
tcttaagcttcactaaagataacccatgtgcaccagcaaaacgcttggaaatgaaggaatgggttgcaccagaatcaaacaatattactgccggtgtcgagttgacggggaatgtgcccaatataacttctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggttgaactgattgagctggaatctttagtgaactcggagtagggttgagactgtgctgctcactgttgttgtgactgccactatggtggttcttgttgaagctacccgggtggtagggacggtgctgtcggataatcatggtggaaggtccaccgtgacgtcccatcgtgaaacgaggcttctgactcttcccctggggagtcctgaactgagctgccttcctcttacggtttattttgttacagtgctcctcctgacggatagccttatccaccagcttctcaatgtcctcataatctctagagatcaactggttagtcaattcatcatcaagacccgacaaaaacttctcctgcctctcggcatcggtacgcacgtcctcaggggtgtagcgcgcgaggcggttgaactcatgcaaatactctataactgttctggttccttgttgcagggaacggaactctctcttcttttgtgccacaattccctcgggaacctgtgctttattgaaactatgacaaaactctgtccaagtaacttctgccccagctggacgggtcaccatgtagttgtcccaccaaacagaagcgggaccttgcagctggtgtgtagcaaaagcaaccttctcttgctcgttgcattgcaaaagattcagcttcttctcaatggcatgaagccagt

SEQ ID NO: 27969 - DNA, 1501 bp, Oryza sativa
tataggttctagggtcgaccttagacccctggacacgtccctattaaaccccgacacgacgcacggcccaacaggctcaaagatgtgacacagcacccggacaaattctgaatgccttcttatttcgaagattcccgttgactcagaaggaatttggcgtgggaccagatccaaagttggtctcgttagctttccatatatatgtataacgtcgaaatcggagtccgaatgcaacccgacgatgattttagtgtgaactgctctggtagcccgaagtgcactcgaacttgacatgagttggacatcgacatgacttgaacgcccatgatgatcttgtctatctctcagccactctccaattgctccatggtcctctccgtagtttctaatcataattaagtcattaggtagtaatctattctcaagagtacataaagaagtatataggaacgagctcacctgtaaatttattgttgggcgcgagctctagtgattggatcttgcaaaacaacttgaggagtaacgtgtgtatccaaaggtgtgatgtcctcatcacccgaggctgtagccgccgctaccatggttgttgtcgccacgcaaggacgccatcgtacgtcactgcatgatgtcgtgggagagagaggagggtagaggcgatgaggaggaataagtgggagagagatagagtaagccgggagagaggagggtgattaaaaaggggaagcggggaagtgcgggcgcacggggaaaaaatgagtggagcgcaggtagaagagagacacccccacctaaaaaatggatttttataggcagatctcttaagattcccgattataaaaataggatatttttgcaaactggagtcttaagaggcccacccgcacttaaccgaacctcgcctaaatatttttacatgtggatgcaattatggtccacctagagtttggagggggtcttgtccgtgaaatgtcaattatgcgtagtagtgccagttatgaatagattaataagctacaaagagactgtggaagtactaattaaagtaattatacctaagcaaaccatcatatgaactgccacccgttatgggttctaattaaatttgtatccatgaccgaactggatgtataacctatacggctagatgcctctcatatctcataacatcttataatgaagccttaccagctaggggctcaaaactcaaaagccttaacaaaaagggcatctgatgcatagtggtcaatcaggcaaaaacttttcagcttcccaacaggaaaaaagaaccctaaaaatcttatcacaagcaaatgtatggttcgataatgtcatcatacatattattacatgagtatgggatctcacagatctgttcatattaataaattcttctgtgtattgctcttcataatgttacgttgttaattaacacacattattaattagggcagctaaagttagtagaacttcccaccaagatgccaaaaagctccaagcaaac

SEQ ID NO: 27970 - DNA, 1501 bp, Oryza sativa
taatgcaggcttcaacgggaaggctgttgtttttgcaattgattttatttaaactcttttctgaaacaactaagtgagtgcttctcaaacgatgcggatgagacagtgcgtctcgtctggtcggagtatgtgcaatgtatcagtcttttgatttgatcaaggttggcacccggccaacagctttcaaacggccacccgggcctggctgatcccatcagccgcaaattttccaaacatcgaacccaatccacagcagcaaatttcacaaagcagtagtcaaacaaaactacgctaggaatcacctcacatccacccatgaccgtgggcacggctgttcgaacagtttgttaacctctgcagagggggttcactttacccacacgacattactaacccgaatcacccagcccgtgtagaacggccacgtctggtgacctaagggctttcatgacaaggcatttcgagagcagacacagggttgccatatgccgacgagaggggtcccagaccaacaacaggttaggtcccagaccatactgtgccaggaagcccgggggttctccccgacaccaccccgttgaatctacatgtctctcggcatcaaggctcccccgcttagcaatttactcagccaggggtgtcccattccacctatgtggtcgcacttgtcttatgttcggatgaaattccaaggaaacggtccttaagtgcaagagcgggaaatcgtacacccggtacgttccccggtcggcgattttggaaattcatttagttcgcaagcaccgacccaggtgttgggttttccaagacttttgtaaaacccaagttttaccgaagatgttccttagattttaagtttgaaggcgaccgtcgatactcgtgcagagtgcatgaataccgaggctcaactaggtggttacaggggaatatggtataacaattaacaatggatggatcagatgcaacaagttaggtaggcccaccggtctgccttgcagacggggcaaacagattaagtgtaatcctatcaatgcataatattttgcaagcaatataattaagttcaaatataggctcaatatgttcaaaggtggcttgccttgctcgagatcttgagcttgatcctcgaaatcctcgcactgcgggtcttcgggctccgaaactacacgcgaaacgggacaactcaacaaacggcgaaaataaagccctattattgacctctaggcgtgccattagatagatctcgagatttgaggagttttggaagttaaacggagtcaaacggtctttcggttgggaagatattgaatttccaagtttattggatttttggtctaaaggaaaaggatttatttaaattcctttttgaaaaagaaaagaaaagaaaagaaggagggagggaaattagactttcctcgggcggctagggcgcagcccgagagaaaggggctgctcggccaaacttaacgggccggccggccagagaaggcggcccaaagcg

SEQ ID NO: 27971 - DNA, 1501 bp, Oryza sativa
ggaggttgagtcctctgacaccatcgacaacgtgaaggccaagatccaggataaggagggcatccctccagaccagcagcgcctcatcttcgccggcaagcagctcgaggatggccgcacccttgccgactataacatccagaaggagtccaccctgcaccttgtcctgcgcctccgtggtggtctctgagcgtgtgctgtggtgcagcattggacttcattatacctatgccgctcgtctgtcatatcatcgtgtcatggttgtgttgtgttctggtttagagtccctaagttgtgttgatactattatccatactagtacaatttgcttcactgtgcatcggtaccaatcgatgatattatcattctacttctgttaatgtttctgagatgtttgatccgagatgagattctgtttgtgcattgctcacatggtcgtaaccggccactgttgcgcgtgcctgttgatcaatctgtttgcgcttgacggtttctgatgcttggaattggggtgtcgatgttggtttggttatctatcctggtatgtttgttgatttcatgcgcatttcagtctttacggcttctgatgcttggaattctaatggtgttggttgatttcacaattgggctggtgcggtttggtgcctaaaaaaaatgggagtacctatacatctttcgaaagattttgatgatcgtatcacacagattttgatgatcgtatcacacagatttttaatctttgaattaaaatccgatagatataataaaaagtaaaaagtaattaagaaacaccataatggacactaaattaccatatcctcgagaaaaagaccaaatccaataaaaaagaaaaagaccaaatccaatacaaaatttaaaatttacatgcgaagattcaaaaattacagtgtaacttacaaaagttacaatgtaagtttcataaattacactgtaacttacaagaaaatgcactgtaaatttaagtgagaaaatcgagtgagagataagaaaaaatctttcgagtgagatatagcaaaattgaaaaaaaattggtttgggcccaaaaatggttgagggcccattcggccattccccaatcccaaccatcgcgtcctactccagccgccgctgccacccacgtccgtcggcgccatggccgccgccaaggagctccttcgccggctccagcgaccagcgtccctgcgcggctgcagttcaactgtttttggtgtcgtcccctctgtcctatctctttctgcttcttctcttcagcctaaaaaatttggtcattcccttttgtctgctttccaatctgcaaaagcacataattttttcttcatctccattttttcttcttctccatttaatctttcttctatgctattgaatcataacggtacgtttaatttatccaatcaccttttttttcacactttgattttcatgtgctagatggataactgatggtggtatgactgaatttgattcttcagaaggcctt

SEQ ID NO: 27972 - DNA, 283 bp, Oryza sativa
agtcctaattgcttgtttgtttatcagttatgatcagtcacttgctctgacgattcggagggaggatgaatagcggatcacaaaacgagatgattgattcatgtgagatccaagcacccatcttgagctgtattttctttagagttcttgacggtctggaatcctaatgtgttctctttccatggaaaatttttgggcatttcagtttcagagcggcaaggagccaaggatgcagcagcactagggtcctagtccaaattgtcagctgggggatcaatggcaa

SEQ ID NO: 27973 - DNA, 1501 bp, Oryza sativa
atcgtaaaccttctgtctatatagtcaataaaacagttttactggatccttgaatttgctgttctgcaacgtggagtgtatatagcatacttgagaatcattggttgtcactgcattatagttgtacatcatagatcccatcaaatattggatcaattgtgacttgcgagcacatgtgtgcagcgtgagcagttgggctgcaacttgccagggcaaggttagtttttattgatagaacattgaattatatttctcccttttccttgatcgtgatgagatagagctcagctgctaattttggtaaaataaactgcatggtgatgatatctttgaagctcaggcacaaaaatttcatgatgatatgctccacttaaaaatagtttaatttgggttggaaaattaggacattacaataatttctcctattacttttacttggctgaatatatatgatggaattgcttagcggttagtggtatttaacctgaaattggtgcctcggatgatcacagtattttaacccgaatcaattccaatactcggatttcagatcattgctcaatttcagatcatttgtcaaggttggaattgctgcgggatcatccgaggcctcgacacgacataccctcgtctcattgctcagtttacagagtcaagttccaagaaggtataatgcacatcctgcgatcaaaggaatgtctttggttttttaataaaaatgagtttgcagtgtatcaatgaccctatatacctgcttgttggagtatattaattctatccaattgttaattatatagactggaaagaaagttctcttatgtcaaacgcaagactcctcatccctgctcccgcaggccatcgatcccgcctgacagcaaggcctaagcatcgctcgatctacttttctttttacctgtgtatatgtgtttgttgcgttccaatttgttgttctttgatttgatcaagagcagtttgtcgatggttgatatgttccctaggggttcgtattataaatcatgttgctttgttgatcatgtttgtattgatctgtttcaggtaactacatggttgtttgtcgatttattatgttaccaaatgtaaattattgtgcattgcaaagagggtcatctttgttttaaacaatctgcaacttacattgcatatgcgatgagctgtactgaaattcctgactgttttctaatgatatcctatgtgttttctgatgatattttgtttattctgatagatctttttgctgagggagcactggccctagagcaaaggattatgtagatgtgcggcgcatgcagcagcgcaatggcagcaaaagtttatcataatatcctcaatgatcgatctgaaaaacaaagtgtgctgaaatggtagtataagataagagcttgaccatgtaggatgcacttggcaagccttactggttctcaattttcttctgaacggatttgcacatcctgatagcataatccaatgcttctttttcccc

SEQ ID NO: 27974 - DNA, 201 bp, Oryza sativa
atcccccatataagacgggaggataaaaggaagggaaaattcaatcaaatagttaattaaagtattccagaattgacaactacaattcgagaacttgcagcagctccttcaaagtcagatattccacttgctaaactcactcgtgtaatgacttcgattccattaattggaactattcaaacagcatgaagctataaaggg

SEQ ID NO: 27975 - DNA, 1501 bp, Oryza sativa
cacattgttccaatttcaatcaaacttctaattatagcgtgaactactactccgtacttttgtaaagtgcgttggacacactgtggctgctgtaaaggcacttgtgtgtaaaaaacatttctatgagtggggtacattttattcggggataggaaacaatagatgtgcacagttgaaagttgttcaaaggcttaccaaaacaagtgcttcacatttcttggttcatttaaaaactcgaaagttgcatatgaaaatgtatcaaaagttgtttttgctggtttgagtagagagagatgatggatttgaacttagttgaatttgactaggacaataacttgcttttgtttcgttcaaaaaaataacttgcttttgtacggctttagatggtggctgtgttgaagcatcaatattctggatagtggatacaccatttgtttctccctttttccttaattactttccttggactctattgaatttccattaataagtagtaagtatttccattactaaaagttgcatgtcacaagttggagacagtggttatgtaactttttactaattatggattgagattcacaaatagacttgaataaatgagttctccttattttggcttggtttcctctgcttttgtttggtgtgttttattttatctgaactacacacttttctggatgttatattccattatctaaaaattagtgagcaattaatggacattggacaaggtgtgtgctgctgtcctcatcaaatatcatatcgtaagatattccagttcatgtttttgtacatgtaagcaggaggtcacttacattattgtttcacttacaaacgaatcattgaacaaatgcagttacaagttacaatggtgattaaaaaacgtaaatattagggaatgacctaatatcaaataaatagaagaggtgaagcttcgaatccaggccgactaacccatcacatttggagctagccagaaaagtggaaaaatacatacaggaagcaactgtgaaaaaaaaaaggggaaatagtgatgccacaagaactgaacttttaattatctgaccgtggaggcaaagaggggaacgaaaagaacatttcttgtctcatcttgatccaatgaaaacttgcatgtatatattccaaataaacatgaacaagatcttaacaaatctagacaaaaaaaagttcagaacatgcttattgcttcatgagtgttcactagcgtttctatcaaaagagccacttgaaacaagaaaaggaacttatcaatgaaattcatgatgatgacaattcggacttaaaagaaaagagaaaaagaaatccatgacaattatctggctttttctctctccatctctagacacaagaacaaacaaacacatgaaatgtagggagggaaaaagggccaaaagttcataaacagcgaaacaaagtaacatgtttatcaacagttcataagaacctttttgctgtcaagctaatcttctccccgacatgt

SEQ ID NO: 27976 - DNA, 554 bp, Oryza sativa
cattgagagtagattgaggaacacaagaaaagagagggcaatcgtggctcatcggcgctggtgacggtcgtcgtcttcacggccggcgacgaggttgagatggaagaggggggctgaagttctccccctcagtttcttcaactcaggagcgaacatgaaagggaaggcgaggcagctaggaggatataaaggaccggtttagttcccaaattttttctccaaaaaagtcacatcgaattttggacacatacatgcagcataaaatatagataaaaataaaaactaattgcacagttaaaagggaattcccaagacgaatattttgagtctaattgtttcatgattagccataagtgctatagtaacccacatgtgctaataatggattaattatgctcaaaatattagtctcgatattttcaggggagttatgaaattagttttttcattcatgtccaaaaactctttccgatatccgatcaaatatccgatatgacaccaaaaaattttttttcgcgaactaaaccaggccacgtgttcggcgttgggcacga

SEQ ID NO: 27977 - DNA, 1110 bp, Oryza sativa
aaaccgcgtggtaaccacgagacatacccgtggttttaaaaactgaaaaggttaccgtgcatggtaaccgcgcggttttgtaaaccctggtctctcgtcaatttagtcggtatggatggataagagccacatgcgtccgttctctctctctctctatctctttcttctcctcttctcccctcctccccttggctctctctctccatctccaccgcgcaggagagcgcaaccctagctacagcgcatgcaggggcttgtcgtctcctctctttcttcttctcttctcccctcggctctctcgcaccctcccctcgcctttctcgcgcgtcggcggcggcaccctccataggaagggaggcgggggcggcagcggcggcgtctgcgcctcccctccgccagatttggccgggagcggcggcccggcaggaggggaggcggggacggagggaaggcgacggcccggcggcggcgaacgggagcagaagcaaaaatcttgtgttcatgttgggttcttgaagtgaaagtgaaattgctcgatgcatcggctcgatgcgtaatggatttgtgtgaattttattccttttctttttctggggttatcagtcggtgtagttcttatatttgaaagtgatgattgctcgattgggcttttaatccatctttgattttgtgatttgcccgccgtaagcgattaggattttgaatcgatctctgattcttttgtgaattggccagcgtacgcaatgaactcatacggatacggacacaatcagtgacgacgcgcaaaatttgtggcaaaaacatcttaaacttttataatagataaagaataatggtataaaataatagatccaccaatttaaatgaaaatcgacggtaagattatagaatgccacgtggcaatctgggagtgcttgtagaaacgccacatgacggcttagaaacatttatagaaagattaatggacttttagtagataatagatatgattaagtggagccaggtcttatatatttctagtttcttgatccaatagttataattctagttccagatattggctccaggatggctacggttcttgccgtgatgctgtcggcctgtcgcagg

SEQ ID NO: 27978 - DNA, 244 bp, Oryza sativa
tctcctttcagaacttttccgcaccatgttacataaatatcacaatacttgatgttcctcctctggagagcaaatacgacaagttcttttactgccgttgtattgaagtttgtatggaataaaagcttctctccacatatacatacaaacacctgtgaaattcacaaaactacattcaagctatgcaagcagcagataacacaaagcactcacattacataggatttctaaaataaacaagcga

SEQ ID NO: 27979 - DNA, 1501 bp, Oryza sativa
  unsure (1)..(1501): unsure at all n locations
cctccctgtgaggagctgccactgccattgcctggttgggccaccactgtcgcctcctccctacaaggagcagctgcctggctgggcctccttcctacacggaactgccgctgtcatcacctcctcttcgccgcctggctgagctgctattgccttaggtttgggggcatgaatttggatttgggataggaaaatgactcaagggtattgtttgcatatggcaaaatctccacgggtagaaaggttaactgttaagttgaaataatattatttcttgttttgttactttttagtttagcaatcctggacccactaacttctataaaaaatatttgaaaagaaataatgaaaaccaaaaaatagggaaaaacaatatcggaatcaaagtagcagcaagaataaaatngtcccaattcaatatgatggatgaaatgaaacaaaaagacgattatatcttgctcgttcaaaatgctatgtgatgcacnaaatatgaannatgttcanaatcacactacaatatgtaagtaaaaaaaatttaaaagccctattttaatctggttgtgggaacttccattcgaaattaatttactagctgattttgattgcattaatacgaactctatacttatacaagtaaacattggtccttattgtaatacaatggttgacatattaatgaagtctaaatagttcttttttttaagaaataaggttataggacccggctaattgttaaacatttatgtccccttaatgcacatctttataaaattgactaatgcgtgcatgcagtcaagctttacaaagtttcgcaacgatcacaaacaagtatcaacatttattatatgacattgaattattactagcctttagggcttaattgatcatcctcttatatttatggcctaaaatgtaaaggcgcaacagagttttgaaagtaatctacgcgtcttgagccaatccatcttcttgatgattttggtttagcttatagcaattatcggtgcaaataccatgtgtatatggaataacatgaccaacagtattataggtggcaaataacaattaacatcggtaccattagttgtggcatacaaaatcaaataacaattaacatcggtaccattagttgtggcatacaaaatcaggaaaaggctccagggtgttggtctgaccggctataggtagcccgatctaaccagccaggtacttggtctgaccgacggctataggtagcccgatctaaccagcctggtacttggtctgaccgacagttagtgagatggttagaccggccacaagaggcatgatctggccgaggtagggcgcagtctgaccagtcatgatgagcacggtctgaccaatagagggagcggtaactattctctcaacgaaatgtgcaaaggaattgatttccttccagtagcacagaaggaatttatccatacaaatatcatcatagagaaaagcagtacaaaatgatacacattgccatcagctg

SEQ ID NO: 27980 - DNA, 255 bp, Oryza sativa
aattccattgtattttgtgttggtatcattaaggtttttattttggctgcagaaatagtataaccatactttcatctatatattcaagctcttatagcagctgatggcaatgtgtatcattttgtactgcttttctctatgatgatatttgtatggataaattccttctgtgctactggaaggaaatcaattcctttgcacatttcgttgagagaatagttaccgctccctctattggtcagaccgtgctcatca

SEQ ID NO: 27981 - DNA, 1501 bp, Oryza sativa
aagacagaactaggacaaaacaaaaatatcaaacgaagtttcatacccctccgtcctccgccgcaatcttgatgatgatgagctgaattcactattcatgccactcattttgggaatgttgtgtgcatagtataagcagatacaaggatatgttatgtgtggtagcttcaaggaagagaagcaactttagacaactgcaaagtattgtgggtgacgaatggcaacatggaactttagtgtgttggattcacaggaaagagagacggctgcgaacaaaagaaaagggaaaccgtcgacggtgactagggggacaaggtaccttcgaggaagatcaacagatgtggtgaaaagcacaacagcatggtggcatgaaatgaggcacacgtagatcaccaatacaagggatttgggaatattaacaattgtgaataagatttcgatcaagagagattttttgcgaaattggctatgcccaaggaccccttgcaatgagaatacacctggcatgccacatctctagactctaggatacaatcatggcaaacttggaccttcaatggtacatttaataaaattagaacgactaaatttgcaattttaaagattagagattgggatgagaccaccaaacatgtgttgtagcagggaccccgcacctcctccgatctagggaaagccgaaactaccatgtatgtcctatttgatttgaatatatattcaggagtcaagctagccatcacacacactcgaatcaagaagttttcgaatatcatttggaaacctagtcattcgagaaagccaatagggcacagttttgaaggaggtacttcgaggagccaagcctaagtctggggaatcaagccggctcaaacatgtgtttccagggaccacgacaaaaggagcggcaccagcttgtaggtgtggccctgagctcgacaattggataaatgggtcccctcataaaggccagaatatacatctgtaccctttgcatgtgacgtcctttctaggcactaatgtaacttcctaaagggggttggatggcctgtaaaagggcagcttgtcctatcaggaggcagatgcattctgaacttaaaaaaaaggctagcagcgatatactaaatatacccatatacctttcggatacattcattactcaagataggtaaggtcaccttatttcctcctctatcttctacttgttaacgaaattttgtcacggcatatattggcatcgttcgttgggagcgtgagtggcctcgaaaggtagatgaaaccaagacctcaacgaagataagtggtaatagcgagatatgctgaagtgttcggaaaatcaccttagtcacctgaattcaatgttgtagaagcagaggagccgaatttgagaacatgaatgatttcgagtaaggtgcaactgtcaaagatgaagagcagaaagctgaggaagcaagagtcacaactgaagtggcaagtggagtgctagcattgagaatggaagcat

SEQ ID NO: 27982 - DNA, 155 bp, Oryza sativa
aagtactcagttggcgccggcgatccaatcaggatttataccaaactaaacgaaattgaagttatacaaaaaaaaaataaagtcaatcgaaatggttggcgacatagcaaggattagccgtaccttctgatgtgctcccatatttcaaaattagt

SEQ ID NO: 27983 - DNA, 1501 bp, Oryza sativa
tttctcccctttgcagtatcatggtgatacttcggggcattgcgacatgtgtggaatcgtgtcttgtgggtacagttgtacacctctggccagcgtaaaactattcgaatagccgtgcccgcggttatgggcgatcaaccagattcaccgtgattagtctcacccctagcttagcttaatgaactggtgtagttcaggtggttggttgggcctattgcaacgtggtgtagcgttggacagtgattggttaatactgcttaattactacaattgttttactgctttcaactacttcttttaaatgactactttattgcaaaggaaccccttagcctcctttggatatatcctgcatcatacctcctcttccggtatgacttgctgagtacagtgggtagtactcagtcttgctctcttttcccccacaccagagctgaagatcttcatagttggagccgtcttgttgaggttggtttcgtcgctgccgtcaagggatgcctgtggagtggagtcgcctcgctgcagaattcaagcttccaagtctagctcgttttatctttttccgctgcatttgtaatcttttctatttttgtaagacgtggatctgtatgtcaacaattgtcgtttgtgtaccctggctggtcctggacaggggtttaatgcacattcagcttagaaattctggttcgtgaatttctgggcgtgataagttggtatcagagccgaccttgaccgtaggacaagccaactggaaacctaagagccctctgaacccctttttcatctgcatatgctctttgcacttggatttgtttcgggaaaatttggggttttgcctctttggtttgtgggaaaaatcttggtcgttcagatcggatctttaaaattagctcagtctagggttttagaaaaattttatttggagtttattcaacagtcagtcgggaatatatcgggtgatatgcactaagtcgtgtctatgttcgatggggcaattttgtgcgtatcattataactatgcatctattttatgcattaatttattgtttagtcagttgcattagtatcttcatctgggttcatgaaaaatgttccatgcataaaaatcaccatgctcagttatttgtttgagtcatttgttgctttgtttatttggatttgagcatgcattggttcctatcccttgtccatcttaggtgttagacctgttcctcgatcgcaagcgccgctccgagcttcagagtcgccgcccttagctttatcgtctgcttagtctatttgcttgctagtttccatgttttaggtttgttgcttgtgggttagtcggcggtcgatatcatgtgtcagtggtatggctgccttaattaggagttgcgtgcctctttttcagtgttttaataaagattaagataattgcacttaaatttataagaaagattagtttctaagccccctgtttttcttcctttcctcatatttctacctatcccccttcagatgg

SEQ ID NO: 27984 - DNA, 1485 bp, Oryza sativa
tttgcaaagcagtcggtatatcactcggatcatgttgatcggggattcacaccgcatatactatatattaatattaagtcacttggttggctacaattatcgaaatcactcggttgtttggtgttgacggtccttaaatcataatatctgaccatcaatacctgcatataacgaaataaaacatggtatccaacgtagtggtaggtattattactaatcatttccactagtgttggtgaaatatgtgtatgcgagtattttgagaagaaaacacatccgtcaagcgacaaactgcacctccgcgcattcaggacacatttacacggattggaggccccataagtcaattaaacaactccaaatgggcccaactatcatgccaatgggctgagggcctcaaaattagtgtccacaacgaaaaatgggccgaatggagccgtcccgggttcggccgaacctccagtttggccgaacgattttggtagccgttgatcgccaaatttcacgtggacggtcctgatcacatcctaatggcggttctggggtagtttggtcatttcgcataggttgtaaccgtcatacctgcctataaaagaagcagctcactctcatttccaacacacaactttgacctgaattacaagaggctttattgtatcttttgtacattagaataaggtagagagtaaggggaagttctggaggagtgcccggaagtttggcgctcatccgacttctacctcaaggagtgtagcttcctaggaggaattctggaggagtaccggagccgtcggtacactctgcttcgggttcggagaacttcttctataaagtaagcattcgtgtttctttcttatgttatttaattactttgtctaagtaagatagatatccatctttgcgggttcattgtttagtatttatactaagtgctctagtactaggactccagatagagaaggaagctcttgcgcaagtattagagtagtaattaataacttagacgtggtgtctagtttagagattacctttgttagttgtgtatcccacggatttgttagaggtagttggcaggtggtgatagccctgaatcccgtcctagtaatcctccacgttcggatacatcatagagctatagccggaaccacgctggcagacaagcaggggtcggtgcctgaagcaacagatagggaattacctttacttagcttaaataattaaaaatacatagagagtcctctctagcgtgcctaccatcagttgctgtccttggatagtctcagccttaggtagattacacacattccctgagttcgatatctttttggggtcacctgaaggtgaagtgctacaacggtattccgtgcgcttgcggatttatctgtggtcgtaagaaataccaacaagcatttttggcgctgttgccggggaacggttgctaatttatccgagtctaggtcatcctcatatctttatttttacttc

SEQ ID NO: 27985 - DNA, 201 bp, Oryza sativa
tcccctctttttgaggctggcttggaagccctagctcagccgagccgagccgacaccacaagaggacggggctcgatccccttctccgcgcaacgccttgccacgcggtcacacatggcgccacgctcccagccccaccatcccttccgacgcctaccacgcccatctcgccggcgggctcgcccttgcccttccccaagc

SEQ ID NO: 27986 - DNA, 502 bp, Oryza sativa
ctccacgtggcccgcgacgccgtctcccccgcctcctccgctgcccctgccgccggtcgtctccttcgccgcaccccgccgccgcgctcgcctcctccgccgcaccccgccgctgctcgcctcctccgccgccgcctcgcctcgcctcgcctcgagcagcgcgagctcccgccgccgctcgcctcctcctccgccgttgccgcctcgcctcacctcctccgccgcacccctccgccgcttgccgcctcatcccccgccgctcgcctccaccgccgccgctccctgttgcccgcctgcctccatgcgcgtgagtgagaagagagtgagagaagagagagagagagataagagagagaggaatagttggatgggagtatgacaggtgggtcccacatttttttaataaataaaatgctgactggactgccacgcgtatgccacgtagaccaaaaccaccgcggattaggtcgaggggggtaattcgtccggtttgcatagttcg

SEQ ID NO: 27987 - DNA, 231 bp, Oryza sativa
tctgtattgaaaatactattatattttgctataagcttggtcaaacttaagataaatttaactaagaaaaaagtcaaacgacttataatatgaaacggagggagtatttgaactagaagtcccctatgcagtacggtaatgcttaaacataataaattaaggaaaaagtacgaattaccccccccccccccgaactatcgcggtcgtctgaattacccccctgaaccacaa

SEQ ID NO: 27988 - DNA, 370 bp, Oryza sativa
tgacaccgagggatgttatattataacaatgattctggtgatgaagatgatggcggcacaatttgtactatactgatgaatttatgctgtgcttgatatttcgaacttactcctaatttcttaaaagcttttgtcaaaccttattgagcctaaaacccacaaaagttattaaaaaactttcaattctcattgactaagccaaaaaaatcaagcaaggcaatgataaatcaagtaagcaaattgaattgataaaaatcacactccattattattatagtagcccccgactgataactcaagggaaaacttgatgttagcagtcaaaatagggaaatacaaaggtaatggctaagcataaaaacgaccaaga

SEQ ID NO: 27989 - DNA, 287 bp, Oryza sativa
aaaatttagagacttgaaccaactaaatcggagctaagatgaattagttatgaatttttaaagattaaatcggattaaaacacttatatcggttaaaattgaattatgacgcaataatgaattatttttgaaaaggaaaagagggtttattgcgtcagcgggctagggtttggtgaaccgggcgcacgggcggcggttcacacgaacggacggccgagatcgaaccaatccaaaacggacggccgagatcgatcgggtccacggcggctcacggcggacgaccccga

SEQ ID NO: 27990 - DNA, 376 bp, Oryza sativa
tattcacctatttgtaagtagtaaccatgccatcacaattcattagaaatatgagatatgtcgttccctatactgtaaacgtcattggacacatgtatatgccactatatttttataacccaaaatgcccctatgtacatttatgtgggcctcatgtgtcataacctttatcaatcttcgagcgaggagtaaccttgctggcgatgtcatcggtctactccttagcatgtgactctcatagcttgtcgtacaccgttcgcagctggttttctttcatgattcagaggcgagtgagcaatcaaactgcgtcgcaacaaaagctggagaactgaaaaaaatgagggaaatcggcaaatggtagcgtgacataagaaca

SEQ ID NO: 27991 - DNA, 724 bp, Oryza sativa
aaaaatagcttagcttggctgttggggttaattgggataagaaaatcatagcccgcctctttcccttcaaggtaagcattaggcggctgtagttctacgaatataaacagccaccaacagagatatttctaaaaacaatccatcatgaaagttttactctcaaagttaataatagaaaaatactacaaatctaataaaaatcgacacattcaaacctagctagaagcgttatctttataaaatcagttatcttgtcttacaataagtcaacaatgtgaatgtaatggttttcacacctctatgatacatgagcctattatggtactatggtaaacatgctctcacaatgtcatcatctgacgtgtcaacctctcctatcccacgttggatctggtgtgctttgttgtcacatgccacatcgaattcgtgccacaccggtagtgatgaatataattgttaaatacggtacacaaaaacaagaaagctattagtacataattaattgagttttttacgatatcaataccccgtttagcagtttgaaaaaaaaacgctaatgaaaaccagcttaaaaaaatgtctaaaaccatccaaaatcgagagagtataaaacccccattcccaccactccaccaaccaccgtactatagccgccacacgacgcggccgtccctcctcctcctcctgctgctccggcgatgtcggcgtcggcgatggtgccccc

SEQ ID NO: 27992 - DNA, 1501 bp, Oryza sativa
ccttacttgtgagggctgctggttccattccaattatttatgcccttggcttgctctctctctctctcgttcatttgagccttgcttcctcgattcatctctccacccgtgtttgatttggatttggtgtgtgtgtgagagtgtggattcgagcttgtgtgggtgcttcttgtggtctttgtgaagatttgtgagcacttgcatcatctccgggagttctttgcatcatcttttacttttggaggttgaggactcctagacggctaggtgtcactcccgagccaccgatctacttgtggttggccgggagaagtttgtgaaggccggatctcgccttcgcaagggaagagatacctcttagtgaaaggaggagtgcttaatacaacctcttgaggaaagggttagctaagacccggctcttagtgagctcctcaacagagagtagaatcccctcaaggatttgaactccggggaacaactttgggagctacatcttggtgaaatttcttcatccctctcctctaactttgcttgcttgtgccgctattggtctagttgctgattgtgccttgtatttcctgttatagtcttgtagatctagagttttcattttgtgtgtgcgctgctctgtgcattttcggaagttccgaaaattcccagcctagctccgaaaattactgcttccacatttcttaagttttaaattagcctattcaccccccttctaggcctaattgaccctttcaggctcaatttggtccttcacgtttcattttgtccacatagctcctccaaatatttgttttggcttgaaatcatccttgggcccatttaatatgtcatatggctatttttagtcaatatttctattaaagaatatcatttttgcccttaatttgtatacaactatatactataaaagagaaagtcaacatgaataaatacattacagatgtacttctcattatttcaacatgtgcacatgaaacttaagcaattgttatcgtgtacacttgctagtacataatttttttttgttttacataatatactatgtattatctataaaaaatcaagcatgtaatttttctcttatatatgtgaatgattatgggtataagtgttctcttataaatagagttgttaattcaaggataaatttgaactaaaatgaaaacttgaaggattaatatggatagattgaaacattaagaactaaactgagcctcagatgaaatttggaggaccactttgactattcacccctgttctagtaatagcataatttcctttcatcttttgccattttcgttgatggaggcaacgcaacgcaagctgcatctaccgctttcttggactgtgttctctcctctatcctattatctattcaatctatttatctccttacctgagctataatgccactactgcgtctgcgtggtagctagctcgcgagccaagaaagcccctacctcagctaagctgccagcccagcctccca

SEQ ID NO: 27993 - DNA, 1286 bp, Oryza sativa
tggatcccctttttcgaatgtgaactgctacagcggtattccgtgcgcttgcagatttatctgtggtcgtaagaaatatctacatttggtttatttactccttgactatatgtttagtttgttcaactaaccacatagttaggggctacacctattaggtgcatttagtcgatgcacctaagtttacatttaattatttttcagccctctacactcttcagatctggtaaaagtactcgggagaccatagcgaagatgattgaaacacttagctttggagtaatctagttcgagagaagattatctttttgactgtgaaggtctcaggggctactgtgtatattgtgggtaactcctacccacacggcaaggttatctgactaattataagggatagcttagatctatggaatatgtaacggatcataacttgaatattacgtttccttgtatattacggaacggcctaaagtcctggtttgataatagatttaggaaacccttaccgtatttgttaaggtttttgtcgtgtaatcctatccccccaccccggtgctatataaggcaggcaggaggccctctacggcatgatttcacaaccagatcgtcagatcaatactacaccaggtggattcaaatccccaaacaggagtagggtattacctctcattgagagggccagaacctgtctaaatctgttgtctctgcattcatccagttttaggtctcatgcgctaccccctttatattgctgaaatcttgtttcgacactaaagatactgcaattctgagtccgtgaagtagtgcttcatactcaccacattatgggaagctaaaaaatgaatctacaaaacatagctaagtcgttctccagtcggggaaatcaatacaaccccagcacctgtgcctaatattctcttcgacccatcaaaatgcatagtctagtactccaattttcgaaggcgtgtcttactagcacttggtccactcggcaacaaaatctggcaaggcttgaggcttgattgaagtgggtggcttgaatgatatgtccaaagacatcaactccaaagcgcactttgcaatacgactagtcgcctcacgattgtgaagatatctccgagtggaaaagatgtgaacaccatgactaagtgactttgaaagtaaagggccaacttcctaatggtattagaacaccatataacaacttttgtacctgaggatatcttgtcttggaatcggccaaaacttcactaacgaagtagattggtcgttaaactttttgaaca

SEQ ID NO: 27994 - DNA, 413 bp, Oryza sativa
tcaccatataagatatagattttataattattgcaccatgaaagttttgcttattagtaattcggctaatgtcaatgggcaatgtgatgatttattctagagttgttttctttagaaacattggcattattaatattttgcatacatgctcaagccgattacttacatttgtagtttattggaattcatgtgtgtgaggcatatgactttggtgattcattattcaattggctaagtgttttgatgccatgatgattattgtttcaaaagccatttgaattagtattcatctagacatgttagttggatgttatagtttttcatatgtctagagaggaggaattttggtccaataatttgatacaccaagcatctggctattatgtgaagaaaaattatatactaaaggccga

SEQ ID NO: 27995 - DNA, 455 bp, Oryza sativa
ggagccacatggttcacaagatcttgtgagttgggtgaaaaggatggcattttcctttgattccttcagatggaatcaaatggggagaagagtttgattaatcgcaccgagggagatggcagcagggcaggagtagttgattacttgattgcagtgtcatcaactcattatgatcaatatactatttagttaagccagatccagcctcttttgtagtacagggtaggaccaagattgttatggattaagaattaatgaggctacaagtacatccaagtcgcccttgataagatgacagcatctctaaacaagtactagtactactctagtcttagtttgcttagaaccaggtctttccaggctatgtaaatgaaaatatgcgtaccactgttctcaaactatttttttaataaaactctctacatcaatatttgcttagacaatttgttcatgat

SEQ ID NO: 27996 - DNA, 286 bp, Oryza sativa
tttcattgatcaaaagctaatttattatcctatttctcatcgcctttgtttgttattcttctcttgtttgtttggcttttgtgaagccatcccttccttccgtctttaaaggcatcgctgccgggcggctgttagctgaatcgatcgcaaggaaagacaaaggaggagagttcagtcgacttgggatcgagtagaatcgccggcttctgctgctattgcggtactcttccttccttgaatgtcgtttacttctccaggtgcatagcatagcttttttttttttttt

SEQ ID NO: 27997 - DNA, 172 bp, Oryza sativa
tcaaagtactcagctgaagatcgaaagttcatgattggtgtaggaagctgaatcgttcctatctttaacgttgctgccgcttccttctcgttattgtcggcacccgcccatggggtggagtcttgtgggcgttctgattcagatattttcccattcagtatcagtgcagcag

SEQ ID NO: 27998 - DNA, 1202 bp, Oryza sativa
ttacattcacattgttgacttattgtaagacaagataactgattttataaagataacgcttctagctaggtttgaatgtgtcgatttttattagatttgtagtatttttctattattaactttgagagtaaaactttcatgatggattgtttttagaaatatctctgttggtggctgtttatattcgtagaactacagccgcctaatgcttaccttgaagggaaagaggcgggctatgattttcttatccaattaaccccacagccaagctaagctatttttgtaacctgttactaccttcatcctgaaatatgagtaattgacctataaatcaatcatgcatccaaatcttatcaccgtcatagccatcgaagccaatctgataaagactacgccacactagtaagggaatattcaatatggggcatccacgaaggttgtgacatctaggatgatgtcattgcattccatcctgaactaggttttacgtggagagctcaccttgagacacaaaggtgatagagagggtgaacaacatctgaaagaaaagtatgtgccatctatagacgtcacgattttggtgcttccactagcgttggcacccttgacctagatcgtagcatgtgcaagtgcaacctcctccaccctctctcgtgtgtgattattatgacgctaaaccaaacgtaccatgacaccatctagcgatttttcttatgcgacttccacttagtatattttttttcttatgtgagttacacttgtacataaatgttacttgtttgtaaacttaaaaaatacatgctacaagtccaaaaaaaatagcaagggaaaatccctacatccattaatagaaaatgaatggttgctcttttcatgccgtcgggaatggaagaggctcacgtccctctgactttacgtcagaggagctccgtctgccgggaatagccctttgtaccccattcttttcctttgtttctcttttgtatttggttgtgagttggctttgtgaggcaatatcctttaatcttaatacaaaaatacgtaaatcatttgcgtattttgtaaaaaagaaatagaggttaccagatccagctaatgagagataaaactaagcacaatttctttttttttcctcatcctaacaaccgatcaagagggtgctagattgggatgaaaacggagcggatagtttccgtccgatc

SEQ ID NO: 27999 - DNA, 259 bp, Oryza sativa
tgcaaaaaaaaccttaccaaattttggtaatgccaaattttggcaattatgccaaaattttgataagatttcttatatatttatcaaattttggcagcaaactaaatgtagccacttttttggcaattttatcaaaatttggtaaggttggaaatggcatcaaagtgaacaggccctgtataaacttccgataatttggtcatcacgccacgtcgccacacaagccagctcgctccaagcatggcgatcgttgagtcat

SEQ ID NO: 28000 - DNA, 1501 bp, Oryza sativa
tgctggaggtccttgtatatgctcttcatcgttggatccattcgcttcttgggtttcttcgtgccggttcttgttttcttggcattgctttgctcatggaggttcatgttttgttgatgcattgtcatggtggtggatgctgcatctcagccttttgcatgattaatttcagattgtgctttcctttctagtgcagtgctgctgctagcatcttacaaggtcattaaactgtatgatggggggattggttcaattaagtatctcgttgattctcagagttattttctatatggaaaaaaatatgtttgctttcttttatggcaaagcaattcacaacagcaatcttatggctatgaaatactaggtttaagtgaaatcatatttattttgctgatttgtgatacttagaagtaaccttcatttttttttttatccagatggctatgagaatgcctctccagagccgtggtgacagatatctgtcgacagggaggacttgagaatctgcagcacttcgtcggctcaacgttgatttgttttattggcgttgtcttgcttgttggattcgtgcatgcgtagatggatcattggccttgatctatattgtcgtattagtcttggcatcaatcttcatcaccgtatccttcagtggtgttgctgttgtgatttttttactggagctgttgtgatctttaattagttctgtttattctaccgatgtaccacattgcatgtgtgatcacatcattgatgtaataccgaaattaatttactcgatcaaaattttttaaatctaacttgtgagtaattaatttactgataggaggcgggctataagttatgtctacgcatagagtaattcatctactgacataagaccaccagaatcggaacggaattcttgctagattcaatatgttatgtctatagtaatttctttacataaaagccaaaaccaaagaggggaatggatcaatatgtttcgtcgacagtaatttctatacttagaagccaaaaccaccaaggaggggaataaaataaaccgggagtaatttctttacctagaagccaacacaaaggaggggaacaaaataaaccagaagtaatttattttactgaagaaaatttcgtggcagccaacaaaataaaaataaccatcaaaaataatttatttaccgaagaaaaattcatggcaatattaatatgttgattataagtaacagaaaattcgtggcaagattaatatgttgattagtaatttatttactaaaagggaagagaagcagtgggaataaaaaaaaaggtgggaacggaaggggtgggtggcggttggcggacgagagggaagtgggggtgggagcagacgagagggaggtggggtgggagtgccgaccgggggtggggtggggtaggttgtgaggggagcattttagttattacgcagcctgggtgcggtttagcgctgccccacatatatatatacatatatatatacatatat

SEQ ID NO: 28001 - DNA, 1501 bp, Oryza sativa
actcataacacaaagaccaagaaaatatttaatcaccttcttggttggatcaccttaatgcatgcaagcaatgtgattgagaggtttgatgatataagatttaaaacaaatcaatgttataagaccaagagatgctagttaatgtatgcatgcatgcacgccttatattatgagacatgagagaaaaatggctgtgccttatattttgggatggagggagtaattgcttagatgcggtgtctaggtagttgatctctggtgtttgctccgtatcccacagtaggtgtgagatgggtgtagaggtggtgacagccctcaagatcactaaagtcctctctgtccggatacatagtagagcgatatctgagagcggtgagctggccagtgtctgaagtatcacgttaggattaaagttaagctttccgtagacactgtttctcaccggtgaatcctctctatcctttgcctatccttagctttgtgtctttggaagaacctggtgaagagctgacacacacgttcactgtggaaatcgatacctgagactactcccgggtgaagtgttacatcaatatttttcgtgcgcttgcggattttatctgtaaggttaagaaataccaacaacgggcactcctctacgtgccctccaccactaccttccgcactccttggcgagctccagctccaccctcgccatctccgttacgcgctccacatacgcccgcctactgcatctgcgtcagtagtagtagtagcagcagcagcagcagtagcaacagcagcagcacgacgagcgtcgctcgccgctggtccacgttctcgctcgactcagtcgccacctccatgccctcctcctccccgtcgcgctcgcaccacgtggctggcgtcgcctgggcgcccatccgctctgccgccgcgccgcttggcctgcgggacttcaccctcgttcgctgcctgggcgccggggatatcggaccgtctacctcctccgccttgatggggaacatggcagcagctcgctgtcgctgtcgacctgtcgtcgtgcgagtatgccatgaaggtggtggaccgttgccacactcgccaagaagggcaagctggagttctaccctggtggcgacctccactcgctctgccaccgcatgctcgatagccgcttccccgtcgcgccctccaggttttacgccgccaaggttctcttcgcgctcgagtatctgcacatgacggccaggtttaggtccagaggtatacaagcagggatggcctgtaggtggtggaggccgcgaatggcccgagagaacggggaagaagataagggcaaaacaatcattttatgtggtttctctctcatcaatttaatggatattatattttaatgcgtccaatgtattgcagcaaagtaccacacttttagagtttcctcggtcaaattctcattttgcaatatcccacagctaattacatatatttttttaatatcctatagcaaaatttgcatatt

SEQ ID NO: 28002 - DNA, 429 bp, Oryza sativa
aaattgaaccgatataaacagccgatattggtaaagagcatctccaagagaatcttgtccctaaaagttaaattttaagaattaagggtaaaatcaaccctccaacaggtttccaaatgaggccccccaatatttaggtacatctaaaatccaaccaaatagtagctagttttggacacctgcacgcactcgagaaaaatcagtttagtagggccaaccagtgatgacatgacagattttaaagtttttttaatcaagtattggatattcttagagatggagatgatttttgagcccgatatcttttggatactcccaactaggggtttgagagctatttggtttttaatataccttcccatgtagagttcgccacaactgctttatatagagttggaagcattgactgatcttacgtatagatggcca

SEQ ID NO: 28003 - DNA, 1501 bp, Oryza sativa
ataaatgaaataataatttagcatttatttcctacggatattctgtcaaaacgtttaattatcctttagtaagtgatgacatatattactacctactatactcaaccattggttcttctagaacagatggcctcgaatgacttgggaataccgcggctaccgccccaagaaaaacttgtactttgtacatgaaaattgttataatgtctttgtttctgatctataagaagttagtaatgacttgaaacattgcaattttgcagggatgaggttacagtggggccaccgtctgtacttgattcatactacagactactgaacttcaacaatggtcttccgcgcgaccacccacttattcatgtccaaaggaaagcaattgcgcgcttagcagtgatgttttgtgaagccgcacgcctgagatcagtcagagcacttgtctatcaccaaatggacctatatgtgaatggaaccatcacaagcctcattacaagaaagagaatcacgagctggagcctgatatctgcattcgcattacactgctggagacgggagcatgatggtattgaaggatatcttcaggaagagcttgacaagcttcacccgatcgacatctatgatgcaaatcttgtcgcgggtgaaccagatggtgagttgctgctcatcctttacagagaagaggcgtttgctggcctgcaacagcatgcgccggagccgcaactgcagtgactgcaagtaagcactcaacaactagccagtacaaagaagatctacaggcaacacttacttctgcaagcccgaacaatctaactgtcaacgtagcttgatggatcagaacagtctttggagggagaggatgaacttttacttcctgtactttcagcaatgtctcttgtgagggagaaggatcggcctaatccaatgtcacttactcaagtgggggaacctcccttctcgtacttgctgtttttttctcctcccgttttcggtttctctgcagtacgtttttagctgtactacaatgatcaggagctccttaggaagaatgatgtgtaatgcggcgcttctgaatttggaagagcgatcctgaatgtgccaatcaacgtactttcgttctgaacagacagacaagtgtaggaatgcaactcttcatactgttggcacatttgtccttgaggcacattttacagacagacaagtgtacggctgtctttctcatgagttcccaacttatctttcttgttttttaagtttcgcaagaagtttatataggaaagttgttttagaaaatcatattaatacatttttaatttttttatagctactccctccgtttcacaatgtaaaacttaattaatcatacgttaatctatcactccatcattttacgtgcagaggggaggggcaacccctccaaaaaaaaaaacacagccaaagcagcttttgaaaggaggatgagcgatgttagctgcaataattaggaccattggatagacctggtaaa

SEQ ID NO: 28004 - DNA, 1501 bp, Oryza sativa
gcattttccatgctataacaagcgtatttgtcttaaaatatcatgatgagaataataattagagactttatgttactaaaaattgtaagtaaaatttgttttttggaaaagaaaattaatccatagttttcttaacttgctagctcggtcaatccctccccatgggaattaaaggagatttggagatgattaattccacaaacctattgagtgtggaattaatagtttaataccctctcaatcctctccaatctcttcgtcatatgaactaagcgaacaagcccttaacatatccaaatgtgcagctcaacatgaaatcctttgctaaaactaaatgaagttgcatgattcattgttccgagaatctccaaaacaaaaaataagtttagatacatcactgagaataaaacagatgataagtagcacatgtgaatgatactctgtgtcttctattgacgtatgcactttttttttcttcttaagaaaggcaagagccctgctttctatttaattgtagaccgaaagaattgctgcacaggccaacctcttggggagccagccagttctgcaatattttgttgtgaaacaatttctggttctattcactgtagctaaactgtatcacattttcccaaagtgcacataaagattgaagtattaattgaaatgaaatgacattgttttgacttttgaacaagtgcaagtgcagaaactgaatatccttacagttgctcatgcactggatggatccttcttcttgcaggaaataccagttctcaacatcaacgtggttgatttgtccagtcagaactacaatgacctcatggacgatattggacaactttttcagcagagagcacatcacgatttcaggaatgttcctataacaagcaatgaggaggggtggcacataatatctcttgacatgcctgaggaaccatctgttcagtgatggataagtctttgtggtccttggtcgtgattcttctttttgcttttggatagtttcacctttttaggatagcatctacccctttagcatatttttcagttgctaggacagctgcggttagtaggacagtagcagttagcatctcctttatgcctcctttatgctttattcagtttggatgccctctaggacagcatcccattcaaattttgaattttagactaggagggtgcaacaataggctagcagccagctatggctatatatatgtatccaacctccctcaggtaggtatggcttttgagtttgtgaatgaagaaaaccagaaaattgtcccactctgagtgccattctcttctcaatgagagtaaccattgaaattctaacatctggtatcagaaccacactttcctgtaggctaaacatctcttgttccactccttcccaagctcggttgagctctcagccagcagcagcagcagcaccggctactcctccttcccctttcccttcctcctctccacgcagcagccccccggaggtgcgcca

SEQ ID NO: 28005 - DNA, 1501 bp, Oryza sativa
ccctgggcgcctctgcgagcgccaccctcggcgtgtcttcgcgtccaccgcagctggacgcctccgcgcgccttgcgcggcttgcggcccctctcgagggagaggactcccccttcttcccatcaccctggctggcctcccactgctcccgagtgagatggagcttcccgccaatggtgataggccccgagagaggctgtggctcatcgccgtcgacgaccttgaggcgacctaacgcctcctcgatcgacatcgtggagaggtctagcagagactcaatcgagcgagcgatctgcctgtacttctctgggacgcagcgaaagagcttctcaacagctctctcctcgtcgtaggtgtcgtcgccgtactgcaccatcttctgcaaaagagtgttgagacggagggcaaagtcatcaacatcctcacctggcttgaaggctaggttctcccactccttgcggagtgcctgcagtgtggacttgcaggcgcggtcactgccgatgtgtgccacagcgatggcgtcccaggcctccttggcagtccgcttctgggaaagcgagaactgcatctcgggcgggactgcagtgatgagggcatccagcgcccgtcgatcctcgtcgtagtcgacgtcgccgtaccgaactgcctcccacatgtgccgcacctggacctggttttggtgaggggccacccaccgccaggaccaaagtccctgaccaccgtctggacgccgtggtgaccatggcgccggtcagggaagggagaattgcgctgcctgggagggccgcgcgcgggctccgggctgccgccggcacgcccgcgcccgtctgggttcccgtcggagggcgcgcggtcccttgggccgccgccgccgccgtggaggtgggctactgcccaccgctctgcccgctccccgtgtccttcctcttgccagctcctcaagctccctgtcggtggtgatgttgccggcgatggagccgttgatgctgctgcgcaaggtctcaacctctacctccgccacacgtgccgcatcttccgccgcctctgcttccgcctccgccctggctgctgccaactccgctgctgccagtctggccgccctcgctgctgctgcaacggtctgagccgttgctcgcctgcgctcttctgctgcggcgagctcggcgtcctgctgacgccgagtgctcgaggcgaccgaacgccgagaccgaacgtcgaacatggcgcacctccggggggctgctgcgtggagaggaggaagggaaaggggaaggaggagtagccggtgctgctgctgctgctggctgagagctcaaccgagcttgggaaggagtggaacaagagatgtttagcctacaggaaagtgtggttctgataccagatgttagaatttcaatggttactctcattgagaagagaatggcactcagagtgggacaattttctggttttcttcattcacaaactcaaaagccatacctacctgagggaggttggatac

SEQ ID NO: 28006 - DNA, 943 bp, Oryza sativa
aagaatgatgtgtattgctgtggttttggatttggacgagcgatcctgaatgtgccagtcaactttcgttctgaacagacaggagtgtaggaatgcagttctacatacttttggcgtaacaattaatggccagcacatttgaggcacacgtgtatgaatctagtttcggattctcaatttcttgcaaggtcggatttttcattttccagtgaaaaagcttgcaacacatccttttctctttgcaatgataccacgatgccgatccagaataggagaaaaaagtttggtgtcttggtctactgatgaacaatcacaatatcaatatgaggtctgacctttcggatgcagcactctatgcaaaacaagaaacaagttggtcgcattgcattctgggcgggcttagggagatcgttctgcacgccttgctcccctccaatcaggctggttccaaacacagagatctgttagacttgatgatataagctggtactatggagctctgtttcaggagctctgcttcttccttctcacaccgtacactgttcgatgcatgcaaggtgtttgttagagtctgttttatttccgtttttttggcttggttgttacagttcgagtcgcgtcctgtaaagccggattcgtgcaagttcacgattaggcgtagtgtagcgagtcgtacgctcacgttctccgccgtgtgggatggcacatgcgcaaatggaggaagtgggagtgcacagagccggagacacgatctacacgatcgcatgatctcgttttcgctttccataaaaggagatgaaatatacagaaaagctgcgtaagtttagcggcacaaaaaacttctcgcgtgtgttcttctcttccactgttcatcgtcaagcattgtcgatttctagggattcgtgtgtagtttgatcctgagtttttgccaacatctggtatc

SEQ ID NO: 28007 - DNA, 1501 bp, Oryza sativa
tactgtttttttttaaacaaagttggatactggagttcctgtgactaattgaaaatcatagctctcttggattgagccttccaagctttgacaagttagatttgagcgtgtttgcatatttcgtacgagtacaggaaaatatgcattacatttccatgatactagaatatgaagtaatctggaattagatgggttacgaagaatgtggtgatattttagtgctaaataattttatcttttctctctttttctttatattaatctttaatctatctcgtggattagcaacagaaaacaaaaaaaaaactttttatatgtgtgtctttagcgattaaaaagggcattctgtaaaataaactacgacaaaatacaaacaaattcaacttcaaaattaagttttgaaattttaattttagctttcaagcataagagagactaagctgatattgtttttttattagtgttattatataattgcaccgtagcgttagcacgggtatattactagttttaattaggtaaagaagagctactgcactagtgcaccacaaatgtgaagttgtaaactaactagctgcctgtataaaagtctgatgactttgtgctgctatttccatgaagcatggagatacctttgcagtgagagtctggcagttgttcctggtgcgctcaaagatatagttgtggttccggtccagagagtcacgaacggggatgagaccaaacacatctattggccagcgtagaatacctttaagctccgtcacctcaaaagaaaaaacctctagtaaatctaggagcattgcgaaccagggcggttcctccgtgtaccgcatgggaccaatctcagttgcatccatccaataaaccatatcaatcagtcaagcattattgtttctttttcctttgcaacacaccaaagagacgagccattagatcacattgatgcatatccatgtgaaaaatgtcaatcccaacattttccattttcatgtttccatcctcactattgtgcgcccaggctcccgcctaccataatcagcgagtgaacatgtcgatttgagatgaaaactaaaaacctaacaagaggatgagcgaattcgtatttaccataaaatcatctctaaaacaagaaaaaagaagcttcctcacttcttttggcgatgtcgccggaatcgtcggaccacagattcgtccagtagcggcgatagtgggagagctcgttgagcagctcttcctcctcgctgccatcacgtggcctcatcaaatcctcctcttgccccaccgccgccgccatcccgccttgaagtttctcagaacgaggaatttttttgggaataagttcaccggacgttcctcaacttaacagcgaaatttttcgaggttacttaaccacaaaatcagaaatatgtacatctaaactcacacaaaccatgcacttaagatctcatggcagtatatatgggtggtttcgctgacgtggcatcctagtcagcaaaaa

SEQ ID NO: 28008 - DNA, 961 bp, Oryza sativa
aaggtactaggcctagaggctgttgatcgggctatcgttcagcttgcaaggctcctgtgggaagctgaaaagtctgggaaataccagtatttcctttgtgtcaccggagaccactctactccagttgagtacggtgaccacagttttgaacccgttccttttgtgttgtgccgacttagagatttcgtaggagctatgggggaggacaatgttatcaacttccccctggacgatttcctgcttccttcagttaaatctggagaagatgtggcagaaaacatagatgtagctgatcgcaagtctgatcagcgcaaagctttcagtggcgattctgtctttgaattcaacgagattgccgctgcaaggggctgccttggacgtttccctggaagtgagatgatgggcatcatcaagaagttcatcaaagcgaagaacgattagtgccagttcaacatactgacgtttgtgtaatctgttgaccttgaggcttccatgtctgtaataattgcaaacaaggatgtattcagagaaccagctcagtctgagatgaataaggcttctcatggatcttgaatcttgcactgaaaagcataaataatctgacctgctgtgtacatttaccaagcttttgtgtctaatttggagtgcctagacaaatatgcgttgttctttattagctttttgtactgaaggtttaattaagccttttttgtgtatgcctttcgtgagtagaccagcctatgaagcttcctgagatgcaatgcagcagatgctcagctttatcttacacaagattttattattcaacacaagctttgccttcttccagtagaaattttgctatagtatcacggccattgctattcttttttacattttgtagtatagaaataagaatctgataatcaacattgatataatgatttagaccgaactaattaaggaacattaggaactttca

SEQ ID NO: 28009 - DNA, 1432 bp, Oryza sativa
tcagctatcagacgtcctatcaatgttgctgctgagaaggatcggttaaggaatgagttggatatggccattgccagaagggatgaagctgaagcagaaaggatccgttcaaagctcaatcagctgcagaagatgtcgaagccaatatcaaataatgagaaggctgccaagttggaggcgatgaacaagaagaaccgtgctgagaacttcaagaacgcatcagaaatgaagcccgttaacacgagtttgaaggttggagaggctggttatgatcccttttcaaggagatggacaagatcaagaaattactacgcagcaaagcctgaaggagagagcgctgaagtccccaacgggaacgatggcagcgcagtagctggcgatgaagatacgaagaacgggccgcgaggtggttcagcagccactgcagcggctctagtggcagctgctgatgccggtaagctggttgataccaatgcacctgtagatctgggaacggaatcgaatttgctgcataattttgagctcggtatatcattggccggcctggaagaattcggcggtcccaagggtctcttcgatggttacatggcgaggaagcagaagattgaagcaaccatgggttacaaggtccctgacaatgatggaaggaggcatgctctaactctgaccgtcagtgactacaaaagaagacggggtttactctgaacttctcaagttatctgtgcctctgcctgctgttcgatggattcatctgcctctttggccacaaagttcatcagctgatcggcaccatgccattgtgactacttgtccagatcaatttgcattttagccttgagtgtatgtaacatgatgagacaagcaaggttacacattttcttttcataaacaggacctgtatgcctgaattgtgttgatgacaatttccgcattaatatttgtggagtgagtccttctgttatttagtttgttacccttgttgctctgcataaaacatttatgcagcggatattgggagactagactaagaggtacaaatattctatgttgtatacttatatgccaaaaggaaaaaaaaaacatgtgtcaagttatgaaagttcctaatgttccttaattagttcggtctaaatcattatatcaatgttgattatcagattcttatttctatactacaaaatgtaaaaaagaatagcaatggccgtgatactatagcaaaatttctactggaagaaggcaaagcttgtgttgaataataaaatcttgtgtaagataaagctgagcatctgctgcattgcatctcaggaagcttcataggctggtctactcacgaaaggcatacacaaaaaaggcttaattaaaccttcagtacaaaaagctaataaagaacaacgcatatttgtctaggcactccaaattagacacaaaagct

SEQ ID NO: 28010 - DNA, 1501 bp, Oryza sativa
aaggaatagaagttttcccaaaaatctgaagaatcttttgtttgccagaatcaaattttgaatggattgtactaccaccaacagggaggcctagcacaacatggacaaattgcttgttcaatggaataagtttttggcccaaaactatatcagaacagttcacatctacttgttttgcaatccagagagcaaaagaattgggaacaaaacacttgtcaaatagcagcatgctttgaaaacaagaattttcaatgactgttttgtgatgtggacttaaagaatcaacttttgagaaatatttgactgagaatctagagaatgcatcagacttcaaatcagtgtcaacatttttgtcctgacaaaaagaaaataaaacaatttaatcaataaataaaaaccaaacatagatataaaagggcattgcaaaaaactaaccttcaaattttgatcacctatgttgtgatgaatattaagcttttttttcaaactgttgataatttgatccctttgtatgatatcacgtagaacctgatttatcattacatcattgtccaattcaatagattcagaccttttcatcttaaaaaaaattcaaaattaaaaacaagaatgatggaaaaatataaaatgaaaaataacaaacaaaataattaccttaatgttatcatcttcacttcttttagacttactgagtttccttttcaaagttttcagaagttcatttgtagaaatttcatttacatgtggttgtgaaacatccatatcctaaaaaaacatattaaacaattaaaacattgcaaatgtgctatgaaacatggctacaacagagctacaactgcatactaatgaaaaaaaataatgaaagaataatggatactattctgaccttggaacaacatgacaattcaagaacaaataaaacaagaaaatattggtcatactattacattggctaccaagcaatgagaatgtataattgcaaactcttcatgaatttacaaatggaaatgaaaaaaacaactatatttcaaatcaatgaaattgaaatgtaaaataaacttacatgactggctgagttatcatcaaaatcacaattgtaatcatcatctttttcacgcgaaaactctgaattaatatcatcagattcacttatgggctggctacaattatccaattttgaacgcttttggtgaaccatctattaaaaatagcaattaaaaatcaataaagtttggcagactataaattataaaataagtgaaggtatgcattaaaaaaagatatataattcctcagaaattgaccactgtattcaagaaaaaaatgaacattacttaaacatggcaaacgaacaaaataactcccagtacaatatatatacgttggttagtactttcaacttgaagtcaaatgttatagtatatctccatgtcctcacaaatatatgcaaagaggtccacactatgataaaaagtcaaacaatctcacaaacttaagccct

SEQ ID NO: 28011 - DNA, 168 bp, Oryza sativa
gtcaaaaaaaccttatgaaaaaaaaaccaaaattttcaaaaaaaaacccaggcggaataaaagaaaaaaacaaaccctgtccgattataaagggcgaaaaaaccaaatctatccgatccagaaaaattcggatgaaaaaaaaaacttaaacctgtccgaccaaaaaaa

SEQ ID NO: 28012 - DNA, 173 bp, Oryza sativa
tttttttccatataaaaaataactctgagaatcaacgagatacttaattgaaccaatccccccatcatacagtttaatgactttgtaagatgctagcaccagcactgcactagaaagaaaagcacaatctgaaattaatcatgcaaaaggctaagatgcagcatcccccacca

SEQ ID NO: 28013 - DNA, 165 bp, Oryza sativa
ggctttgtgaggcaatatcctttaatctttatacaaaaatacgtaaatcatttgcgtattttgtaaaaaaaaatagaggttaccagatccagctaatgagagataattctaagcacaatttctttttttttcctcatcctaacaaccgatcaagagggtgctaga

SEQ ID NO: 28014 - DNA, 1311 bp, Oryza sativa
atgtacggctcatatgtacgtatatatcccccgtcgtagatgcatacatatattgtacgcccatgtcataggattagcattttcggaatgcaaaacaaaacgaaggacagtatattaattctagatttttcaaaaaaaaaaggcaaacaaaatacgatgatctctagaaattttttgctgagttttgaatagttgtgtgctacatgtacattcacaatttcacaattcggcagtgtccatcttacagccgtaatttacaatagcagcttgtaagtacttttacctatttattactatctcggtatatatttaaatcacattactaaaaatctgtcgtcatgtttttgcgtccgattttagtcgaaggtgtggccgtccgatacgcttatctcggtgcgcatggttccctccccttttatctctttgtttttttttctcttttacattagtaaataatcattcctagccctaaatgtcatatagtatatacagtgagtattagaaaaattacaatgtaaatattaacatttacaatgtataagtatttaaatttatactgtaattagagtgtaactatatatattttataatataaaaaatgattattgttaaaaagtttggcaccataaatatagttagccccttttcttaagggaattttttcagggaaagttagtccctatttaaatatatggcactgttaattttattaatttggttttatgtgcaactttaaccattgttttctataacaataatatctaacaaaattgtaatattgtaaaactgtttgtaaagaaaatctaaatatgatcctttttattttcaaactaaatactttgagatattttaaggactatcgatggtcagagttttaaaagtttgatcaaataaattcaatagtacctttaaatacagagggaggattatttaacaatccatacaacttatggagatgcaacatgttgtgttaaactgtattaccaaccatacacagcagctaaaacaacctctaaaccaacaaaaggcacataatgcatatactttgcccgaattccaaggcggccccttgtgcattgtagaggtatctttcccagcacatagagatgcatgttcgatttatctattttgctccacatcatgatgtagagagagagagagatggatctatcctatccaactttggaggaggaaaaagaaagaaagaaggcaacataggatggtgggggaggaagaagagaagagaagcatcagttgacagcctttccagctgcaggcttttggtttagttttactagtactctcctaaca

SEQ ID NO: 28015 - DNA, 327 bp, Oryza sativa
tggatgggttggggtcacatgggcagttacagtttagcagttacagacagcccctgcctcctctggaataggtctcaccacctccttgtttcaggaaacaaaagccatcatgggtctcagtgagtgagagagagcaaaggagaaggcatcttcttctcctttggacatgcaatgcctctgcatttttcactgcattttgcattgcattttggccttttttttttttggggggggggggggtctcaacttgtgcattcctctgcatttttgcattgcattgaagaagaagaggagtggtttgtgtgtggtggttgcgtgttgtggtaa

SEQ ID NO: 28016 - DNA, 656 bp, Oryza sativa
tgatgcatcagttgaatagaaaagtcgttcctttcttgttacaagtgtagactaatattttcatgtgcatcttggtggacctggagtctcctgcttcatgggatgtcacatgtatacctaggtttcaacacgtgaaaccataggtgattgaaaagtttggcatccttgtgtattgtccatgctaagttatttctaaccgtagaccagataagttctgttcaccagagatttacaagtgctggttgcttcctagggggctaatgtcaaaagtcagtgataattcatgttttgtgctgtagatatattggctttgagagcttaattatgttaatttttttattgttttccagcttcttgtcagtgaggttagcgagcatttagattcacaaatgagcctagttgccaatctactctccttttttattgctcatccagtaggagcactttttttttgtgaggacagtgggagcatccagtagaaaaaaaacttgaagtaatctgtttaacaaagggtctgaatgtatatttgtcgcattgcaatcttgtgttcaagcactcaaaagttttgagcgaactagcatttgtttgagcaaagtaaaaattgttagtttgatgtcatatgttcatactttccagtttccactgtagtaccctca

SEQ ID NO: 28017 - DNA, 1501 bp, Oryza sativa
tcctctactgcattcattatgcggagaaacagaggcctgctcattctattcctgcgaatcataactaatgagacatgcatatctatgcatataacaaaaataaattatataaaatttacttatacaaacctgcgcctgaataaaactgggccataggtaggattatcggaaaagtagtcttggtataatctcaagtgccgtgcttctctgttgcgatcaatcacttcatgtcccatgactgacccaccatgtcttggtgcattgacagagtgccaatagctatggacgatttgtgccgtggcaaaaaaaaatcatcgtcatcgtcagacgatgattcatccacgagctgttgaaacgaggagcgaggtcgactcatcttggatcaaatcaactgccaaaccattattcatcacaataaattaagtttttccccttgcgacgttgtcagatcaaattaaaaaaaaatgtgattggccttccgtttttccaaatatttattcatcatatcaaattaagtttttttttccatcaagacattgtcagatcagaaacataaaaaaaggaaatagaacaaagtaaaaaacatggttgctagcaaaattttgctactcacgcactgcacaagagcttgtgcctgtcaccaatcgttgctgcttgctgcagttgcctgattaagtgaggtgctaacgtcgccggccctgacagaggaagagctctgattgagtgaagtgctaacgccgccggcgctgacagaggaagagctctatgtgcgtctatagcactgtgtccttcgatcaatttcgtatatcgctgcgtctgatatataacctcgccaacggtatcagttgcgatctcgcgcgcgactaggatgagcagccatctccttccgtccgcgtgcgtcgcgtcgaccatgcccattcccctccgcatccgcacgccgcgatctcctcctcgcctctcacgcgcgacgcgatctccccctccgctctcgcctgtgattttaacgagcaggtagaaaattagttgggaagggcccactaatgatgatgtggaaaaattttaaatttttgggaaccaaattttagtcatctattggagaagagggtgtattttaggctaaatatgtttttggctgtccccaatacaggatttttgggagtttaattttagtcatctattggagatgctcttaaagacgaaaatgaagatgaaaattaagttttttttatgtaaaatgaggtgatattaatatatgattgattgagttttaattattacaaacttgaaaaatagattaatatatgattgttggagaaaagaacggaaccttaatcaaacttatccacattgaaatcggtttagttagatcatatcgaccgacgaatcaattttcccttgagcgtgccctgttcatcgatagatcaatcgatcgatcgccatacgtgcaacacgaacatgctggcctccggtttcgtcgagtgcaagctcgactatctggaat

SEQ ID NO: 28018 - DNA, 406 bp, Oryza sativa
caatcatatactttcttttaccaggtctatccaatggtcctaattattgcagctaacatcgctcatcctcctttcaaaagctgctttggctgtgtttttttttttggaggggttgcccctcccctctgcacgtaaaatgatggagtgatagattaacgtatgattaattaagttttacattgtgaaacggagggagtagctataaaaaaattaaaaatgtattaatatgattttctaaaacaactttcctatataaacttcttgcgaaacttaaaaaacaagaaagataagttgggaactcatgagaaagacagccgtacacttgtctgtctgtaaaatgtgcctcaaggacaaatgtgccaacagtatgaagagttgcattcctacacttgtctgtctgttcaga

SEQ ID NO: 28019 - DNA, 238 bp, Oryza sativa
tttaacatacatgatggagataattgcttgtaggtcctactgataatggaagaagaaggattctatactaatttgatgaatgaggggaacgattccttagattgggatagtttgagtacgatgcctgtggaggatgatatgagtaaccagcttgatgagaatggcatgagtagcgagcctgtcacgcagcagttccccactattgagaggactaccgtggctagatcaaatcaaaaaa

SEQ ID NO: 28020 - DNA, 1501 bp, Oryza sativa
gacgaggccgcacacgaacgtcgccacgccgtcgaccacgtgggacgactcgaggtcgccccgcctgatgaagcggtgccaccccatgacgcgcgtgccgccggcctcgccgacgaccgacctccgtgctcctcctcgcgtgctgcggcgacggcgcgccatgcttgtccgtcaagaagacctcgaagacggcggcgtcgatccgggggtcatcgtcgtcgacgtcatcgatgaacatgaagatcgagacgtgctcgccatggccaccctcgatcccacgcgggtagagacggatccgcgcatggtgctccccggccgagaccttcgtttctggcaacgaatcgtcgatggcgatcttctcggattccagatagtcgagcttgcactcgacgaaaccggaggccagcatgttcgtgttgcacgtatggcgatcgatcgattgatctatcgatgaacagggcacgctcaagggaaaattgattcgtcggtcgatatgatctaactaaaccgatttcaatgtggataagtttgattaaggttccgttcttttctccaacaatcatatattaatctatttttcaagtttgtaataattaaaactcaatcaatcatatattaatatcacctcattttacataaaaaaaacttaattttcatcttcattttcgtctttaagagcatctccaatagatgactaaaattaaactcccaaaaatcctgtattggggacagccaaaaacatatttagcctaaaatacaccctcttctccaatagatgactaaaatttggttcccaaaaatttaaaatttttccacatcatcattagtgggcccttcccaactaattttctacctgctcgttaaaatcacaggcgagagcggagggggagatcgcgtcgcgcgtgagaggcgaggaggagatcgcggcgtgcggatgcggaggggaatgggcatggtcgacgcgacgcacgcggacggaaggagatggctgctcatcctagtcgcgcgcgagatcgcaactgataccgttggcgaggttatatatcagacgcagcgatatacgaaattgatcgaaggacacagtgctatagacgcacatagagctcttcctctgtcagcgccggcggcgttagcacttcactcaatcagagctcttcctctgtcagggccggcgacgttagcacctcacttaatcaggcaactgcagcaagcagcaacgattggtgacaggcacaagctcttgtgcagtgcgtgagtagcaaaattttgctagcaaccatgttttttactttgttctatttcctttttttatgtttctgatctgacaatgtcttgatggaaaaaaaaacttaatttgatatgatgaataaatatttggaaaaacggaaggccaatcacatttttttttaatttgatctgacaacgtcgcaaggggaaaaacttaatttattgtgatgaataatggtttggcagttgatttgatccaagatgagtcgacctc

SEQ ID NO: 28021 - DNA, 579 bp, Oryza sativa
tattgatatcgtaaaaaactcaattaattatgtactaatagctttcttgtttttgtgtaccgtatttaacaattatattcatcactaccggtgtggcacgaattcgatgtggcatgtgacaacaaagcacaccagatccaacgtgggataggagaggttgacacgtcagatgatgacattgtgagagcatgtttaccatagtaccataataggctcatgtatcatagaggtgtgaaaaccattacattcacattgttgacttattgtaagacaagataactgattttataaagataacgcttctagctaggtttgaatgtgtcgatttttattagatttgtagtatttttctattattaactttgagagtaaaactttcatgatggattgtttttagaaatatctctgttggtggctgtttatattcgtagaactacagccgcctaatgcttaccttgaagggaaagaggcgggctatgattttcttatccaattaaccccacagccaagctaagctatttttgtaacctgttactaccttcatcctgaaatatgagtaattgacctataaatcaatca

SEQ ID NO: 28022 - DNA, 1501 bp, Oryza sativa
catcctgcaattccaaatccaccgaatcataattgagctccgcatcacgcagcgctgtcaacaaccgatccttgtccttctccaatgccgcaagggagtcgctgatcttctcggccctctcaaagtcctcggcctcgcacgcctcttcaagctccctctccaaatccttgtgcctggatgccgcagagcccacgtcctccgcaacctttcgccgcctaccagccaactgcctcctcttggcagccacagcagtggctctctgctggatagactcgagcttgccggagatttgggatctaagaagagccaatctctcctcaatccccattgcttcagccccagcacctccatcctcctccaattcaccatcctcttctttcacatgaagagaattctcatccggatccaccaccgctaccgctgcagcctgctcaacgccattatcaaggtgttcgaggtggtggactgggatggtcggagcggattgatgatgcatcgaagcatcggggaggacgctgccatggattacactagcggtagcagctgcggtggcggtcgtagcagcaattgcaacggcaggaggggaaggaggcgcgggttgaggcgagcggccatacccgatgcgcacggccctcttcttcttgcggagcgacgaggaggccgaggaggacgcctgccgggccagaacggcgacgggtgcagccggagccggcaccggcgaggggggcgcggcggcggagtggtcctgatcttgaccttggtgggcgccgctcaggtcgacgggggactgcggggacaggagggtgagatcggagaacaggtcctcatccagaggcggcggcggctgctgctgggaggccgccccgtcagctccggcgacggcggcatcgtcgcgaggggtgggcggcttggggtcgggggcctcggcgacgggcggcgcgggatcgggatcgacggagagggacggggtgaagaggaccatcccctcgaagagcgagtccccatcgccgccgccgccgccgccgccgtcgtgggactccatcggcggcgaggtgacgtgtcggggaagaagacgaagacgagaagagggtggagtgggaagaggagtagcaatggatgccactgcttagatcaatttagaattttaagatgatcaaaatttgggttgatctgttcgatttgtcgcgttgcagcgaggagaagaggaggattagagaagagaatggagagaaaaagggatggattagaggatgaactttctgcgtgatctctcctcttttcggcgagaatttgtttagaaaatgccaaacgatccagacgtgtaaagtagagcacgacgatcatgtgcagtatttctacgcgagtaccgtattaacgtatttctcaaatagtttacatattattcaaattagaatttggaatgccgaatttgctacgaatttgggggatttgagactttggtgcatatgggctgaagcccagtccaagatgtatattatgt

SEQ ID NO: 28023 - DNA, 1501 bp, Oryza sativa
atgtggcagctcgcgacatcgtcgatgtggacgtaccccatcctcccgtacatggtgaacttcgttgtctcacctgcaatgcgatttcatggacattcactcagaggactgaatgcagagagcgtctttgtagaagtgtttctgaaagattacgctccgttgaaatgcaagagtttcatatgagacagttcatgattctaactgaaatcgaagaaaattcttcgtattcacggttgcgtttcatgtaccttggaataggccgaggacatcggtggtagtgggacttaattcatgagacagattgggtccaaccacgaaggttggaagaacagccacaaggtcgatgccgttctccttggcgaactcccaggctgccttctctgcaagtgtcttggcaatggcgtaccatatctatgtacaaagatagatgttcagagcagctgaaacaatgccaaaaacctgcaaatgtatatatcggattgtgctctgttcacctggagactctcgcagaactccatggagctccatgatgtctcatccagcaacacgttgggtggcagatcagcttcatctttgagcctcacggttgatgatgaagaggtgaggactaccctcttgagggatgggttcttcttgcatgatctcagaacgttcagggtgccgtttatcgctgaatcaagcactgctgcctacaaatgaagtagcatcacatctgttaaaagttaaaacctacaaccagatggcatcttaaatctgaattccaagataaaaaggagagtcgcataattgcagggtgaaagtggtcttcacagttagtgtagcatgccttgctggagtcagtttcggtgatgacaggtgatgcagtatggaagacaccctcacaagccatcacagcatcatcaaagctcccttcttccaagaggtcagctctcacaagctccagcctttcctttgcacctgttaaattccacaggtgccctactttcttgtgattgcctgccaaagtaaccaaaaacagaaatttaaactcaaattaacaagtccatccatcaccatgaaacaagtaaactgaactcaattagaacagaatgaaagatggacctgggtctctgactgtcccaagaacatgataccctgactcaagaagtcgcttcacaagccaagaggcaacatagccagaagccccagtgacacacaccttgcccttggtagtgttctccattctcccaagctgaaactggaattgctcctgaaatttcaccctcgagatctttatatgaactgtgaaagtatgtattaggagtacaaaaggcagaaaaaaaaagtatactaaaatgtcactcccttttggtgattatatttggcaggtagagagtaggatagatttcacaacggcctgtgaggttcacagcttcttcatgctgaagcaacaactctataaaacagttcttagctaggactaactttcaacacatactcgatgactcgatgtgactagttg

SEQ ID NO: 28024 - DNA, 530 bp, Oryza sativa
gggtgtgtttagtacacgctaaaatgggaagtttggttgaaattgaaacgatgtgatgcaaaagttaaaagtttacatgtgtaggaaagttttgatgtgatgaaaaaattagaagtttgaagaaaaagtttggattttaacaagggctttattttgataggagtgattttcaggatttacaggaggtaccatattttttttccgtgaaattttaccatccttaaaaagtacccatgttttttagtgtaaaatttggtacctctatatactaagtagcttgatgtataaaaaaatttagtatgaaatttaggtacctcgaggtatttttttaaggaccataaaatttctctattttttaatataaaatttgatacctcttaatatctctgatggtaagacataccaaatttgcaccaaaaattttggtatctctcgatatgtctcaagtattgttgaatttgtgttttgatagataatcatcagatcaaattttgttgttgaatgatgatgatactctttcttgttgcagt

SEQ ID NO: 28025 - DNA, 335 bp, Oryza sativa
tgaccaaagtaaaaaagactaataatcagttttattttgaccaaagtaaaaacgacttataatctgtaaaagatcatagaaggactaggttttgctttgtgtgatttgatttgcttatgttttttgtgttactttcctaccaatacacatttgtggttttccatcttagaattatgtccccaatcgccttaacaacaagggctgtttgttacaaggtccctatcttgtccactccaagaactgcatgccccaactgaaaaaactatgatttctcccaaccacccccatgacaccagaatttctgttctgttatgcttcatgctgctgttaatagg

SEQ ID NO: 28026 - DNA, 1501 bp, Oryza sativa
ctccacaaatatgcaaattcaaattcaatttctacacgaagttgaatttgaacttacatgcttgtagagtgatataccacattctaatacatcttctcaaattttttcaaattttttcataatcatttaggtgacatgcaaacaaggatgatatataatatacttcgttcctataaaagatctatcgttatagattctcctccacatctctgaacttcatgccatcacctttttttttttttggaaacccatgccatcaccttggacatgctgaaatcatacacctgttaccccgtaaacgcacagtaaactacacagaaatatacagtcggagcaatgcctgaatgccattttcagtaacacaaatacaaccaacgaatcacagaagaagaagaacagcaaggtgaccagcagctcattgatgttcaggacagcagagttgcagatgtacctcccggctgcacggggtgtctcgtagagcaggatgcggcagctcgcgacgtcgtccatgtggacgtacaccatcctcccgtacatggtgaatttcgttctcacctgcagtgcgatttcatggacattaagagtcagagacttgaaagcggagagcataaatgtagaagtgtttctgaaagattgcgctccattgaaatgcacgaatttcattcatatgaggtagttcatgatcagagaacattctctgcatttcgggtggtgttttgcgtaccatggaataggcctaggacgatatcggtggtagcggggcttaattcatggagaaaatcccctgtgtacacttaaaagttcacctaatcctttgtgtacccctgaattttgctcaatcccttacatacccctgaattttagtttggatcccttccataccctttccgctagttgaccgttagttgaccgttaaattcttatgaaaaagtccattttgccctttggtataaagaagcatataaattaatagagtatattgttggagaatagaaatttgttatatgagactattatgtttatgagatagttatgcaccatactatttgcgataaatatacttttaaatatgacataaaaaattaatacttatttattagttattaaaagatttttttagcatatgtgttctgaagtaataaacaaatctgttgtattactatgaaaacacatatgctacataaaagaacttttaataactaataaataagtatcaaatttttatatcatatgtaaaagtaaatttgtcacaaataatatggtgcatcacatactcataaatataatagtctcatccaataaatttttacatttcaacaatatacttcattaatttattatgtttcttcatagcaaagggcaaaatggacttttttaaaagaatttaacggtcaactaacggtcaactagcggaaagggcatggaagggatccaaactaaaattcaggggtatgtaagggattgagcaaaattcagaggtatagaagggattaggtgaact

SEQ ID NO: 28027 - DNA, 634 bp, Oryza sativa
taagaataagagaaaatttcctgcgtaaccctaaattttgtccaatcccttttatatcctgagatttacttattttcattcatacccctaaatttcagtttatatcctttcttttatatctctttcgttagttgacagttaaatttatgaagtatatcgatggagtatataaatttattgtgtgtgactaataaggcatgacaaccaatcacacttctccatataataataagtctatttttcgtccctgaactctttgggtgtgtcttatatggctggagcaagtctattttgtattcctcttctttggggcttacctttgcttatatggctgcattaagtctatttagtccctctactattttccattaaccgtgccgtgccgggacggcccaccgtaccaaggcatcggtccagacacggctcaactgttggctctcgggccttattaccatctatacttgtgtgggtcgtttaaaaaaaaatcttattttgggacacagaggccatgccaacatagtagaaactttatgaaaaagtctatggcaaaccacgaagaatagatattgggaatttccttgacgatgttgccgtgatcataccaagatttggctgctacatgccagatttgaga

SEQ ID NO: 28028 - DNA, 1501 bp, Oryza sativa
tcagaaggaagcttgcatcgtcaattttgaagtcaagggaggacagaattgggttgttaaaaatggaggaggaaattttgcaagatatccaagtgctcaggcaacaaacatcagatgcaagaatcagtcttcaggtacattaatcctttttcatgttgataaaaaagatcatcatgtttaatttttagaggacaccgtgtaagtaagaacacaaatatttttatgtacttattgagtttgatgacttgcaggagatatcttcaaggaaggctgtcattcagcaagatatagctacatttaagcagaaattgagctttattgacaaaaggggccctgaactagaggctgaaaagagagttgctgccgctgcaaggaatttcaaggaagctggaaggatagctgctgaggctaaagcgctttactctgaaaaggaagaacttcatgctaaacttgagaaagctgctactgatctggaggtaatcgaaaaggatatcacagctaccactgacaaaatacaggaatgcgaagggcttattatactcaaagaaaaagaatcagccatgacaagttacaaaagactcaggttggatgctgctgctgctagagcagaattgactgctgcaactgaaacagacgatagcgaagaggttgaggttctgcggaaagaagctgaagctgcagaatctaaagcaatggaactaaaaacatgctatgaccttgaactggacgacaacgaaatcatgtttcagcctgtagtccctatagtattcataaccaattcaacagggcagcacttgctagaaattgcgtcttctttcggtctatccccctagaagcaaacttcgacagtacttgcatgccaccatgcttgttacagtttgtagagttttgccagcgacagctgcctattgaagggaacatctgtgctgcaatcaaagcttatctccagatatacatgtcttcctcattgttcctccttacctcctagcatttgggatctactctaaatcgaggagaggttcctaggggacagccaagtgtataacatccattttgcgtactcaaactcttcagggagtttgtctccccctcatttttgtgtacattaagactgtaattcttttgttgttgtggtaattttggttgagctacagtaaatgccattcatccgaatgtaatcagtataagttatccatgaaataaactctcttctgcattgcacaactagtcacatcgagtcatcgagtatgtgttgaaagttagtcctagctaagaactgttttatagagttgttgcttcagcatgaagaagctgtgaacctcacaggccgttgtgaaatctatcctactctctacctgccaaatataatcaccaaaagggagtgacattttagtatactttttttttctgccttttgtactcctaatacatactttcacagttcatataaagatctcgagggtgaaatttcaggagcaattccagtttcagcttgggagaa

SEQ ID NO: 28029 - DNA, 194 bp, Oryza sativa
cttcgtcgtccggctcctcaaaaattctggacaccagaatatcgaaccatgaacgcggaaaggcacgagagaaatattggctagaatatgatatctatctaatgtgatatatggaatatatgacaaaggtggagtcttagagtatttcgatcgatcggtcatataggcctgagtcagacatcaaatagctttga

SEQ ID NO: 28030 - DNA, 1501 bp, Oryza sativa
ctaggcgattcccttcgtaccccatcccaaagaggtcaagaactccggcgaaatggaacttttttttttctgctgattgatcgattcattggtttgtgtctgtgtttctgaagatgacattgtcttgggatttctctgtagtttgccgtgcgtttacggggagcagacttatggtttcagcacggccaaggtgagggagctgggcatgaagttcagagatgtggaggagatgttcgacgacgccgtcgactcgctcagagctcacggctacctgctgaacagcgtaccatgacaattgacgacaaatttatcagaattcagaaattgggtatgccccgacgaagatgaagctgtagctagaatcatcagttgcacacaggaaaaatgtgtctctgtgtcagagaaggttgtgcgctactgaagaagtggagatgattatgtattatactccctccgtttcacaatataagtcattctattatttcccacattcatattgatgttaatgaaactacatctatttaagtttcattaacatcaatataaatgtgggaaatactagaatgacttacattgtgaaacggaggaagtagaagatttataacttgttgagaaaacgttaatcgtattgttcgtgtatccaaaacataaattttaaaaaaatattatctcgttcagattattgttagtggtgactattactccgtagtattttatttcgaccgcttgttagttaatgaggacgatgcacaaaatttcatactcgtgtctaagatacaatacacttagtaaacatgacatcttttaagtatttgcttttcttttcccaggagtagtcaaagttggatgatgactaattctgttgactgctacttaaaaatggatggagctatgtttaaaattaagaagatttaactgcaactactgtagtataatttttttttaaaaaaatatttttgaccagagggagggtttttttttttttgagagagtaatagggaggaggtttaaacatgaccaaaagcatgactcgctgatcgatctgagcccatgggccttatctcggcccaagattccgagacgtaatcaagcaggaggacaaagtcatagagataagccgtttttagcgcactcgcttgctcaggttcctcctcatcttcttctctcctcttatccccttcgccttcctcctccccgcctacacgaccagttcctggtttctgctgccttccctcggtctggatcaacaaggtgagtcccaatctttgacatcctgcctcacttccattcttgcacccaggtttgcttggatgatttctggtttcgttggcgacctgcactgcacctgttcgatgaattgccgcaatggatagtttcttgattgattgagtacgctagggtaccgtttgcactgagtgcactagatgtccgaacacacgctgagaaatttgagggatttttttatggttgttgagcagaggaggtcgtccaatggcgagtg

SEQ ID NO: 28031 - DNA, 1501 bp, Oryza sativa
ctgtcttatttgaaaaatttttgaaaaaaatttaaaaacataagtcacgagtaaagtactattcatgttttatcatctcataacaacgaaaatactaattataaaaaaatttcaaataagacgaacgatcaaagttgggcgcggaaacttatggttgctcttataatgggacggagggagtaatttctaagtcgttttggttttgataaaagtcaaactattttgagtttggctcagtttgttgataaatatagcaatatgtaaacatcaaattaatttcgctaaatcgataattgagtatattttcataatatatttgtcttgggttaaaattgttactgcttttttttttctacaaatttgattaaacttaaagcagttttattttgaccaaagtaaaaaagactaataatcagttttattttgaccaaagtaaaaacgacttataatctgtaaaagatcatagaaggactaggttttgctttgtgtgatttgatttgcttatgttttttgtgttactttcctaccaatacacatttgtggttttccatcttagaattatgtccccaatcgccttaacaacaagggctgtttgttacaaggtccctatcttgtccactccaagaactgcatgccccaactgaaaaaactatgatttctcccaaccacccccatgacaccagaatttctgttctgttatgcttcatgctgctgttaataggatttacaatccggtggaaaccggaccaaatttcgtaaaatacagacttttcggatcgggttgaaaccatagacactcgatttgatggtcatgtttatttttgcgaacgagtaaaagaattgcacgtcaatatattagagggaaaagagtttttgttacacaatgcaatcagccagagcggcttataccgagggaaggaagaaaaagcaaaacaaaaattgtagctaagaagaaaaaaatacggtggctatacacaactccgattggaggaaaggggcaaaaccacagtacactcccaagaaatctccaaaagcagcaatacccattaaaggccacagatgaccttacgagcggatggactgcagagccagtgagaccgaagagagcgcataatcgaaaaccctggagtcatgttcaaaactgaattttaaaattttgataagatttatctgaattttatcagttgttttcgccttttcggttaatcagtacacttaccatgagtgatttttatccagcatcggaattatgaatagcatgctgcataccctgcctgcgttgcatgcttgccaagagtggtcagaaagcatccctgcttcagctccactcctacatacagatgaggttagcttgggagttttatctgacttctttttggtggcaagtcactcctcttgcttgttgctattgggaaactagttgctggttggccagtgtgctactgaagtggaagcaaagaaactacctgcagccaagcgatgatccactgatcttcgcccc

SEQ ID NO: 28032 - DNA, 1501 bp, Oryza sativa
aaacccctggctcaaattacttggtcatcagcacgtactaggcccctgtaacgccgggccattttgcatgggcttagccgaacgggagtgacagaaactgggccgaatgtgaagtgacggacagacagcctgggccgtcgatgggcgtgtcaggcagcgaagattggtggatcaggcacggccgcacggtggaattggcggtgatggtgggtagttctaaggaataggtccattttacctccctcatctcctgcgcttgtgtgaataacatccctcaatcggaaaaccgggtataacaaaccgggtataacacctccttcttctctaaaaaccagagcaaatcatctccctcggtggtttcggaggtggttttgtccaacgtggaggcggcgctcggcgtgcgtgacggcgggggtggggacagcggccacagcgccgccaccggcgctgctggagtcgccgcggaggaggtgtccgaggcggcctcgattcatgccatcctctcggtgtcggtttcctcgtcgcggaggaagatgaggcagccgaggtggacgcggtgcgtccacgtgcggccctccacaacgccacagtccatgtcggcgagcacgacgaacacctccgagatgagccccgtccggtcggcccctgtcagctccagcgccgtcaacccctcgagcgccatcggccgcgttggcccgttccacatccccagagactgcaaagaagccatgtatgccatcagaaaatcccaactccgtcgaacactcgtgccagaatcaagaaaccaccaagaaaacccaccaacctgctcgatgtaggtgatgacgctgtcgttggtgagcttgcaaccgaggcggtcggtgacatggaagacgtccatgaacgaatgaaccacctcccatccgaccagatggcgcgagcgacgggacggcgggagctcggcgggagcggcaggagcgacggggcggcgagaccgcgggagcctggcggagcgatgggagcggcggggcggcgggggcggcaggagccgctaggcggcgagaccgcgggagcccggcggagcggcaggagccactgggcggcgggaccgacgggctccatggccatcttcgtccccgatgggcgacgtgagcaacggggctccatggtctcgtggagaagatggcgttgcagccgggaggtcgtggccgggcgggcacgagggaggagctcgccgggaggtcgcagccgaccgggagcgggggaggagctcgccgggaggcaacgccccgattttcgttcgggaataaaaatcaattaataatacattttctagaaattaaataaaagttaaatcaatttaatcaagtgaaataatgggagaatttgaaattttcctttaaaaatcattggccggaaatattttgtaatattctttgtgccctaatgtactctccggaattttccgtgaattttcggagctcgagaaatagttttaatagcacaaagatcattgcatcaa

SEQ ID NO: 28033 - DNA, 1501 bp, Oryza sativa
acttgatttcttcgtgggcagacctatggcagctgttcgtcgccaacttccagggaacctacaaacgccacgcgatcgaagacgacttacacgcattggcacagagctcgggtgaatccttgagggaatatgttcggcgctttaatgagtgcagaaatacaatccccgaaatcaccgatgcttctgtaattcgcgccttcaagtccggtgttagagatcgctacactacccaggagttagcaacgagacgcatcacaactattggagactgttcgagattgttgactgacgtgcccacgttgacgatgcacttagacgcaagaacgacaagccgaagaccgagggcgagaagaaatcagccacggacacacctgagtcaagcaaaaagaaaaatcgcaagaacgcgaaaaggaaagctcaagcagaagtactcgcagcagaatatgctaaccctcccaagcgcccaaacccacaaggtagtgacgcaaggaaagcatggttcccatacacaagtcgaacagacattctttggaagactgccttgtttccaaaaaatcgctcgagaagcacatgacatcggaacaaggcaaacgagtacgcgtggtcgagaaggatacggagatgaccgctcaggagtcggacccagcgtatccagactctaacctccacgtctcacacattttcggaggctctacagcgtactcctccaagcgagagtataagaaagtggagcgagaagtctgctcgacgtggcagggggctgcacccaagatgaagtggtctgaacagaagatacaattttcggaagatgaccatcccaagaccgccgttatcccaggacgctatccgatcgtggtcgaacccactattcggaacatcaaggtcgcgcgggttctcatcgacggtggcagctcaatcaatctcctcttcgccagcacattggacgccatgggaataccacgaagcgagttgacagccaccgatcaacccttccatggaattactccccagtcttcgtccaaaccaatgggaaaaatcacgctgcctgtgactttcggccaagcaaacaacttccggacagagtagttcaactttgatgtcgctgaattcgatacagcgtatagcaccatcatcgggagaactgcacttgcgaagttcatggccgcatctcactacgcgtattaagtgctcaagatgccagggccgaagggaacaatcaccatccaagggaacgcaaagctggcggtacaatgtgacaagcggagcctcgacatggtcgagcaaacgccaagtacacccgccacaaccgagccacccaagaaaatgagcaagacaaacaagacgctgaaaccggacggcgcaatcaagactgttcctctctctagtgccaaccccgacaagaccatcaagatcggggcatcactaaacgagaaataggaactcacgctcatcaccttcctccgcgacaatgctgacgtgttcgcttggcagccgtctgaca

SEQ ID NO: 28034 - DNA, 1501 bp, Oryza sativa
aagcttctcagttttggcaaatcactcagctgggtacttatattgccatttaaagagttggaggacaaatcaagaacctcgagcttgtgaaaaccaacgaaatcaccaagttgaccagacagcatattgctactgagatccagcacttgcaattcagccttcatggggcacggagagagttggcttggcaaatcggtgaacgagtttctcgagaggttaagagatcgcaaggtatgaagattgcatatggacgcaaggatggtggcattggagaggccacatccggggagggatagcctagtgacaaacgcagaggatgcaactgaagagcaatgaacaccactccattggcatggatttgagcaggtgttccagttcttggtactgcccaccgagctcagaatatctcgcatgatgtcctcgtgtgccttgttcagtcgcgctggcgattgttcggtggacgctgccatgggcacaccaagaagcaagaacagcagcagtaacagtaagcacaggcttctatcgggagcatggtgccgactcatcacctccatggctactctcagcactttctccatctttcctcctgcaacatatgaagacagagaagcacaatgttcaacacaaaaaatgttcaaacttcagacgttgtgttgaagaacggtgacacatgtaggaaggggtccagcagactgactgagcacggccagcattcgttgtcaccggttctcatttgtcaaccaaccccagagaccattcatcgtgcagcgtcttgacttgcaatggtttttactgggcatcaggatgtggccacaagtcggtgtcacagttggcaaaaacactgaaatcgttcgagcaaatggagctggtttgcaggaaagaggaatgagatttgcaacccaaaagaattaaaattcgacagggagatggataactacatcatcaagacgctatgctgtcacgattgacaaaagcacgcgcacacgtagaaattgtaaaatggtagtagctgtcattcagtgatcaaacacaatgtcgtatgctacaattgttctaatttctaaaatgattggtacatactaatcatataaacataaagagataactatagactcatgttaaatgtttaggagattgtatctttgttgttcagcacaaattcacgatatattgtatcatcattatgttatcttcgttgttttgtgatatactgatatggtatcgtaacacattgcaactaacactcggctataaaccatagacgtattagcccttgcaagttgcaataacgacgactatcgaggcactacaatgacattgaagagcagtgcactttccttcagatataacggcgaatggattcattcatacactgaatctgttttttttttaatttttcaatgtgtcttttgtttttatgtctgagttgattttagatgtaagattttgtgatgttgtataggtatgtcacatgaatactgtcaattcttttaagattttc

SEQ ID NO: 28035 - DNA, 1501 bp, Oryza sativa
tcgctacactacccaggagttagcaacgagacgcatcacaactattggagactgttcgagattgttgactgacgtgcccacgttgacgatgcacttagacgcaagaacgacaagccgaagaccgagggcgagaagaaatcagccacggacacacctgagtcaagcaaaaagaaaaatcgcaagaacgcgaaaaggaaagctcaagcagaagtactcgcagcagaatatgctaaccctcccaagcgcccaaacccacaaggtagtgacgcaaggaaagcatggttcccatacacaagtcgaacagacattctttggaagactgccttgtttccaaaaaatcgctcgagaagcacatgacatcggaacaaggcaaacgagtacgcgtggtcgagaaggatacggagatgaccgctcaggagtcggacccagcgtatccagactctaacctccacgtctcacacattttcggaggctctacagcgtactcctccaagcgagagtataagaaagtggagcgagaagtctgctcgacgtggcagggggctgcacccaagatgaagtggtctgaacagaagatacaattttcggaagatgaccatcccaagaccgccgttatcccaggacgctatccgatcgtggtcgaacccactattcggaacatcaaggtcgcgcgggttctcatcgacggtggcagctcaatcaatctcctcttcgccagcacattggacgccatgggaataccacgaagcgagttgacagccaccgatcaacccttccatggaattactccccagtcttcgtccaaaccaatgggaaaaatcacgctgcctgtgactttcggccaagcaaacaacttccggacagagtagttcaactttgatgtcgctgaattcgatacagcgtatagcaccatcatcgggagaactgcacttgcgaagttcatggccgcatctcactacgcgtattaagtgctcaagatgccagggccgaagggaacaatcaccatccaagggaacgcaaagctggcggtacaatgtgacaagcggagcctcgacatggtcgagcaaacgccaagtacacccgccacaaccgagccacccaagaaaatgagcaagacaaacaagacgctgaaaccggacggcgcaatcaagactgttcctctctctagtgccaaccccgacaagaccatcaagatcggggcatcactaaacgagaaataggaactcacgctcatcaccttcctccgcgacaatgctgacgtgttcgcttggcagccgtctgacatgccgggcgtccccagggaggtgatcgagcacaaactcatggtgcgacccgatgccaagccagtaaagcaaagactgcggagatttgcaccagaccgaagacaagccatacgagaagagctcgacaaacttctcaaagctggctttatcagagaagtacttcatccagagtggctagccaacccagtcatggtgcggaaggccaacgggaaatggag

SEQ ID NO: 28036 - DNA, 1501 bp, Oryza sativa
aacttgcaggcctgtaggtcgactctagaggatcccattactagatgctaatagcgttacatactaaactaaatatgcatcgcttctggaaacttggcgctggataacttatcatctacagtataagttgagaaattgggtggtcaaatgttaaataaactgaataatcattgctgagcaattaatgccggttgtagtttacatttttatcaatatatggtttctggttatgagggtgtgatcgatgaaatattactttgctacaatactgtatttctagataaactgttgtagctttgcaaacttaggagggattatgtactctaccctgatattttcagtctgaacattaagtgttccctaggggaaatatttaggcatcatagaaggaatagaaaatgaccaatgctgattgttaattgcatccctctaaaatctatcaaattattagttaatgaagggaaaagtagaaaaccttgttcttctgtacccaccagaatcagatccgtccagagttttttttttctgatgtaaactgccatgaaaactgatcgaatatggtgcatgagatcacccttctgataaatgaagcaatggcctctattggttgctgctagaggaggctagatagaaaatgattacccgccatcacagttagagctcaaattgtttttagatatggggatgcgtgtcttattcatttaatttgttttctgttttgttttaatgaaaaaaattcggcaccagtaatcatgtcgtacctcaagtcttctttcttacatgcaaacgaaatttgcttgtcaggttgccctttcatggaaggagcaaaatcctgagttgtggaagctcaagaagcccgtctgggacgtcaccaactggagtagattattctggctgaggtcatccaagagaggaacattttttttaaaaaaaaagttagaactttcattgctcactactctcttggtaaaaaaaaaaaaggcctaggttagatttttctgggacggaggcagttgagatatgcaagagaggaagatttccatacatgggaatgctaccgctgacatgatcaccggaaaacacccggttcttgcagacagcgaaccggtatgggcccatcaaaagccacgttccgagcctaactggtatgggccgcacgtactccgccgctctctccttccagcccaagtaggatgagccagacgtgggccgcactcccgttatgggcccaactagtatgggcacgcactccgccgctctctccttccaggaattttttttatttataattttttttattaaaagttttacaaaaataattttccattttgaaaattaacggaagtagtcgcctaccgccctcaaatcgccctcccagagggcggcgaaaatgacatggcagacggccgttcgctctcgggcgacggccgtcaacgaaatttgcaggcggcccccttgccgtcctccgcgagggcgattttgtactgtgcggggggccgcc

SEQ ID NO: 28037 - DNA, 1501 bp, Oryza sativa
cgatacagcgtatagcaccatcatcgggagaactgcacttgcgaagttcatggccgcatctcactacgcgtattaagtgctcaagatgccagggccgaagggaacaatcaccatccaagggaacgcaaagctggcggtacaatgtgacaagcggagcctcgacatggtcgagcaaacgccaagtacacccgccacaaccgagccacccaagaaaatgagcaagacaaacaagacgctgaaaccggacggcgcaatcaagactgttcctctctctagtgccaaccccgacaagaccatcaagatcggggcatcactaaacgagaaataggaactcacgctcatcaccttcctccgcgacaatgctgacgtgttcgcttggcagccgtctgacatgccgggcgtccccagggaggtgatcgagcacaaactcatggtgcgacccgatgccaagccagtaaagcaaagactgcggagatttgcaccagaccgaagacaagccatacgagaagagctcgacaaacttctcaaagctggctttatcagagaagtacttcatccagagtggctagccaacccagtcatggtgcggaaggccaacgggaaatggagaatgtgtgtcgacttcaccgacctcaacaaggcgtgccccaaggatcacttccctcttccttgaatagaccaactggtggactcaacagccggctgtgagatgctgagcttcctcgacgcttactccggctaccaccaaatcagcatggcgagagaggacgaagagaagacatcattcatcacgccgttcggggtatttttctacgttaagatgccatttggactcataaccgctgggaacactttccagcgcacggtccagggcgcacttagtgaccagctcggcaacaacgtcgaggcatatgtcgacgacattgttgtcaagaccaagaaaagcgactcattgattgacgatctacgggaaacgttcgacaacctccgacgatatcacctcatgctcaatccagagaagtgcacctgcggagtaccgtcgggcaagctactcggcttcctcatctctggcagaggaatagaagcgaatcccgagaagatcaaggcaatcgagaacatgaagtcgcccacaagactcaaggaagtacaaaagctaatcagatgcacggcagcactaagcagattcgtcgctaggatgggagaacgaggacaacccttcttcgctttgctgaagaagcaagataaatttgtatggacacaggaagccgaagaggcatttattgcactcaagcgctacctatcagatccccctgtactcgttgctccccaacctaatgaagaattattcatttatattgccgccacgccatactccgtcaacactgtaattgtcgtcgagagagagaatgtccaatgaccagtatattatgccagcgaagctctccacgacgcaaaaccagatatccacagatccaaaaactgctctacgcagtaatcatga

SEQ ID NO: 28038 - DNA, 1501 bp, Oryza sativa
tagctagctatataccaaataagacaatggctagttatatactccctccatcccataatataagggattttgagtttttgcttgtactgtttgaccactcgtcttattcaaaaaatttatgcaaatataaaaaacgaaaagttgtacttaaagtactttggataataaagtaagtcacaaaaaataaataataattccaaaaaaaaaatttgaataagacgagtggttaaacaatgcaaacaaaaacttaaaatctcttatattataggacggaggaagtaccaaataaggtaaatggttggtactgagggccaacactaatctatttttttcttaataccaaaccttttgcagtctatatattttaaaccatgcattatttttaaattccgtttaaaccatcatactcttcttaaaatatatgacaaaatgtacaacattaaatatattcaaatacttgaaagtaatttatttaaattatggaagtaacttagtttgaaaagaagtaacttttcataaaataacattaagttaattatataggagtgaattgaaaataaagaactacgtgaaggaaattcacatataaaatatgggagtacctatacatttgtcgacaaattttctcttaaaaatttgtcaaatgtaaatacaatataattatactgtaattacgttataagtatagaataattacactgtaacttacatgtagttacactgtaactatagtataactacactgtaactttagtataactacactgtaacttatatgtaattacactgtaactataatatgacttgcatgtaagtgagatgtacctttagaaaacttatgtttggcactgctcacgtgaaagagggattacgaactcgcaatgtctgtttgtacgatgcgtgtggaggccatcgttcatgcatgcatgttcggctatgccctgccgctttatctctgcccttcgtctgacatctacgcgtgcatgagccgcgccattgccggcagccagcggccctcgaaagaaacaaatcaaagcgttgacgcaaaagcacgaatcccgaggttcatcaagcgggtcaaaaatcgataaattctgaggaagaaatttgtcaacagatttatagcaaaatcgtaaaatatagagaagattcataagtgaatacatagactttcttatttaaagtaatcactatattattttaccttatataagaactgatataagaagtaactcttcataacactaaaagtaactacgttgttatagggaagtaattatgaaaaaaggaagtaactttcaatggcataagaggcaactacactgttaagaaagtaactcatgaaaatatatattcactagtaatatatattcatagtattagaagtaaccacactgataatttattcacagtattagaagtaactacactacaaaagcgaagtaactctttacagtattagaagtaactatattgtttcatgaaagtagcttttcggtac

SEQ ID NO: 28039 - DNA, 1501 bp, Oryza sativa
aaagctggcggtacaatgtgacaagcggagcctcgacatggtcgagcaaacgccaagtacacccgccacaaccgagccacccaagaaaatgagcaagacaaacaagacgctgaaaccggacggcgcaatcaagactgttcctctctctagtgccaaccccgacaagaccatcaagatcggggcatcactaaacgagaaataggaactcacgctcatcaccttcctccgcgacaatgctgacgtgttcgcttggcagccgtctgacatgccgggcgtccccagggaggtgatcgagcacaaactcatggtgcgacccgatgccaagccagtaaagcaaagactgcggagatttgcaccagaccgaagacaagccatacgagaagagctcgacaaacttctcaaagctggctttatcagagaagtacttcatccagagtggctagccaacccagtcatggtgcggaaggccaacgggaaatggagaatgtgtgtcgacttcaccgacctcaacaaggcgtgccccaaggatcacttccctcttccttgaatagaccaactggtggactcaacagccggctgtgagatgctgagcttcctcgacgcttactccggctaccaccaaatcagcatggcgagagaggacgaagagaagacatcattcatcacgccgttcggggtatttttctacgttaagatgccatttggactcataaccgctgggaacactttccagcgcacggtccagggcgcacttagtgaccagctcggcaacaacgtcgaggcatatgtcgacgacattgttgtcaagaccaagaaaagcgactcattgattgacgatctacgggaaacgttcgacaacctccgacgatatcacctcatgctcaatccagagaagtgcacctgcggagtaccgtcgggcaagctactcggcttcctcatctctggcagaggaatagaagcgaatcccgagaagatcaaggcaatcgagaacatgaagtcgcccacaagactcaaggaagtacaaaagctaatcagatgcacggcagcactaagcagattcgtcgctaggatgggagaacgaggacaacccttcttcgctttgctgaagaagcaagataaatttgtatggacacaggaagccgaagaggcatttattgcactcaagcgctacctatcagatccccctgtactcgttgctccccaacctaatgaagaattattcatttatattgccgccacgccatactccgtcaacactgtaattgtcgtcgagagagagaatgtccaatgaccagtatattatgccagcgaagctctccacgacgcaaaaccagatatccacagatccaaaaactgctctacgcagtaatcatgacatcaagaaagctacgacactacttccaagcccacagagtcacagttgtctcctccttccccctcggtgaagtcgtgagaaacaaagacgttgtcggccgcattgcgaaatgggtagtcgagctaa

SEQ ID NO: 28040 - DNA, 1501 bp, Oryza sativa
agtcggcggcggctctggtagagcggcgccccgatggtgtggcggctggatttggggattagggtttggtgggtgagaggctttgtaaatatatagtggttgcacaaatgcccctgggtgttgttttgctcttcgttagatggaggataaaagtgacatttcccattctgatttgggcaaatgggcggcaatggaatgttttggggctgtcattggcggtaggtttaggcgccgaacgaaaaatcctccatccatgagtaattaacattatccataaatcaaaaacattcaaattatactaatctatctggattaacaatttgactttaaaaatatactccctccgttcaatattatataacttgaaaatttggattaagggggtgtttagttccagggtgtaaagtttttaaagtatacggacacacatttaaagtattaaacgtaaactaataacaaaactaattatagattatgcccgtaaactacgacacaaatttattaagcctaaaacatccgtcattagcaaatgtttactgcagcaccacttagtcaaatcatggcgcaattaggctcaaaatattggtctcacaatttacacgcaaactgtgtaattggttattttgtctacatttagcactcaatgcatgtatctaaacattcgatgtgacatttttggaaaaaaaatgtgggaactaaacaccccctaatattatttttttaaagcaactttcctataaaaactttttggaaaacacagacaatttagtagtttaagaagcattcaccgattaatcggaatacggttgtcagacggaatacggttttccacaacactactttaagcatgactgaatttatttttagaaactagcacctataatatattataggcgtctttttttaattaattggcacctatgacaaattaaaggtgttggtttttttttaaaaaaaagaaaaccaacacctatagtattggtgtcggctcttctatagtcaaaatctgctgtggacgtctaccacaggggcgcggtcgtcgtctcccatgtcatcgagacctccatgtcatcctcgtggttgctcacctcgccattcaccatcgacaccgtggaatgcaagaacctggttccagcctcggtggcgttgccggtggatctaaagccaagctggaggatgatcggcgacggaggatttgagccaggcaggtgataaaatcgtctcagtttaccattcatggatactccctccgtcccataaaaaaatcaacttctggctatgaacctggacacatgttgcgtccagatttatagtcagaagttggttttttatgggacggagggagtatataggtccaattgaaaattgaattttaaaaattttatgttcactttaaactgggtgaaccggtcggtgtttgtaggaaaaatgttggaccggccagttttaatagaacggaccgggtggtttggaccgacttacccctcattcttatcggtag

SEQ ID NO: 28041 - DNA, 1501 bp, Oryza sativa
tccaatcggctggtgaccagtttctagccatgactagatcgaacaaaacatcttggcggctacgtaccttccttggcagagccactccccattacaattttcttcgtgcatctcaatatggaccaataggtgatccaataacaagcatcatatatcggaccagtgggggtctaatactcgtatggcaacttttttaaaacatgtaattcctccgtttcatattatgagactttttaccattactaacattcattaacatctgtatgaatgtataccgtatctagattcattaacatctatatgaatatgggcaatactagaaagtattataatattaaacggagggagtagcattttgggctttccataaagctgatcgcatacactagtacatatccttctatctgtgacgaactttaatatggttagaaatagcgggccgtcacaaggaagtcatgtcaatcgggccgaaaagtgctcgattgagatatggtcgcacagacatgttagatgggcataaaacttaagcccgtcacggatgacacctttcagtgatgggccgtagtttaggcctgattgagataacattccatatctcaaacgggcctaaagttgcggccgtcacagatgaccatcatctgtgacgggaactttaggcccgattgagataacattctgtccacgggtgatacccgtagaccggatatagagagtattggggtacgctggtacaagggtctacgtagtacgacatcaagcaaacagaagacgaagattatactggttcaggccccttgataggtaatagccctaatccagttagtatgggattatatgatggaaatcacaggttacaaagggaaatatggaactcgatgaaaccgacgagatcgtatcgggttaatccgactagacctctcggcaatctggctttcgcaggctccgacttcgtaggctgtggtggtgatgttggctatcagattccctctcttaggtcctcccagggggtcccttttataacgcaggtcaagcggtttccaagtagaactcggagatatcggaccctgcacgatgcactgacgacccagtcttgtccgagtaggactctttccatctgtgaactccatgacggattcccttaatgtatgcagagagcgtccgtatacgcgcaggtataccataccgatacgcggcatgtatcgaagggtaaagggtataccttacccgtaaccctgacagtagcccccgatttctgcttaaatggactcgtgtaaccgatcgcgacttctggtgtcgaggctgttgtcgttctcggtgtgcgaaccgtagagacaggacgcaatcgacaacaccatgtgaagcccaacggtcatgagtgaatttaaactgaagtccgaaaaactgccgtgcgtaacggacctagaaatttccggcggtaatctctctctcctttccttggaattcgcaccgtcggaaatgcgtctatttaagaggattttga

SEQ ID NO: 28042 - DNA, 628 bp, Oryza sativa
aatatgatcagagcaggattacttactatttaatttatttctgcttttggcttatggagaaaaaatcagttagtggtgagatgatctcctcatacctgatagtatggagttcttttgaaaaggtaaatattgatatcatctttatggtgccttttcacccgtttctttgcaagtcatctcttatcttgaccgttcctccaaaccagctcaaattatttcagtagccacaagcccagtaaaaagggacaaaggctaagccagtgctggtgtcaaatgtgatgccgacggccacaacatcctgaatggatccatctgccaggtgaaatcagtgcaagtcacactgaacggtgagtgttctctgctctgctccattcacacgccataaaaaaatttacagtgtcacacaaggtaaagtggtgaaagcaaacttttgaccccttcctggatgactctttggcatttccctctaatgcaatctctatatatgtataattcacaacttcacataagcaactaactgaaaattgcaccagtgtacttcagatgtaaccagtcgatatcttgaatcgacagagttgccgaggagagtggagagagaactgagaagtagccatggaggtgatcagtc

SEQ ID NO: 28043 - DNA, 1501 bp, Oryza sativa
aaaaaacaatctctctctcctttttctgtttatgagctaatctgaaacaaaaaccaacaatatgtccatctttgccacaaaaagaacaagtatatttttcacgatgattagacacattattagaattagaagacttagcaacataagcagtaacaagaggttttgcatgcacaacattggattttgaagaagatgcactcaaggtagacataatactagcagatttaaacacaattttattagtatcaggtttaaccaaaatctcaccacctctagcaccagcacctaacacaacaggaggatgtctagaattatgagcataaggattaaaacctaaaccacgattatttgtgctaaccttagattgatctaaaatcatgttgaggttctttttaccatcagaaaatcttagcaaagaatttttcaaataagaaacctccatttccaaattagcacaattttcactatctaccataacacctttgcttttacgacatctggggcaagaaaacacttcattgttttttacaacatcttccatgtactcaacacgatctaaagcatctttcaatttcatcttattcaaattacttgttgagcaatcaaaaacatcatgaggttgttttaactttttagcagaaatcatgttaaacatcaaactagcatgaaaagcaatttgatatttttgcaacaactttttagttaaaaacaactcatccaaagtgcgtgtgtgcaaagcaaaactacaagcaagagaagatctatttttcaaatcatgtgcagcattaacatctctaatttttgaaatctcattcattaaaacctcacaatttgagcaatcatcatcattaggaataagagattttaacctatcaatttcagatttaagagattcaatgataaattcctgttttctatacatcttcttacacttcttattttttacactcaaaatattaatagcttcctcaaaagcacttacctcattatcttcatactctgtatccgattcaccacgcgccatgaagcaaacaccggagatgttctttcccttgtcatcatctccactcttaccatctacatcacttagtggctcgaaggcggcgcaaacttgttgaaaagccttcctgagattctccagcttcctccctagggatgaacccttcgacttgttgttgttggtcttctcaccatctttgtcttctcttttgcctctcccaagcttaggacaatgcgaacgaagatgatcaattgaatcacattaaaagcaacgatttggaccacctcttttcctgttcctggcattattcatagctcgagcaattctgttagcaaccaaagccaaatcctcctcctcgatctgttcgagttgatcatcggatgtggcattaaaaatagctagaaaagaaggcttagatgaagaagcatcaacatccaaagaagaagaagaagaaaccaaagcactcgacttagaatcaactttttgtgaaagaacattcat

SEQ ID NO: 28044 - DNA, 264 bp, Oryza sativa
actcctaatacagagatcaaccaggccattagatgggtactacgagtagcagagagattcccctgttataattttaattcatcagttcagaacttcatcagaagttcagaattgcagatcttgactgtgcgcgtgttgatccggctgctacgctctcgttggtgccaatcgccaatcaatcacgctggagtatatgcatccagtcagagccataagttgcgcacgctacatcaccaactagagcgtacggcgacctgtgcgcga

SEQ ID NO: 28045 - DNA, 193 bp, Oryza sativa
tatatatatatatatatatatcagatctggaagctgaggaaagaaaatccaggggtggtcagtgaagcactatttgcattgtcatgtggtcctgatctccgagtaaagagttgtgcatcttgcattgtcaacggagtccggtatagcactgttgaccgtgagaaatacctccaaacgcagaatagtggtgtaa

SEQ ID NO: 28046 - DNA, 1501 bp, Oryza sativa
aggtaatgctgatgaggatctagaccatttgcaggaagatggagaagttactattattgaagctaatttagaagaccttaacaaccaagctaacttgactgaagacagtagggatgatgcagatgaagatgacacaatattgcagtactgtagtgacagtggcaatgggaacgctgaagatgacatgccggaagacaccgatgatgattaaattatatcttgagttgtgtcatctatctgatatgtcatatgtaattgggatgagctataaactcatttattttgtgttatgtaactgagatgtcacaactgatttattctgtgaactcatttgccattgcagatctgaaacacatcgagattctgagctagcaattttaagaacagagttgttaccagcaatgatttgcatttatttgatttctttcccaggttcatggtgctaactcatattcctaacaatatgtgaagcagttgggtcaaaaatttcaggagaagagaaaatattttacttctgttttttgggcaatccagtaagtttcctggtgaaacagtatgcaaagtgatgtacatatatatttgttccaagtgacatactgcatatcagtctaaaactgtacagaccatgacatttcaagcagcaaaaaccaatttcaatctgtacaaacacaacttacacttcaagcatctgttcaaagcattacacttttttcttaattgtcatattcaattgacataaaaaaatgacacaaatatggtcttcacattttcaaaataacacaataatcagccataagtttattcacattcacgatctcaacctgaattcaccaagctgtacaaagaagtatcatttcttctcaagctactgttgtcgcccacatccaggaagcaagcagcataagcaccagaagcttgctactcgatcatggccagcaccaggtcctcttcaccagcagcgctaagagcatcggccttggagatgcggcacctggaccagctgctactgcggcgatgcggtcggagtcagagacgggatgcggtcgcacgtgtggtgacgcggcggccgcgctccatcggcagcagatggcgcggaggcggaagaatgtgtccggcgggaggcgtgccaggacgcgctccagcacgccgtcgtggaggtccccagcccacgcgtcggcgggctcctgcgcttcctgctaattctcaccgccatggaggaggaagctctttttttttgttacgatttggtttggtttggatctgaatccgttgttatatgtgtgttgatttacgattgtaccctcgttatatgtgagttctaccgataagaatgaggggtaagtcggtccaaaccacccggtccgttctattaaaactggccggtccaacatttttcctacaaacaccgaccggttcacccagtttaaagtgaacataaaatttttaaaattcaattttcaattggacctatatactccctccgtcccataaaaaaccaact

SEQ ID NO: 28047 - DNA, 1501 bp, Oryza sativa
ggccacgtcgggcgtctcccgagcgacgctctccttcagtgaggccgccgcctggtggtccgcaaacggtccaataacgtcagtcagagggtgagcctacaccgcatgaaatcattttccgacccgggaagcaaaaatagcgaggttaccgagtacactcacgttgattgcggcttcgcgctcggtcacctccttatcacaaagaggcatggggacgtcgcttgccgttgtcgggccgttgatcatcaattggccgacgcggcgctccacagtggcgtcactcaagcctgcagatcaagaacagagttcaataaattagggagaacatgcacagaagaggatcaaattaaacacaagaaaaataccccgaggagaaacccgggtcgcgtcctccggcccagagtagtcaaaggctgggtgggggcgagcctggagcggctggatccgcctactaatgaagtcggtagcgacttcataacccgacaaacctcgcgctcggaggtcatcgatggcatcaatgaacgactgaagagcaggggtcaaggcgggttttgcggtccaagatgggattttgtctggttgttcctcaggaacaaggaaccacctcgcccgccacttgctacgagaagaagggcactggaaggggatatatcgcgacttcaggccatctcgaagtcggaaacccacacatccagataccctggtagattccatccaacgcaactcatagtagaagcgaaagaggtcgagaaacggctctaccccaatgtaggcctcacaaagatgtgaaaagatgctgaggaaggcaatggaattggggttcaaatggagcagagaaaggccgtagaaattcaagaccaagagaagaaacttagaaggcggaggaagaaagccacagagaatatagtcctcgatcgcaactatacggcccaggacaagttcaggttcaatacctcctggttccctctccatggctccgcggccggggaggacgccatcctcctgtagcttcttaagcgacgcgctggtggaggtagacttgccgagatccatcgccgccggagatcgccggagaaggggccgagatgaacaagctagggctttgcaggagcggaggagacaaggaacgcctggaggctggagagctttcttcacaacgggcggacttcaaaatggatcctcaaaatcctcttaaatagacgcatttccgacggtgcgaattccaaggaaaggagagagagattaccgccggaaatttctaggtccgttacgcacggcagtttttcggacttcagtttaaattcactcatgaccgttgggcttcacatggtgttgtcgattgcgtcctgtctctacggttcgcacaccgagaacgacaacagcctcgacaccagaagtcgcgatcggttacacgagtccatttaagcagaaatcgggggctactgtcagggttacgggtaaggtataccctttacccttcgatacatgccgcgtatcggta

SEQ ID NO: 28048 - DNA, 1501 bp, Oryza sativa
aacgtcataaattgaacaatacgtggtcgttattttagtactactactgtcacggtttggactgccatttcggaaccagttagtgttttacttcttcttccaatgcaattatgcataaacgcgattgaaaagattcaaagttttgttaagaaccaaatgaatcagtagaattcaaatagtgaaattatgaaatcaaggccgaaactgcagttgtgcatcgtcgatgggtaggtggttcatgcgaagtcgtcagagcacgtacgcaccttgcatccgagggagcagaagccgaatcgaaggagtcgagcaggccacggccacacacctcacagcaccggccagcggcggcggaacatgttgcactcgccgcactgcgcgaagtatacctcgccgactgcagaggcctcagccaccgcgactacttctcttgaatcgccggaccaacctgcaatacaatgcacaacatcaaaaccaatccaggaagccgagcaattgctctcaacctagctcatcgaaaagaaaagaaaaacagaaatgaggtttggtcacttaccatatgcctaaatggtctctcttcgttgaatcgcaagaacaatgtgtcaactaaaccttgaacaggggaaatcccaagaacagaattctgctgatttgggatggaaatcgtaagaatgagtgtacagccaggcttatagtttgaagaatagtaagaatctgctcatgtccaaatttatagtattaaggtgtgttatctcttttactagatttgtttgttttgtgatagggagagtacgtgctatgctaaccttgcacctatagatggccatatggcccgagacctccggcccagcccaaggcacgccattttggtccggcccaagcatggcatggcccgattggggtcgtgcccgtgccagcccggcccgacatccgggccgtgcttgagctgcaccctcgacatggtgggtcggtccggcacggcatgatcgaagaaaaatagtatagggatgcaaataaacttaaataaccatataaggtaaggccaaaaagaagaggaatataaaatggacttattttttagccatatgggcatagccaatagagttgagagacgaaaatagagttattctgtggagaagcacgatgggttgtcgtgccttcggcacggcccgagttgtattggccgtgcctaggccgtgtgtgtagcccgtgggctggcacgacacggcccggcatgtaggttgggccatgccggcccgattaacctcggcccgtgcaagaaaaaaaaaagaaattgtcgtctttacgtgtttaaggcattgtcatcatgccatgttcagttgttcaccatgatcatgtcaaactgtcaagtgccaaaaactgagctgaccacaattagatgtaaaatcaaaagtgtttttgattattattctgtgatgaacaattggcatcggagattattggttttgttatttggaatttattcacgaagtggttttggaga

SEQ ID NO: 28049 - DNA, 659 bp, Oryza sativa
tctggccctgtaactgtcatttgaattgatggtacttgcacggcagctcatccacaaatgtgaatgctgactacctgaccatgagtatcacttggtggtcaggaggacatgttgttccaaatttttggatggctgcaggcctgcagctgacagtgatagattactctattctgttgttgctagcaaaaaattgcaactaacctgtatgcagcaatagtgcaataccaacaagtgttatgttataaggttattaatataagcatgcaatgcatgtaaggttttgtacttatattagtagcctttttttttgctactttggctgaaatagacttctgcaaaactattccagaaaaaaagagagaaaaagataaaagggggactttgtttagtactttagttgaatattgctcttctgcatttttctatttttagagcattttatttcgtgaaatcattacactttttggatattttgattgccataggtgcgaccgtacctttgtatgaagtgtttgcttgcaacctggtacagacattggaggaacttaagaaaaaacaccatactgaaatagtttctgattatcgtgaatctatgtagtatgttgacatggtttttcatgtgaatctcatgtgaaagagtaacaccctttctagcacaa

SEQ ID NO: 28050 - DNA, 184 bp, Oryza sativa
caaggaaataaagcccaaatcataatccaacagcctatccaaaaaagtagtagggaccaaacttggaagccaagtagatgaaaaacatgtcacgtgaatcaaccatgtatgggaccacacttttcaatcccctacttttcaacagcactactagttcacaaacagatctagcacgaatcaaaca

SEQ ID NO: 28051 - DNA, 169 bp, Oryza sativa
cattagattgggaattccgcacgcagatcgacttattaaaaaataattaaataaacattagctatttttttttaaaaaaatagattaatatgattgtatgaaacaacttttctacagaaaattggttcaaaaaataaaccgtttggcagttgagtcaataccaatttat

SEQ ID NO: 28052 - DNA, 689 bp, Oryza sativa
cggtttcaagagtccttaggtttacagggtaggaaacgctttgcttcttgatatcaccaatggaaagagaaaagaatctgctggggcttgctgtgactttgtgcagaatgcatattttgcttgtgatcacaatagaaaggtattttgcacctgaaagatggtaggaacctgaatgatcctgaaaactttgtatctagaaggagatatgggggaagatctgactgatttcctagtcattgctctttgatctgttgcgaatataccctttaattttcttctcttgctaagatcatgaactttataaaaaaaataagaatgtttctgttttccataaagttgagatctttaacttgtcaaaagggacaaatgactagaaaaatgcttgacatattttcgtccactaacattattgcccctaaaaaagaaaggattaaatatctaccaatatcaggttataaataaatccaataaagagaggataattcctgcatagttgtctctgaacctgtcctgatcagttgatcacaacttgtctacagtacttactaaaggattggactctggaacaccagcattgacagaatatcgatgtaaccatcttgtccactaacggggacaagaacatggcccacgatggcaattcccggggcctgcctcaacttaattaacctccgagctcctaaagcagt

SEQ ID NO: 28053 - DNA, 1501 bp, Oryza sativa
attcccttagaatctgtatgaaattttgacttatagaaaacaatattccctcctgtttttaatgtttgacattgttgaattttgggccatttgttttattaaaaattatatgtaaacataaaaaagtataaagaaaccgcaatgaactaaataataattatataatttttaataaaacaaatagttaaatatatggtcaaaagtaaatgatgtcaaacattctaaaagtagagggagtatcatctttgtaagccatcaaacccaacgaagaacggatgtgccaataacatttgccttttaaccattgtattatttttccccatctaattggtacaaacaatggtttaaatgatcactaacaactaatacaattttgataggttgcctattcaagttattggccaagaaatttctgcactgtctattagactgataatcattagataactttcttctccctgctctctgttgcctccacgttacaaaaatcttatgtggcagctttttctagacaccaagattaccctattgttcatgtgttgaaaactaaacattaagacataaatataactagtcttgattaagtgggccttaacctattggcccgctccaattgtaacatcctgaaaatccctgataataaaaatcactaaaatttcaaactttttaaaacttttgcatcatgctagatgttatggttgttcttgcttgccaaaccataaattgtcacattgaatattttaattaatttttgaactatcaaagcctccaagtatattggataatttctgatgatctaatgggaagtaaaatcatttggtagagatatgaataaataaataaatattcaaataaatatttgaattctcaaatccaaaatgtgtagagctacatctcaattcaaaatccaattctaactgttttgcattttagcccctccactctacctctttttcctttttcttccttttctctcctttctaggcgctactgtacattgtctgccaaccgttcgatcctatgtatcgcgtgcaccacatcgctcccggccgcgccagcaacgcccatgccgcctcacacctgcctcccgtgcaccgcaccacggcgcacagcgcccgcgtgggcccgccgcccaaccaagccgccgttccgccacagcttccatgtgcgcgcgtcgccatggccacgtccgccaccttatccacagccaatgatgtctcggcgcccctctttatgtctagtggataaaacagagtccccttccccagctaggactaaaactcgcagactataggctataggcacaatgatggagccatagaaccttaatggagaaggagatgaaccttagtcgcgtcatccacctcattgctcttatccgatcgccattagagctctagctcatccaggccatgtgctggcgatcttatccccatggtttccttacaccctaagctaagcccccagtaaaatccccattcctctcagctttcgtcccgaa

SEQ ID NO: 28054 - DNA, 1501 bp, Oryza sativa
ttccgtgcgggagggattagttcccattccctgaaaccgaacacagcctaacctagcatcactttccgatccatctaatcacccattgacctatgtcggagcacgagctcctctagtgggaaggttaggtaccctcccttggagattcggccaaggtacgggcacaatctgtggattgcgattcggccaaggttgggtaccctcccttggagattcgaccgagatcgcgatcgcatgtccatagattgcgcttgcgattcacaactcctgtctcctggtagctatgtaccctcttaggctgagttcgttagtgggggatgggaactaatccctttggcacctaaaacggagcgactcgttagcgcatgattaattaagtattaatcatttttaaagaaaaaagattaatagtattttaaaaacgactttcacataggaaatttttgcaaaaaaacatgtcgttttgcagtttgagaaatgtgagcgtggaaaacgagagagctgagttgggaaaggtgggggaagaacacatcctgatagtttatgtttttatggatacaattgcattttgtatataactcatggtttctattttcatataatcatatttcatatacaactcttggtttttatcttcatactagaaaaaatacccgtgtgtagcaacgctattttaattttattattatacggtttagttaaggtgaaattcactatgagaattcgcttggatatatatttttttctagaaaatcatgagctgcggttaggagtctgatcatttcaagttagcatgtaagttaattttttaaagatatttcttatacggctgctcctatatttccaaaagcgaacggacttaaatcccgactcaaatacatatttttatttctaaaagcgaacgaacttaaaaaccgactcatacacgaatgatgtaccaaagtactagcaaaaacatcttcaatctttataatagtttcactgtgagaattcgcttggatatatattttttttctagaaaactatgagctacaattagaagtctgatcatctcaagatagcatgcaagttttttttaaagagatttcttatatgactcagatttaaaacccgactcaaataaagatctgtattttcaaaagtgaacgaacataaaaaaaaccgactcatacacggatgacgtaccaaaataccgacaattttttttttcaatttttataatagtagaaatagagataggtaggtgtaatcttacgttttgtcaataaattgtaaaggtgaaatttgattcgttatatacatttttttcacttctatttccatcacagacacaaactgtattttgtatataactaatcttaataaatctacgccgatcataatacgtaaacaccatgatcaaataccatgccgaatacacttgcaaaacagaaattctgatgccagtatacaaaaacttttaccttgtagaattagattcgatataggagtatatattttt

SEQ ID NO: 28055 - DNA, 1501 bp, Oryza sativa
aaacagaaattaatacgtatataaaagttagttgcaagtaataaagaattgtattatgcacttatcgtctctattctacttcagtgacgccagaatattaaattgcttttgattcaatgatatgcatgattagtgtaaagagactttatccccaaaagtgttgtacatggttagatctcatagattctgttgttctcccttttcttttaaagaatgggaaaaagtgtttttggataataattgactatatatagtttgatttagtatgattttagcaagcaatagttttgtgcaaacttttatttggcaaattaagctagcttgctacattttctagttaggctgatgcaaatgactcatttgcacgcgagctttagaggtattatgcatgatgtatcatgtctgacaatagctttttaaaaaaattatcaaagagacaccataccacgtattatagcgtttatttgcgccgcaactcatacatacttatgttgagataccacaacttaataaatggatatagtccgtccgtttcaatttgcttgtcacactaaataggacgtttggttaaaaattacaattaattaaaactcatggtaaaagtaatattacccaaagccagcattaaaactcatggtggtaagaagtaatattattaatatggctacaatgatgaaagatatgaagggaaagacacttctgaatgtgctttacaatatgacaacaataagttttttaataaaaaaaaattaaatactacttcctcctggctaataatattagttgttttaaacaagggtaaagtcaaactttaaaatctttgactacaaataatttttaaaatatttatcttagaatataaaaaccatatgtgtagattagtattaaaaagtactttaataaaaccatatatttattgatatttttatatatattataatagaaggtactagttgtcaaagttatgtttttaagaccgtgttattatctaaaatgataagtattattaattcggagtacgtagactgataagtaaattgaaatagagagtgggttacttctaagggaccatatgaaaaactcgttgcatagaaaacgtggaaaacggaagccagtttgatgccactagaaatcagaacggatttcattcgtgttattatcactgctctcccacacagacaggccatttctgtctggctgccaccggttatgaggttgcacagtgtcattacacagcctcgctcgccacgtacgtagggcgcggtgactgcatgcagcaggaacgcgagtacatgtatttacaccacaccagtataaacttgccgatggaaagtgtaccgttgctgcctagttgccattagccctacacactaattggtcgaccattaaacaatggcaacacgcaaaaacgccgagcagaggagaggagaggccgcatctgtaacggtatgattgcaagggcccgacagcgagtcatggtgtttagcgagccccgtcctct

SEQ ID NO: 28056 - DNA, 1501 bp, Oryza sativa
cccaagcatgccattgacagcataattaacacccaaccacaatcactacctgcatccatgcacactaatcttttccttgtgctctgaaatgatcagtggcacagcttagctctgaatctctgatcaatgtgcgtgtttactcaggcgccggcaaagtgcacggccaaagtgaagctagcaaacgcatgcttcaccaaccaaagccatgatgatgagaaaacggccatctatccatccagcctttggaactccgcaacgtccttccatcattccccccaatctatctgtcaacatatcctctactattcaatgcagtagtggtacttgtatgcaatgcacaacacttgaactcaacacattcctttgcttcccttctactcccctcataggcacacacaatatctttggttttctctctctaggtagcctctccctctactaacaattgagttgcattgacacaattggggggcccctatttaatgaagacccccactattatgcaactccacacataaccacttcctcactagcatggcaaaggggagaggatcatcatccatcactactatactagcatgcacgcacgcctcactacattttcaatatccaaggtggccactttcaagggctcaaactcgctttcaaggtgatgtttgtcactcgcgcgccatcagtgttaaaaataaagtaaaggtggatttttgttcgaggaatattttttttatgggtggcgaatgtttcccaaaaacaatcttgaatttaaaagaaaaaatctttagaatcgaagggaaaaaattaggggacatccaaatttaaggaagaattttcttagttatctttttttctcatttaaattgctcaccctgaccaaaagaattgatgataaaggtttgaaaaaaaagtaaaggaaaaaaatgaagatttcctctgatattccccatttgagaggactgaacaacaattataattaatctcccgaaatcaaaatagtaaaccatgagtaaaaaaaggatacatatgactagtcgtccgatgaaaaacagacggccctgataacacatagaataagtaattgtatttctcacctaatgttttgacaatttccctaagccagataaaacacttaaaaattgttgacaaatatattgtcattgatctagagtccaccctgaattccataaaaccatcagatgcctcacatggcaacctaagctagctgccaacatcagcagatctgcttcttataaccttccccaacctctcctccccttcctctactcttccatttaagtactccatgtttcagttagtgctagtctgttactagtgttagtgttagcctctctccctccctctcacacactgttcactaacccaatcactaggcagctcagctcagctcatttcattctgagtctcagctcagctcaagcaaagtaagcaagaagattagaagaagaggaggaaaaattaattggggtgagtttgatgacgacgc

SEQ ID NO: 28057 - DNA, 1501 bp, Oryza sativa
aatattgtccagcttccagtaggcccccatggttacatgcagaaagaagagcaacaaaggttatctcatcaggggggaaggcatcaaataccatagatctgaagaacattagtgcatcctgtgcacgtccatgcatcgctagcgccccaataatcgcattccatgagataacatttttactaggcatttcactgaacaagcttatggcagtgtctacctgaccacaccttgcatacatgtcaagaagtgaattaaatagagcaacacctggattatggaagttatctctgatacagtcatgtatcatctttccagaagccaaatcgccaagttgcccacaggcagagaggacagcagccaaggtaaactcgtctggagcgaggcctagcaatttcatacggttataaagatccagcgcttcatggaatcggccaccttgaacatagcaagagatcatggcattccaagatattatgctcttctctggtatctgttcaaaccaatctcttgcggcatcaatagacgcacgtttggccagagcacaaagcatagatgtccatgaaacagcattcttgaagggcatcatgtcaaagcatgtatgagccatcaacaaatccccacacttaccatacatgtccaccaaagcattggcaaggatcaaatcaatccgacatcctctaaccagcaaatgagagtgcacaagcttaccaaattcaagatttccctccgctgagcaggcaaaaagcaggctgaccagcgtgaactcatcagccaagagtccctgacgtctcatcccctcaaacaaggagcacgcctccctagtatttccagcctgcgcatatccgttgatcattgagttccatgacaccacattcctgtccaccatctcatcaaagaaccggcgagaatcccccagtgacccggccgaagcataagaatgcagaagagcattccccacaaacacctgccccacaaatcccagcttaacaaccacgccatgggtgaccatcacatgctcccacgcctgtaccctcgcgcacgccttgaggaggaatggcagcgtgaactcgttcggcaggatgcctcgccggatcatgccacgaagaagaggcagcgcttcttgggggcaatggctattgcagtaggctctgataagactgttgtaaacgaacctgtccggatcaggaattctgtcgaacagttggcgggcataccacaccccaccaccagccggtagcgcgcagtaggacgcgaggatctgagaggtgacgtcgtccacgccgtggacgacgaggtgggcgtggagctggttgagacggtgcacggagccgcaccgccgcaggagctcccgaacatggcgggcggaggaggcgccgccggccgatggcgcgagcatcggagaggagactcgaagcgcaacctcccaacgggccgggccaagctagaggaaaggcccatgggctttcacctgctcgcgcatatggagagatcgagagagggg

SEQ ID NO: 28058 - DNA, 569 bp, Oryza sativa
tcatggtttacggcagactaggattgctgttgaactgatttcacactgctaagacacatctaagctggaacaagtagatgaaacgaataggcagcagcattagtatagtagccattaagcaagtttcaaagtggtaagaaactacgagctcttccaagtatgtgaaatcatggaccatagagtgcttgtgagtaggttatcaaactggtggtgtgacattccatttgttcagacatgcgagccctgaggtagtaggtcgatgggtcttatcagcttagtaagctgttgttgcaattaaattggtttagggaactctacacgagtaacgaggaaattgcctattgtctatgcaagtttgagcaacagtcatcaacttggcatggttttgctggttctcactagggttattgtaaggatgttgttgtgcgtttgattatcctggattaaacttagactagagagttgaagttatatctaccaccaagggcgttggttcaaatgacttgctgcatatccgcaaccaacaaatgctgtagtgggacatatgtggctctgtaaatattggatcg

SEQ ID NO: 28059 - DNA, 1032 bp, Oryza sativa
ttatccccatttgttatctattatgaaattgtattacattttgctgctactttgattgtttgttaagggttgccatgcaacatatagattaatgagttgagtccatgatcctggagatgcccaattctctattattgtaaactgtgatgttcttgttctttctggaatttctttggggcaaggaacttaacagtgaaatagaggcttgcatcaaaagaaccaaaaagagtaaaagagggtaatttctaccagttctattgatgactttgtggcttagctttggttcgttttctgttttatatgaaaacagtatattcttcactatggacctctctgctggttggcaaatctgaatccgtttgttcaatccattaggttgcattcttaaaaggcatggagttaaatttccatggtggtttttcaaagtttactttggttgatgctttcatagacgtagtatggtccaatgtggggctgtaatttgtcatcattccagttatgtcatcacatgtggcatgtgatatacctgtcataaaaatgcgtttaatattgccatgctttcaccaagttgtaacgatacactattgcataattgctttgaagtttgttttgactagattgaagatgtgaaaatatgatctaattggaatactgaaatgtctacatgattagctctaaacctgccacaagttacttgacattcttctctacaggcttttctgaaggaagctactgctatagttccacttgttatatttgatgatgcaattggtgatcctttatctactcttgaccagttttgatagttcattttttggatctggaatcgtactagaggtatgcctgaaatgcattagcttgtattcagaactatgctgatgaaggcatagttgatcatagatagtgttaaagattgtaaatctgcggttttcttttggctgcttttgtttaccattaagatttgaagaaggtgccaggcataggcaattctttctttcccaaagtagacttcattaacttgtctcaattgca

SEQ ID NO: 28060 - DNA, 378 bp, Oryza sativa
gtttctcaatagtaagggttcatattgatctgtcctatggaaatccagggtcttgaggtcaaggtcattgacgagagcatccaattaaggttgtgggaatttgacatgacagtatttaagtttgtcaaaccaaaatttcttttcaaaagaagcaaataatgtcaagattgtgtgataagacactatttgactatgaatgattgatgaattaagctatattaaaaggatcaacaagaaatcttaataaatatactgcaatatgatgaatagtgtgaaactcactcatgttatagcttatgtgttattatctggaatcgactagcgaaaaaatggaatctttatgatgtaagcctgatttgcgatttttcactacgtagg

SEQ ID NO: 28061 - DNA, 481 bp, Oryza sativa
gtcaagcatttttctagtcatttgtcccttttgacaagttaaagatctcaactttatggaaaacagaaacattcttattttttttataaagttcatgatcttagcaagagaagaaaattaaagggtatattcgcaacagatcaaagagcaatgactaggaaatcagtcaagatcttcccccatatctccttctagatccaaagttttcaggatcattcaggttcctaccatctttcaggtgcaaaatacctttctattgtgatcacaagcaaaatatgcattctgcacaaagtcacagcaagccccagcagattcttttctctttccattgttgatatcaagaagcaaagcgtttcctaccctgtaaacctaaggactcttgaaaccgaagaaaacaaaaccaaagccaatttcttgattaatcgccaaggcaaggctaaataaccctttatgtcagggttgacccaaacacctcacctca

SEQ ID NO: 28062 - DNA, 553 bp, Oryza sativa
atatatatatatatatatatatatatatatatatatatatatatatatatatatatatatatatatatgattgtatgatctttatgagatggatatttgaattgaaataactactacttcctccgtcccctaatataagagattttgacattttacttgtactgtttgatcattcgtcttattcaaaaaaattttagaattattttttatttttttaacttactttattatccaaagtactttaagcacaacttttcgttttttatatttgcacaaattttttgaataagacgagtgatcaaacaacacaagcaaatgtcaaaatcccttatattagggagtactactacatcacatacagttgcctcgatcattttaagtttgaatgcttgaggtagccatcatatgagacaggtagtacaagtcaatgtgttcaatttgttgttcacaagttaaaataattgggtagaaaatatgaacgcaatctttcagcacaaacatgcatagctactttggctgtgtttagatccaaacttctaactttttccattac

SEQ ID NO: 28063 - DNA, 1501 bp, Oryza sativa
ttgagaggtgactagagatcgggcggcttcttctttgtttgtaagccgtcggtttggttcggtgccaccaaactacaccttttatcattttttttacaggttctctattttctacgagatatattcaatttcttatgtataaataaatttgataaaactacaaccatttgtcataactaccagcttgttgcaactttagttgattgcatgataatcactgattttaacagaaatatacaactctgtatgttaggttgctcactgtcagttcatccatgcaatatccgcacattcatgcaaattaggcccacatatcagaaactgtataggataaagtcaaaattttgcaataaaactgtatgttttcttgtagttttgtgaaatgtcgttgtaccaaccgattcagttttataaaatttactctttatattttttctaaattgatatttgattttagaatttccactttgctacctgattttttgtttgatttttcctctgactattcatttatttagtatattcaaatataatgcttatgaagttcagttattgtataaaggattttaaacacatactttatcctgtagtacatttttagatacgttatttgcatctaaaagtgtcggattgataagctccgtagatgtaggaaactacaggtttaaaaaaataggaccaatctaggaaggactagattgatattgaaataaggaggagggtgaggctcgaacccggaccggctagctcgcagcttgcgttgctagccgggaagaccccgggcctttctcgaaactacaggtttgggatcaaccaagggttttgggtgagcttgttgtgcccatgagtgtttgggagtaacacaagtcatgtatacaagttcgagtttcccgaaagataacaattatacactcctgttttgttcactatcggctaagtccatataaacctggaaactctcaagctagctagcatagttcttgccaatttctagaaccaacccttttatgtaaaatcaaagtgttttgattattattttgtgatgaacaattggcatatgtgattattggttttgatatttggagattattggcgaagtggttttggagatgattggattttacagatgttaaacaggagctgctgagttttgggtccggttagaccgggcatgggttgccagtcaaaccgacggttatcgagcggtcagaccgggcgactctgtgttgatttcagtttcgggttgtttgtttggatatccgtgattattttatgtttatggcttctagatggatactacgtatgtaatactgttatttgctaacaatgagtcaagttggagatagcttggtctcgaaatatggtttctttgtttgattcatgtgtaggtgacttgatgcctcgagagagtattgccggtgatggatcgggagtcgacttggggataaagcgatgtccgtgacggtcagatatcatgcaggatacttaggctagagttcaa

SEQ ID NO: 28064 - DNA, 487 bp, Oryza sativa
tcgagctcggtacccaaatctaccactatacaatacacaaaaacctccagtcgaggataggatttctgggctctcgcttgctcttgtgttcttccttttccctacgcaagaggagggcaagcaagcgaagcaggggagtgtggcgaatgtataggttcctctcgcctcgacgagaggaccggatgcgcgccgggttccgtatcgatttggtggcggaaagccgcgacacgttggcgatgacggggagacgaggcgagtaggcgacgtgggggggtacccgcgcgggtggaggggagtgggatcgcgatcacgggtggggcgtcggatctcgcgatcacgggcgggcgtgctgtgattggccgcgcgggatttcctgggcgggcggggcgcggataaggggtgtgtgtttggttggcgtcttggcgaggcgatgaggcgcgcggataagggcgtgtttgggttacgttacctgcaccgaacctggctc

SEQ ID NO: 28065 - DNA, 1501 bp, Oryza sativa
catacaagttacatatttaatatcctaatttattaaataacaataaaaaacatatattattggaatagttagaagctcgagctcggttcgacaaagctcgcgagctttgggagaggctcaggctcggttcgtttgaagctcgagctgaacgagtgattattgaacctaggacctaggacgagtcgagctcgagcagcttacgagcctcgagctttttttgatagcctatcatgaagaaagctaccatgaaccacttaatgcatgaatagcaagaaccataatctgaacatactcaatcacatagatatgtaatgaaaacaaataaacaaagcgaacaatccattcatctcacacaatttaattagtttgttatgcacttgcattaacattatcagtaactcacgggtggcataaaaaatcctcaactcctaaaataacaaaattacactcaaattctcaataacgaaagactttgagtgttaaattttatccaccaatttaccgattaaggtctaagcctgaaatcaggaatttataataacccgtcaaaaacatgtcctcgctgttttattcataacacttgaactgctaaaccaaatttagcaaaaaaaaatacatatagaacatctacagaaaattatctacaactttcctatccatcaaaagttataatttagcctctatcactaacagatttgtgccatgtagggccagtttttgttgtatcattattgacagattttgtttaacatctacagaaaagtatcactgctttttttttctcctaaaccgcttatctgaatcgagtgaaacaagtgcctatagaaagatattaacatgacctacaagtgttgtttggaccacatgacctgattcccttactctttaattaatccaagaaatcaaaagaatatttcggactacaatcgaagaaatcaaaagaatatttcagcctacagtcaaaagattaaatttgatataccggcaactaaaactgtatttctacagagactaggatatatgtaactggggactatttgaggatacccttgtagtgaagaaccttaatttggaccactccaatgaactacactgtggaatccctaatttcctcttcgtcttccttttcttcgatctgtcctcttctactggtgagatcagaacagcagcagcaacgaacaggagtagattagcaggcagaacaacagattggtaggggaggatgcagatggcaatagcaaagaagaaactgacaacgcgcgatggtagtggcggcgccgcgcggcagtgggatctcaaggttttttttttctttttatagaaaattcgatccatagcataggaaaaaaagcggtaccaaaaaatagtataaaaatttttcgctttcgattagaagcacaggccacctgtttttcttagctccatagtaattctgtcaggtttagagttaacagcattagattgaagtatagaaaaattttgttggacccatttgcccttc

SEQ ID NO: 28066 - DNA, 1501 bp, Oryza sativa
aaaggacacccactacaatttttttctttgaaatgaaccgcacgagacagtgcgagatttcgtatcaaagaatatagcaaagatgaactgcaccaatatgggttccatgagtttgccggtcatgtttagcaatgacatgggccacatggcccatctctcacccggaacaagaacaaattcaaccaagtatcacaggagagaagggcagcaatcttgttcttgtcatcagctgggatcaaggaagaagagggcattgtgctcaaatgcttggaatattgggaatggaattgccacgataatgtctataggtgagtacacttgtctgaataatctttcactttagttgattgtttgcatcaatcagacatgattctccacatgagattgtgaacaataatcaacgcctaaactccgccaacttcttggttcatcttgtgctgtcagattagtattttttcctcttgcgactaaacatagctttcagatcagatgcaccgacagactgataacatgtgctttgtgcaaccattatgcaataatttaagtgcaaattgacagctgagcaagcgaggcgaggatgccatgtctgaacttcaaagcagctcaaccggggtacagtacttgcttgcaatgcaaacctgaaaagcatcgtaaaatcgaaattaattcttaatggcgaaagatcagtagcaacaaacacaatgaaaatacagaaacttctcaaaaattaagcgatcagttatgcagggatcaccgaaccgaggagcaagcaggaagatgcttcggagaaacaaaccactgcatcttcagagttcagagaacaagagatgaccagctctgttgcctcctgatcgaactgtgtggtttcgttgaattcggggagaccgatttgagagtggcgtgctgtccttctctctgaaataccttaacgaactttttaattctcatgagatgtcgtaagacattgacagtatttccaaattaacgcctaatgtttcaattccaggacccagattcagatcacaaatccaaccacaatacaccaatctgaattcgactttacttgctttttcttcaaaaacaaccagcttataatcatgattagaaacagaaagagagttaattacacagacggccacacgaggcacgcagcccaatgacacgctgtcagcaacagacttgcaacagcttgcgccgttccgtccgtctgcgatcacgacgccgacggtgccggcgcccgcagccaaaagttagacggcgacggtaacggccgtcaccgtcccccgcccgccacgtgtccgggatccaccctaacgccgtcacggccgcggcacatcccggaacattccgtcacggcgtgtgggcgacgggacggaatcccgcggcgccctataagaaacccgcgcttgcattttcctcgcacacacacaacgctcgcactcctctcctctcatctgacatatctcctcccgtcctttcgaagcctctcgaatcgcatcgc

SEQ ID NO: 28067 - DNA, 1501 bp, Oryza sativa
ccacccctgcacagccaaagccatccatcgatccaccgccgcaaaaaccaatcagaacgagtaaaaacaaaaaacccaacacatcgttccagtaaaagaagaagaagaagaagaagatctagctcaccggcgggggcggtggcggcgcccccaccgagggcgtgcgccatggtcgggggcggcggcgaagggaggggcgttcggagcgggaaggcggcgagggtttaagcgcggcgaggcgagaggggaggcggcggcggcggcggcggaggaggaggttggtgggggagtatttgtgtgtgggcgattgtggcttggtgatctgtgggtgggccgttgaaaaggtggtgggctacgactacgagtcggacttcttttttcttttcttttctttttcgaagtagaactaggatctactatcaggtttaccttttcattttcggtttatcaaaaaccagcaaaagaatagataaaaattggtgactttcgattaagacgatataaaaaccgagtaataccagtcagttttcccaaattgataagagcagctccagtgtgcacctaaaatcgattttaacatgaaaaaaccgaactatgcacactgtgggaagcgaaccgtatgtgtcagatgaaaaagcgacttcaaaacagaagtcgacattgatgataaaaaattacttgttgctacaggttgtgagggggaagggaaaggtgggattatttttttttttcatgggtcccacccaaaatcgattttaacgctgtaggggtcgaatcaaatgtttattcgacttctgtgaaccggacttaccgaaccaacactacaaatgccctaaccagcggtttcatgaaaaccgatcaatttttggattttgtgaaccctgactgactatgactactgcactagctagtagcctagtactgtattcggtttttttatactggcatgagaatttcggttttgcaagtgtattcggcgtggtattactattacatcacggtgcccgtggtttaaaccatgtcgattgattgaaattagttgtatacaaaatagagtttatgtctgtggtggaaatagaagacaaaaatatatactcctatatcgaatctaattctacaaggtaaaagtttttgtatactggcatcagaatttctgttttgcaagtgtattcggcatggtatttgatcatggtgtttacgtattatgatcggcgtagatttattaagattagttatatacaaaatacagtttgtgtctgtgatggaaatagaagtgaaaaaaatgtatataacgaatcaaatttcacctttacaatttattgacaaaacgtaagattacacctacctatctctatttctactattataaaaattgaaaaaaaaaattgtcggtattttggtacgtcatccgtgtatgagtcggttttttttatgttcgttcacttttgaaaatacagatctttatttgagtcgggttttaaatctgagtcatataagaaat

SEQ ID NO: 28068 - DNA, 1501 bp, Oryza sativa
aacgagatggtggcgtcgggcgccgtgacgagcgcggcggcgacggcggcgctgctggccttgctggaggcggcggcgccgctgggcttgctggacgacagcaagctcgagagggcgtacatggagaagtacctgccgctggtggcgtcgggcatgtcggaagacgacgcggacgcgctggtacgcgacatgatcgacgctgaattcgtcctcaggttcacgtcgccggcgtgggggcggcggccgccgccgtcttcgtcctcctcgtcgttctaccacatctcgtctgcgactgcagcaccagcgacagggtcgtgatgtgtgtcgccgtggccttcctcgtgctgataatggcgtacaaggccttgtaccatctccgggagcgcgcgagggcacacgacgccctcgccaagtcactggccatcttccgggaggtgacgtcgcggccaccgttgccaatgccacctgtttgatgaaagccccggcacctgaagtcacctcctctaatttttttatattagtttttttttctaatgccacccgtttagttaggtacgttttttacactcgactataacatgcggaacagctaaatttccgtcgacagaaatcagagagcaaaacttactaattttccacttttagattagattagatctgagatgacgtcagttggagagagaaaaagtagcaacgcatagcgataccattttttcctaggttacaatgtaattatttttttatattacaattgcatgtgataatatttttctaagttacaatgtaattatattttatttatatattactattacgtgtggtaatataattatgagtgaagatgtagttatattactaatatattatagttgaatttgtaagttttctaattctttagtctctctggtttttagctatgccgtaaaatttaggcaaaattggttatagcatcaaaagttcactttaatagcatctaaagttcacctccctcccattttaacacttccattaattcttgatcgttttctgtccgctttgattgttattgacctagccacgcacgcgatataatgtttctaccccttcacaagtccaagttaaatgtttccgtgattttttttcaccatatataactcaatgtttcaccagtggtcaattgcaacatttgaccgatcgatttttttttaagatcggctgcccgattcaaagattctttcggtaatcgcatgttgttttagttaggaaaaaaattaggtttgattatcatatcggatatacagacacatatttcaagtattaaacgtagtataataacaaaaaaatatagattccgccagaaaactgcgagatgaatttattaaacccaattaattcgtcattagcaaatgtttactgtagcactacattatcaaatcatggcgcaattaggcttaaaagatttgtctcgcaatttacacgtaaactgtgtcattgattttgttttgggaactaaagaagtcct

SEQ ID NO: 28069 - DNA, 1105 bp, Oryza sativa
aaaattgtcaacaacaaagttgtataacgcatcaatattacaacttttgttttggtcatttttctatatgactttgttttaaccgtttgaatttaaattttaaaatatgacaacttcaaacaatattttgaaatactaaatgatttcaactgaaaaagtcatcaacaacaaagttgtataactcatcaagatctataacttttattttggtcatttcttcatccgacatagtgatagtaacattgtttataaaatttatatctatatcatttggttctataaactataagagagataggtaaactttgtaaacaatactactatcactttattggacgaagaaatgactaaaataaaagttgtatgtcttgatgagctctacaacttttatgttcatgactttttttagctgaaattaattacagcttcaaaaatattatttaaagttttgaaattcaaatttttaattgataaaacaaagtcaaaagaaaaaaatggccaaaataatagcagtaagaacacaataacatgatagagcatgattttagaaacatttaggaaaaaaaatcatccaatttggagttcatatgagtgagataaattagtttcaaattttcaaattttatttttgcatacggcttcttaagtcacccgtgtggaaaaatcaatttttccatgcgggtccttaaatggtccacaaacaaacaaatgaaaaaaattcaattctgaaaaataactactcaaatttttaaaaactttcaactgaaatgttcaacccaaaatttaaaatatttaaaaaattttcaaaaatttcaatgtgcttacgaaaatttcagtgatactcattaatttatttgtttcatgataacataaatttgtatggaaagtaaacaaaacattttctatctccccttgcccttataaatagagataaaatttgagaatactgatgttttgtttttgaaaactaatggctatatcgtttttagaagcttattttgtggggtcttgatattttgataattattcgttaccgtattcatttcgattcgtattcgctccgtatctgtattcgataatattcgattccgttttcgtatccagg

SEQ ID NO: 28070 - DNA, 1501 bp, Oryza sativa
caggttaacacaattcaagaacttaggcactaccaaatacaataagttgttttaggcagaataccatatactctcccaaattgcaatcccttatggacataatttccatcactttcaaaccattcaacctgtaaaatggcccccaaaatggtattatcaatgccatatatgaaatgtgcagaatcatgccctgccaaacagcaaaatgaaactatgaagctgatataccttcaatgatggatcaacttgcttaaatatcatatctgctaggcttattccagcgacaacaccatcctcctttgcaataaaggtggcttcagctttcacgtcagaaggtatggttgccaagcaagatacatcccctgaaggtgtaaatatgatgccaagagtgtcagactcatactgaaagatgagaactgcaaataagttcaaagcacagcaatagttcaatgtcaaagatagaagaacttaagtagcattaccatactagattgttactagtactatttaggagactacagagggctaaagcagagcagcccacctgaatatgttcctttagctccaatagagttaatcatatttgtaggaatctccaatgatgataaacttattttgctaatacaaccgcagtgtctacgttcatgactatgctagtaactgttaaagaactgaagagaaaaaacaacagatataaatgtaccccaaacaaattgattgcatatatgggattgcaatttacagaccaccgcgaaacttaggccctctttgtttaagcttaggcttattagtttagacttttaagtcagcttattggcttttatggtttataagctggtggatttaatgtgctaaatttagtggtggagtcatacatctatctcaaataggtcaaaaaaaacttctccaacctagtttttggtttaataatgttagagtggcttataactttagaaaagtcaaatgaataagccgcttgtttgtttaggcttagacttttcagcttataagttggcttataagcctaaacaaagagagccttaacaaagtgatcttacagaccagaaatgaataccaaaaaacaaatgttagtacttaattgtgcctacactacactacaccactacaggaacaggatttgcttgtggtgtcacggcatacacgactgctatctacgttgcgtacctcggtcgccggcgtcctcggatagggcgaggttgatgacggccttgaggtcgtaggtggggtgggccggcggcgccacgggcacccgcgcctcggcggacatggaggcggcgcgggggaggcggaggcggaggcggttggagaacggcgatgaggaggagtatgaggaggggaaggagacgaggcctcggaggcgtggggctagctgcagaacgttgggattgggcggcgcggcggcggcggcggcggcgggcatcgcaaacgcagtagccgccggcgtctggggatcagcgcgacaaaagaagggtgtggggag

SEQ ID NO: 28071 - DNA, 1284 bp, Oryza sativa
aattagcaatgccacgattgtaacttagcatcgcttttcaattgtaggtatatgccccacacacgtcaaagattcgtttattgcatattaagttttcctaagtttggccagcattttactataaccacatttatggaccatattccctacctaagatttggttttactactaaggttagtcatcaaaacaaacacccttttatacgaacgcgcgcggaccatatagttatgtagctatatgaacatttgatagtttttctttaaaacaaactttcaacaataactattgtgtgattacaattttattgtagttacgctgtaactaatatgtaactcgtacataactaatagaaacgacatgtcgccttattggctaggagtagcaatgatgatatgcatctaaccggtcatgtgttcgactctggctgtgcctttttctccctcgcgcacaaatctcgaaacaatctgacggtcaacaattcaaaagttttgtgttaaaaaatatcgtatgctctttagccattccgtaaatataagagattttaggattcaaaatttgttaataaatacaagggaatattatatagtacaactttccctaccaattaaccacttaggacttaattttcacctaatatcttgtccccgacaattcccactctctcaacatcccttatataagaggcatatagtattttccttttatttttaatctcttcaaaaatttaaaataatctcttatatttataaatagagaaaatagtttagtgtggctgcatagatcatttaatcgtatatataaatcgtatacatagcatttttgaaacatatgtatattcatcctttagcaatcgtacacataatgacataaatcatatgcatagcattttcgaaatatgtgtacttgtgtcaacctctgtcctcacacctacattcaaccatacatcatttaatagagggtattatggttacttctttttaaatcttaatatttactaaataattactccctccgtttcatattataagactttctaatattgcccacattcatatatatatatatatatatatatatatatatatatatatatgataatgaaactagacatatatcattgtccacattcatatatatgaatgtagaaagtcttataatatgaaaatgaggaagtaattaagtattagctataaaaaaactttttgcaaaaactttttactgaataattaattaagtattaggcgtgttctcttttggagaagttgggaactccacgggaaaga

SEQ ID NO: 28072 - DNA, 475 bp, Oryza sativa
tgatttttttggcagtcaaaaatacccaccaagtttagtcattatcttggcggctgaaattaacgcggctatgtagaaaccaccaaggtaaagtgtattcttgtcggtctagaccgttaaggttatatttcttagctttccaaaagtttgatattcttcatagttttcttggcggttagaccaccaataaaactttcccttatggttaacagtcaagaaaatctggatttccctgttaccttagacttggtggtttttgggcgctaaaaaaattacggattcttgtcatattagaaaaggaaagcaagtgctttcagacgaaatttccctgccaatacttggcaaccaaggagctaagccatagttagcaccagctggaactcactgatgacttgattcatcaacaaggaaaatgccgtggtctttccattgatttggctaggtggtggtcaatcaagcagctaacgcgtgcgca

SEQ ID NO: 28073 - DNA, 1136 bp, Oryza sativa
atcgatgatctggtgttctttgttacggtttgagctatgatgggcctatttaggccacaaaatacataacttatatggtgggcataaatgcggcatcttatatagttctatctcggcctatagagtctatctaaagtctctgatctctaataccagaaatctccacccctatacaaaccgtgcaaaaaaggtccggatgtagtatagatctttggtttcgctgacatagcatcctagtcagcaaagaaaaataaaaaaaattatgggacccacatgtcaatgagaagaaaaaatgtgaggctcgcgtgtcagcatccttttctttctgctcttttcttccgaagcttgggaggtaaggggaggcgcccaacgggacaaggggagagaggcatacgcgggagagggagggggaggcggcgtcaggagccgttgccgccattcagctgccgcccgatgctagccacgaggtggagttccagcgagcctagtgggaggaggaggcgattggcgggagaaggaggagactagaccacgtctctcttcgtcgttgtggccgtcgttgcgctatcgtcgtgtcgctctacacgagccgcaagcacagcaaggtgtggaagcagcagcaatagtggagagtgttagatttaattgggtaattgatccatttaaatcaattaaatcaaataaattccaaggctcattatgctaggaattcatgtgtattcattcttttatgggatatcaatgggatgaagagttttgagaattaatccatttgattagggaattggtaacttatatcaattagtcctaattgattgttggttgatggttgtgtagtggaggatggttgatggctagttgatgacaattagttgctctattcctcttcctattccattggtaacttacatcaattactcctaattgattgttggttgatggtggtgtagtggaggatggttcatggctagttgatgacaattagttgctctattcttcttcctattccatgactcttactcttcatcttccattcctcttataaaatgagaatggatttgatttcccacgagaatagtgagacacactttcatccattttctaacgctgttgctgctacggtaatcccatcccga

SEQ ID NO: 28074 - DNA, 1501 bp, Oryza sativa
gtttgtggttgcctttgctctcaggcagaaacaatgcaattctatacgggtactacaatttatacaggaactgtgtggaattgcgtaccttagttttcctcttcagctctgcccatctgattgctctagtgcagagctgctccaccctcttgtgcaacgcatgtgacttccctgcatcaaacagaggaaaaaacagtttcaggctcagctacaagtacaggattacctgcgaagtaggtgagtgagaccaaaaggaatctggaaatgtccttgcctgttctggggtcacggccggcgaacacaatgggctccatgccaccgtcaagctccgggagcgcaacctgcagcgccacctgaatcgggtgcaggcccaatgtgctgttcagccactcctctgtcgtctggaacacgagcggcagtgccacgatgtacggcacgtcgagcttctgcagcgcggcgatcgccttgggatggtcctgcctcgctggccctccgacgagcgcgaacccggtgagcgacaccaccgcgttcacgaacggctttccggtgatcgggtcgacgaggtaccgctgcgtgggtcccgagaagtccagcccgccggcgaagatcggtatgaccttggcacccttggcctccagctccatgatcacggcgacgtagtgaccgtcgtctccggtgacaatgtggctcctctgcaaaacgaggccgatcaccggcgcgttggggtccttgagcttgtcgttggtgtcgcggcgggtgccgtaccagttgaggtactccttgacgtcgtcgtacatggtgggcgccagcgggtgccagataccagcgtcgaggaagaggacggggtcgtcgtacttgatgtcggcgcccttgagcgccggcacgtaggagacggcgatcatcttgaggaaattctggaggttgtccggcgagcctccgagccagaactggaggctgaggatgtacagccgggcgtcctgcgccttgtcggagggcaagtacttgagcaccttgggcagcgtgcgcaccagcttgagcatgctatcggcgaagccaccggagttcttcttgcgcttgaagagctggaagaatgggctcttggactggccgagctgggacatgctgaaggagccgagcttgttgaggcgcatgacctccggcatcgacgggaagacgagcacggcgtccatccggtcgcgctccttctcgacggcatccttcaccttgagcgcgagctcctccacgaagatgagcgagccgatgaacacattggcgtcggcgaggtcggcgcagaaggtcttgtacgtctcctcgtcccggagctcctccacgaggtagcccaccacctcgaaccccgccgcgcggcgcgggtcggcgttgagctcccgcaccgccgccgtcaccgacgactggtactgcgcctccagcacgacgtacaccaccttcacccgcggcaccccgcgccgcgacgcgtcgccctcgggcggcaccacgcgccgca

SEQ ID NO: 28075 - DNA, 1501 bp, Oryza sativa
acgatcttcactccacgcgtaacttatccggactccacgccgtttgcatgcaccagatttttcggaacgtttccaaaacaaaaacgaatccgaatttgcagcaaaacaaaactgcaaaaggagcgcaaggtgaggaaccaattttggcggaccattcgacgcgtacgtcgtgcacgcgcgccgcctgccctgccctgtcaggcgaggcgagcgagcacgcgcgtgtgttctcctctcttctctccaccacacatgcttcaagtagctaggagggcatcctcccttttaaggaggtccccatctcctagaataagcaatgtggtactaaactccacatgcatgccatcccatgaggcgggcttttgtgattttccaaagaattaattttcgagtgggctaaggcccattcattaattccaacaagtggttgatatctagctacattgcagttcgatatactccccccattccaaattaatctacatattccataggtacaccaagacaaaaaaaaagctaataactctctcattctatatttactctagcaataaactcaatgcatgcaccatccccactattttctagccaatagcaaattaaaatattgcatgtgggttataaatgcttgtgtgcatggatgcatgtatcaatgtctatttactccaatgcacaaataacgaatagacctaatgaatgaacacaaatatgtagatcatttaggaataacctcaaaaaaattatatgtagatcaatttggaatggagggagtagtattgatttgaccatcgttgaccaagaataagaacagcgaatttgcataatgtcaaacggtgtctgagtcgctttaatttgacgatagatccaattcgtttaatatttcggacttcatatttctgttactgcagtagcctttgggttccttcagcaaattcatctgtgcttttgtttgtatatttctgttactgcagttgcatttgtattccttcagcaaattcatttgtgcttttgtttcagttggttctagcagttgaattagcctgaaatccggatagtttcaggaaatttcatctgagctttagtttcaacagacctccgcaggaaaattttaacaacagtgagtgagtgtgacgcactgacgctgcacttggcagttggctcttgcacatcactctcaatggcaatttctgaaaatggcatagcattgctcagagtcacaggaattcacttgaaatcatatcaacattagtggcagagattaatggaatagcttcaaaacataaacaaaaagaacagccgtttttttttgtggagaagttgggtccaaatgggctgggcccaccaatcatttatggcccatgggctcaaatctaacggcccatgaacgcatctcaccgtccccttctctctcctccgccgcctcctcctcactagtgacgacaccacccgaccaaaccgcaaagcgacgcgacgcggtaaaaaaaggaatcaaaaaggcgaa

SEQ ID NO: 28076 - DNA, 1501 bp, Oryza sativa
aacagccaaacagtaacttacacattgttagggcctctttgatttgaagaaaaaacatagaatttttagaggatttgaaccatatagaaaaatttcctatgaaaccctttaaaataaaagattgaatcctatcatatcctttaaaattcctatggaatggacaatcctataggaattttgaaggaaatttagcaagagctccaacctcttgaaaacattcctttgagtctatctctctcatccgattcctgcgtttttcctgcggttcaatcaaacggtcattactgtgttttttctgcgttttgcaatcctctgttttgcatttatatttctgtcagaatcctacgtttttcctattcctccattttttcattcctaatattcaaatgacccttaattcacccggcaatcaatcggattagaaaaaaaacaagcaaaataaagagaaccgtcatagagcagtccgcaacgccgcaatgctcgcccgtacgccgctccgcctgcccatgccgctacacgccgctgcgcctgcccatgccgctccatcgccccaaccgcacgcccgccgtatgacgagtcggatccggcggtgccgagctcgtagccgctggatccggcgttttgcgagggccaaagagcagcgagagagagagttggaaggcggtggtcgtcggtgaggaagagtagcggcgaccggcgtggaaagtggaggcggcggccgacgacgagaagaggagtggaggcaatccatccctcatccccaagccctcccttcaggccggaccttcgtccccatcgtcccggtgatgtgaagggaggggaaagcagcaaccgtcgttgcgcaacggcggcgacgacggcgacgacgctcgtgaggcaccgaccgagcgagcaaatgaggagtgggaaggtgacgggatgctcgaccccctctcgtcacgctgcacccactggagggcgcgggtgcgagccaggttcggtgcaggtaacgtaacccaaacacgcccttatccgcgcgcctcatcgcctcgccaagacgccaaccaaacacacaccccttatccgcgccccgcccgcccaggaaatcccgcgcggccaatcacagcacgcccgcccgtgatcgcgagatccgacgccccacccgtgatcgcgatcccactcccctccacccgcgcgggtacccccccacgtcgcctactcgcctcgtctccccgtcatcgccaacgtgtcgcggctttccgccaccaaatcgatacggaacccggcgcgcatccggtcctctcgtcgaggcgagaggaacctatacattcgccacactcccctgcttcgcttgcttgccctcctcttgcgtagggaaaaggaagaacacaagagcaagcgagagcccagaaatcctatcctcgactggaggtttttgtgtattgtatagtggtagatttttttactgacttgggagttgtgtgatagtgtgggttgcgttctttttttagtgtgtaaacga

SEQ ID NO: 28077 - DNA, 1501 bp, Oryza sativa
gaaacattatatcgcgtgcgtggctaggtcaataacaatcaaagcggacagaaaacgatcaagaattaatggaagtgttaaaatgggagggaggtgaactttagatgctattaaagtgaacttttgatgctataaccaattttgcctaaattttacggcatagctaaaaaccagagagactaaagaattagaaaacttacaaattcaactataatatattagtaatataactacatcttcactcataattatattaccacacgtaatagtaatatataaataaaatataattacattgtaacttagaaaaatattatcacatgcaattgtaatataaaaaaataattacattgtaacctaggaaaaaatggtatcgctatgcgttgctactttttctctctccaactgacgtcatctcagatctaatctaatctaaaagtggaaaattagtaagttttgctctctgatttctgtcgacggaaatttagctgttccgcatgttatagtcgagtgtaaaaaacgtacctaactaaacgggtggcattagaaaaaaaaactaatataaaaaaattagaggaggtgacttcaggtgccggggctttcatcaaacaggtggcattggcaacggtggccgcgacgtcacctcccggaagatggccagtgacttggcgagggcgtcgtgtgccctcgcgcgctcccggagatggtacaaggccttgtacgccattatcagcacgaggaaggccacggcgacacacatcacgaccctgtcgctggtgctgcagtcgcagacgagatgtggtagaacgacgaggaggacgaagacggcggcggccgccgcccccacgccggcgacgtgaacctgaggacgaattcagcgtcgatcatgtcgcgtaccagcgcgtccgcgtcgtcttccgacatgcccgacgccaccagcggcaggtacttctccatgtacgccctctcgagcttgctgtcgtccagcaagcccagcggcgccgccgcctccagcaaggccagcagcgccgccgtcgccgccgcgctcgtcacggcgcccgacgccaccatctcgttgtggcgcgccgcgcaccagtctctcctcttgaggaagtggctttgcgggccttgcggcagccatccgacgtgcaagtacttccagacgtcgtcgttgctgctggccgcgtttttcggtggcgccgccgtgttcatcatggccgaccggtttgatgcgctctttctttttagaaaaagaagaaaaatcacggcacgaaaccaccagcaagtgccggtctggctggctggaatcctgcatcgtatccggattttatttcgtcgttgtaccgatccgattcggatctgtattgtatctgcatcgtatctggattttgtttctgtattgttttttgggtttttttatacataatttatattgttgattgatatataccacctttttgttatgagtgatggttattcaagatgcatggtgaaatcaatt

SEQ ID NO: 28078 - DNA, 1501 bp, Oryza sativa
ataccccaaccgtgacattcctccactgaaatcagaactatggaaggagatgggttggcaaggcactgatccatcaactgacttcaggtattccatttattccattttctgctccagtcgaattcagttacaaagccatctaatgctgatattgtccacgcaggggtggaggattcatatcattggagaacctcatatttttcgctaggaactatcctgtaaataccttctatatgatattctgagaagatttgttaatgctgtttgtttttgtataattactcacctattctggtacagggttcctttcaggcgcttctgaacaaagtacaagggcagagagcagactgggagtacccttttgcggttgctgggatcaacatttcatttatgctgatccaaatgctggatctacagtcaagtaatatctcagtttccaaaaatcgtctttacactataatggttggtgtggttcccattcccctggtttaacgctcttcgaactgtgcaggtgttccatcttcaaagtcaggagttcgttttgttgaactgcttggacgagatgagaatgcatttgatcacctctactgcatagcctttcggcttctcgatgctcagtggcttgtgaaacgtgcttcttacatggagttcaatgtaagcccgagtaggtgcatattatgcagttactgtgtgtatgttttaatcaatggcatgcttatctgttcgttttcgtggtgccaggaggtattgaaatctacaagaactcagttggagcgtgaactagtactagaggatgtattggaggtgaatgacctgccgtcttacacaatgctggacaaataatccaaataagtaagggactgtatgtggcattcaagtgaaaaaagttatccggatctgcaactgatttatgttggcggggccttttgttgtctgaccatctgagtgcatatttatcttttccttgttcaagagaaaaattcaggcctgtgtacatagtgttcattttctgtaacttatgactcgcctttcaaggcaataataagcatcaagttgatcacactatgtagtatgtactactgtttgtgcattgtcccgaatcaaagttgttttttttttcttttttaaatgctacacccttcgttccatattataaatcgtttaactttctttttaatcaaagttactttttagcattgcttataggaaaattagtaacatcttctacaccaaatttaatatattattttgataacatgttcatctttatatatattttttaaaaaatacccgtgtgttgcaacgggtgacaattattttaatcttattattgttattatacagtttagttaaggtgaaattcactattggaattcgcttggatatatttctttctagaaaatcatgagctacaatcaggagttcaatcatctcaagttagcatgcgagtttttttaaagagatatcttatacagctccttccgtatttctaaaagcgtac

SEQ ID NO: 28079 - DNA, 1501 bp, Oryza sativa
catggagatgtcgatggaaggaagaatgagcatgttgacatatccagcgtagattcccttaatgaacctttactagggaaatctagctctgatactggtggatcagaggtcaggcctttcttatcatagttttatttaccattgctactaccttttcggacgaacacaactgtagtatatccttttctaaggtattgacagaattttccgccatctgaaggtatatgatcccagaaggcaagacttatgggatgatgatagaaagaaggaacagctacactggtcatttcttttctcaaatttgattgcgcaatgggcacaatggttaggtactgttcacttgcaatttgcaactttgaataagttttgtcccacttgacactagttggctgccaatcctgtcattgttcatttctgtttcctggttttctaattttggagcacatgtaatgagttacagataatccttactgattataacctcagtaagctacccattgacaccatctttcagagttgatattctaggttaatgtgcctatatttctcatacacagtatgtttatgattttgtctcatacaagcattatttttttaaaaaaaaattggtgatgagtaaccattggtagaatggtagtcaggttgtcgggctgatctaatgcacacaggtatagttctgtttttgtgtctgcccatgccatactttatataattgctggcttgctgctttagcacgaattcaagaataatggatgcagctgtcatcatgtcttagttctcttatggagcctttagtaccttatcttcatttgctgatgtcatcattttcataagaactgcaaaaacattcttgtgggttagtaaacttgactaaacagaataactgttgtgaagtaagtttgctaatttggatgtccgtgtcatatcattgaccctgtttcattttttgaaatcatgcaaataaattgttgatgtagcaatgttcacttgcataagaaatcgtagcagtggaagtagtattttttccattctgtaaacccatgccttaattttttttctctgattcactacaagtggtattgttgtgccgtgttgcaactatttcacagatgtaacccttagtgctttcaagaataagatactgattcccctttgctgttctacgtgcagcaaatattattgttggctctggatcactatttggtagattgtttcccttttcgttggacaaccagaacagcagtccagtgtatcttagtcctttgcaggtaatgtattgagaaaaggtataatagacacacaggaattgatgtaattctgaaccttaatgtatacaattttctttcaggaagatagactgaatactttaaggtctagattgcaaatccctttcgatggctcccgtgttgaacaccaagtatgtaaacctatttcaatagcttaggcctggctataatgtggccacaagtgaccctcttattcaagcaagtaattttgcatt

SEQ ID NO: 28080 - DNA, 333 bp, Oryza sativa
cgtaattgcaccaactcatgaagaagcactcatggttctaacaccacacagtaataagaagaggttctctcagctatgagccaaggacactctctctctatatataaaatagtatactctttcaatttttttacactagacctcatttattttaatgtacaattattgctagagctacctattctaaacagatgcaaaataatttcatataacctctcgccacccaccggcgatcactttccccaaatcatgggttcttcgtccctactctccatgttgtcgatggaattgtcgctatggatccaagcctcctcctctccctcccccttacca

SEQ ID NO: 28081 - DNA, 377 bp, Oryza sativa
aattgagacattcaaattttatatataactaaaaaatttaaaacgattggaaaccatacttaggttgtgttggttgggagtgggttgggaatgaatcctcttgtacgtaaaacggaacaactcattattgcaggatcaattaagtattaattaaaaaattctgaaaataaatcaatatgaatttttaaagcgattttcatataatttttttttaaaaaaaacagcatcgtttagcagtggctctgtttctgtggtaagatttagtatagcatttggttacactttataacttccatcctactacccttttcctatgcggttgggtcaactcatttcgggccaaaacccaaggcctcaccgaatgcgttttgccgcca

SEQ ID NO: 28082 - DNA, 413 bp, Oryza sativa
ctcccccaatctcccaccctcctcccccaccttccatctcccccaaccccccatcgccctctccttccccccctccacgcgcgcgcgcgccccggcgcgatcgatcgatcgatcgcccccttctctcttcccgcgggcggacgcgcgggcggatcgggtgcgcgcgtggggggccaggacgacagcgtgcgtgtgtgcgcggatggcgtgccacgaggtgggcgcgccgcggcggaggtggtgagacgggcgggctcgcgcgcgatggttgtgtgatcggcgcggcgcggctgctcctcggtggtcggtccgtgcgtctttctttttcttctttggctggcggcggcggcggcggcggcggacaggggtggtggtggtggccgccacggggaggcagggagggggcgcgaaga

SEQ ID NO: 28083 - DNA, 1501 bp, Oryza sativa
accgggacgacgagcggaagctaccgtggcgtggctcatcggtgggaggggggcgtccaaggattcgttgctttgaccggtgacaaacgcgtgtgcttgaatcgttaatatgttgtgcttttatttttgttggttttgggtcaaaaagagagccaagtcatgtgcacctacgtgttatgcttcctcttattttcgtgtttctatttcggtgagatatgatggaatttggtatattaattgtatcgcaagtttctaaacacacctagatgttcttttcttttcctccttgttgtcggtaagagcaaaggtaacatcttacggacaaaacagagctgatagtagcagaaataaaaggagaggacatgaagcttttcaaaagatatttgtagaaacgccgtaggtttttttaaagggctatggacattgattttaagttcctttttctttgttaaagtatgtcaaatgacaccctgtataaactattagcttgtttaagaagctttgttttacatgcgtctcgtaatctaagctatagccataggtggtgtgtacacgcatatgtgatgtttttttagattgtgtgaaaaatacatgccatgcacgtaaatcacacgtttgtgagtgtgtatctattaatatacgctcaatggtaaaaatccatgcccttgttgaattcttactaaagcgcaaccacacgtgtagtattaattgataataggctgtgttaggaggttgaggttgggaactcaacctcctcagcgtaaaatagagcaatccattagcacatgatcaattaataattagctaaaataaacttgaaaactgattagtatcatttttaaaaaaaataacttccctatagaactttttttcataaaaaagcgccatgtaagcagtttgggaaatgcgcatgtgaaaaacgaggaagtaagttaagaattgatacatccgaatataactttacatatcttcggaaaacattcttcttttattcgttattggtataactctgaaagaaaacaattattgtagttggaggcacttactccctatatgaagcaaaatttatgcaagtttttagtaggatatgaccgacatttctacataaatctagcacctgcaaaaatcagtaaaccttttatgttaacattaatattaataaacatcccgattgagtcatgctagcgaaattaatttctggtgggatttatccaagataaaccctattattagttctaatatcattagtttcgtagtaacacatactcctactatgttactaacaaatgagcattgcaattcatctcacagtagacatttttttatggacgagaagaaagtaagaaaaaacagaaaaccgccagttcgcatccagatcacaaccagaggcgtccaatggcggtacaatccgtgctgtccatccgagacacgcaaccggcgccaggagatctccaccgtccgtatccgaaaccgccaatccagccgtccatcccttacccac

SEQ ID NO: 28084 - DNA, 1501 bp, Oryza sativa
ttatcaaaataatatatttaatattaaatttaatgaaactatctctactattataaaaattaaaaatgtttttgccaatggctcggtaagtcttcgtgtcccgaatctgcctcgcacataatcactatcagtttaactatttatgtgtctctaatccgtatctgattttcctttttccatcgtgtggtcagtccctaacggacttagactcatacacggagccgctctcctcatccgtttccaggcataggggtgtaactacgcatccgtctggaccacctgatccaaacaccctatcacacgagcagcctacctaactaatggcacccgtaatggcacccgtaatagttatctataaactatctacaagagatctatgtcagtatattttcctacttggaagagattaaatggagagaaagagcagagctatctactaacttagagatagtctatagagaaaaacgagacaatgtattagagagctatagatacccatatagacatactattgaagtggtttactattaatctagtctattgttgagatgtacatgttttatagatagcacattactttaccattgtggatgctctaaggctgtgttcttatcttcaagttttcaacccctctctctcattttccgcactaaacggcgtgtttttttaaaaaaagtttctatatgaaagttgcttaaaaaatcaaattaatccatttttgaaaaaatagctaatacttaattaattatgtaataacgcgtgctttgttttgcgtgcccgggagaaggggttcccgaacgcagcctaagcaggcctgatgaacatacataattttaccatctcatatttttctttgcaaagcccccatttctttgtcagctagccttccttgccaactttgcacatgtatatagagtcaacattcacatatctatctctaccattacaaaaattgaaaatgcttttaccagtatttcggtacgtcatccatgtatgagttggttttttaagttcgtttgattttgaaattacacatctgtatttgagtcgggttttaaatttgtacgcttttagaaatacggaaggagctgtataagatatctctttaaaaaaactcgcatgctaacttgagatgattgaactcctgattgtagctcatgattttctagaaagaaatatatccaagcgaattccaatagtgaatttcaccttaactaaactgtataataacaataataagattaaaataattgtcacccgttgcaacacacgggtattttttaaaaaatatatataaagatgaacatgttatcaaaataatatattaaatttggtgtagaagatgttactaattttcctataagcaatgctaaaaagtaactttgattaaaaagaaagttaaacgatttataatatggaacgaagggtgtagcatttaaaaaagaaaaaaaaaacaactttgattcgggacaatgcacaaacagtagtacatactacatag

SEQ ID NO: 28085 - DNA, 1501 bp, Oryza sativa
aattgcattccagatctccagtacatcgtccttttgtaatgggaggtaaagatgcatgagtgatgatgttttgtgagtcaaatggtgatggaaaacaaatgtgagtacatagtacggcctactcatgcctaatatatacaagtactgaagtagggtgtgtttatatcaggggtgtaaatttttggcgtgtcacatcggatatacagacacatatttgaaagcattaaacatagtctaataacaaaacaaattacagaatccgtctgtaaaccgcgagacgaatttattaagcctaattaatccatcattagcaaatatttactgtagcaccacattgtcaaatcatggcgcatttagacttaaaagattcgtctcgtaatttgtgtaattagttattttttcgtttatatttaatacaccatgcatatgtccaaacattcgatctgacatggtgtaaaattttgccagaagacctaaacaggcccgtattatatcaaaaactcttcgcgttggacgcccgcacaccacatcgcttaaccattccgacgtgggtctagatttggccaccggagaagagaaataagccaaatctatacctgtaaattttgtgatttttgatatttcagtctattttatcttaatgtttatttgagttaaattgaaatattgcaatgtgtattttaatggtgttttacatttttatcatctattctttgagaatctgtcgatgttcaaacggtgtaaactttatgttccatgtgtgaaacaaaaatgttttaatctttgattccactatctttcattattttagttattcaaaacattttttatttagagataaaacatttttctctaaatgcaagaatgtgttgttcatagaaaaacatttttctcgtcttggtcaacacatctttgtcatcttgagcagcggttgcggacgaggaagggattgggatcacttgcagtaggaatagcgactgcaagttaaactaatgcatgcgattacaaccgttcattttggtgatgaatggaccagatcttcagctacagtactgacgcaaaaaatactgaacatttcttgctacagtgttctacagtatccgggtgcatgtgaaccgttagattcggatctaacatgtggcagtggactgcgtaagttatagtgatagtaccaactgcacctgatacaaatccacgaggaagtgcctctcgatgacgacgaccccgacgcgccacccgcccgccacatcatcaccgccgcgccgggtcgggcgggaggcgatccctgccgcctgcggagagctgcgacgaggctagggccgggcggcctggatacacttcgcttgtgggggggcgaatttcttcgtgggctttcgtcttcacggtcacggcacagcccacgaaagtttgctaacgtgtcgtgcgccgcgtccgcgtgacagcaagcagccgaaccgagtcagtcatacactcgtagtcgtactccacatttgcctttgga

SEQ ID NO: 28086 - DNA, 380 bp, Oryza sativa
tctttgtgaaactcgttgatgaagttgatcgtattgtttgttatggattccaactctacacattcatccgcaattcattttaatgtcaaaggagccttagattcatgccaccacctaaaaccatcttcccttgctactttcaggcataatgactccattttgtaagatttcttgtttgaatttggacaggcatcgttatactattttgattgcatagttttattttaacagtgagatgtaggttaccatggttgagaccaatacggcacaatgttagagtgcagacatccaatgtaaatgttggagctggaagctatgaaggtggcgaagcaggtagccatggggaacatttggatagttctgctaccagagattcaaac

SEQ ID NO: 28087 - DNA, 560 bp, Oryza sativa
tttatcttggaatttgcaatggcatagtaatccaaagcccaccaaattatctctcctgtgcatacaataaagaacctatctaatttttccatcctacacaacttaggagatcgataacctgaaatcggcaaaacctgatgctagcttgaaacaacaattggggtctaaaacttatcataggctaaacatttacatttattatgaatgcaacgcccataattttgggtttctctatgccactatggcactatctgaaacattttggcccttcctccatgacactatctgaaattagactaggggttgtttagattgatgtcatttcaaaccataacattttttggtaaagttgtcaaaaatgtgcatctatttagtttttttaccaaactctggtaaatacataagaaaccctgccaaaacttggcagtattgccaaattgccaaaaattggtaaagtttattttggctacaatctaaacaagacctagattactgtactagtaaggatgccacatatgtttgattgagccacattgactgactggcctgatcatcaacca

SEQ ID NO: 28088 - DNA, 1501 bp, Oryza sativa
aataataagagtaggcgacgaacgggctgtagaggggtatagtggcatcgtttgatgggacttctaaaaattataaaaaatgaaactacaagtctaatttttaaaggttcagaacttctaaaaagtaaaaaaaaaacaatgataatcatgttcgattttaaaatctcaatgacaataaagaagggaggcagtgggtgagacgtagaggagtacaatggcaaagccgctgacggtttgacgggacttctagaaagtaaaactgaaccaagacgataattatgttcgatttttaaaatctcaatgacaataaagagaagagacagtggatgggccatagaggagtataatggcaacgtttgacgggacacctagaaattataaaaatgaaacccaacgtgacaataaactctaaaaatataaaatccaatttttaaaggttccaagaagaatgaatagaaatagtggtagatcaagcaagcaaataaagaaggaaatgatataaggggtagcaacaggtgtgacttttaaaaactatataattagaaacacgaggatgataaggtttggtctttcaaagtcttaagacaataagatagctatttaataaattttaagtaaaattatactaaaaaatatatgattttgtttgggtgctagccgcgcaattgcgcgggccacccagctagttgttgattaagtaaacttaaaacgtatggggataaatttctatcttgtaatactactcatttgcctatataaggagggcaggacacccctttgggtattcacaaccagatcattagatcaatacacaacttgaggataaaattcccgaaattggagttgagtattatctcttattgagatggtctgaaccatgtctaaattcttgtctccgcatatatctattttcttttgcgctatttcttttatattgccgaatttcagtttcgacacagccgaaagaaaatttcgtaggacggccgttctacggataggggaaggaccgccgttctaccaaattttcttccgtcacagccactgaccgagccatgacccaacgaatccccaagttcccaacgcgtcaaaaaaggagaagggacagcaaaccaggcaatgacacagctcaaaaaaggaaaaaagaaaagaaaagaaaagaaagaggaatatagggacacgaattgcatcttgttgttcctatggttctgccacttgtatttcagttacaagtttaattgggcaacaattttggatacagaaagaatcatatatacccaatcttttctttttgtttgtgtaaggagctatgtccagtctatactccttgaattttcattatctaaaaaatattgcttcaattcctacacacatgtggtgctgacaagcctaagtacgactcgttcgagaatcgagaggctcgtcgtctccagcctctttacgtgctatccgtgagctgaatattaccacaaattcggttcttcttgattgtcaccctcaacct

SEQ ID NO: 28089 - DNA, 1501 bp, Oryza sativa
aggataaaattcccgaaattggagttgagtattatctcttattgagatggtctgaaccatgtctaaattcttgtctccgcatatatctattttcttttgcgctatttcttttatattgccgaatttcagtttcgacacagccgaaagaaaatttcgtaggacggccgttctacggataggggaaggaccgccgttctaccaaattttcttccgtcacagccactgaccgagccatgacccaacgaatccccaagttcccaacgcgtcaaaaaaggagaagggacagcaaaccaggcaatgacacagctcaaaaaaggaaaaaagaaaagaaaagaaaagaaagaggaatatagggacacgaattgcatcttgttgttcctatggttctgccacttgtatttcagttacaagtttaattgggcaacaattttggatacagaaagaatcatatatacccaatcttttctttttgtttgtgtaaggagctatgtccagtctatactccttgaattttcattatctaaaaaatattgcttcaattcctacacacatgtggtgctgacaagcctaagtacgactcgttcgagaatcgagaggctcgtcgtctccagcctctttacgtgctatccgtgagctgaatattaccacaaattcggttcttcttgattgtcaccctcaacctcaagacaggatggacatgaatatcgtcgaccacgtcgtaagcgcaatggcagcaatcaggtaagtccacaaactgagccatggttcctggatcgaacagatcacacacacacaagacacatgatcaggtgatcaagatcttcctagaagcatggacagaaacttcagaaatcaagagtgaaactgcatgggattcagggactaccgatgttcattgcaggtggcagtgcgaacagcatcatcagcacgtagcggtacaatggatcgtgtggcaataatccaaccccataggcagcatggacaaccgccatcccgatcaagggttggatcacgtagcggatgcagacgatcgtgatgatcaccgtacgcttcagccctgcatgcacatgttcattatagcaccacattgtcaaatcatgtactaattaggcttaaaaaattcgtctcgcaatttacacgcattctgtgtaattagtttttttctatatttaatactacatctgtgtgtcaaacattcgatgcgacattttatggcattgatttactgttgattactgtagcgatcaatcccgttcgtccacgtttaatccagcagctgaaaatcgttcgaggaaaaaaaaatccaacttaacagctgaaaatgaagaatgcatattctagttgcggatacattcccccggcggcggtggctttggaccgatcccatcgttgattcggattcggggagcaaccgcgcgcgcaagaggggaggagcgagcgaggatcatcaggttggttggtttccgtctccgtttcgcttcggaagcgctctccacggttc

SEQ ID NO: 28090 - DNA, 1038 bp, Oryza sativa
actgttgtgtctagggattcaagtgggtagtcccgctatccacataaaaacccgtttgctagtttatttttcacatggtagtacaaaatttagaagaaaaaatgaagtagaagtaggataagtgggcaaaaaaagcccgcttgcatccgtggttgtgccatgtaatgactgttgccaaatgtggcttttgtgctagttaactctagttgccaaactgatgtgtgaaggctttatattgcctcacactatgcccaattgttgctatgctggttaagtgaacctaattatgtgctgctatgctggttaagtgaacctaattatgacttattctgctataaagattttcagacttgtgtgatccaaattgtgtcaactattctttcctgagattgaatttatccctgtcgattgttatgtgaagccaattgtgctacccacttgttatgacagacaaacacatattctgctgtaaatgaatcaaaattatgtcatgccatataaaaaaaatcaactagcacagtttgtaacatattcttgccaaatactcattgcattcataatgcaagttgtagctgcaaatactacaacgtgcagttcacattcttgataccatcacagatacgacaagaacacagaatatgacaacaatcgagagataaaatctctcattctctaccctagtgtttacgtactaattttctctgcattctcacaacccaaggctttgactgactccaactattgcctggcagcatcaagctctctgctcttctcctctgcattcaacctctcttcttgaacagccaaaaccagatcttcattcttcttgctcattgaccaaaccaaatctcgcaagtcattcaacaaatctcacatataagtggttgttggcccatcaaaccaagaaaagaaattgcatctttgaagcatctaggcccctgttgttagttttggtaattaataacaagcactaattgtggactaaccgttgtctttgagctatatacatttaagttaggttcacatcatgtgtgcgca

SEQ ID NO: 28091 - DNA, 1501 bp, Oryza sativa
tactaggggtagcatgggaagtagtgtggtaaaagttactttctacatattgtaggtagttatatttgggacaaaatttgaacctaaaggtagctatattgtgggacggagggagtatatgaaaactgaaacagtgcatcacaaaatcacttgcacaaattaatgcactcaagcaggagtaattgtttctgcagcggtgtgtttaaatagcaaacatttattccgcattattgacaaaatatgttatgtacttatgtttacttagtttccacagacgattgaaaagtcaaaaattggccttgaacacaagatattatcagtggtttctatttttgttggaagtgaagagtcaagagtttaaactaggaaattatacagctccctggttcatagagagaaaacattagttgcacaaatgtgttcttcttttcctaactattgcactaggaaattccaaaattgtacagctcccaggttcatacagcaaaaacattagttgcacaaatgttcttcttttcctaattattgcactgcaccaaaccccatatacattaatgtccacccgtaccttgtctacacattgctttatgaactttttatgggcgtcaagtgaatgtttctccaagcccatgtccttctccagtgctctccttacaccttcgagggttaaggagctgaaaagaaagaaaaatatatgtggtgtcattcctcatagttgaccaatataagagatctagagagcagaaaaggttcgaatttctagtaattagaagaaagcatcgacctctcctgcctgcgtgaaaattagggagaatgcaaccctaggatgctttatatgcagcagctatatacatttatcactcacatatcgccaaacccttttcatttcttccttacaggtttaaatacctagagagacacaagaaatctgatgcacagccattattatccttaaatagctgaaatgctgaatacaaggctgcaactacacgtggttcttcagaaccctgcgcaactaaataaccaaccgtcgcccagcaacatttctgaaatcacaacatttctgaaatcagaagtaccaccttgtcaaatcctagctagaacctgacgaatttggaggtagaacagaaatatttggtgcacacacctgctaatacgaaattgttggtttccctcccccccactaaaccctaggaatcggcatcactcccccttgcttctccttcacaaccctgccgaccacccgcagcagcagaagaatcccgaactaaaatcgaagattggaaacaaccaaccaggccataaacccctccccggttcgaaacccaaaaagcggacaccaaaccccccgcaagcgtgcaccagctgccgccgccgaaaaaccctagggccaccgccaacaacctcccgggcgcgacgcgaggcaggcagccaaagacacaggaacgaaccctagaagccgcgcccgcgtagaccaaaccatcccgcgcgggagagccga

SEQ ID NO: 28092 - DNA, 813 bp, Oryza sativa
atcaaaaaacaggtgttgtattgtctcattagatctacaaaagaacacctaagggctacctttccacctcctctttgctaagttatccttggttaaaatgactccctctttcaaataccacaagaaaatttttatcttcaaaggaagtcttagcttccaaataaaagatttcctcggtattacattaccatacatgagctttttgtacatcgaattgaccgtgaaagttccatttttgttagcctcccaaaaaaacacatccttttgcccctttaagcttaagtcaaccacgttagctacaatctcatgccaagcatggagattgtctcccactatggccctcctaaaggaaacgttcaaaggtacccttccaactaccttggccaccacctcatttttattccttacaagattatacaaagaagggtatttcttatctaaagactgattcccgagccaacggtctttcccagaatctcacttgtgagccatcatgcaatttaaatgaaccaaaagaacgaaaggtatccttaacccccattagtcctgcccagaagtgagagtccccccttcgcttctgcacttgcataatggttttactagaaagatattttcttctcaacaaattctgccagaccccctcctcattgatcagcttgtataaccacttactcaacaagcatttattctgaatctcaagattttgtatccctaaacccccgcactccttgggtttacacaacacactccatctggtcaatctgtacttctttttgtgctcatcactttgccaaaaaaacctagacctaaaaa

SEQ ID NO: 28093 - DNA, 202 bp, Oryza sativa
gaagtcgctggccattaaatgaaggttgaaatgggcgtccaccgggaaagcgggcgagcggggcaggaggcgtgtgctctgcttgtcagaggtcacttccggctgtagacgagccctcattgtaaaaagcatgtttcccttcttaggcagagagaggcccatgtggtgacccctgatcagataaaaaggaggaaggggggtt

SEQ ID NO: 28094 - DNA, 1501 bp, Oryza sativa
tcccacggcctcgccgccgccatccatcgctccgcccagctccatccccagttggggttgccggtgtccatgaacattggaggcggcgaggctcgcgcagatgaaggtttcctgttactccactgctcgcagaaaccatacaaagttcagaaaaaagaaaaaacgagcaagaaacaggcgatcggatgtactccgtagcacggatataaccatgtcacctgatgagaaaatgcgtatgccaacgccctttgccgccttaaagcggcttcttgcttcatcgtcagcacggtctcaatctgctccttggactgatgtccatggtcccagctttcaccaatctgccaagacattagcattgccagttttctttactgatttgttacaacggcaaaagtatgagttttaaggatacggatttttcatccctcgaagagatatcccctcgttatttacatatcatctaaatagttagtattaaaatattttttaaaaataataatatagattaatatgaaatgtcactttacaaacatgcacaaccaaattcgatttttacaagttacaataaaaagaacaaattaaactgaaaataattatcttacattcgtatctatatttgtagaagttaagttttaactcatgtttgtggagtaatatatttcatattaatttatcttgtcatttttaaagtctttttgataactatttaagtgacatgtacgaattgagcggatatcttgtgacgaaatgactttcctcgttataaggtctgaagatgcaaatgacaacagcatgaaacgatgcgatgagtgacaggagcaagtgatcatcaatgcattattgcacctttattctgtcaaggctctgtttaacgtggacctggcttttcagggccttcttgtcctcctccgtcttcacccgcctggagtgtatctgggtctggaccctcgtcatcgtttgcatgcagtacaaggcttcgtaggtctggcgcttcacggcgagcccctccagcagcagcatcaaccgatccaatcccctcgcccgttgcgatctccttccctgccatcgagtgttaaaatgttcccaaatcaaaccatcacgagccatgaaaccatttgagatcggcaaaaaaaaatgatgaaacgaacagcagaagagagggtcaattaccaggtagaccctgcatgctttctgaatcttgacggcggcgagctcctcggcggaacgcgccggagctcttggcgcggtggtcgtggggcgggtcaccgccgtggccgtggccgtcttctgtgcggcggcggcggcggcgtccgaggatttcgcctccttgatcccgtcatcccgctgccgatcaggcggcgcagcttgtggaggaggaggatgatgatggtgaggttgctgccgagccgacggagaggtcaccggcggcgacgacgtggacgcgctcgacttgctgaattgcagtatcttcttcagggtcgacctcttgcccttctcacgt

SEQ ID NO: 28095 - DNA, 690 bp, Oryza sativa
gaagtcgctggccattaaatgaaggttgaaatgggcgtccaccgggaaagcgggcgagcggggcaggaggcgtgtgctctgcttgtcagaggtcacttccggctgtagacgagccctcattgtaaaaagcatgtttcccttcttaggcagagagaggcccatgtggtgacccctgatcagataaaaaggaggaaggggggttgggactctggggaatgggttctagagcctgaactctctcccgctctccgctctctgtattccttcacgcacagatccaccagaacacaggagtagggtgttacgcttctcagcggcccgaacctgtctacgtcgcccgtgtcttgtgcatttcctctcccgctgacgttcctcagatcgagggcgaagaacctcacttagcgcccccggccgaaccggcaaaggggggcctgcgcggtctcccggtgaggagccccacgctccgtcaattatttattttatttgtgacttactttactttattatctacggtactttaagcacaactttttattttttatatttgcaaaaaaaaatgaataagacgactggtcaaacgttacaaagaaaaactaaaaatctcttatatcgtgggacagattgagtaatagattggcacgggtacaaccaatacgtcacagtaccagctaagcagtagtactagtaatt

SEQ ID NO: 28096 - DNA, 1501 bp, Oryza sativa
tatttcccatagaaccacagaatcagcggcatgatcatgtatattagggccaataacctcacttgaaacaactagtgaccattcaccggtatctgaaactcaacagtttaccctatgagtgataggaacaatatacaaaatgctgaatcagtactacaaacttttttttttcatgagtgtagtcttattcttataaactgcatggtaatctgagtgtggaaccatgaaaacattcatagacatgatcacttaactgaacacttacttctcggtgacaagtgaaatgccatacaggattagttcattttagccctctccatgagggttctacttaacattgtatctgcaaggtattgtagtctattggaccttggtacccccatcactgactgtcctgtttgtaggcgtgtctacatttttgcatagcatgtaatgttttgtcattattggggcatctgaatctgtatagttcattgattatagcattggaagtttggatcctcattatatgcaggattgcatgtggttgttactttacattcatttctcgcagttcctcaggatatttctgatttcttactattcaacatcatatctttttgtgatttggataagacgacaattgtcttttgatgcttgactatgatcattgagaaagtaactagtatttgattattcaaatgcaggtggagtcaatgagcaaccaggaagaagtagaattgcgtgctaagatcgaagcactaggactagaagttaccaaggtaccagagcagacacctaagcagcttgatgaggtaactgcaacaacctctgtttaatcccctttccgcgaatttatttacattttctcatctcatttgttttcgttcaacgctatctttagttagagatcgcagcagagctggacaaactatcagcgaggcttgataatgttgacaagatgatatcttctgccatggcctcggatccagaggtgaaatcccttttgagtaccactgctgatatctggatgcccgtcatcaccgcctctgccgatgaaaggcggggatttgcaggaacaagtggtgaaagcaaccaagaagagcaggagagttccaaacaatagcctcctacatgtaccttcacatgagtatttcttgaccatgtatcaacatttgtagacaaaacaagcaataagcacacattcatgagatggtaaataaatctgataacttgtggtggccattttgtacatcaattcttgagtcttcagtttgttatttttcagtttcgattctcaaagttgcgcctgcagagtgcagctgtttgtagctagcaaccacaacatttttatctggaaatgcatcaattttgtgtatgatgttgattggagtctgataacttgtcactggatgacatgattattttgtcttgctcctgctgcatattgttcatctggcgagccacgtcgattgttacataacagccactaattatttctgaaatatttgctcgctgtaat

SEQ ID NO: 28097 - DNA, 1501 bp, Oryza sativa
aagacattgaattcgagataggtttatcaactccatctgaagatcatctttcactgcactgctcttgaaatacagacgcatcatgcagaacaatgcaggcaacagcaagtattcaacatggaaaaaaaaagcagtaataactagtgagaacgcaatgtatcttgtccataaatcatagcaggatggtcatgtcctgtcctggtaacatccacaaacatatagcataagttcagggcaccaattgttatgccagttacaggaattattcaacggagaggcagtgtgacatccttgccatgaaggcagttcaacagacgggcactcgttagcccggcggccagttcatctgcctgcctccgaggagatgtacatgtatgtggtaaacagattggcctgcaaataaagatatcaggtgactgaagatgaatggtctaccaaatataggttctaatgtataagaagactgaaatgagacgtacatccactggggccatcattgatgacaatacggtagccatcttcaagtccctcctgctttgcaacaactttggcaacatagaggaggtaaccgagtatttctacatgcctctcttctgcctgtgaagatgggaaacatgaaatgcatttagtttcgaagatactttattcattttacttgttactcttgttaacgtttacttgtcactcaacatgagtccatgtcagttttttacgggcttggtaatttgtggcatgtgggtgcattccgaggtaagaatgcagtgagtgacaagaaagccttactcatcattcatgcttaggcaatctcccacatgcatgcaccaactcatggcgcctgcattagtgaggccaaaggcagtccataacagtaatcacattcatctacccaacatgaccaaaatgacatttatatattctctatttgggtaaggagtcagcaggttggattacacagctaattgctcctaggcccacaagggagggcaaggacaaatgagaaatgggcaaatttgaaatcacgaaagggttagtaaatttaggtaaactataaatcgactacatatgaagagaaaggttgacataaactggaacataaattgtgataatagatgagtgttaaatgctacctttgataggccagttaatccatccttcactttgggaatgatcacaatgtgggtcggagcttgaggatttatgtctctgaaagccagaacctgggaaacaaactcacagttcatgcccaaaacaaattcacattggagaattaagaaatatgaacaaaagtgtttgatccaaaacataagagtaatgaactgttgcagttctaggatttagtcatttcaatgcaataacagtagaacgacaggcatccagtttacttgggccttaggagttggaaactggagacttgtattgcagtactttagtacctagtgagagagaactatgtattcgacatttctggcacccgtgagaatgacctaggtaaggatatagc

SEQ ID NO: 28098 - DNA, 1501 bp, Oryza sativa
tcttctctcctacgtatataagcggcttccttcccaactaattataatgcatttcaggtggatcgattgattccattacccaacctcaagctagctagctctccaccgtctgcgcccattcaggtcagcttctgctttctgactgactttgagttcttcccatgttttgtcctctgtctcgcgttctccttgattttgggagctggtagaaagctaagctagattttagcttagctccgattgccatggagatcgtctggagcatgattcgtctgccctcctgcttctttggaggaagctagctagttatgttttcttgtgcatttttttctcttcttctttcttcttcctcgctttgcctcgttgatttggtgttgcctagtcttgcaattagttctcaaactttgcttcctgtcgagcaacttgaggcaatgagctggctgttttgagctgcatgatgtttccagctacgagtactgaagatgcagtttctggtaactgctgtcagattaggactgcaattaacggctggctttgcattagcattctttcctttttcttttttttttctttttgaaaccaagccattctttcctttttcttgtttacatgaatgcgtgcgttcttttttcttttttgaacttgtcattgttcttgtaaatctgctaaagtgctaatttgacagctaggttcctgctaaaatggtttctatatacatgaacgaagtataaagaaacttccagctctatacggttctatcgctggcctgagaataaaaaattgtagttcaatgcctcatcagtggacaacaatattctctgatatttaagtttccattttctttcttttttgggaccttgcaatcattccgtaaaaggaggtgttgtgcccagcaacattgacttgttcagtgtgctcgagcttcacgtctttcaccctcttgtaggagacgatgaccaagaacagtgcaagcaatgtggatatgtcattttcaaattaactaacacatgctagaagatggaagaaaaaaatataaataaaaatggaatattaataactgtattagtagtactcaattgcgttcctgaagttctcatacggttcccatactccttttctttttctttttttaaataaaaaaaataactaatgtatgtgactaagaaatctaaacgtttcatttctttattgatcgattatcttagcagggtgtacgagccctgaagaactttgaatcatcttttttttattatttttttagagaagggtattttttacccggcctctatatctaaccggatatatacggccattgaaatagggaatttaaccccgcaaacaacccaatctgaaattcgcaccataagagatttgaattcaggaccttaggatactactcatgtcactgtaacctctaactttgaatcatctcctgaggactaatcacaagacatctgaaacatttccagaaaaggagagtttaatccaacatcagaaaaga

SEQ ID NO: 28099 - DNA, 1501 bp, Oryza sativa
aataaaacggatttccttaataaagcgcttccgtaatatgcgggtgattcgttgcaacgacacgtgtggtggggcgcgtggtggggatggcgcgggagcgcgcgggcgccagacgcgaagaaatttcgctttccctcaccgtctccttttccttttcctgactactgctcgcgtcacctctatcactcttggctcctagcgccaacgtgccgcgcgcctccaccgcctatctacgaactgtcgtccccgttccaccgtcatacaacgcctataaaacccacgcctctcctctcgttcggccgcttcccttttcgcagccgagctccagcaccaaaatccgccgccgtcactcccacgccgtcgtccgccatcgtcaagtgcgccggaggagccaatgctcttggaggcgcttgacacggacttcggccactcctctccttccccttccctgacccgaggccgaggcgatcacaccccgcgccttcagccctcttcgcagcgccacccctctcggtacccctcgccgctccgactcccttttccctctctcctttaggtgttaattagcccaccgccggccgccgcagctcgccgttgctagcctcccttggcgccacgtctctccccgcgattagccgccctcggtcctcggtcatgggtggatgtgaggtgattccttagcgtagttttgattcgattactgcttgtgaaattgctatggtgtgctggaacacgttgcttttgactgtggctgatgtgatcagctgggccagggaggccatccaaatcgtttggctgggggccaactcttgatctgttaaagattgatacattgtactagtccgaccgggcatggtgcactgtcgtgtccgcgttgttgagaagcactctcttagaaacatttgaaaaagttttaaacaaaatcgtatgcaaaaacaaacaatctttctatgaagcttgcaataaacacttaatttcgatgacttgctgagtataccctgtactcacccttgctctacataaataatccggttcttccaggagcagtctggcttcaagcaattttgacgaggtgttcccaagtcatgcttgtggccgtggggcagtcttcatttccgctttctcttttgtaatacacttgtgagctcgaggtctacccgtagcctcaacatgactgtaaaactactcttaattaagagaccactgatgttgtgatattctatcttcctatgataccagcgtggttttttgggactggtattggcttaccggttaatttggagcttctcacggtagttcccgtctggagctagtttggggcgtgacaattcgacttttagaattttatacctacacagactcttgtctactctttcaattttttatttcttaattctgattttctgttatttcttattgtatttttatatgaactctaaaacttatctttaaatatatattttttaattttaaattttagttatttctaaattgtactcct

SEQ ID NO: 28100 - DNA, 737 bp, Oryza sativa
gaagtacaggttgaggagactactacaactgagaaattgtagaggataaagaactagctgaggagacgacagaaggtgaaactacagctgaagtacaggttgcggagactacttcaactgagaaaattgtagaggataaagaactagctgaggagacaacagaaggtgaagctacagctgaagtacacattgaagaaacttcaacaactgaaagaactgtagaggataaagtggtacctgaggagacaacggaaggtgaagctactgctgaagtactcgaggaatgtacagccattgagaaaattgtagaggataataccatagctgaggagattacagaaggtgaaactgtagctgaagtacatgttgaggtagctacagcaattgataaagctgtagaggaaaacacactagctgaggagacagctaaaggtgaaactacacctgaagtacacgttgaggaaactacaacagcagaggaatctgtgggggacaaagcagtagatgagacaacaaaaggtgaaactacagctgaagtatatgctgaagaatcaaccgagaaaactgtagaggataccacagttgaggcaccagatgagaaaactaaaacagccaatgatcctgtagaggatgccaccgttgaagagccagataagaaaaccgcagccaatgatcctgcagaggatgccacagtcgaagagccagataagaaaaccgcagccaatgatcatgtagag

SEQ ID NO: 28101 - DNA, 1501 bp, Oryza sativa
ggccgcgcgcgggtcttgttggcaagcgggaggagcggcgacgccgcggccaggcacccacgcgcgtcgccccgtggtacagcctccggcgactccgacgatgatgccgctcctccccatccgctccggcgccgcctcctatgccgctgctgaacggggtaggttgacacggcggaggtggcgcggcgctggcgttcgtggtggcgagcctcgggaagggcgggtggcggcgctgttccggcgggggttggcggagtggtcgtcgctgcgtcgggtgttcggtgtcgatgccgtcgagagcgacagcttccccttccgcctccgcgacgtctgcgcagccacgtgctcgggcggacggccgcacagccatcaccgcggcttccggcagggtggcggccatgggcaactccaccgatgacccacatgctccacaacaagcaggagttcccccttgccactggcgccgtacgtcgtcgattcggattcggattcggtgagcaccgcgcattcatgattataacaggctcacagcatatagaaatacactcaaaagtctagtaaaattttaagtacaaagactgtaaacagctagacttaaaagcaaagcactagaaggaagatcgaagagcttgtttcggcataacatacacagtatcacagattttaacagcacccaagctactatctcagatgatttcacacataccctttattcaattcctgccatccctttattcacaataaaagcacacaaatagatcacttcttattactaaccgatatgttaaatagcactatttgctactccctccgtttcataatatttgacaccgttgactttttagcacgtgtttaaccgttcgtcttattaaaaaaaattgtgaaatatgtaaaactgtatgtgtacatgaaagcatatttaacaatgaatcaaatgatatgaaaaaaatagataattacttaaattttttgaataagacgaatggtcaaacacgtactaaaaattcaacggtgtcaaatattttaaaatagagggagtacttaacaatcgattacatagggatgtatggaaatgtatgccagataaatggcactgtttagtaattgcttggagggttttctagatcacgcgtttcggttggggcagtgatcagaagcgatcccttcgagcttctggctagcttcacaagttagtgggctagccggtctgaatttgaagcctcactgcttctttttatttgatattagatttttccctaatattcgtgtttttagctgagcacggccgcacaagagatgacaggtgatgagggacttcaacttcttgaaactgtcccaaatgtgaaccttatatccctctttgtcaccaagcatcctgaattcctcctcgatatcatttatgtaacgcagtcggatgtcgtcaggtaccttaaatttctggaagtaggcctgctggaagtactcaggtacatctaatttgtcaactatgttcataaaatcc

SEQ ID NO: 28102 - DNA, 1501 bp, Oryza sativa
tgcatggcgccgggggcattgcctcctccgcctcgacggcgaacgacgacgggttgcacagccgcgagcaccgcgccaccagcgccagcccgacgacgcagagcaggaagcagagcacggcggcgaggatgaggaacgtgtccgtgtggacgccccggccgcccgacgccgccgccgtcgccgtcgcggcggtcaggtgctccgacgactgcagcaagtgacgcatggtaggtgaaggtgagactgagagcactgccaaccactgtgccgacgaggggccagttaagcaatacactgacctaaaaatggtgaaaaatggagaaggcaatgcaagagttaggcgctgggagggtgcatttttatagtgtgaagtgaaggtgatttgtgctggtttaagtgattaattaaattcatgagctcttaagtgaagtgtcactgtcctgtccaccaattcttctaggaattattatttttttggttttttgtcacagacgtgtgctgctgccttggagctgaattctcctgtgctgatacagcagctttggtgcgtttgtccctttttatcctaaatctgtggcgtttgatgacttgatcgatccagatttatgcaggcacgaggtcctaaattatgttgccttttacttaatttattattactactggcagaattaaagcaaagcacattgcgacggtggtagtagctagctttgtccaatctgcacgttgtagcggagaaagtcgacgtggcgatgagcgtgaaagtgcatgcaatgcagtttacggaaaaaagtgtgattattccatgatcaagcgctaaaaaacaaagcagtattcgcggacgtagcatagcaggagagaggagaccgaccagggccatgcgtagggttcatgagccacgtcggatacatgtcaaagcacaagtactcgtacgtactccctccgtccaaaaaaacaaactctaattttcgtgtcaaatgtttaactgtccgttttatttaaaaaaattatgaaaaaaattaaaaagataagtcacgcataaaatattcatcatgttttattatctaacaacaataaaaatactaattataaaaaaatttcatataagacgaacagtcaaacgttggcacgtaaattcgcggtttgtctttttttttttaaggagggagggagtactactgcaagatctggataacataggctattaattagttagtcgtcgccaccgtaccaacctttgaggaaaaagaaaataaatggtgtaccctgactccgatccatcctgatcttctgtgattaactccatccatcagtaaccagtgtcgttttctgcatcaaactaatctggtgtttaaatcttctgaaaataaagatgaaaattaagtgttttacgtaaaacgaggtggtaatatcgtgtgattaattgagttttaattgttacaaacttgaaaaatggattaatctggaattttagagcaactttcatatagaaaattttcgcacg

SEQ ID NO: 28103 - DNA, 1501 bp, Oryza sativa
aaggcaaagtagattagatatcatggttaatctttcagtgattggaacagatcgaccagaaaatttcagataaaccacgagggactcagggcccaaagaattacgtaatgtcaaaattgatgattcttccacatggataaaatatgggtcaaataaacagaaaccgccatgaagttggtcaacaaacaaacttcagttgactcggagcggaggatgggttgggatttaaggcggcacaccatataaggtgaaccattaacatatagcatgcctaattgagtaattattataaaatttaaaaataaattttattttttaaaagaaaaaactttcgtatagaaaactttcatgtaaaatataccacttagttatttggaaatcacgttgataaggaaaaaaaataaagtaggcttgtttagaatgcagcctgaagtatggatatgctaatgttattagggcatctacaatgttgaaaaaaaaggcagcattaaacatttaatgctactaagttttgtacctttgccattgtagagatgcactataagcatcaccaaactaaaatgcaccaccctaagcttaaggtatggtcacaagacaataaaactaagcttaaggtatggccacaagacaataaaatataggatttgctattcatactaataaaatacaacattgcattgaattgtttatttgtaatcatttggctgccatgcgggaccttttgccattttctttcttttggtgggacccagcggggcccactttattttcttacctaggccctgtttagattccaactttttttcttcaaacttttaactttttcttcacatcgaactttcctacacacaaatttctaacttttccgtcgcatcgttctaatttatttaaactttcaattttgacgtggaactaaacacacccctagtcataagcatgatacatatggatatagttgtggctctttctagtggaccccactcctattactcacggtggcataaacgttggtcttgcccttagaaatttagaaccaacctttctttttctcgggttatttaataacttaaactgggcccggatatggtagaagtttctcacggtactactggctgctaatggtcaagtaagccattattattaattaatactcctagttttttttctttaaatttaatcaaatttataaatggtatactaatatttttaatacaaaataatgtattattaaaatatatttaatagaaataatcttttgtcgtagatgatgataatttttttataaatttgatcaacttaaggaacttgggacctgttgatattgtagccaaaataaaccttaccaaattttggtattagcaagttaataatattgtcaaaattttggcaggattttttatatatttataaatttgataacaaactagacatagaactttttttggcaactttgacgaaaaaaaatgttatggttgaaaataatatcaatctgaacagtgtc

SEQ ID NO: 28104 - DNA, 1501 bp, Oryza sativa; identical to SEQ ID NO: 28102

SEQ ID NO: 28105 - DNA, 1501 bp, Oryza sativa
tgagaacaaactggatggagggactagctgtgcctcccattctcctgacacacgggcattcaggtcaagaagccggcatggaaaaccaagcagtgaggaatcatccactcctcagctcaggaggtgcatgtcattgacgtcgtcagcaattgatcgttccttgaatgaacggacaatgaacttttcaggcgatattccatgctctttctccaatagttctgatgtgcctcgacacattggggatgcggagtaagtggattaaagataaaatttacttgtgcttgaggttcccactgtctgtaacttatgcttcagcaacatcaataattaataataataactgaacactgtgtcatcccctatttggaaaattccaaacaatctgttttttcccaagtaagtggtagttttacattttaattggtttgacagagctaaaaccaagcacaaagtttggtggtgcattatagactcactatctgttactagattttttatttctagctcatgcccattgtgttactaacaaaccacttatgaaaacttattcaactttcagttaacaatgaactgtttttgaaaacttattcagctttcagtcagcaatgaactctttgcatattatcttgagcagatgtaacctttagccatgtttagccccatttaattatgtttctgtttgtcctaattgtttatcataactgtgatgctggagattttccttttaaacttactattatcatgcatggtattctatttagcatgatgactgaaggatggtagaaataaaaggttacaatctttctgtctgcaggtactatccctggtcacaagaaagacacaccaatatgggagaatacacgatagaggttccaaaaacacatggggtacaggaaagtgattcacctcagtcaagatgctactcatgctcagcaggacactctcctgttagttctcctgttgtgttaaaatgcaggccttctaaattgaccaatctttcaagcaagaatgaagttctagatctatatattgatggagagcaagagtcaaacagtctaaatgagaaacataagctaaaattacctgtcagatcctcatcatcttatttgggacggggacggccacctagaccccattctacagctccatcttcaccaaagtcttgcaaagaaatcgttgagagctatagctactcaaacatcgacatgattgatgcctgccaattagctcaggaggaaacaaagggcatatggaaggttgcatctgtgtgtgcagagcctggagatgatgcacaaatgcttgaagcatcttctgaaaaattttcacatatagaggagtgcaaatcacaaagtattgctacattggaagatatttatgatcgtttggaagatgcacaacctccatgcttttgtgacacttcaatggattatatttcaggcactacctcaagatgctttgatgcagatgtctgttgtcgtgatgactctcatggttttcatgg

SEQ ID NO: 28106 - DNA, 287 bp, Oryza sativa
agagagagagagagatcgcccgggagagagaggagagggccgggggagagggggagatgggccgagcgagatttggcccatcgacctcgggggaggcaaaatagacttttgcggaggaaaatgattttggaagggtttggattcagaattgatctcgacgatagatcggggattgagatcttgagatagcacggacactagacaacaagcaaggaaacaaatttcgcaaatagggtttttaagagataattttcccgctaggcgccacgacggaacgggcgctacag

SEQ ID NO: 28107 - DNA, 1501 bp, Oryza sativa
aggggcaaggtatcaaatgagagacaaagcttacagcatcatttattcttcatttatgctccaaaatggaggtcaccttcattcgcaatgaacaaaaccagacgaaaatttcctaatgtcatttccagacttgacggcaagacgttctgaagaactctaagttcagtatacatagtaaaacaatcaggattgcttatctgcagctaagcaaaccatgtcggcgcactcggattcatccttgaattccacatcgctgaagcagaatgttcttgctaagctctgcacgagctgatcatggatcacctcgtcgggagggagctccaccgccgcctctcgccgcagagaggtgacctccttgtcggcgataccgcagggcacaatgtgctcgaagaaacccaaatcaggatcgatgttgaaggccagaccatggcaagtaaaccctgacgagatcctgaccccgatggcgccaatcttcctgtccccgacccacacgccggtctcgccggcggcacccgggcacgcctggacgccgtacagcgccgccacctcgatcatggcggactcgagcccctccacgtacctccgcgcgccgaggccgatggcccggagcgagaggatcgggtagagcacggcctgccgcggcccgtggaaggtgacgtcgccgccgcgctccgtgcggtggatgtcggcgccgagcgccctgaggtcggcctccggcaggagcaggttgtggtcggtgcgccgcttgccgagggtgtaggtcggcgggtgctgcagcgacagcacgaggtcggggaccccggccggccctccggtcggtgacgagcctctcctggagcccgagggcgtcgccgtacctcaccaccccgagcctccacgcctcgagcaccctcctcgcgccgccgctcatctcctccgcagccgcgaggagaagaggacacggcggcgggctgcctcctccggctaccgtcagagactggacaggatgaagcgaaactaaacttgcgaggtaaataaatgggccacaagtctctcggcccacggcctgaaaaggagaaggaaaagaaacctaacccacctcgacctgaacccgatcgcgccgccgctcgcctgaacccgccgccgctcgctgcaccccagtgcactcaccacgcacgccggaagttcccttaccagaccgggcgatggcggcggcggcggcggagtttatggagctcgcgctcgagcaggtatggctgaaatctccagcttgatttgctgggaagaacacgttttacgctgctacggtgtttctggcgctgaattctggatcgtttttgcaggccaagtttgcgttggacaaccttgaggtccctgtagggtatacccctgcttcgtttcatacataggagttcatccttggttcttgctgtgctaactgctagtaactcctaactgctgctggctctacttttttttgttattctgtcttggtagatgtgtgattgtggaggatgggaag

SEQ ID NO: 28108 - DNA, 1501 bp, Oryza sativa
atgaggatgatggcaccatattagaggaagaagagggaaaaaaacaagcgtgaaaaagaaaacaaaaggggaaacttttgcaggacagccccactttgtctatgggtgtaggattggggaaggtgccatgtcagcgtccgtgtggcacaccacgttggattttggactaatgttggtaccaagtttagaagtataaacatataatttttaaatttataaatctatatgacacatatatacaggtattaaatctaaggactctttgtgtattttactctttagaaattatcaactcaactcaacggtgtgtttaaactttaactattgataaattttagattgttggattatgaacgaatgctgtgtttatatttgaagcgcatttaaacaccactcacaccatcgcacgcactcacaaggtcccggcaatgtcgtcggtcatgtgcaatggcaagtacccgatcgtctcttggtgtagatcaagccgcacatgcattaattaaccgtgttcttctttctaaatttgtgtttgtttaatagggtgattttgtgtttgtttgctaagggtggttttgtcttactgaacggctgtatttctaacgtaagacaatgaccatgtatatttaacgttgatttctaattggtgatgaccagccttgccggtttccactacctaatcttggttttatagtgcagataatgcagccttgttttgactgcaagtgcggtcagttttaataaagaccaatgaataaaaaggtgcctccacataactaaagacttgcattggccaacagatttattgaaatttggtcatgacccgcacataaaccattcttcacaagcttaatgcgagtcataagaaagaaaaaaagctataaaatgtgtagcttggcgctatttgtctacctacatttcatggactactcaatagtttttttgcatttggccctagtgcggcggctgacggtgcaatattttctccaaggactctaattaactagtactattataatcggatggaagattgttcaagaaaaatccaaatattcaatgttaggttctagtgcctctcatgcacatgccaaataatgcattgcctgagagctactcgtaatgattccttttcttaatccctaaagagtacttcatcgaaaagaaatagtatagaactgatcatttcccaactatattttgaactggatatatttaagatcattatctatgaaatctcatgagatttgaaagtatatgaacacggacgccccagcggcacggcagctgtgccttcttctgcatttctcttgtttattttgccgatggcatcgcggagccacaaccatacaattttctatcacttggctcctacttgttaatcgtgtagttcattgtgaccacacttttacccttatttatttctgttcatcaggattgtgacaacatattttagtctgtaaccaactaaattagcgggcaatttactagtagcatactatatgca

SEQ ID NO: 28109 - DNA, 1439 bp, Oryza sativa
aagcaatgccaagaaacccatctcttttttaatgctggattaaactcaatttcttctggagccctacttgataatcccttgatttgctttctgatgccttcagattatctgtgaggatatgattcgattgatcgagttcttacaggctcgggcccggccccctgctaagataataatcgaccaacgaattcaagcgtttagatgacagagtcacacacgcattagctaacagtaaactgtacttgaggaatgcatgcagttggatacttttattcatggaaaaaaaatcctactactttttggcatgtgaccatggcaactacacattattgtttcaactgtttttcgtcaacaccagttgtgaagcacgagcatagctagttcagtagtaatgagcaagtcaatgctgccgggcacaagatctccttaagcaaaactagaagatggagcttgactgcttgaataacaaagacaatccttaacttttgcccactgatggcgcatatatcgaactaaaaactaaactgtagtagtagtttctttaatttgtacttctttcatgagtacgtgcgtagcctctaataaaggctgccgaagaattcaatatgtatacagcaaaaaaatgtttaacaggaactttcttaagagtactttggcagtgttgttactccaaatttttttttacgtatacggacgcacatttaaaatattaaacgtagactaataacaaaacaaattacagattttgcctgtaaactgtgagacgaatttattaagcctaattaatctgtcattagcaaatgtttctggtagcatcacattgtcaaatcatagcgtaattaggctcaaaagattcgtctcgcaatttacatgcaaactatgtaattggtttttttcgtccatatttaatgctccatgcatgtgtccaaacatttgatgtgacggaattttcgtaagtttgaagggaactaaacacagcatttgtcaaatttgcagatttataagaacaattaatgttaataggcagcgttgttgtaaccgtaagctttgaccggctaattccttcaaccggccaggcaaaaaaaaatttcaaaaattgttttttttaacaaaatggaaggaaacaaagcatgggaaagaaggttactgtcgcaagacaactttgaattaattatacgagcaaattacccatgccattccattccatgggataaaaaaacgaaaccgttttgccgtatattattggtagcaagagtttcgtttttttccttccttttgtttttgcctgctgctgtagcagtgtcaggatctaagatcaggtgggaaatgaagaaagaagatgaatctgacgggtgggcatcacgtgcagataagaaaaaagatggaaaaaggaaggaggttgatgaaaaacgtgacggcggtggcataattttagttcc

SEQ ID NO: 28110 - DNA, 906 bp, Oryza sativa
cagttagatagcatagagacatggactagttgtaaaaaaggaggaaaaaaacattttgagccaagtccatgcatctctcttggtcttggagcacatgaacagctgattatttttttatctgtgtgttagcatagattgtgttcgaatgaaaaaaacaaaaaagacaggtaaagcgagatgagccactaattattttaaacctagaaataaattaatatattttttctataacttttttttaaaaacataccgtttagagcacccgtaatggtaaagtaatgtgccatatataaaacatttacatctcagcaatagactacattaatagtaaaccactttaatggtatatctacatgggtatctatagctctctaatctattgcctcgtttttctctatagactatctccaggttagtagatagctttgctctctctcttcatttaatctcttccaaatagaaaaatatgctgacatagatcttttgtagagagtctatagataatcattgcgggtgcccttatcagtttggaaattgtgtgcgtgtaaaacgagagaaaattcatctctttcttgctcagtacaacgcagcctcaagtaggaaggaaaaaaaccatcacgatttacgaaatacagtattgaagacctgctgtgaattgtgaatttgtgattgggctcgaacgcgggccggagaggggagagctcctcgccgctgacatgtgggccatagtaaaaagtgggacccacatgtcaggtctgcttccgcccgctgagcttcacgccgtcctcgctcgccgcgctaaaaatttcgctccgcccgccccccaactctcctctcccgccgccgccgccgctgccgcgcaactcgccggagagagaagggagcggcccatttctcaggcgaaca

SEQ ID NO: 28111 - DNA, 1501 bp, Oryza sativa
aagtttgcaaaaatcatgatattgaattgaaatgttagggtaatgggcaactaatgaagcactaaaagcaacatgttatcatgagtaaacagctttctgctgcttgttgcattgctccctcaccctgacagttcagcagaagaactctgatgcaatgacatgattgatccacatcctccaaatttatcgttagcacaaccaaagtacacctcccttattcctgtcaaaagaatgaacatgttaaaaagcataaatccatatgctcttacatatttttaacacaataaagataaaacatctcagaccaagtatcgacaacgccattgcgcacattatgcaaggctcacatgtgacataaaggtcgcatcttgcaaacttctccgcgacctgtggctgatcaagtcccatgccctgccactccctaagcaggatatcaattgcttccatctcagcatgccttgtagccttagaatcggtacaggcacaatcaaattacagctttaatctaagagcaaaaaaaaatcttttacatgtaaatgcagttggtatcaattacaggttttcttttacacctgtacaaaatttttactcctgctctatttaatgaaattggcatgtttaatgctggttcgttcaaaagaaataataataataataataataataataataataataataataataataataataataataataataataataataataataataataataataataataataataataataataataataataataataataataataataataataataataataataataataataataatctaagagcaaaaatattcctaaccgaagatgtaagagcatgcatacattccgggtggcatttgtcttgttgctaccggatgaaatcaccttcccatcctccacaatcacacatctaccaagacagaataacaaaaaaaagtagagccagcagcagttaggagttactagcagttagcacagcaagaaccaaggatgaactcctatgtatgaaacgaagcaggggtataccctacagggacctcaaggttgtccaacgcaaacttggcctgcaaaaacgatccagaattcagcgccagaaacaccgtagcagcgtaaaacgtgttcttcccagcaaatcaagctggagatttcagccatacctgctcgagcgcgagctccataaactccgccgccgccgccgccatcgcccggtctggtaagggaacttccggcgtgcgtggtgagtgcactggggtgcagcgagcggcggcgggttcaggcgagcggcggcgcgatcgggttcaggtcgaggtgggttaggtttcttttccttctccttttcaggccgtgggccgagagacttgtggcccatttatttacctcgcaagtttagtttcgcttcatcctgtccagtctctgacggtagccggaggaggcagcccgccgccgtgtcctcttctcctcgcggctgcggaggagatgagcg

SEQ ID NO: 28112 - DNA, 206 bp, Oryza sativa
cccccaccaactgcaccctctcccgcatccccgtccgcatccacgtctgcatcctcgcgctctccgtctccgacggtcccaacgtctcgctcggccccgccgtcgacgagtcctacacactctccgtgctcctggactccggatcggccgatatctccgccgccacgccatggggcatgggacgccatccgctctgcctgccgcca

SEQ ID NO: 28113 - DNA, 591 bp, Oryza sativa
agttttagggtttcggcctagttcccaagtcgcgcctgtgatgtttggtccaagtcctggcttccgtttcccttttgtaatgcagttgtgagctcgggatctgtccgtagcccaacatgactgtacttctactctataataaagagacctctgttgctatgatattctgtctccctgtgataccagcactgtttcctgggactggtatcgattaacaggctaaattggagcgtcacgggccagttccggtcgggactagttcggggcgtgacaagagatggtatcagagcacaggcttggccctagggcgaaacccgacgcttaggacaaccctaaggatactaagttcaaaactacttgcgaaaagctaaggtttcttttattttctttattttctacagtttgtttccaaaatggttactgatcttttcttcctctttcaaaattgtagatggcagtgaatgccagcttcagttcccacggttttggtgagggtcaccacgtcgctcagcttcgtgacctcgcccatttccttggcttctcgtgtcccgagtacacggggtactccgtggaccgtgttccccctcactg

SEQ ID NO: 28114 - DNA, 1501 bp, Oryza sativa
tggcagttatgacccgttccaagggggtttcacctgacttgtgggcccttcaatccgtgtacttgcgtctgattgaccggaagtgtgtttcctcgcatgatgggtgtgttttatccttaaaatacctgcatacacatatttcaccaacactagtggaattgattagaataatccctaccactaagttggatacaatgttttatttcattatatgcaggtattgacggtcaaatattatgatttaaggaccatcaacaaccaccccatttatttctctctctctctttatctcctctcctcttctctctctttgttctctcctctcttctcgctgacagcgggaatgggtgcatggcgatggcgtcggcgggcggcgagggcagcggatccggcagcgctgtcctcgggagggctggattcgtcgccctagggaggagttcggcgctcgacggcggacggcgggcacggcgatagcctgcggcggcggatccggcgacgccgtcctcgggagggccggagcaggagggtgaggatgcagagcctcacgccggttgggaggtcactgcagtgatcctctccggctctcccgagcggacttcgctggcagtcaccgcgggcggagattccttccccgccgcttgccagaacgccgctctcctcgccatcggcacccttcaccagcgctacccggacgagttgcagcctcgccctaccgctaccaccctcgtcgcggaggagccagcgaccacgccaccttccgagacgccagctcggaggatgacgctaccgtcgtgcatctggcacgcatggtggaggcatacgacgcagctcgtattgacttccatcagatggtgcgtcgcggcatggtggagaacaacatgaagatcctggagctgcgtcaggagaacctgcagctcaagaaggacctcgacgcgttggaggcgcagctgcatcagctcaagatcgcccagggagaggacagccgtcccaagcgtcgccgcgtctgccgcagccagaagatcaccgcccgcaagagcacctccaggcccgagcttattcgtcagtccctggcgtggacttgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgttttttttttttttttttttctcgtttgtctttttggagtcgtgtggggcatggttatgccggtgtgtggcataactatgtcggagcctgccttattttgtttgcctaagcaacttgaacattaatgaaccaatttaatagcagtaataatttaagaataatggtagtcgtgggtggttagttttaatcgttagctctctctgtttgctggttccgtgtggggttttcagatggtgacgaccaggagaaatgttaacaccggtgaagg

SEQ ID NO: 28115 - DNA, 1450 bp, Oryza sativa
gtggggcccaaaagtgcccagtgggccccacttctgggccgatcgcgggctgcgactttagggagaacagccacgtgtggatgacaagtggggaggtttggatcgtccgggcccactgtcagtgacacagatgttcaaacttggtcggttcgtgggtcccacctcgccgcaatttttccacgtagtagtctgttccacgcaatcacggggctttggctttggcttgctctgccttggattgcagctagtggtttgtgatgggaacctctccatttagccgcgctaatcatgaccaaaaacgcaattagaaaagagagaagacagtgcacgcctagaagcattatagtgcctactccttctatcttaaaaaatactactaacaattactaatatattgttataaatctaaatagattttctattacttaaaactaatactagtactaagtcatacttcctcctccgtttcatattataagtctttctagtattgtctacattcatatatataataatctagacatatatgtttagatttattaacatctatataaatatggacaatgttagaaagttctttaacctgaaatggaggaagtatgttgatgtattttggaacgatgaaaatagtttattcggtcagtgagccggtggtggttcagtgatcagtatcaacaaggttgctgcgctttcgcttgctttatactaccacaaaatcaccaatgcttaggcgccgcgatgtggataagcataataagccataaggacacgccaggtcaacagcaagtggtgcactgggagagaagatgctttcacattagaaggtactactacttgtgcataatccgatttgtctgaactttcatgcagcttgttctgcttgtgtgtgtttccttgttagcgaagaaacttgagaagtttcaaaagaaaaagagaagaaacttgtgagaggtaatcctggccgttggagcatcatcatcatgcatgtttgcgatggaatgttcgcgttacctcatcaggagcacgtcagcgcgagcgttcgcaatcgcggtttttttatttttatttttttggtgcgaactcgcaatcacaggtgtgcgttggcagctcgggttaagtggggtttgttcgaacggagggaaggcgtgaaaattgcggtttgggctcggcttcccgaaatcagattcttgcagtctttgaaataagttcaccggaggtccctcaacttaacagcgagaattcttgagatcccttaaccacataaccagaaatgtgtacccctaaactcacacaaaccgttcaaaggaggtcccatgacagtatatgtgggtggttttgctgacgtggcatcctagtcagcattttttttaaaaaagtatgtgggcccacatgtcagttacacatattttcttttcttttcttttcttctcctcctcttctcttttctccc

SEQ ID NO: 28116 - DNA, 1501 bp, Oryza sativa
gggcgaaacccgacgcttaggacaaccctaaggatactaagttcaaaactacttgcgaaaagctaaggtttcttttattttctttattttctacagtttgtttccaaaatggttactgatcttttcttcctctttcaaaattgtagatggcagtgaatgccagcttcagttcccacggttttggtgagggtcaccacgtcgctcagcttcgtgacctcgcccatttccttggcttctcgtgtcccgagtacacggggtactccgtggaccgtgttccccctcactgtgagctctctgtgtacctttacccccgtggaggtatacacggagctggccttcgcccacaccacttcaccgtggccaggcccactctccagatcgcgtaccaggatctctcctggactgcgcttcgtcgcctggcccatgactacagccaccgtctcggaggctccgccttccggcagcttccacgccttccttctggccactcagacgctaggtacccttgtccgtacagcgagcctcagccagtgctgactcgcatggttgagctttcggaggctcaggccactcagcacgacctactccttgaggcttaccgctcccttgcccgccgctacgccgccttggaggcccgtctggccgaggagggtgtcacctcagttgacactatctcctgggactcaggccgcctctgccacgccagccacctgtcctcccacagctcccgcggctctacccgcactcccagtggcccgcgctcccccagctcgcgtgcgccgtactcaccagtgtactcgccctacccacacccagttagcccttcctacaccccaggacacaccccagttgcttcctcccgccgtggcccacgctttatccgcactgcgcggaagcgtgttgttggttctgccaccgtgttccgtttccactacccagctcccctaccgccagcggcccgtgctgctgccggccctcgacaggttccgccggtcccttcgcgccagccgatcgacgtttcttcgactcaggagccgactacaagaggcagccaggccgacgaggagtagaggaggcagtcttcagcagccgtccgtgtgataggcccttttgttccgccgccaactcttttggagtcatggcgaggtagtgcgtgcatgtgttagttgtgggtgttgtttggtagtctggttctcctaggtggtgtgcgcacagtcaagctcggcgtagctctgtgacttgtccacacccattgtatcaggtgtttttatgatttgaaaaatccagtttatgcctagtgtgtgctatctgagttgctatttgctttgctccttgccctcctaagtgcttatctgactcttaccccgcccttttctgggagtttagatggctagccgcccccgccgtgcagctcgtgcaccagcccactttggttttgaagatggtagagttgagccagaagaaaatcatgagtcggctaatgagcagtctcaccgcagca

SEQ ID NO: 28117 - DNA, 1501 bp, Oryza sativa
tcatgtgtggtcttgttttgaagatttaattgcaatgaatttaatggtgcaatcggatcatgatttggataagtaatttagaagaaaaatcagtttaaagtagttttgcatgtaaatcggacgctgacgtcagcgcccgatttttctcgaaatcgtcgggcgcccgagccgtaggcacccctatttttcatcgtaatataatcatgtaagatcttgttgtaaagatttaattgcaacgaacgtaatggtgtaatcagattgtagattggattactagtttaagagagaattttataagaagaaaaacaagatatgcactattggatatattatagcaaccaaaatttctaaagtactagcacgtgggtgtctctggttaagactaattgaagagcgctctccagttagttttaccgtctagggtgatatagatccaattaaacaaaaaaaaaaaaagggctcactcttgctgctgcctgcaggcaaagaatcggaagccacgctccggcagccggcagctgcacgtactgggctagtgggctaatcttggatacttgatatgatcgttgggcgtaattatgtgattggggtaggggatacccatgggcctaattatctgattgttgtggctccctgctttgttcaccactgtctgagttaaaactgcctcgctctttttattttctatctctccggtccagcttgcttaattttctatggactacgtaaaatccaaaccagtattcaaatttaaagttcgtttttttaagaataaatttaggtagacttttacttgtcttctttttttatgaagtgcttttaccttattcttgttaaaagtacacatatgttagttagagataagaattaaatacgaatatagagataagatacaatcctagagataaaatagagttctaaagatagaatcctagaggtaaatctactcttacttatattgtactacaagtctctatctcctatgcactcctgtatataccctataagagggtcgatgtaactttttgctagatatctgtcgcgtgattttttttctagctattccaccttttttttggccgcacgatatgtgcgctaagatttgtgcaagaattggtggtggaggctgcatgcgtggataaggccatgcattggatgcttaggcccggttcttttctaaataaaaattgatttctttaacggttgaaaaattaagacatttgaaactaaaataaaatataaaatataaaatataaaactatagttctatataactaaaattacgtttgtaaaatcagttgatatgacatgtaagtacactgtaattttgataagtaaacatgtgttagttattttatttaaaatataaaattacagtcctatataactaaaattatactttgtaaattcagttgatataacatgtaagtgcactgtaattttgataaaaatgttgtgtaagtaaatatgtttttgttattttcttttgtatagtccgttg

SEQ ID NO: 28118 - DNA, 1501 bp, Oryza sativa
ataaaatgaagtgcgatgctccgatgctctctactggtaatatataataatatgaaccgttcattattaagggtaaaatagtaatttaatcctatagttgtcatccattccactggcatcactcatatttcattgaaaaagccaaaaaagagtaagagaaaaaaaggtttagtctctgctaaatgacgattatatcccttcacacaaaatttttacaataatgttcctccacatttctactatcgttaactgggggtggtagtacatacagatctaaacttttcgatcaaatgagatcaaccgttcatatcactttttactattagtagagagcaccgtagttaagctcatgaacgaaaccttccactaagagcaacgctacgacactctctactagtaatatcatactattagcagaattgatctgagttgttaatttatagagcaattctacggttcttgaggaggtaccatgaggtaattaaaaaaatagtgtaaaatctggtacctcatagtacctaagtaacaagaggtaccaaatttacagtggaaaaagtggtacctcatggtaccttcttccttaaggacctaaaattgctataatttataaggtcatatcagtgctttactaacttagtgattagaagtaatgctggtatttcagattttatctatccatcgtgaaaaaaaaagttttgtatccattcatcagaccgttaatattttttcttggacaataatagcccatgacgtttctactactattaagtgtggtggtaatagaaatgaatatgacccttcgatcaaataagattaatggttgacattgttttctactatcagtagagaacagcgaagtgagactcttccacttaggccttgtttagttagcgaagtgagactcttccacttaggccttgtttagttgggaaaatttttgggtttgattgtcacaccggatatacgaacacacatttgaagtattaaacgtagtctaataacaaaataaattacagattccgccaggaaaatgcgatatgaatttattaagcctaattaatccgtcattagcagatgtttactgtaacaccacattgtcaaatcatggcgcaattaggcttaaaagattcatctcgcaatttacacacaatctgtgtaattggttttttttattcacatttaatacttcatacatgtatttaaatattcaatgtgaaagtgtgaaaatttttgttttagaaactgccttaaaattggtaagagtggctttcatgggttccttgtgctgactagccaattaatctggcattctgaccctcgtgcgtctaaaccatgccctgcttcaacgataccagtcactgattctcacgtctgacgtccacatcgcccttaacatgaggttaaccgcataagttccctttaatttgtcacttacgttcgcgtgcgttcacacgaggtggcacgagaccctgcaggcagagatgaggctgctattcatttg

SEQ ID NO: 28119 - DNA, 1501 bp, Oryza sativa
aacgcaggaggaaatcctgccctcagcaacaacagatcggagacgaactccatccagacccatctcactagatgggagacagccgccgccccccagttgcccgggagtcacccctgcccaaaccctaaaaacatcttactgttgatagtaagcctaaacttaacactataaaaatatgttgattcagataaataccactacaactcatttattcgtagtcatgccataaaaaatttatggaactaaaattatgccaccgccgtcacgtttttcatcaacctccttcctttttccatcttttttcttatctgcacgtgatgcccacccgtcagattcatcttctttcttcatttcccacctgatcttagatcctgacactgctacagcagcaggcaaaaacaaaaggaaggaaaaaaacgaaactcttgctaccaataatatacggcaaaacggtttcgtttttttatcccatggaatggaatggcatgggtaatttgctcgtataattaattcaaagttgtcttgcgacagtaaccttctttcccatgctttgtttccttccattttgttaaaaaaaacaatttttgaaatttttttttgcctggccggttgaaggaattagccggtcaaagcttacggttacaacaacgctgcctattaacattaattgttcttataaatctgcaaatttgacaaatgctgtgtttagttcccttcaaacttacgaaaattccgtcacatcaaatgtttggacacatgcatggagcattaaatatggacgaaaaaaaccaattacatagtttgcatgtaaattgcgagacgaatcttttgagcctaattacgctatgatttgacaatgtgatgctaccagaaacatttgctaatgacagattaattaggcttaataaattcgtctcacagtttacaggcaaaatctgtaatttgttttgttattagtctacgtttaatattttaaatgtgcgtccgtatacgtaaaaaaaaatttggagtaacaacactgccaaagtactcttaagaaagttcctgttaaacatttttttgctgtatacatattgaattcttcggcagcctttattagaggctacgcacgtactcatgaaagaagtacaaattaaagaaactactactacagtttagtttttagttcgatatatgcgccatcagtgggcaaaagttaaggattgtctttgttattcaagcagtcaagctccatcttctagttttgcttaaggagatcttgtgcccggcagcattgacttgctcattactactgaactagctatgctcgtgcttcacaactggtgttgacgaaaaacagttgaaacaataatgtgtagttgccatggtcacatgccaaaaagtagtaggattttttttccatgaataaaagtatccaactgcatgcattcctcaagtacagtttactgttagctaatgcgtgtgtgactctgtcatctaaacgcttgaattcgttggtcga

SEQ ID NO: 28120 - DNA, 284 bp, Oryza sativa
ccctatctttttgttgcattgaggagctgatgagctgagctaatcagggcagaacaaaggcaggaggatatagttttccaaggtttgtgctcttcctttgttctgttttagccctatgcatgaagaggaaggtatatagtcaagattgcatgcacttctctgattcaaaggttgcttttcaagctagtaactcaagtagatgatcttctggtgtttctctcccaaatctaaacaatgtctgaatctcatcagatcctagggccggcctgcatcaaaaagaagga

SEQ ID NO: 28121 - DNA, 574 bp, Oryza sativa
cattgtgaaacagagaaagtattttacaaataagtccaattaattatattcatataaaagcaatccatgcacaagaacagttaatgtttgcaggcaaagggcacaaccgcgtgcacaacagcacaagcacagcacaggcagttcccgtaatatacttaatacaaaatttaagttgtagtaaaaagttagcggcaaaccggcaacaaccgcttccgtagcatagtggtagtgcgttcgcttcgtaagcgaaaggtcgcgagttcgatcctcgccgggagctcctatttctttttcggttctccaaataaaacatcctttttttgttttggggggggggggggggggtgtgattgagtacatgaccttaaatcataaattgtatagaagcaaaacaaaaaattatatagaaaccagaaacaaatggaggtgccgggaatcgaaccccgtgcacctcgcatgcgaagcgagcgctctaccatatgtgctacaccccgtcttgttaaagaatgctactaattattcaaattgtattatgactcgagtttatagaattaattttattaaacctagcatt

SEQ ID NO: 28122 - DNA, 206 bp, Oryza sativa
tgctcttgcctctgtgtttgtgtataagcatgctaaagattgcatttcccagtcttgtcaacattgacaaaagaatggcatttgtgacaagaaatgccaatattgatacttaaaaggaaatgaaaaggacacccacaacaatttttttctttgaaatgaaccgcacgagacagtgcgagatttcgtatcaaagaatatagcaaaga

SEQ ID NO: 28123 - DNA, 1501 bp, Oryza sativa
ttcagggtgttacagaagttggtgcttgcggcggtgcacggcgcctgcattggcggcggcggcgaggtcttggccgcctgcgccatccgagccgaaggagggggggatctatgtggggcccacggttggccagtgatttctggctggccaaatttggctagtggaggaggggttttggccagcaggatggcttagctatccagttggagaggctgttggagcacctttttaggctaaaatggctaaaatttggcttgaagagtggaatggagaggctgttaaagatgctctgaggctgttgaagatgctctaacttacagaagtagtacctccgtattgaaatataagtagtacagtatattttaagctataaatctgaacatataattatctaaattcataatatcttctcgtgatttgtatttatcttaatggttacgaaaaaggttaaaaaagaaccacatatttttttctttcaaaattttgaagtatataaaatttatgttgggcttgtttggttctttaacctaccaatttattggtaatgccaaagtctaggtaaacttaggcactaccaaattattggtagagtaaaattatttagcaaacatttggattgctaccaatataaaaccaaattctcatagtacattgaagaaacttataaaatataataaataggaaagatgcactaccaaatatttggccacgatccaaactaacacaaaaactattacatttgccaataaattggtagggcatgtttgtttatcaaaccaaaacggcccattatctcagaggcttgaaagtatgcatgcaacccacaccttctaggcttccacatattttcggaagtggattctaaactcaaaaaatatatctacttattatttgcatggaatttaattgattgtaaaaaaaaatcaacataatagattaatacttttagaaacatagtacaaacgcacaaacgacgtcttgctatcgacaggtacatcgtctactactgaaataataattagcctaaacaattagtctaggacttagactcgggtgggctggttccaccacaagaacctaaccaattgaattatactcactttacaaatagatcattccacaaacatagaagttaaaaatccagttaccacaagttataaaagaaaacacgtaactagttaatgtatattcgtagttaaagttataaatgaagaagatgaaaatgtgacggcaatgatatgtttctaattttgtaaaaatttcagtgacacaattacgaataaacaaattataatgatatttatctgaaataacatacttgtaatggcatgaataaattaaccctgcccttaaaacattggttgttaggtatggcaagataaaagtgaaacactttttttgttttgaaagaatataaagtggttctcaaaaaaaaagtgaaagacagagaggtcggagaagggaaaagtggcgatgaaacaagggaaagtggagatgacgc

SEQ ID NO: 28124 - DNA, 1501 bp, Oryza sativa
aggggaattttcttatttagagcggtaggtgaggaagttagtgggagttacctttcctcttttttcttgcgaaattggacgatacactagtgttttcttgagatcatttgtagcaagtgctgaggcatctcaagaggaggagctggtaaggggctggtcatcttcaatctcacgcagtcaagcctgaaatcatccacctgtctcacgagtcatgccaaggatccccgcaaaaaaagagtcacgccaaggatggcctctggctcagtgttctgctccctctgagtgcaaagaggtagatgctgccgctccagctcgtacggcattggcttgtcaaggtagtagtagcgtgcatgatggcagattaattggcgggaacgggtggtttaagaggtggcattatggcatggggaggcgcaggcaatcttgtgcctgttaggccagcgggttctgtcaatgctaaaggacaggggccacgcgagcagcgcgttaaaggcagcaagctcctcagtggccgcttcttgtgcataggtggcatcctcaaggagaggtgtagtgatggcagcagtcgggcaatgtggaggcacagagagggaggaggagcaggagaagatgggagggggagatggaggtggcattggctggggaagaagagggggaacaggtcggagaagagaagcagagatgtgatgggctggcacaggggggttggggtggggcacagatcacggcaattgtgtatttgagggaaaaactgatggatggcgaagcagctaattagtgttgggcaattcgctactgcagcatgaatgaagttggctctttgaagtaatagaggttgattattcttgcattgctattcaacagactgtattggagttggtggaatggttatatcttgtatttgaggtctttgttttctccattcactagtgtccatgaacatgaatatgcaaatattctttttgctagcagtggttatatgtatcttttattttgttgttgaagtaacaggagtatcttttgtcatggtaatcatatgatattaagtggtaactttcctctctctcttttggtaccatggcaaagttatgttaaataacttccctattatactgtaggtggtcatattaaaaaattgaggtggtaaaagttgcaactatttaatcatgtcgaattccaactcatcagagcgacgagagtaccgagaaccaacttcaccttcaccatccacgtcatcttctagatcaaggtataacattgactcgtttcttcttcttctttttttctcattaatacaatggaattatcaagaaaatcttgtaatttgcaaagttagattaccaggttggactttctacattaccatattgtaattccttgtgtttattttaagcattctccatctctttatttcatgcatttatttatgtactttgatggactggtatcgcaatcatcatttttacttcttctctgctatatagggatagaagtgatcttg

SEQ ID NO: 28125 - DNA, 1501 bp, Oryza sativa
aatcatgacgttacaaaattagaaaaagtccactttaggtgattaggtctcttaaccgtaaaacaggtatttaacatcctctaatttttaaaaccagtgtaaatcaagtttctcagcggtttggaagacggtatcgtcctacgtggtgtctacatagcatcattaaaaaaaaatcaatgggacccacatatcattgatatcatcccttcttcctctacatcctctcttccccatatcattttgctcggcgcattaacattttttttagataatggaatttaacatcccagcctttgctcaaaaagagctacagccaattattacattgtagcaatccagaaaagagcatagttcggctaaataggacacaccaaacaaaaacagaggaaaccaagccaaaataaggagaacacatttattgaaatatatttgtgaacctccatccataattggcaaatagttgcataaccatcgactccaacttgcggcatgcaacctttaggaactccccatcatcctcacacatttgtagctgtacccaaaaccagagtcagtgcgttgctcggcgcattaacatgggagagcgttgaggggaaccggcaggaatgagcgagtcaacggatcaattcatggaggttcttcacctcctcatccaactcgtcgtttaatttgctgcaccggcgaaggaaaggagaaccctgcggccacgttacagaggctacaccgcagtgattgctataggtcgtggcagatgcgccactgctctaccttcaactgtctttctcttgccactgcaatggcctcaaccttctcctctctcttgtgaccgctgctccctttcccatgccgacgttgccaaagaagaagagatgaggatcgcgagagagacaaaggaggcagatgaggaataaggggtgatgccattgacatgtggatcacactgttcttttattaattattataaatgctatgcacatgccacgttaatgatgacaaagtcaaaataccatctggatgtcacttagaatgaaaccatcgtctaaaactgccaagagattcatatgtcacttattttaaaagttaggggacacgctataccaggttttgtgattgagggctacgaattataatctgtaaagtgcacttttccctacaaaattcgggtggttatgttcgatagctgacatggtacatattcaaaattaagttgggccgagttgggttactaccatggagcgatccaaaatttgatgggcctaaatgtaccgagttagttgtcagtgtaatgggccattgggccagatcgactcgggactttgctgggtcaacacgccgttatccaccacacaatcggcggaaggaccgaatagtcgccgccggccaccggccaccggccaccgtgaaaccaacgagcaaacggcggcgcctccagagagatcgggagagagagagagagagagagagagagagaggggttcggccatggagacgagcagcagcc

SEQ ID NO: 28126 - DNA, 429 bp, Oryza sativa
attaatgtgttgtacttcttttaattttcattttagtttgttttctattatttaagattagctttcactgtattttccttctcaactattttataaaaccttctttagcaaataaactaaatttctatatattctttctttcccacacaaattttatctcttatcaacttacaactaaatttggagacaaaaagtgtgcaaaacatagctccaaatgtaatatgacaaaaaaacattggaggatgaaattgctaaccttttaggcacatccgatttgtatataatcaccaaaataaattcactagaaattttagcatgacctcccctcttttttgaagaaattttaaagcttgctcgggcagctggaggaggaagaagacatatatatataggggtgggactttagtcccggttggtgggatctttagc

SEQ ID NO: 28127 - DNA, 1501 bp, Oryza sativa
tgctgtcatctggatccagcggcggccgacctccgttgcctccgtccccaccagtggcgacatggattcgggcggcgcggcgtggattcgtgcggcctccgccgccttgccgtcgccgccttgccattcgccgtcgccaccatccccatccactgtggtagccatcgtcgtttccatttgtcagtgttgaggaagaggaggggggagaaaatctagaggaagaggggaaaaaagattaaggagtgataatagaggctgacatataggtcccaatgttataggttcggaatagagattttagatggagaggctgttggagtccacaatgagtttgactgaccaaatcaattggctaactagctatatgggtatttgaagagtctattttaggtagtccgttggagatgctattagatagtgacaaatgttgatggtagtatcaatgaaggagaagcagacacgcatccatttctgactcagaggacgttcattttctgtgacacctgtcaggcaattaattacacaatcgtgcggtcggtacaggcctcacaagtctcgagccaaacacacacactatcaagtgctcggtatgtactggtaaagaagagcccacacgtgacatactacatgtaaataattttaccttttatcttcatttttcttctttcaaaattttgaattacatataattggtgtaagctccaaggcttgaaagtaggcatgcaatccaggcttccacagatttcggaagtgaattctaaacttgtttgtattttgagatgatacaaacttgtttgtatttctatttcctcttctcaatttctctaaacttgttctacgtatcttttcaatcttctcttttcaactcaaccatttttacttagtctattaataaaaaaattaaacatgtaaattgatgttgctagatttatcattaaccaaactatcataatatgcaactcttttatttaaaacatcttagttttatgaatattattgatcaaaatagcattttaaaaactatatcaaagtctaaaaatacttctattttaggatgaacggagtatttggacttatactatggcactacgtagcgaaagtgacggggggccgggggtgtgaattctggccgcacattgtacctacccaaaaagtacttgctgtattgaatcaacgacgatgtcgtcgttaatgcatcatcttaattgactgtagtagtactagtacgtaatgccattgcacgggaccatcttatctctttttttttctttaattatttgacacaatgcgattgaattggggtgcaggagtatatatataatagtagtggtaggtaacatgaacggtgtagattgagagaggagacgtactggtgctaataacaagaagtactcctacataaagagagagagagctagctaagggagtaccgaccgaaaaagcagaaacagcctgcctgaccccaaaaaaatggaggaaggcgtcgtcggtgggggcggcg

SEQ ID NO: 28128 - DNA, 1501 bp, Oryza sativa
gtcgtgtggaaacaatttgtaatatgaagattagtataagttcaattcatacaccatatataaaatatattttgacttggtttaaattattataaagtttgatattattggataattttatcatactctctccatcctcgttttcttttcattattgaccatcaacatttcaaccttgaccactgataacacttaaatgattaatttataaaagttgcacgtttgtatttatggtacgacgcatatatattactttcaagtatatataaactttttgaaaaggggaggaagctgtgaaaattaaaaagtaaataggattatgggccttttgtttgggcttaggcttatagataagcagcttatgccaggtttttccagttaggcagcttattcttccttggcttaaaagtctccactgtgttgtttggcaatctagcttttgtgtgggatggctgatttgctaactattgaatggtccaaaacacccctgagattttggtggcttgtttacaagctaaggacattgtcaaatgtatttttctggcgtacgtatgatctgctagtaacgtcacaaacatcatcttatattgttacaattaccgtgaccattatattagtaaaataataagatcacatatatgccacgacaacaaatgaggaagtaaaataatacaagcacatatatataaattaacctatcaatctatgcccttgttgccgttagtgaattagcaatcctatcacggaaagcattcatgtcttcatcatccaccgctaatccattgataccattttcttgagatgaactagcttgttcagtgtttggatcgaactcttcatcgagatcacatctcccaaaaagttcatcacgcaaaacactgtctcgaatgaaattgtgaagagccatacatgcaagaataatcttcgtttgccttttcatccgataacttggcaaattcagtaagatccgggtatagctgaactgttaccagtgacaaaagctttatcatacgacgtccatttcttgtagattagccggtggtccattacgaaaatgcgtatgattagggtgcttctaaaaagggaaaaaagaacaaagttagcacaagtttaaatgtaaatatgaactggaacatgtaaagtgtttaaatagtatataccactatgtggtccgcccaccaagcatcatcagcagtaaatgttcctttaattggatcccagcctaatccagttgatttttccttcagttcgatccacaagttgtattccttctttagtgtttcccagtggttctttaattgtttttggtcatgctttttccctgtcctctgaaagaacttcagctgtagatttttgtagccagtagttgacaaacaacccgtaggtctattcccagcctcacattcctcggcacagatctcacaaaaggccctgttgctaaatgtgtcccaatttgccttggatcgaggaactagatccatctagacaatttacattcagc

SEQ ID NO: 28129 - DNA, 379 bp, Oryza sativa
attattagagttttaatacaagattatttgagttttaatataagattattagatttgtaattagacttagcatatatgattgtctagggttctaatatacgacaattagacttagcatatatgatatttgagttttaatataagattattagagttttaatacaagattatttgagttttaatataggattattagatttgtaattagacttagcatatatgattgtctagggttctaatacaagattagtacagttttaatgattatctagggttctaatatacgacacttagacttagcatatatgattgttagcatataagattgttaaagcaaatatgacctacagacttagcaaatatttcttgtatgaacaga

SEQ ID NO: 28130 - DNA, 1501 bp, Oryza sativa
gtggtcgcgtcttcaatctcgactagatgcgggagatcgggaattgcgttcccgtccatcgtcgtcgccttgccactgatgctgtcgccctgaacttgaccattggctccctgatctcgctgattgttgtcaccatcgtcacgatggttgttatcgttgttgtctcggcggtcgctacgggcctgccgatctcgatctttgttagggcggcctcctcgatcattgttccctccttggcgtgaggggagacggtggcagtgtcaacggtgagcggtgttctcttctcgtcgagagggagaacgacgccgatgacgatcagtgtcgttccgatctcgtctttccctccgccagtcgtccagatgttcgcgaaggtcgcgattctcacgacgcggtggagttggatctcgggctgcccgtggcgattgagcacggggaggacgttctccaatagggttttccgcttctgcgttcccgttagctggttcaccgtttcctcgtggtggatcttgcggtggaggctcagtcgctgtgtccgcgaacacgctattgagattggtcacagtctctcgtaatcacgttgcccgctgatcaacgtcagggtttagggcaaggtcaaaggggctttatctcaatatcgcatcgaggttccacagttgttgggcaggcgttctggctgctgcggacgcacttgtctcagcgacattgatcacgtttacatctcgtaatcttccaaaaggtgtagcacgaatggctcgttagggttgacaccgacaaaacccacgaaccgatctaaagtcattgctacgtctcgttcctcggcaacgcactgagattgaattcgtggttgtttgatgtgaggacgtggcggcttgaatgtcctaaggaagatcttgcaacttgtgagatcgtgagatcttgatttatggaccgggcaataggtgaagcccgttggtgaagtgcgttgaatcccacgctcccagcaggcgtagagttcggccttcacatggagtatcaccaggcaatcttccagagtatgcttggatgtcttatggacgagacaccaagatctcagattctggataggcatccttgtcggctctgggtttctgcgcgaaggacataactcagccgcttgaggattccttccaggtgttggggccgttgatgttccgttctccacttgtgtgggaggaactgttggcgggacgtcgtttctcgaagtcgtagccatgttgttctcattcccgatagtaactgggtcagtcgagattggtgtaacggtgtagactggaagataatagatccgacttgagtccacaccagcgatgtcgaggtagaagctccttgattgatgccggtgttggtactgttgtcgagatggcttgaagtcatattagcggaaccttgagcaccaagtcccactacccggcgcgccattgtcgacgagtgatactcgtagaccggatgattagggtattggggtacgttggaacgaggatcg

SEQ ID NO: 28131 - DNA, 1501 bp, Oryza sativa
tggatcctatcaatactttttcatctcaaaattttgagctatcctgtacgagaataaaaaaaaagattagttttcaactacttacattgtagtcaaccgcccagcccatcgttgcttgcttgctgcaattcatttcatggaagcttgctggaaaatgctgaagaagggtagggtgggtacttggataaaaacttgaccagccaatggatgatttctccaacagagctcacggcagtggcccaagagggatggaaaaactttttggatggcatataaggagattgatgttttctattggcatataagaaaccaagcgaattttcagtgccatataggtaattctctcaatataaaataacaagagtccatataaaaccataagttataaatatttgaaatttggaataataaaacaagtattcaaagaagagtccaaatacaacacgatacgagattaggtataatttataattcctaaaaagacaattttgaataaaacaataatttgatttgaatacaaattcgaaataagaatcactcaatcactaaattcaaaatacaataaatattttttaaaagaattttttatctttattgattcaaatgcataatgaattgtatatatatgaagcaattaaagagggggctagcaggataataaaaaaatacatttattaccaagtttgtcgagatttgttcacaagaaagagatataatgaacgctccattaaaaatagaaaaatatcttattttaatttcaatttgtcatggttatggataccacatacctaatagtagttgactaaatctcggcaggacccaccacatactatgtcctatacggaagcaaccttcggatataggaggagttccggataagaaaagacaaccagagttatacatggaaacgacaaggactactcggattgtatccatattggttttcctagttctacttggataaggggacacctatgggtataaatacaagaccccccatacacccaccagaagccacaacatacaagccaacatacgccaagacaagctgccggatatcgacatcagagatacgcctggatcgaccctacccggtaccttcagaggccagccgtagggatctagcgctacctctggtctcacctggcataagctcgaggaggaaggctaccctgttgtcgactacgagtcagatcttcagaccgcaatgtcgacaacagttagataggctaccccacacattgtactggtgttattatggtgaataaagatcaacgaccggctccggccaacaggatgtagggttattaccttccgaggggcccgaacctatataaaaatccctgtctccaccatcttttacctcagtctcgcgtatatcctagcaccaacgatccccatactgtccaaataccgtagtcgcgacatcaaacgtcgacagtggcgcgccaggtagggggattttggtgctctaggatttcgacgagatgggttcaaaaga

SEQ ID NO: 28132 - DNA, 823 bp, Oryza sativa
aaaaacaacagacgttcaatacaatttcggcgcatcgccatccttttgctttagttttatttcgacgagttctcgctttcgggttgagctgcatcggtttcgatcttcaacaagaggtaaaacttgtcatggcgacttgtgttttcgggattagtgcttccatctttatgacactctaatcttgtttatgtaattcgtcgagctatcatatatcttgtataatcttcgacaatatcattatctaatctataatcggccaatatctgttagtagaaggcagccgattaggttaaatagcgacgttggcttagattatacaagatatctaccactctatgaaacatctagcggcttgattgtctagatattgtccttcttttcatacttaatgctgcatcagttgagtttgatctattaagtcgtgcttagaattgtaatctctagcctgctttctagttgccgagtagagtagtgtcggagtttcagccgatcttatctgatttaactacttctatcctatacgcttatttgatacgttaaatctgccatttgcattaagatcttgtcgcatctaaagtatattaggctactgtttggtatatttgatttgctttagtatcttaatacagagtagtatcggagtattagccgatacgtgccaggtctacatgatcggctatgctataaacatatataatcctcttattagtatatatttcgatcgtagtgatttatactgtctcggcattacgaccgatctatcccaatcactcgatttaagtatatactagcatgaagattatatatcgttgatacctacagc

SEQ ID NO: 28133 - DNA, 1501 bp, Oryza sativa
aaatgtaaatagataagtggagctaaccagcaacaacccaggggtccaaacactgcaaatgtatcaaggtgcaattgtgattttttactgacatacatgaatttctaatgtggatttcaagacgagtgctttaaattaattgggtatgacttccccctgaataacttcaggagcagtttatttggagtactaatgctgagggtttagtgaagaattagctagaataggaagccggacaacagcaaaaatatgatgtctaggcttgctgggaaagagtttacctctgctagtcctttgagaccaaagactaacagagcaaccactccaataaccagagcttcgggagctccaactccaaataaagaagcgtaaacaccagttccacgacttgttcttttgctctctacattgaagaagtcaaagaaacacaaacgcagtgagatgcctaatttggcaaagaattatggaacagcacgatatgaatacaggcatagtaaatatagtaaagggaatatccttcatccagctatgtaaagcaggaaggtagatgggcagttatatcggcgaagacaaattagatgggtaagaaatcctgatctcttcctttcctagtctttagctttcctgtttttcatacaaagatggtagtgtgttgacgtctaattccagtccaagagaaaatttgtagatgaggttagtgaaatcgaactgccgagacacgtaggaatggtagttatggaaacgaaagaagaagtgggtagagttgaattgagatgaaactaaacagtgtagaatggcgagcagccaggtgatgcgagggacatgatcccaggcattttgccgagcatatggtgggcattttgccgaacaatgacaaaatgttgaatgccgcccaatttgtgcactgtatagagcttgtgacaagagttgctattacgggtattttcatctaagatatgatgaatacttttgacggataataacacaaagaaggagtgcaattaaaaggcaactagatactatgagtcgcaatgaatgaagggaagaaatgaatccaaacaataaactcaggaaggctcgcttagtatcatacaatcaatcaatcaatgaatcgtttgttggttgtggtgtagtagtaggagagtgcccgtacgacggcggcggcggagatggcggccggagacgaaggatagaccgaccgcgcagtagggctgggcgagggtgagcctccgcctcctccactgtgaggaaagggaaggggaaggaggagtgcacgtggcgacgcacggaggaggtcggagtagcaggccggcgatggccatcgccggcggtgggcttggaattcgattcgattcgtagggtatatgccgctcactcgcaatcgcaagtcgcaccgcacctcaacaacacaagagggaggtgaacgagaaggagatattgcgggacccaccatataaatcaataaaaataaatatccttatggtactagtttattttctac

SEQ ID NO: 28134 - DNA, 187 bp, Oryza sativa
ctttagagttagatacgagatcgttgacgaagtccaggagattcttaacgaacgtgtggaacagaatttcggggtaggcgatcacgagaagcgggtcaagatccgggcttgggaggaatctcacaggttgcggatcgatgctgcggccgataagcgtgctgccaagaagctgcacctctgcaggata

SEQ ID NO: 28135 - DNA, 816 bp, Oryza sativa
aatacttgtctctgcatccatccatttttaagtctcgtgcgctaccccttttattattgtcgaattcatgtttcgatagttgcaccaatagtagaattagagcaccttgattagaatagtaaaataatcacagagcatgtactgctgaagctgaaacatatctagctgcactttcgtgccgcgtcgactcgaggtgtttctcatgtggaggtcaagaaggattctacgattcagggctgtctatatgggattcgcataattttttagactttcatcatgcagtgtttcaataagtagatcgaaaatgtatcttttaaaaaaaagttggaacacaatcaaatcaccccttaaaacattttgctacaacgtataaaacaacggttccgaatatattgaaacatgaaacaaatttgagtacatcgagaaaaagtctatataagattcgcatgatttttaggcttccataatatagattttgaagtaatcgggcattgttttaccaagtatatcgaaaatatttcaatcttttaaaaagctgaaatacaatcaaatcacctcatatgaaacattttgctacaacgtatgaaacaacggttctaaatatacgaaacatgaatgatttagctatgaaagatcattcaacagccatttagcctttctgttatttttttatacaacgtgcacgagataatgtgatgtttcgtatttgatatagcagtaaaaaaaatgcaaccacaccacacacgtctagaactgtaacctgctactgcagagcaaaacacctagatgaatggatcttcaaactacacctctagg

SEQ ID NO: 28136 - DNA, 1501 bp, Oryza sativa
gtccaagtccaggaaggagttgggggctgcataatatagtgagtacctgctcttggacctcttggggcatgtggaaggtgttgtagggcaaggcatccaaggcgaggtgaatctgcctgttgacgcctgcaaattcgtccaggaacgcatcccctcgcatggcctgcatccatccatcatatagtatatagtatatagattgatggttgagaattgaaatcagcagcaggaagagcaggaggagaattgacaagagacctggtcgatcttactgccgtcgcgggtcttgcggaggaggtctcgcgcggccccgagggcgtcggcgaggggagtactcgaggaggaggaggaggaggcggggaggtggtcgagcagcggggcgaggaggcggacgcggcgggagaggtcggcgcaggggcggcgcaggggcccacgcggctccgggagcgccgcgatctcgtcggccacccgcttcggcatcgcaacgccgatttcccctttttccgatctcgcctctcctcacactcaagatcaacctcaacctcctctcctctccttgtgaacgcgggcggacagcaagccaagccaacccaagacgacgaccggtggtcaggtcaaccaaaccgagtctcagctgctcggtggccctctcccactcccatttcattttgcatccaaggatgggagcgtacctttctaccttttcaattcatacgtccaaatttatagctacatttccaaacaaatacagtaataaaatctactattatctctttaccagaatataaaaagttttattattattattattatgaatgtctacatacatacaccctctgtcccaaaatataaacatttttagaatagtctaagtcaaacatttttaattttaactattaataaaaaataaaaaagatcaataatgtaaaattaatgttactagattaatcattaaacaaactatcgtagtatgtaactatttatatttaaaacatattactatctattactttcatagatattgttgctcaaagtagtatcttcgaggctatgttgaagtcaaaaaatacttatattttgagacgatgatagtttaagttaaaagtgatcatagtgataataataaaatataataacacctatactggacatgcctgcagtgccaataatcagacacatcatccatcaattcattacttgcatcgtctcctttggcattaacttatatcctcttcaccttacaaatcaagctcatcaagtgattgcagatgacaactgatcaaacacatagtagtactagggatagtcaatgggcatagacagacagctactcctacaaattaaggtggtgtttagatccagtgactaaactttagcctctatcatatcgaatgaatttggagtattctatcatatcggatgaatttggagtattaaacatagactacttataaaactaattatataaatgagtgctaattcgtgtgacaaatttttaaag

SEQ ID NO: 28137 - DNA, 1501 bp, Oryza sativa
ctgccctcgaggttctcatcgtggcgcgaaaagccgcaaagaaggccaggatcaggctgacgagcgagacccagataaagtgcaacgccgccacgaagctcttccacgagccggcggagcgcgatgccttcccgtagacgagtaggatcacggcgaccaccgatgccgctacggcgacggtgtcgaggaccatgaaccatttgaatgagaacctgcccttgaggttcgccgtgccgtcgtctccgtagctgcctggcatgttgaatccggcggcaaaggcgacggtggcgatgagcacggccaccaccgcaaggctgtcagttgtcctctctatccctttacctatgtcgcggccgctccacggctttagatggtcattcctttgtggtcggccttgtgccccaaaagcaactaatatcaccacaaagcttacctgcattgcatgcacaccatgaatatataccattaagctgagggcccatgccatcatctctgatgtgtttgggtttcgtcaaaaaatagtggtcagttatgactccacctaatttctaacgagtggaggcctgtcagtacatgtggtggtcaacatctctgacaagcctcatatatgtaagtgttttttttctaatgaagatcaatcataccaaacttctaagtcaagatgtattgaaccatttaatgcttgcacatatttggttattgctcaccatgttgaacaaattggtcgatgtcgaagcgagatcaagcggcgagtgtccatcgtcgttcaagacatcgctttgcactttccccttatggagtaaggcattcacaatgtcaggcgagccggcaaccacggcgatgtggagcggcgtgttcccaaccccgtcctgcgcgtccagaaggccaccgacctgcttgtgtttcttgatagcgagggacacgatcgaggactgcttctccctgaccgcggtgtgcaggaaggtctctccatggccgtcacggagctcaacagcatcagggcagatcccaattagttgcttgacaacattggcatgtcccaacctagccgcgacatgaagagcggagaggccatccgagtccttcatgtacactgtgccagttggcacgatggctaggattgcatgtacgattttgcggttgccgtcggatgccgcgaaatggagtggggtgctgccattgcagtcgacctggctagccagttctggcttccattgcaataataagtgaaccatctctgccaaagacacaaatttatcaatcgagttgacaaacacattcttgttttgtgcttgagatctgccgaatcaacatgagccgatatcttacctaagcttcggaagacggcagcatgcagagcattctgggagctcggcccaacgggtgatgcgtcgctgcaggtagtaactattgctcttacggcaggcactgacctgctcatcactgccaagtacaacggtgacacaccggctttgtttagctcggtctgtgaattagtttg

SEQ ID NO: 28138 - DNA, 267 bp, Oryza sativa
aaacagagtaagaatcggctggagtccggatcggctacgattggatcggctaagtccgagttagactaggtcaggtgatacagccgattccgacaatacgacttggtatacgacatcgggttgagttgatatgcttcaaggtgattgccacgcatggatagagtcctgggaaggcaattgtatctattaattaggatattttatgtaattttcttagatatatgtttgggcaaaagtctgccgtaaagacttatggtatcttagagt

SEQ ID NO: 28139 - DNA, 1501 bp, Oryza sativa
agaagaggaggaggaggaggaggaggaggaagaggcctttgcgaatcggcctttgacccgctttcgtgcgtcggctccggccttgcggcaggcatacttgatctgcttgctgaacctgcatcaatttaatttaattagcttatgttaagatgagatcatttgggggttgttgcacttgcaagtagtaataagtagagtatatatatacgtacttcctcgtcttcttcttatcattgtacctgagcttggctctgttcctctcctcccgcttgtgaatgttccttatcatcatgatgagggaggtggtggtgtggtgttgtagtggtgggggtggcattgccattggcgcagcagtagcagtattaggagtcgcagtcgcagataagagagttggaagtagctcttctccttctcctcgttgttgtaaactgcaggtagctggctgcatatgatgcattattgtaccagcatcgggtttcctggacctgccgactgcaggaaactatagagccaaattcagatgagagaagagatgagggtgactgaataccggcggcggcggggcggcatggaggaggcgcatcatctccagcggggtggggcagccggtgtagacgtaggtgtatgtgtaggggtaggcgtaggcgtaggggtaggcgcacggcccgcacagcgtggccccgtcgttgaggcgcagctcggcggcggcggcgttgcacgagtcgcagagcggcgcgcgggggtgatcgccggccccgccgtgggcttggtgcagggctcggtcgcattggaggcagaggcgcccgccgtgggcgccgcagaacaccacgccacgccgcccaccgcacagctggcactcgcaacccacctcattttccatttccaccttttttttttcactctcaacccttctcgactattaccctctccgtctaaaaaaatatatattaaattgcgcaaaatctatttcgagagacatctcctgctaggcgacagcgcaatacgtgcgagaagtactattgcacctcacatatatgcaactatttttttgctattaggttatacatgtcttttttatcttcttatgaagttttctctcaagttacttatccgatctataatccgattatatcattgtactcgttgcaattaaatcttcagaacaaaatcttacatgattatattacgatgaaaaaatatttatatttgtatattacttttattacatatgtaagttacttttatcatatacataaaatatttatcaaaggcaggacaagcatgctgggtactagctagctgtcaggaacaagactatacactgatacacacagcaaacgtgcatgatgataatcctagcagcaggcgacatactcggaagaagccggcacgcggggccgtggcatgggggataagcagtataccgttcaacggtataccgttgtgtagtctttctctaaagtacaccctttcaaaaataaaacaaaaaaaagattcaagg

SEQ ID NO: 28140 - DNA, 1501 bp, Oryza sativa
actcactagacaaatctgaacaggggaggctaaacttattgactacttgtttaaccgtggtaatggaaggatgaccaagacgatgatgccaccggtccaaagatagtttgatggcactgtaggcttgcttcaaggaggagtgtggtagaggatatagcctgcgccatgatcttcccttaaggagagtttttcctggtgatttgatccttaagaaagaaataatcacgatgtaattcaagaaaggcagagttatcattaactaagcgatgtactgaaacaagatttttcttagcttgaggcacatataaaacatttctaaggtggatattacgactattgggattatgaacaatagcatgaccaatatgactaatatccatacctgcaccacttgctgtgtggatttgttcaccaccgttgtatttttccttcatagtgagcttgtccagctctcccgtgacatgatctgtagcaccagtgtcgatgtaccaatttgtgtcaactccataggagttaaccgctgcagctgcaacatgcttggcgtcaggaacgtaatcctcgtcgtacctataccaacaatctgctgccgtgtgcccccgtttgaaacacacttggcagattggtcttttatcaacgcctcctggtgtgcggcctcgaccacggccacctcctccgttgccgcgaccatggccgccgccgccgccgccgcgcgaacctccttggccaccattgctgttgccacgccccccgtggctgaagcctccacggttggcaacattgacggtgacctcctgtgcgccgcggtagatggcttggcgagcttcaaagttcaacacttgagagtacagatcactcacagagattggttcaacccgagcgcagacagccgacaccacctcgctgtagccctcgccaaggccggtgatgatatactgaatcagctcctcttcatcgatcgggcgacctccggcagtagccatctcatctcctaaggatttcatttttgcaaaatactcaggagttgacatgttacctttctttgtattggtgagagcaaaccgagtgttaatcgctcttgctcgtgtgtgggtggagtacatctgctcgatggcgctccacacttcagccgcggtgtcgcatgtagcgacctgcatcagcacctctcttgtcagcgacgagagaaggtaccccagaacttgctggtcggtggcttcccagtcttcatgggctgggttcggctccttcttggtggcgccatcttttgtgacagcgatctctgccggcggccgcttggttgcaccggtgagatgcccctgaagccgcgctcctctaactgcggcgcttacttgcaccttccagagcgcatgatttgccttcccaagcttctctgagattgggtggccttggaacggatttgtggcagccgtactggacgacgaggccatgagtattgatctcttagggaattgatcaacgctctgataccatgtgaattagtttg

SEQ ID NO: 28141 - DNA, 1501 bp, Oryza sativa
ggattgatctatggaatatacgaggtcagacctgatcattcgctagcatctgctctttctctctggtgtgtattgactaagctagtcatgatcagaactcatctttctgaacttatgcaggccaaagctgatggttttcttcctggaggtgctagccttcacagttgcatgacacctcatggcccagacaccaagacatacgaggttagtcatgccgatggtagggaggaattccttccttgtaggtggtatggctgctgatgtgtttgtaacatggtgtgttgcatcaatttgcaggcaacaatcagccgtcctgatgccaatgagccatcaaggctaagcggcacgcttgcattcatgttcgagtctgcactcatccccagggtttgccaatgggccctcgattccccatcccgggatctcgattactaccagtgctggattggattgaaatcccacttctcacatgacaatggaggggcaaccagcgaagaaccatgcagaaagtagctttgatcagttttagtagcttatgatgctgtgcttgtgtatattttgtgaggctgtaactgaaccattcaccagatccgtgtaagtaaagacaataatgctcagcagcctgtactgtacaatcgtgggtatagcattatcagaagcaagaatgtcaatttcaataagaggttgcctacactgtaggcagattagtacaggcgtgtttgtaacaccatgaatgaatgaatggatggatggacaccgtgtgaggtaccattaacatgccgccggaaagaagatgttacattcgcaacttgggactgttaacatgttcccctctgttgagatacagattgatgtggggagttgagatagataaaattgatctattttggttttggttttggacctatgatataataattggtttggtgtttagagcggaacctgtcaaattcttggtctcaaactgaacgcatggagggtttcctccagtccagaacatcaattttctcatatgtgcatacttgtggtgttggtgtataaggaaaccaaaccaatctttcttgtgtagcaactgaagataatgctggatggctcaagtgatttggtacttgtaagataatacagtatctatgtagtttgcttgcaacctcagtttttgtagataatgaattagacacgaacccataagtttgcaacctctgttacgtcaaaagaaaaaaagaagaagaaggtgttgtgcattgcatcctcactggaatgatgtcatgacatgaatagatatatctttactttgtttgttgatgctggattatcaatcaagcaagcaaacaaacactaaggaaaccaaaacctgagacagagacgggaaacaatatcatcggaaggaaaagcttaaagcttcttattttattatttaattttggaagaaaaggcaggcactaattaaggcaggaaggaggaggaagaaaagcttcaaggtttgttgttgttgagcagtagcggc

SEQ ID NO: 28142 - DNA, 1501 bp, Oryza sativa
tgccctttctccgctgcgacatgaagaatggtgttcctctccgccgtcacctcgagtacgttgcactgtctgtgctgaatgatgcctgaaatgggtacgaggagaattaaatgctgcttgtatgatgatatactagtcaaatgtctgtgagttgcaacagaaatcaactttttgaacaaaagaagatcattattgtgtggcggactagagaaggagagcccatttctttttttctagttctcacagggtcatcccccctggttttctaattttttgcatgctaggatgaccgaggatagaggatcggtttggggttggatttttggatgatggcatcgtgggcggagatggtttcgcaagataaaataggtttattttattggtactaagacggttttgaaacatcagatacttagttttattggtatgtctgtgagttctaggcaaactgttgttttcctgacagggggtggtgggctcaagtaacagagatagagatatcataggcttgcatttctttatatattttttgaaatgtttcagtattgtagctaacatttaagggcaaatgtagatgaaggacgtgcatggatttgtatttaaaaatcaaacaatggacaattttgatttatgatagtagcactccatctctctgtgcaacaacctccttgattggggctttgcatctcgaggaaacatcacgtttgtcccaaacaactttggatatacttcctctgtttcaaatactcatcacttagaccctctttgtttaggcttaagcttcagtttatagccagaaaagctaaagcccaaacaaagggcaggctttttcatctggcttttaaaaaagcctaagccaccctataactaaaagccgaaagcccatagaaaggtgctttttctggcttttgtgggttggagaatatccagtgccattaaatttgataacaaattacccaccatgcaatccatttataattacggaacgaatcgttttgtttgaattctatcctcgagcgagagcgaaccaaggagccatctctccgccgccggcgacgggcatcggtggccctcttcctcccctaggcccctgctgctcttcttcccaactgtcatcagattcttccctgacactagcgccatcttcttggcagccttctgtgatcaaggtaattaagacaagcccatattctcgatggataaattagcaggtgacaatgatggaatatcagtatgatgtgttttattgcgtgatttgcctacatgatttatttagaccattaatgtagttgttacacagcacgaagttaaattgctgaatatctttttttttctgaatacattgctgtgcatctttactgcctaaacatttttcatgtaataaagtcatgtagcattacataaatcttactataaatcattaaaatgtgtttatggctgaatgtaaattgtctagatggatctagttcctcgatccaaggcaaattgggacacatttagc

SEQ ID NO: 28143 - DNA, 1501 bp, Oryza sativa
gaaagtggaagtagtcggaggaacgctacatcgctggtcgaggaccaggtagtagccgtaactcgaccactgaaagtggaagtagtcggaggaacgctacatcgctggtcgaggaccaggcagtagccgtaactcgaccacttgaagcaaatgtacgagagatcactacgatcaactggttgagaaccggtgagtaggtgtccctcgatcatttggagtcgtggtacgaggaccgctacgctgccgtagtcgtaccttgaccatctgaagtaaaggtgcgagagattgctacgtactggtgcgagaaccagtgagcgagcagaattatgtctcgaacaccgatggaaggtgcggtgcgagaaccagtgagcgagcagaattatctctcgaacatcgatggaagttgcagtgcgagagattgctgcgtactagtgcgagaaccagtgagcgagcagaattatctctcgaacatcgatggaagttgcagtgcgagagaattctgcgtactggtgcgagaaccagtgagcgagcagaattatctctcgaacaccgatggaagtgctagagttggtttattgcaagtgtatctcatgtagccagcatgactcacgtacccaacttatagcatatccggatgtccgttcgcaatcatgtcgggtgatcaagccgacgacgttcgcgaggaattatctgttaacaaccttttctcgagtagtccagccatggccggttctatgagataggtcatcgatcttcgttggcaggttgggtgcgataactccgcatttgttgagaatgttctcgataatggagtgtactcgaccataacctactcgagtgctcaattgttcctgaaaaatattttctagaaggcaagatatatagcagagaatatcgaatatgtacttaaaaaaactgcatggatcttctaatattatcacgatacaacaagcagatgtaaatatcagggcattatgtaaaccgtaaacaagcatgatttatacagaagaaaacagagcgagcccccagcgttagaccgtagttggcctatcgtcggaagtactcgcacaacggatattgtataaaaagcatgctctaggtaaacataataaattatagatctgacaatgctgtatgatctgaataggtacgataaattgcagataaaatattgtgtaccttagtagatacatgccggatgtatctacgaaattagtagattaatttaaaaaaccaatctaccaattaccttgttgcgtactcgttcgacatcatacggtctgacatctttttggtacgccgcgaagcttgaggcttgaatgatctcgatagaccaagttgttgacgacgatggttccgatctcgtcgggagacatactccggtcgggttggatgttcccacagcgaagtcgtcgagtagcttgttgtcggagagtccatcttttgaacccatctcgtcgaaatcctagagcaccaaaatccccctacctggcgcgccact

SEQ ID NO: 28144 - DNA, 1501 bp, Oryza sativa
tcaacacattgtttttcatcaaatatatatagtacattgtttacaccaagaatagtacaatggaccacaaccacatatataaacaccacgttgtgaaatgtaatttcagcttcagcttattattacagactacagtacagttttgattgttattatttggttcagattattcaagtgtccggactgatcgaacaccggagacaagacacgcagacacgagacgacagccacacacaatcaccggacagatcagatccggcgttcacttggtcctgagctgctccaccaactctggcgacacgttgagcgccgcctgcactatctccggcgtcaggccgccgatcaccgaccccttcccggtgaagtgctccatcgccggtctgcatgacacaacaaagtccaagtgaaaaacccatccgctcacgtacggcaccccacacgaatgcatgcatgcacatgatgtatgatcgtcttaaacaatagaaaaatcagacgctaaatagtaatacctccgttttttaatatatgacgtgttaactttttctcatatgtttaaccattcgtcttatttaaaaaatttacgtaattataatttattttgctatgagttgttttatcactcatagtactttaagtgtgatttatatcttatacatttgcataaaaatttttgaataagacgaatggtcaaacatgtgagaaaaaatcaacggcgtcatctattaaaaaacggagggagtacctatacaaaacaaataaaatatgttattctgtttcttcgtgtgtagattaaatttaaacttttatatttctgaatgagaaaaatacatgtttttatctctcgaggtgatatcccatcattgttgaatgttttcgtagtatcttatattaccataatctatcttattattttatgaaatttttaaataactattaaaccggcatttagatgtcatgagtcaggacatctaggtgtacaaattacttctcttacctagagcttttgatcagcgacaccagctccatgccgccggcgtcgtccgcggccacgagcgcaaccgcgtaccgtggcacgacgagcaggctgcccgccgcgacctccgcatcgagcagcgtcgacgcgccgccggcgctggctacctgcacgcgcccgctccccctggcgacgtacaccgcctgcgccgcggcgtcgcggagcacccagggcccgcgcaccgcggcgcccgcgtcaagaagcgcgagcccgacgcttaacccgagctgcgccagcgccggcaggtgcgccgcggtgaccgtctttccgccggtgctgtccggtggcacgcgcgccgcgttcacgacgatcccgtgcctgtcgtgctcgcgtgggcggacgccgtgcagcttgcggctcagcctggtgagcagcgcggcgggctggctgcggaaggcggtggccgcctgctccggcgacgtcagccccgacgccgtggcgaggaggccggcatcgaggcctcccagg

SEQ ID NO: 28145 - DNA, 1501 bp, Oryza sativa
acgtgaatagtctctaaacgaaataattaatcgaaaccatactgtaattagctgaagctgaaactacttgtatgcaatattattataaagtacattacgcagcgtggtgtaatggtccattgtactatctatacgcaactaaaacaatgtgtctatagagtgtctggacaatgaatagggtgtagaaaagaggatcggaaaatcaacagttcttccccctctgccataccaccttgaagacaacgattcatcttcttgcgtactgcacactatcaaaaagaatctgaaaggaggtccagtgttagatcgggctaaaccaagtcctctaaagtcgttagttgtcctcgtctcttggaaagccatggtacgagcgtaatgcaagaatcttcgggcgtatcggagctgtatgcgcccagccgcaactatcatcataaagataaaaggaataagctgcaacaggcaaaggcggggacgagtcccttgcagagtttatatttttagagacagaggttaaatatgtttgaacaactttttctgctctatcaatatatatacgcggcaaagtttgtgccctcttttcaaaaaaaaaagaaagaaaacaatgtgccgattaccctatagtcaaagaaaacaatgtgccgattaccctatagtcaaagaaaacaatgtgccgattaccctatagtctccgttgtattgtaagattggcagtctttgtttaagataaaattggcgctctttgtttaaatgttactcccttatttctaagatataaggacttttcgagtagaatacaagtattaagaagaaaggtaaaaattaaatggcaaatggttgtaatcagttaaaatgatgtggtagatagagaaattaaataggaaacgattgtggatgattaacggtgaaaatatagctagtatactttattttaagacaaattttaaatgttaatactagctagtatattttaggatggataagcaaacattatttactttctttacgccaaatatatttgaccgaaacccaagcgtgggatctggatcagctgcaattatagtattgactgcaacttaatcagttgtagatactgcattggatcaaatctaaacgatatatagattagcttggtactgtagcaaaagtgtttgtagcataaaatgttgttcgagttttgtagcgatgaatctgtgctactgatcatcgaaatgagcgactgaaaatacatgcaatcatatatactccctctgtcctaaaaaaaaagtaaactctagatttcgtgtccaactttgactgtccgtcttatatgattttttttataatttgtatttttattgctgttagatgataaaacatgattaatattttatgtgtgacttgtctttttaattttttataatttttttaaataagacggacggtcaaatgttcgacacggaaaccagggtttgtatttttttttgagacgagggagtatggtgcagccgtacgtagctatgac

SEQ ID NO: 28146 - DNA, 1501 bp, Oryza sativa
tataactcatatttataaaagttgcatggttgtatttattgtataacacatatatattttgctaatgtacgtctcatacttttgagtatattcaaagtttttacaaaaggaacgagcggtcaaagtgaaaaagtaaaaaaggtaaatagtattcaatggtgagtattattttaaacagagggagtatatccgaagttatttgggacaaacatgatgtttgcttgaggtgcaaagcgccgatgaaggaggccatacaaattgatgtaatgttagtatcgtaaatcaaaattgtccccattttcaaatacaaatacgtgcacgtctaatcttcatctattcaattcttttaggtacattcgccctaaagttagctacaacattgaaacattcaaacaaatatataaataaatgcatacataggaatacaatttagaaataactgaaattcggaattaaaaataagtaatattgtaagaagagttcatataaaactgaatacgagattaattaaaattcaaaataaaaaaataaaaaaatagaaaaataattataggacttcatgtaggaatacactttataagtaaaaaaaatattggaatgaaaaatatgaaattttgaaaaaaagcagtttatctagatgtcaatgatgacaaataacaataaaaaggagagaagcaatagactcataaaagagtaagatggtggtggttaatggacatctaaaaactataagcaaaaccatgaatagaatcccaatgacgattaagaggaggacgacacacagaccgttaggtagcaaggtcacgatagttggtgggacttatataaagtaaaaaaataaaccgcaatgacaatcattttcgatttttttaatctcaataataataaatagggaaggcaacaatgggcgggccatacaggagtatagtgccggagccggtggcggttggcgggacttctagaaagtaaaaaaataaaccccaatgataattatgttcaaattttaaaatcccaataacaataagtaggggagacaacggatgggtcatagaggagtacaatagcgatgtttgacgacacttctaaacattataataacagaacctgacgagacaatggactctgaaaactagaaggcccaattattaaagatttcaagaaggataaatagaagccatggtaaatcgggaaaacaagatagaagggtgataaaattagagtaagaggtagagactgatgtgactttaaaaacaataaaattaaaaattaagggatgataaggttcaatcttttaaggttctaagacaacgtgatggctatttaacaaattttaagtaatatcatatattagaaaatagataatttaacatgggtgctagccgtgcaattacatgggcgacccagctagttaccatgaaaacaacatttaatgctccaaacacctttttcaggcattattcagcatgaacaatgcaacctactcgaggtgacggcggagagg

SEQ ID NO: 28147 - DNA, 1438 bp, Oryza sativa
agtaataattaaacaatattaaaccaacgctatacaacataccctgttgtataggcccaaccattctgaacaaccacacccggctgtacagatctatctcaaaccaggaatatagcatttcaaaccaggagctaaacaaattattaccagttatagcatcttttactaagatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccattgcccacgctggcttgtggttggcacggttaatgtttcacaaccgaaactcgtgaaccggtccttaattgtcatgagcacgactctcaaaaccatgagctcacaacccaccatgataaggcattagccgtcccattaattaattaaccaatcacgattgaccatcgtgaactatcattaagccatcattaaataattaatagtgaatcataagttatcccaatagtgtgctaatgtttctaagcatggctaagcaatcacacctaatatctagctgaatcaatatatagagctcaactagtcaagttataataacccaaggtatcaaggaataaagtaatcaagaacaaaagggctataacaaacaataggttaattccacccaatgacattcgaaaataaatgcaatagttgaatagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccgaaacagcacataaacaagcatgaacagtacatgtggatatttttaacatgtagatctcaattttagaaaaatttagagacttgaaccaactaaatccgagctaagatgaattagttatgaatttttgaagattaaatcggattaaaacacttaaattgattttaattgaattatgacgcaataatgaattatttttgaaaaggaaaaagggatttattgcgtcagtgggctagggtttcggtggaccgggcgcacggcggcagttcacgcgaacggacggctgagatcgacttgatccaaaacggacggccgagatcgatcgatccacgaccggctcacgggagaggggacga

SEQ ID NO: 28148 - DNA, 213 bp, Oryza sativa
tgtcgtgtaagtattgactattgtttcaatctggtcttatgcgagtttgatcgaattactaggctctttatatgtttgttttgtgttaagtgagacagactatgttggtttacacgaggatcaccaatcttaatctggaaatggtttcaatgaatgacatgtcaggctcgccagtgcttaaggcaacatgagttattgagttattggtaggga

SEQ ID NO: 28149 - DNA, 210 bp, Oryza sativa
cagaacagtcgcattatcttttatatagtaaatatgagcaatatggatcttggattatgtatttaattataaataacacaaaaaatcaaataaactaagaaaagtacatgtaacttgggagccatgatcacttagctattatttttttcatatatatgatatattatgtgtcaactagaaaatatgaaaagttagatagaaaataggaga

SEQ ID NO: 28150 - DNA, 165 bp, Oryza sativa
attcgagttcgaatcggatcggcttttctctctccgagctcgagctttccatctcgtcgccggccgccgtgggccttcgccgttgcctcctagcccctttaaaaggacccccgagctctcctctacccgccgccaccctcgccttcgcctctcgtcgtctgtaga

SEQ ID NO: 28151 - DNA, 1501 bp, Oryza sativa
tgattgccgcgtggacaatcgtagaatcggacgtttagctcgttgcggcttcaggcacagcgcaaataagatgagcctcgctcgactcggctcccgggcacgccggctcgcgggctcagatccctctcctaccggcctcattcgtccgcagtcgccgccgcgccggctgccagcggcgcctctctcatctactgtctctcatccgccaccgctccctctctcagacgtcgtcctctcggcggtgatggcgagggcaaccggctcgttcgccacttcatcacaaattcacaattgacgacacccactgcggcaactccatgcatggtttcgtttcggcaagaaacttaattaccggtaaggagattgaggttgaggatgatgacacggaggctgtacacatcggtcttgtcactcatcttcttgaactgcacattatgccatcagaaaatgttagtggcactatcagtatcatgtatatagatgcagattctcagtttatatagatgaaacccaagaaatgtagcgtgaatttggagcaaatttgttcagagagacagaaaggtactagataatattagtaaagcattgttgttaaacaaaagtctgccatttactttatccgctgttcacatattggccagaatatgatatgttaatttgttcaactgaacttgacagtcttttactgaaatatacaggcccggccctggggcagggcgagcagtgcaagcgccctgggccccgccaagtcaggggccccctgaccaggtatacgtaagtaggtttgctattgccatcgtacaattcgttgatttccagtggatcgcatcgtctgctttgcaatccaacaacagcgtaaaaacacaagccccttaatttattgaggcccatacgcgtagctatagaaggcagagcagtcatttgattggtcaagcaagcctataggctgatggccaaggtgattatcatttatcaacaattttagtgctactactccttaatgaagggatcactgatattgatttttttgaaaggatcactgatattgattttgaacccataaatactagatttgtaaaaattactccatcgggccatacatatttaaaattctaaccatcaaattaatctacattggaaaatcttcataaaatatgataagtttaagatactatgattaaatttttttatgcaaatctgtttttcttatgctactctaaaatgaagttttcttcaattctggcacctaatacaattaaaaaaaacgaactcaatatagggccctaatttttgtgtcgccctaggcccctaaaatattaggaccggccctggaaatatatgcactgaccaagtgaccatgaagaaatgaaatgctcatgtctccaaaatcttcagtatgtatcaaatcgaaatggtagaggactaaaatcaatattgtactttgtcaaatctaattagaatctgcaaacattcagactgcatccattgaaatgtagcagtt

SEQ ID NO: 28152 - DNA, 1501 bp, Oryza sativa
aagtggcccagttgtctatgattccaatttccaaaccacttctaaaaaatataaatttttggtgcaaaataaatactgacaaagaaacaaagaagacaagaaattgctgaaaattgttgcccgggtgcagcacgtggatcagcatggtgcataatttagttgtagctaatttcaagagatagtgctttgcggattaattacaaaaaaacacgttattggtatgttagtatgaccgtttacactcttactaggatgcagggaaaagaagtcataggaataaagagacagtaaaaggaaagatacatatgcctccatgaggaggacatataattatatatcatcactgcacttgtggtatgtgagaatacacagcacgttgagaccataactaggtgtcgagaaatgctattcattcgcatgatctggtcttttctcggactctatcaatgcagtcttactattcttatttaatctcttttgagaacatgagaggatctggtcgtttatcttgtggcacaaagagctgagtggctgggacagagtagagtgttgggcttcatgcattccacccatgtggggacaattgttgtcgtgctggttgctctgtaattcctgtcagttctagccgaacccatttacagtctaaaatggaagggggcacaatatagtagtagcagataaatgtaacagcacactacacagtataatgagctgggcttgctatggcatgacgtctggttaatggcactagtaaaaatgaactgcctgtgtcctctcaacttttgaatcgtgatgcatagaaaaagttcatcaggtcccattgcctcctattaacaaatagctccagctctctcctcaccacggtatgtcatgtcagtagtagtgcacaaacatgcagccgcaaccacatggccaacctaagcaacgagggcatgcgcatatcatttgcttgcttaatctttcttaactcatctgtcagattgtcacagccctcttgttggagtaataatcaatactacttgtggtgtgatgacacagctacgatctaatccttgtacttaaaacatataagcaagttgggttgaggaagatctaaacaccgggcagcctgcagattcagttgtgttcaactttgtcctttgaccacaactactagctagtgcgtgtacctaatcaagattcttgttacaagcagctagctagcaaaacatgtattgtgatattattctatatatgttcacatgtgatgtcccctgttggcttggtgcatttggtaaaacaaaactactctatattatgatagactatggatactccaataatccacaatctgttgctagggggggtgtcaacttgcattaacttgttaacaaaatacagattaaggtgggagcccggttggagaatcagtggccaagacgcatgcatgtgcatggcgcttaattagttgagttgtagcttgttgcttatggagcaggagtagtatacatggaggtactcc

SEQ ID NO: 28153 - DNA, 1501 bp, Oryza sativa
ctgaggtctcatccttcctaggccttaaacccctgagtaacatcataactagatatctgcttatttcagtattacgtgttctgtttgtttatacctgcaaaatctatacgacctctggagggagctactttggtttataataatatgaccaaacacagtatctgccagatgaggatacttactacacatgctcttttctgtttaccacctcagtccctttaattactatgtttcatggctcttagcagcaccctggttctttgaatattgtgttatgttagttccgtttgttttgagagatataagatttgcaactccattgtggtgcactctaggatttgccttatccgccattttgttggagtgacaaattcttgattgcccccatcctagtcattaatgatctttcaagttccatgtgtacaagggaattaaaagcgtaacatgtatttttctacagccacttattcctgttgatctgtgttcaaacgataatgcttctgaaagcagccatgggatggaagtcaaagagcaaaccgtgggatgttcaaagtaatccacttatcactgtgtgaatgctgattttcctatagagttgttaccacttaccatgatgacgctgagcatcaccctttcattttgcagcccatgttttgtaacagatttgccaaataggccttgctccattgttcatcatgaagaggtgatactaaaacaagtctttcagcatctttttctgtcactagcattgtatttcttctgtcttcgttttggtggaacaggaccaacatttttagttaatgttcttttgatgcttctctaggccaagaagacaattgaagcaggtgatcccagagagatcaaaggggcttctacttcaaatcaggctttagtaacccattctgatggaacagattacaacgagtacctgtgtgctgtttgcagaagtagggaaaccccaggaattctcaagtaagtcaatttacttcattcttgctgctccttgcggtgctgttcctttctgttacttctgcagatcctgtccattcttgctgtggatcctgtattggctttccacatgttaaactgttcatgccccagtgtagaaaatatgtggtgattgttactcccattgacagctggcattctgtacagtgagttaataccagtgacaaaacactctcaaactgccaaatgtatggagggcactgtgaccacctgcccttcgtgaggatggagggatttgggactatctgcgactgtggaggttgatccaggccatgtagcctccctcgttggttggttggtaggggctacttctgcctcttttgtaggtttaaaatgaggcagctcaggagatgccaccatgaaaggctgtgggagaggtcattcaagaagaatttgtatgacagaatggggcacaccggcagtgtgatgggatcatgggagtagtaggtggtagggtacgagaaggtggcagtggagcatgagaggagagagg

SEQ ID NO: 28154 - DNA, 858 bp, Oryza sativa
tctccacaatcgtcacccggcctaaagttaaaatcatgactgaacttttgctctcgatcgagtgcccccactaattcgtaactgttgtgtccagcttaattgttttgctcaaaacctgataaaattatatataatgcgacgagtacactttgaaaatatccctttttcttttctttttttttgcatgagatgcgtacaccaaattaagagtgtgtttagttcctgaaaaaagttgaaagtttggggaaagttgggagtttggaaaaaaggttaaaagtttatgtgtgtaggaaagttttggatgtgatgtgatgtgatgggaagttgaaagtttagggtagttgggggtaaactaaacacgccctaaattattaatgtgtgcaatctctacaggactagttcgctcggtcgcgccggccggaccacgtgatctcacaaaatctatgcacgaccccatcatgattatgagcttattagctagctaataaagcttggaggatgatgcaaaaagccgatctatcgggtctttacctagctaaggtagtgactcacgatcgagagctcatggctgcacatgggtcgtcacacagctctccattcatcgatcaccatccttcaattcattcctttctccgaaagcaacccatccatcgattttcccaaaagtccaatccggccgtttccatgatgcattaacttaaatgcaagcatcctgcgagatgagcgttgcttaattatttggatttcttgtggtcgaaacttttttagctgcagtggcggaactgagggggctggcaggggccatggcccctcccaataaaaacaaaattttttattatccccatatatcataggaga

SEQ ID NO: 28155 - DNA, 647 bp, Oryza sativa
ctaatattcatactagctagtgtatatgggtttcatggtttgcgatcaccagaatacacgagcaacggtaatcggtgattagggaggatattgaatcaaggtgaattagggtgacgtcatttgggattttctttaaaaaaattaagataatggaagatgaataatatatctccacggcctcttcacctacgtacccgcatatatatgtatagatcaatcggttttaataatgcaatttcgccggcaatattctaaatattcgtcattaaataacagttaatatgagaccgatacgatcgatctggtattgaaaaagcggtagaaaagtacaacaaaaggacaagaaaaagagcacgattcgaccaggaaatgcaaaggacgggcgtcagcttggtctcttttgttgacctggataattatatattactaatacttacatgtagaagtaattaattaatatcttctttacgcacgttctctgaataaattacttgcacacgtgctctcttctctagaactatatatgtcactgttgatcgatctgtgtctcctagctagttcttggttaacgctgataagatcgatgagatgctaccatagtggaagctgcattgaaatgcatgagctaagctacttgggtcaacagt

SEQ ID NO: 28156 - DNA, 857 bp, Oryza sativa
ggagtgctctgtgattatcgaagaactgaaagcaacatctttatgtttccaggtaccatcgaaatgctacaatttccagatcttattcttactgttatctaagccattggtttactgatgaaagctccattaataaaccattagtagtgtctaatcaaggtttttctttgtttttttttcctggcagtgtgctcatggacgtccgaccaccgtgccgattgtgaacgtcgcatctctccgcggcgagttggcgaggctcggagcggtgaacggaaggcaagaagagacctggcatggtctctcgcaccatggacccagccttgaacgtgctcgaacgcgcctcagagaactgagaaagctacgtggtggcctgtagctgtacaacagtacaagatgtaggatcatatagagggtaaatagtccaaaagaaaaggagaagtgttgcatagtgcttcaataggaagcggcttgtagtttgcagagatagatatgccattggttcacgaagaagaggtaaaatggccatgagccgtgttgtacacttgtaaaccattgtgatttgtgaaggccattctcaccctgtaaatatatgacaatatttttcgcagttttcagagcaaaagccaagtccggctctctttttttttttttacaaagcaaaaggtaataagcttagcagcttgggctcctttgaaacacatgaattttaaatgaactaacttgatttctacaaaatttatcttacaaagtccgccttaacaaggtttttgcctttctttccagatgatgaccaaagtagaagagacagtggtagcccaactcctcaatcctcaatctaaagttgggccttgcttatg

SEQ ID NO: 28157 - DNA, 1501 bp, Oryza sativa
gcaattggtacattgttactgttattactgatacatcatatatggagatgattcataatgtatggtgctgagaaatttctatcgatcttgtagcgcagctagctatattataatgtttagtatcagaaaaaaaagagagtagaagatatttgtgtgggtacaaggttttggtagatctgatctgaggagaaaatcactatagcagaatataaataatattactagtgacaatactaataatagtaaaagaggagatatgtgtggaagaaagagcaggagcagtggaataagcatcgcatcgcatcgcatctagcaaaaaaaatactccttaataataataattagggtagcaaacaagtcagcgaaacagtatcaactaaatactcctgctggctgctgctagtaaactaaaaataatatatgaaattattatcgtggggtaaaatcgggccggcgtggtgtggttgttgaagaacaaggaaagaaggattgggggaagagaagaagagcatcatacaggtaatttaatcagagatccggggagccgaagttgataatctatctatctatctgtgcaaagaaagaaagaaagagggagaaagttattgttacggggtcggaagcgacgaggcgcgccatgcggtcggcgacatcgacggcgtggcgggagccagcccaggcaaccttcatgtgttcaacgtcgaactgcgcggtggccctctcgccggcgaggtggtccacctccccccctacgccgccctccatctttccttcctttcttgtccacaccacaccacgagagagagagagagagcgagccagcaaaacaatccaatccaatcgaatcgaaaagggaacagggaggaagaagaagagaaggaggggattgggatttttatttattctcgattgcaacttgggagttgggagtttggcccgcactctctctccctctatttattgggtactatatgcaaagatctagtactcctatagacttacgtttgttgctcttcttcttagaacaaaacttaggaattgtttttgtcaacaatactagtaataataactatagtatacagtcccaccctaatgaatacagtacatacgtacgtacatacatgatacatactagtcgagttgagatcgtatgcatcaagtactttgcttccctagtctcttgcgttgcgtttgtgtagacaaacgtgctcaattatttctaggagtatacggttcatccacgccacctaccaacctactacctgcatactactgctctactcaattatttctcttctttttattactgtacacaaaataactgcatgctgtattattttgctcttgcaaatacagtacctacccagctagcagtagtgattaattagtccagtcctatcttatcttaattatcagggctactgattatcaatactgttagggttacggataaggtataccctctacccttggatgtacgctgtacgacatatggtacata

SEQ ID NO: 28158 - DNA, 1501 bp, Oryza sativa
tagtagtaatctagagtgtacatatataaacctagaaacttatattgattgcaattttggtttgaaatttcggaccccccgcaagtgactatcttggccaaaaattttcggttttctcaaatttttacgaatttggtcaaaatttagtcaaattcagttaattatgttaatttatttaaaaaaaaatcggtccaagaagtgctgaagatactgaaattttaggagaaccaaaatggccaatatcaaaattgaaaaccctgttaccgtatagtcagaatggatgtctgagattatttttcacgcctttattactacattaggttttttacactgtatatgtgacttgcatcctatattttcattgtgaatgtaatgtaggtaattaagctttgttgtgacattggtcacattcggagcacaggcccagccacaaaggaacgaccatctgaagccgtcgagcggccatgacatggcgagtggtatcgagaagacatccgacagcctcgcattggtggctgttctcattgccgccgccgtcttcgccgtcgggttcaacatgcccggcgggtacggggacgacggcacggccaacctcagggacaacatctcgttcaaatacttcatggtcctcgacaccttcgccatcaccacgtcagtggtcgccgtcatcctgctcgtatacgggaagacggcggcggcggcgcacctcgccgtctcgtggaagagcttcgtggtgacgctgcagtgcatctgggtctcgctcgtcagcctgatcctggccttcttctccgccatccatgccgtcgtcatcgcaacctcgagctcgaggacggtcttgatcaccatgttcttggtcatctatgtgtgcttcaacgccttgattttgtggatcgagaagtggattgatcctgcagcgacgacgtatcgcgcggtttggaggttcgtgtggcgtggtcgccatgctcacgccatcaagaggcgatatccgttcctcggcgactccctatacagcttgcttatcttctcggttataattataaatatcacagcatttgtcgttctggttgtggtgtattatttcgatgtgagaagattgtcgaacaattgatgattgtgatatgaaactaagctcatatatcaatgagatatgagtgatattttagttgggagtactcattaataatagaaggatttgtgcaggagtagtttattatgaccgtctcataaaaaaccaacctcctagcactattaatttggacacatatctctgtccaaatttatcgtactatgttatggcacatctaattatagattcgtttttttacggaggaagtaattaatatatagaagcaaagagatttttttgcagcaaaaactaaccatctgtcatgcatactcaggagaaattatcaaggatgcacctccacaatcatcttgtgtgtagttacaaacaagagtagctttcgtttggatttgaatattatagaggtttgatgtacaa

SEQ ID NO: 28159 - DNA, 1232 bp, Oryza sativa
cgagcgtgcgttgcttttcggctctcgcttgattcctcgcgtggtcgtgtgccgcccgcccgataccacccacaggcagccagagtgtgttgttgtgttgtgtcccatgcatccatgatcggtatggacaggcaggaaagcaggggttggacgacaagggtgattggagacaatgtgtgcgtcgatttccacgttgattaaggccttgttcactttgttatcaatttcgcagtgcgagcttgcgatcgacctcaggatactcaaaagtttaaaagtttttcaccatataaacttttgaatgatatattggtaatcccaaataaaaaagagaacgcagtcaacagtaagacgtccatggtaacttcgtcaatctcaagatatgctaatccaaccttctgaaaaatgctcatatggtataggaaaaataaagatagtcttcattgtccatgctagcccacgaaaccataatctctacgcccttaaatatcagggtagtagtgtggcgttttcccctttcttggtgttttcccctctctctccccactcaaccaacgctccctcctctctcccccctcaaccaatcgacgcgctctcctccttctaccgcggcgcggaaggtacgaagcggtagcaaagccaagcgaagcaacaacagaatattaatttgtcccgcacctcaaacaaaatactgtctagcttctagattttctgtatatatttaaatatgtacttactacatatatactccctccttccctaaatatttgacgccgttgacttttttaaacatgtttgaccgtgttcaaaaacttttatgaatgtgtaaaactatatgtatacataaaactatatttaacaataaatcaaatgatagaaaaagaattaataattatttaattttttttaataagatgaacggtcaaacatttttttttaaagtcaacggcgtcaaatattttggaaaacattttgggatggagggagtatacacataccggccggtagtctaacgtgttgggtagagatcgatataacatgaagcataataaccaagctgcacgtgaacacacacgcgaattgttgatcgaatgctgtcaacaattatatccgtgtgcgcgcgtcttaatctgtcctgaacccgatactgcggatgcgtgtatgtacgtgtacagaccacataatgcgaaaaaaaataaaatacatcctttttattatcaccaattttacatgaa

SEQ ID NO: 28160 - DNA, 1501 bp, Oryza sativa
aagtttctagattatgaagatagacatacgattaaattacttgtaggggtaaaataggaaagtaaataactttttagtcaaagttatcaataaaaaatagaggttagtattttttttaccaaactaattaattaaacctgagctttttattctttttgattctagatgatggcatatcctatagcgctcatctgaatatggcatatggtcaaattaagcttttggttattatgccactcgaatatttgaattcagtgacttgtgatgccaatattcatctgttctatctccacatatggagataaattttggttacacgcaaaacaaaaaaagcttattagcatataattaattaaatattaactattataaattttaaaaatagatttatttgttttttttaaaacaacttctatataaaatctttttttaaagatatactccttccgtattttaatgtatgacgctgttgactttttgacaaacgtttgacctttcgtcttattcaaaaaatttatgtaattataatttattttattatgacttgatttatcatcaaatgttctttaagcatgacataagtatttttatatttgcatgaaatttttgaataagacgagtggtcaaacgttggttaaaaagtccccggcgtcatacattaaaatatggagggagtatcatttaacagtttgaaaaacgtgctaacaaacaacaagcaagtatggagttaaagaaatagaacagagccgaccagagctcatacgaaatccacgcgcataaactccttcaaaatccacgcgcacgagctgtgtacagatttgcgggattccgcttcttcctgctgctgtatttttgttcctgaatgcagcttctctgtgcaagcaagaaatgcatcgcagctccccctattgatggtggagctccgtcctctctcaggcactcccaggttgctttcagtttatacaatttgcaaagaaactcacctttatttatataatctcaaaaatatattcccgtacctgataactaagttataaaatcagttcggatagtttcctccattccgaaacaaatagtatcagtcagataatttttgaaaacaaaaactgattccgacttttttttttaaaaaaaaacacgagggtaagtatccatgaaaatggaaaacagtgaaactatcaagatatctattcagataacttctgaaaacaaaagctataaaaatttagaaataagttttgggaggaattatttttaaaatcaaaaagtttaaaaaatacgaaaaaattataatatctattgttacatgggtcacccaaacatcctgctcaagccgggccctcgagcactaggggtgggcagaaaaagaccgaactgaaaagaccaagattgagaccgagaaattcggtcttaggtactgaaagaccgaattttgttcagtcaattcgtagtctcctcggttaatcaaatagaccgaaaagaccaaattaataaaaataaa

SEQ ID NO: 28161 - DNA, 151 bp, Oryza sativa
atggaaaaatcataaatatagtgcatgaaagcacttttcatgagaaatctactgatgtcactttcacatgagaaaattttgatgtttgcacaaataagttgtccaagttataaagtttgtttgcaagcatttgcaaatgacatacttaaga

SEQ ID NO: 28162 - DNA, 1308 bp, Oryza sativa
gactgcagtaggggatgctccggccccctttgccccccctgctgcgtccgtccctttgctcgtgtagatgtggtttcacgatagatctgagcttagtccggagtaatgttttgtggcttatggttcaaacggaagatattcttgtgttgattcttgtttgccatctagaacatacattatatgggattcggaaacactggacagagatgaatttccaataatttaatgaagaaggtttttttaatcttttgtcatgactatccagttatgccattcagatgcaacacggctgctggttaatttgatctgttcagctaattgtttactagtgacattttttctgcggacagttgttttattgacctatttactacatttgttaacattacattgatttctgcatttcttttattggaccaaatttctcaaaactacaattactttggcaaaactaatacaaaagtacaggtttaaactgctgtgtgcctgtatcgcagaactaaatattcccaattgaatttatcaaaaaaccaggtttaagacaatattaaaaaattacagtttaagtcacaatatatcaaaacattaggtttagcactgactctttccaaaaactatatattataaaagttccacaaggataatgtttttagagcagaatctctaaaatctgtatttttgtgataaatctgtgctaattaagtcttgtggtaacttcgatgttagatgtgtagttttatgttactatggcttaaatatgtagttttgtgatattttgtcatagcatttacagatatatgacatttacttttatgttcgtagacctggatgtgctgaggtagaataattagaaacctccaccacctacatatgcaccccaccaccaccaccttcttcaattctctatggcacgctttctcgtttggagaccatgccttgctggctgatttggctactcttttcttttccagagcctgtcaaccacaccaatttttatttttctcattttcgcaggatagaatattatgcttcttctatactgtgatagtgtgatgtttcctcagtgtatgattgccaaatgtcatttggatagctgtgctgttgtcccatggacaatacaggtgctggtgcattgggatcgacgaatttctgtccacaagctattcattttagttcaactttacctttttctatgtttgttattttgcttggatatgaacaacatatattgatttactgaatggaaatattctactgatcggtcgtttcataattctgatggaaaaatgtgttcataacattttcagg

SEQ ID NO: 28163 - DNA, 404 bp, Oryza sativa
gtatctctactcctgtccctacttaaaaaattcacatctacagaggtctgttcgattccgtggcaaaaaaaaaaggttagtaaaaagtaaaaaacgaacaaaaaaaaaataaaaagggcggaaaaaagcgcggcaaaaaattcgatttctattcgttttaatagtccgtaaatatctcttctctatcttaactaattaaaagattcgtatttttcgtccctccatcaaatcctaatctgatttcgattttgtgaatgatcgaaaaaattgaaaaaaaaaatagaaacccaaacttcaacacccaaaaacaccaaatatatcgaccaaaaactccaaatacatcgagtccgtcgccgttgcttgggattgggttgggcgccgccaccgttgccgcctgctggtga

SEQ ID NO: 28164 - DNA, 1501 bp, Oryza sativa
ttcaatcttatatctcatccttctttagagattattttactttatgtctcatgttttgattttaaaactcttatcttgctctataggaccgaaacattttggaaatactatttttgttgaattttatttgaaatcacttaataatcacagcaaaacagtaacatagtgttttgaaaagttttgaaatccatttgcaaactactcctatgtattagcacggatttctaaaatatcgggttaaacatagcccctagtaaatgggttttgaaaatgagtcgataaaacttaaaacttgctagacaatattggaattccatctccctatgttatctctgaaccaaaaatgaatttggtgggattttgtactttcctctcccgatatttcaaaatttcaccggtatggcctaaaatgtgtagttgggtatagaatagaatttgctgtgcttaaccctctagattgtttgcttagatggaccacccaaaattcatctagcctctggaccaccctaacataatacgactaaaaggtgataaaatttatacaacctaaaacttgattaaagtttcattttgtgccggttgttcttttttttttctggaatcttgagtcagtctgcttgttatttttgtctagactaaaccgtaggtgataaacctgagaattttttacatgcatcatgtagactaacccagtaagcatcatgaattttggcataatttttagacccgtgcatcatagtgaaacaatctagatagttagcataatcatattgtggaaatttgtagtagctgcattcattttttttcatgtagcccaaaccataattgattaaatatgcatctttttacagtagttttcatacataacctgtaggctccacgaattttggttgaatttttgagtcattgcatcatggcataaaaattcatataattctgtatagttctgtcctgaaatctgtaggttgtcagtttcacaaatttgtgtagcctaaactacaaatgataaagtcatgattccttcagggtagctcctaatctaacccatctatctctctgatttttgtcaaaatttttgtatctttagagctagacctaaaaatttgattaagacagtaaagtgatgaattccagcacctagcactcatgtcagattagctcctaccttctgaaatttgttaaaaaaaaaaaaacctagtgcaaaaaaaaattattttattttaagggggatagtaagccatatttgtatcaaaaccaaagataaaatttttaaccttgcataattcttcttagacctaaaatagaaatcccattctagtaagccctgtaccgttaatatgaccagaattaatgattagaggtctatataaccataggttgttaaaaaaatgtgtgtcgaccttaataataacagtaaggaaaacctttaatttgtaagtgttaattttagaggtttttggctaatccgtgttctaaattttattcttatagatgcctacca

SEQ ID NO: 28165 - DNA, 855 bp, Oryza sativa
gtttaatctgcacccatgtgtgagtttaagttattgaagtgcatccattatccactggggaactcttggacaatttacaaacatagatcttatcttcaaactaaaccccgtcactgtcagtaatcctccgctcatatcatttatagattggatttgatgtgttttgcacttgttgacaggagtcagaggcttagtgtactcaccaatgtatcccaaaatatttctcatatttgtttcatcaatgcattgttctccatgatggcattcaaagttttctcatcaactgtatattcacataagcctcctctaacaggagtttcaatctaaggctttggttcttttctgcagcatctcatgcatcatcctcttgcacaaatgctacatcatgcgttcatcatcactttgagtattatcacctcaaatgctctctaccttcctttgacacacctctgtaatacatgcataatatttcacactattatgctgtatatgtagttatatatatatatttttctgtagctttgatgcatgtaattttgaatagcgttgttaaggatccatcattcaactcttcaatattgttatcctgtacaattattttgtattttggttctgctgcttgttctacagctttacgaactatgttctattctaacaggacaattttgttatttgtatttttttttttgcagcaaggtggtatctactgatattgcatccgatgaataagataccaaaccttttaaatggggtcactagagccatgtcgatatggaccttttcgttgtactccctttttggtgtcaggaagcagctgccctgatactcctttttttgagtattgccaaaatgacc

SEQ ID NO: 28166 - DNA, 1501 bp, Oryza sativa
aatcaaatttttaggtctagctctaaagatacaaaaattttgacaaaaatcagagagatagatgggttagattaggagctaccctgaaggaatcatgactttatcatttgtagtttaggctacacaaatttgtgaaactgacaacctacagatttcaggacagaactatacagaattatatgaatttttatgccatgatgcaatgactcaaaaattcaaccaaaattcgtggagcctacaggttatgtatgaaaactactgtaaaaagatgcatatttaatcaattatggtttgggctacatgaaaaaaaatgaatgcagctactacaaatttccacaatatgattatgctaactatctagattgtttcactatgatgcacgggtctaaaaattatgccaaaattcatgatgcttactgggttagtctacatgatgcatgtaaaaaattctcaggtttatcacctacggtttagtctagacaaaaataacaagcagactgactcaagattccagaaaaaaaaaagaacaaccggcacaaaatgaaactttaatcaagttttaggttgtataaattttatcaccttttagtcgtattatgttagggtggtccagaggctagatgaattttgggtggtccatctaagcaaacaatctagagggttaagcacagcaaattctattctatacccaactacacattttaggccataccggtgaaattttgaaatatcgggagaggaaagtacaaaatcccaccaaattcatttttggttcagagataacatagggagatggaattccaatattgtctagcaagttttaagttttatcgactcattttcaaaacccatttactaggggctatgtttaacccgatattttagaaatccgtgctaatacataggagtagtttgcaaatggatttcaaaacttttcaaaacactatgttactgttttgctgtgattattaagtgatttcaaataaaattcaacaaaaatagtatttccaaaatgtttcggtcctatagagcaagataagagttttaaaatcaaaacatgagacataaagtaaaataatctctaaagaaggatgagatataagattgaacatgatttttgcaaataatttgtaactgagagcatagcactcaaaataatttttaagaagcaattctaagtgacaacttaaggggctcctgtagtcggtatttgctctgataccatgctgtcataggctctccagaccttccattatatttgagagatgaagtgaataattcaagtcatcaaacaagcataatgaaacatccgacgcctcgagagaggaatattggagacattgctgggcccttagcctgccagtcaacttcagcctgagatgtgcccgtcaaaccactcgaaggcggcgaccagatgtgttacacattcaggagacttgacaaaaatggctaaagatctgcaacctcccaaatattcctaactcatactcatgtgaatcta

SEQ ID NO: 28167 - DNA, 152 bp, Oryza sativa
gaaagggatcgagctcccggcgaggatcgaactcgcgacctttcgcttacgaagcgaacgcactaccactatgctacggaagcagctcacgcacttcgagtgtcataaatactaaccaaaactgtcaaaaaataatatctcttgaaagcagg

SEQ ID NO: 28168 - DNA, 917 bp, Oryza sativa
gctgtaaataaccactggcatcctccttaggcttgccacagaatgtgcaagcctgcgccatcttgactaagcagattttcagatcaaagcaccatctcccatctgacgtgggttccatgtagcatgttatccaacagagggagcagcaaacttgcaaagggtcttctcagccgtatcatgcaattcttgtggcgcgaaattgactggtctggttgccgatagagtaaccttgaggatgaacgacacgaggtcggcttcacttcaccagtgactctagatatgaatttggttggcagatcataaccagtcctgtactaccctgttttacataaaagagaaaacaaacaaggtttgcctacaaaggacagtgacttatatagaggtaaatataaaattattagcaagtagtgaactcttaatcatttatcttccccggcaacggcgccagaaatgcttgtttggtatttcttagtggcactactggaaatataatttccagcaatagcactagaaatactcatggtatattatggttacagatgtgatccgcaagcgcacggatataccattgtagcatttcacccgggagtattccaaggtatcgtatttattttatcccaagggaagatatgataagagagtactatggtaatagtttatatgttacttatatacatcaaagtctatgcaggggttaactcagttcaaagggtagggtgacacacagaagaaagaactaagaaatactcactctaaaatatagtctaagctaagtggtgaaagaataagaaaagtatcattcctgtacttctagtatacatacatctttagtctatacttgctattatacagtcatgcaaccaataccccgtacccagtgtcctcttggtgtttcgagaagccaccctagcccgtca

SEQ ID NO: 28169 - DNA, 1501 bp, Oryza sativa
ttaaaacttttgattatttaagctagccagatatatgaaaaatcatatgtttagattttcagttttttttcaaaaaatactaccatatagaaattaatagtcaaacttagatcagaagaattttattttattgacactaaaagttttcttattgataattggtatgattcatcttcaactctccaaaagaaaaaaaaatgaattgctcaatccttatcaaattcatcactacttaccttttacattttctgcacacaatcatagttgtatatctctgctattataaatagtgaaggtgtttttaccgatactttggtacgtcatctgtatatgagtcggtttttaagttcgtttgcttttggaaatacatatccgtatttgagtcgggttttaagtttgtttgcttttgaaaatacaaaaggagtcatataagaaatctctttaaaaagactcgcatgctaacttgatatgatcttctagaaaaatatatagctaagtgtattctcacggtgaatttcagtgaacaacaataagattaaaatagccttcacccgttgcaacgcacgggcatttttctagtatataaaaaataaatgtgtttcagttaatactagagcataaatcatatccaaatttgaaaatcaacatatatgcatgtgttatgcttcgtatattgggcaatgaaacactccaatgtcctattttaagcgtcaaaccatccacagtttctacaacatacgtacaaaaaatgtgacactaatatttaatcggtataaaatcttcaagctatatgtacatctatatcaagatacaaaataatggtgatcataaatgatatctaaattttgatatccatgggatatatgcgttacactttatagatatctcgtacaacctccatatatccgcaaaaaccgcgcaagcatagcacattggtagaagtgcttttaactcttagagatagagccattgatagctcataaacccaagataagatctagattacatagtatctatacatagccagggaggccagtatatttaacccccattggttcactatagtcgatcagaggtagtcgtagacacatattttgatcaaacaaggggttggagagagagagaagctagctagagtagtagtagactagtagtgagtgagagagagagatggaaaaggttcaagcttcttgtgagggtgatcagggaatctgcaaaagaggagccaaaggtggccatccgatcgaccaaaatcttgtgggagggatgactatgtcgaccggtgtccctactactgtgcctcctaccccagcattagctgccttgaaaaacctacttataagggtggtggcagcagcagctgggaaaggcctcagcagcagcgcagaagaagcaaggtgtctttgggcaaagctgccggcgccggaggaggaggaggaggccggccagcagccggagaggccgccgtcgtcatatcggcggccaccgacatcgacgttga

SEQ ID NO: 28170 - DNA, 240 bp, Oryza sativa
tgcatagcatccaacaacggcactttgatgtggatcttctggatcacaaaacgagcgaactgctcgtcctttcgttggggaaacagcagcaaccgtgtgtcgcagtactcctacggcacagtcttttccggctgaatctccttgtcagccgagtcaatagatggtgcttcttttgacatcccattccatggccttggaacccgtcgtaaacatgtgacataacccttcacccatcctagc

SEQ ID NO: 28171 - DNA, 1501 bp, Oryza sativa
agcaatcggctatatgtccaatgtaaataatgatatgaaggcaatcggctgatgatgatgtaataaaataacaatataatcaagtagaaaccaatcagctagaaacaaaatataataagcactgatctgaggtttaaagcatacatcggctgcaggtccgatgtcatgaaatccacaagattagattaaacagtgaaacatttgttgtcatcggctaaatccaacttatatgtatgtgcaatccttatgagccaatgcaatgtctagataactcaaaagctgaaaccccgatgaaacccttattggcaatcaagaagcaggctagagattatggttctaagcacaacttagtagatcaaacttaactaatgcagcactaagtataaaaagaaacataatatctagacaatcaagccgttgtctgagttttcagggtggtagatgtctaagctaatctaatctagcaacgcgatttagccgataccggcagaaaccctaaaacgagaagcagccgatagagctaaatcgatatgctaagactagattaacagagacatatgataaataggtaggcaaatatatcatccaaaccagagcaatccaagaggtcgattgtactgatgcagccttgaacgacgccaatgtaaatgggaaaattgctggccgatggaacattggacttaccccttcgccggagatcgaaaatcgatgcagccccgcgtcaggtgccaagtcccgccggacgataaaataaagtagaaaaggtaaaaggtggcgatgcgtcgaattgtattgatcgtgaggatagattacatagaccccgggtgtacatatttatacccatgggttgatacaagtccttgttggacaagaaagaaactaacctaaagataaaaggaaaaatataaagtccttatcggacactaaacacactttcctaaaaataaaaggaaactaacaaactattcctaattaatagataaaatgccatgccgcatcctctttaaactcggtcacttagggataagcttcctttaatagattgatttccttaactgaatatagcaggaatccgactattggcgacttgataactcccatcggctgattccgagatactgcagccgataatgattctaagccgacgacgtctttgccgattaccaaatttcactgttaacaatgccgaagtgggaggagatggaggcaagcttgcttgagaggggtatcgaaccggccaccgctaaatggccggatcaatcggagttctggtactatgctcatggtggaacgctcaacccagttgatggctcccaggtcttcagcgatcagatatgcgaggctgcgcgtcgactaacggacgcagtggaagcctcttctcagggcacgttccgacccgacagagagaaggacgagctgtcactcgcgctgcagactcccgagcatccaggacgaacacgagggaaatgggtgattccttggaagattggattcaaggagg

SEQ ID NO: 28172 - DNA, 1501 bp, Oryza sativa
tcacttttcaataaatatttttatagaaataaaaagtcaaagttgtgttttggagaccgtgccgctgtccaaaatgactttctttacgagtacagagggagtacatcccctactccagagtatgagagcagatacaatagcaggctataagccagctataaacatattttaaagaaataaatgaagagagaagagcagcgggctacagatctgtagctagctacaacacggactccaaaacgtaatgtgtgtatgacaggtgggaccaggtattaatagtatagtaagcaactattgtatgaattagctattatattagctatagatgatttggagctaagttgactgtactattaaacttgctctggtggttgatcacgtgaaccaagtctcgcacgcatatgcttgcagttcgatgtataagtctttagtgaatacacaaaaagttaagcgcattggcatataaattaatatgaagaaaaattcaagtgcacaacgcaaacacaaattgttgataattaaactgttcgattcgttgacatcaatttattgacgaggacagatagcaagtgttcttaagttacgtgtagactgtagcatccgtgtgcttgcctcttgcgttgcaggcttgcatgcagctgcagtttgttggttcttttgacacgttctactgcacgtacagggtttctctcaaaaagggaagttcttcaaggttgccttgcgatttaataaaaaaaacactctgaaaaacgatgcatagaaagtctagatttaatggtatgtatgttaaatatactacggagtagttgtttagaattttaaatttcatcaaaaagaaaataagataatttactcaaatgttatcaacgtaatcataaatccacgtctataattttgtggagctaagggcttgttcggaacggaggaattacacaggattttcgtaggattggcaattcctttggatttggcactgtttatgcattcgtttcataggaaccatgcacaggattttcataggaatactatagcaacatgtgaaaacgtaggaatttcataggattctgaacatccactcacacctcatttttttccattagctaccatgggattttttttccattagctaccatgggatagatgctaatcacgttggagtgactagatgggaactaatattttattgcttaattatactataatatatgagattaatattaattggaaaattcctgtggtttatatattcctgtgttccgaacgcttcgtactatcaaattcttttgtttttcaatcccacattttgcatatgcaatcctatattatttctatgttttttctattcctatgtttttcctatcctgtgatccgagcaagcccttaaaatattcaaactctggatcccgagcagtgataaagaggtcctatatatatactctcatacgtgtctccgagagcatgcaccactactacctggacagccaaaagtactaggatcaaa

SEQ ID NO: 28173 - DNA, 1501 bp, Oryza sativa
caaaacggtaaagggaacttgaattaggtactacctccgtcttgtttgctgtcgatattcatgtccaatgtttgaccgtccatcttattttaaaaatttatgaaacatttaaaaataatagcaataaaaatactgatcataaaaaaattttaaataagacgaacggttaaatgttgaacacaaatagtgcaaaactttaggacgcttattttgggacggagggtgtcggtgacatgggaccgggagtatcatgactagaggcttgaggcagacacaatcgcccacgtggcctggcaccgtcagggggcgtcgggcccgagggtgatgtgttcgccctcctctttaccgggagtatcatgacttagagacttgaggcagacacgatcacccacgtggcctaactccctcgggggggggttgggcccgagggtgatacggccgcccttctctttgtctccccaaggggtcgggccgctcccgtctcggccccgagggccgaagcgccccgaccccttgtgggttttgcgccacgtatatggggtaggtgagtatggcggggctcacctaaccacatttattgcagttttgaggagcgcgtcacgccgcatgtatcgcagtacagcacgctcgtttatccggtctgtgaccagtcacagaccggtcagatcatgggttaggtggcgacaggcggtctgacgcacgcctcgccccatcccgtcaggacgagagcctccaagcactcgtccctagctggagccggcgtgttagctcctggagatggcacgttggttccggtcagatgtatgccaggcttcatcctaaccattacaggcaagatattgtatgaagaagagcgaacatgcagattgttaaactgacacgtggtggacaagaatgaccgatttgtgaccggtctgacaatggtcaagtcatcagcagacagccatcttcccacgtcgcgcctgcctccggcggaagtggaggtaggtatgggccgtcccgtcagaaggtcattcagacggcggcgatgcaaatctccgtctgttaatgaagagaagtcaaattggaagaaagagagggggagatggtgcatgtggtatccccttaagatataaaaggaggaccttgcccacttagaggggggatttggacttttccagattgggaacccagaacgagggagaggctggctcatactttgtagttccttcatacacgaattcaccaaaacacaggagtagggtattacgcttctcagcggcccgaacctgtatacatcgccggcgtcttgtgtgcttcctgtctcgcgaaccttccacagattgggagcttagagtctcacccagggtccccggccgaaccggcaaaggggggccagcgcggtctcccggtgaggagccccacgctccgtcatctggcgcgccaggtaggggactctgcgagtgatcttctgagctcttgcactctttcgtgtgcgccaagcttttcctgttcagcctca

SEQ ID NO: 28174 - DNA, 1501 bp, Oryza sativa
ggaatgagatctttcttgggattcctgtttcatagggatggcctgtttggtacagctccaactcctaaatataactccaagagttgagtctggagtggagttgtggagctgcctaaacccagctcccaactctagtacattttgtgagagagctctttggtggagctaaaactgtttggctgagctctagctccaggaagagtggagctggagctggagctgtgctaaacaggcccgtagttcaattctgtctagagaagatctcacatatgttcgattaggaatatatactcaagtactgataatgcagtaacttctgcaggttatcaggggaaacagtgttgtgatgattgaagccctcgaacctgttcccaagccgcagtgaactttcagctcgcctagtttgcttcggtacttgatttggacatttggtagtgccatgtcaaacctaattgttattccagatgtttatgcccgcgggcattttgtatcctgacctggtttatatgcaagctcgtgcacctttgtatagtctagccagcgttacgatttatgcgctctagcctgaacgttactatattgctgtgatgattttccggagcattttgaggtcacggattgtgaatttcgtagcatcacagttttcgtggtgaccgtgcagttactgtggtaaccgatagcggtaagcctcatcaaaacggtaaagggaacttgaattaggtactacctccgtcttgtttgctgtcgatattcatgtccaatgtttgaccgtccatcttattttaaaaatttatgaaacatttaaaaataatagcaataaaaatactgatcataaaaaaattttaaataagacgaacggttaaatgttgaacacaaatagtgcaaaactttaggacgcttattttgggacggagggtgtcggtgacatgggaccgggagtatcatgactagaggcttgaggcagacacaatcgcccacgtggcctggcaccgtcagggggcgtcgggcccgagggtgatgtgttcgccctcctctttaccgggagtatcatgacttagagacttgaggcagacacgatcacccacgtggcctaactccctcgggggggggttgggcccgagggtgatacggccgcccttctctttgtctccccaaggggtcgggccgctcccgtctcggccccgagggccgaagcgccccgaccccttgtgggttttgcgccacgtatatggggtaggtgagtatggcggggctcacctaaccacatttattgcagttttgaggagcgcgtcacgccgcatgtatcgcagtacagcacgctcgtttatccggtctgtgaccagtcacagaccggtcagatcatgggttaggtggcgacaggcggtctgacgcacgcctcgccccatcccgtcaggacgagagcctccaagcactcgtccctagctggagccggcgtgttagctcctggagatggcacgttggttccggtcagatgtatgcc

SEQ ID NO: 28175 - DNA, 932 bp, Oryza sativa
tggttaggtgagccccgccatgctcacctaccccatatacgtggcgcaaaacccacaaggggtcggggcgcttcagccctcggggccgagacgggagcggcccgaccccttggggagacaaagagaagagcggccgtatcaccctcgggcccgaccccccccccgagggagttaggccacgtgggtgatcgtgtctgcctcaagtctctaagtcatgatactcccggtaaagaggagggcgaacacatcaccctcgggcccgacgccccctgacggtgccaggccacgtgggcgattgtgtctgcctcaagcctctagtcatgatactcccggtcccatgtcaccgacagtagcccccggcgttatgccagggcgatcgccctcctcgagggaagcggtcgggcgtaacgccacttcctaaggcctggtgacaggtggggaccggtctccacagttgggcagaaacccaacggccacaaatcacgcacatcggcaatggtaactcggctgtcaataatgagcggtctcttcaagactgccacattactcgagtagcacacgaatctggacatggcgattcgtttcgtctggagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctctttctccggcgcca

SEQ ID NO: 28176 - DNA, 746 bp, Oryza sativa
ttggagctccccgtgctcataggacggcgccctcctctcatcctagagctagctcatgctctgcacctccgcctcttcatgggtatgatccaaatgctttctttcatcctcagtatgcctattttgggatgcaacccaacgagtacttcaacccggtacttggggctattaataccctaagtgaaagcattcaacgcttgtctaccgggcatgacgctttgcatgaggatgttcgtggcttgcgcacggacgttggagacttgaatgcttccgtggggagattgcacactcgagtgggtacattggactctcgagtccaaatgttggagagctcccaagcattcgtgtatcatcgtcatcgtgatgcttctcatccttccacttcggcgcgtcctcctttttctccacaagagtgaagacctttttggtgcttgatgccaaaagggggagaaaagtgtgttttttgttgggttgggactagtagtagtgaggatagtgccctcgtatttaataggttaaggaggattgagctatattttgtatgggtatgggctattactctatcttgtgtgttatttgtcgttttgttaaactctttatgtcatttggacccttcgtggtcttgtaatagcctatgcatttatttgtgaaccctttatgtggtcttgatgtgaacttgtgctatgatggatggttggtgctacattgatatacttgtgaccatcttatgcattcggttgattcat

SEQ ID NO: 28177 - DNA, 1501 bp, Oryza sativa
caaaaccgccgtagaagaaatgcgagaagaccacaatctcatgagtatccggagacgggaaagcctcaccgtgcgctggtcgccacccgatgatctccttggcagggagaacgccgtgcgccaccatctccttaagattctcttctgttacgtcggatgacgcccattggccttcgaagctttctctctcttccgccattggtttcactcaaatgtgttgatttgatttgagggatggcttgggagaggtgagggattgaggcggtggatcacgggaaggattttgatgcacttttcggaggtggatttggccggagttgtgaaccctagttcgccggcgcagctttgcactgtagcagggagtggggaaaatggcgagagttccggcggggaagacgaagcgtcgcttggatatcggattttttcagttaagggtatcggaggtgctaatgggcctaggcctgaacagtacttcagcccaataattttaacagcgtggcccattgtgttccttagggacttaggcatattttgctttggcgatattatgcgcacaacagtgttgcccaatgctgatcaaatcctttttatgcggtcatataattctttggaattattgcaatgcaaattaaaaaggtgcccgacagaaaggcgttatgctgtttttgcaggcttttttaggctacaaaagctgtttgggttaactaggaatgacttgtttttactatagtcatttccttggcgtgttatatgcctgttttcatggtaaatagtcatggcctaggctattcgacttatttattaccataatcttcataatacttgatgggtaatctttagagtttttattcggatgcctgtcaagtgtgttcattcgtgaaccttttagagtgtaaaccactcggatttcttttattgtggctataaatcagtcggctagcatgcctatttaggcgccgcatatgcttttgtcatataatgcacaattgcgttattattttgtcattcaactatatgtttagtttgttaactaatcacatagttgggggctacacctaattaggtgcatctattcgatgcaccatattctttatcttttcgccctttacagtccactcggcagattttggcttgaagagcttgaagtactcggattattatctttgagaaggctacgatggtcgactgcaaaggactcgggggctactgtggagatcatgggtatcccatatctacacggcgatggtattcgaactgggtacaggatacctaatgtagatagaatatcttatttgtatcttgggtttgtttcttaacttgtgtatcaaggaaacaccctgaaacttagtcggttacgactgtatcttacctatattttcatattccgttagggatatagattatcttttgtaacccggactccttcccatatataaggggggtccgggcgcccctaggggcatatgctgatttttcttgaatcatacaatcaataatacac

SEQ ID NO: 28178 - DNA, 524 bp, Oryza sativa
gggatctgtgtgacttgccttgctggccttggaactcttcaaactcttctcctgcgaaaacggactctccggaaacgacggaatctaagcagaaaagagcaaaatcaccaaaacagcacataaacaagcatgaacagtacatgtggatatttttattgtgtagatctcaattttagaaaaatttagagacttgaaccaactaaatcggagctaagatgaattagttatgaatttttgaagattaaatcggattaaaacacttatattgattttaattgaattatgacgcaataatgaattatttttgaaaaggaaaagggatttattgcgtcagcgggctagggtttcggtggaccgggcgcacggcggcagttcacgcgaacggacggccgagatcgacttgatccaaaacggacgaccgagatcgatcggtccacgaccggctcacggaagagggcgacgatgaccaaaacggacgaccgagatcgatcggtccacgaccggctcacggaagagggcgacga

SEQ ID NO: 28179 - DNA, 1450 bp, Oryza sativa
tgtcgaaactagatttcggcaataataaaagggggtggctatcaagctggataagtgtatgggtttggagacaaaggatttatacaggttcaggccttcttataaaagaagtaataccctactcctgtccggggatgaatccgccgagtgtattattgattgtatgattcaagaaaaatcagcatatgcccctaggggcgcccggaccccccttatatatgggaaggagtccgggttacaaaagataatctatatccctaacggaatatgaaaatataggtaagatacagtcgtaaccgactaagtttcagggtgtttccttgatacacaagttaagaaacaaacccaagatacaaataagatattctatctacattaggtatcctgtacccagttcgaataccatcgccgtgtagatatgggatacccatgatctccacagtagcccccgagtcctttgcagtcgaccatcgtagccttctcaaagataataatccgagtacttcaagctcttcaagccaaaatctgccgagtggactgtaaagggcgaaaagataaagaatatggtgcatcgaatagatgcacctaattaggtgtagcccccaactatgtgattagttaacaaactaaacatatagttgaatgacaaaataataacgcaattgtgcattatatgacaaaagcatatgcggcgcctaaataggcatgctagccgactgatttatagccacaataaaagaaatccgagtggtttacactctaaaaggttcacgaatgaacacacttgacaggcatccgaataaaaactctaaagattacccatcaagtattatgaagattatggtaataaataagtcgaatagcctaggccatgactatttaccatgaaaacaggcatataacacgccaaggaaatgactatagtaaaaacaagtcattcctagttaacccaaacagcttttgtagcctaaaaaagcctgcaaaaacagcataacgcctttctgtcgggcacctttttaatttgcattgcaataattccaaagaattatatgaccgcataaaaaggatttgatcagcattgggcaacactgttgtgcgcataatatcgccaaagcaaaatatgcctaagtccctaaggaacacaatgggccacgctgttaaaattattgggctgaagtactgttcaggcctaggcccattagcacctccgatacccttaactgaaaaaatccgatatccaagcgacgcttcgtcttccccgccggaactctcgccattttccccactccctgctacagtgcaaagctgcgccggcgaactagggttcacaactccggccaaatccacctccgaaaagtgcatcaaaatccttcccgtgatccaccgcctcaatccctcacctctcccaagccatccctcaaatcaaatcaacacatttgagtgaaaccaa

SEQ ID NO: 28180 - DNA, 1501 bp, Oryza sativa
gctcacggaagagggcgacgatgacgtcggcgatgacgtcaccaccggcggcggcggctcggcggctcggacggctcggacggcgcacgcttgccagtgaacggcggcacttcggcaagaacggtggacaccaacgggtagcggacggcacggcgaactcaccggcgacccaagcgacggcggaagaccaacggacggcgacggcgacgaggaagaagcgacggcggagatcgggtcgacgacggcgacgatgctccggcggtctccgacggtggcgaaggggcggacgaggacgacgacgacttggcgatcccgacggcggccttcccgagcgatgacgatgaccggaacggcggcggcgcacggctggagcgacggcggcgacggcggcactagggcacacggtgctagagctcttccggcgacgagaggcgaaggcgagggtggcgacgggtagaggaggcaccgggggtccttttaaatgggctcggaggcggcggcaaaggcccacggcgacggcaacggcgaaggaaagctcgggtagaacgaatccgagacgaactcgaatccaactctttccaagacgatttggccaaagattccaaaggagaaaaggtagaggagatcccgaggatcatttcccctctatcaattcggccggagaaggaaaggagcggccggattggaaagcggcggcggcggcgcgaaactagggtttcggcccgaggaagacgacgactccgacaggcgggacccacctgtcagcgacagcgagggcgcgcgcgcgagcggctgcggctgcggactgggccggctgggccgaggagagagagaggaggttttgggcgactttcggcccaaagccaaaagaagactttttaaaacctttttccatttaaattatttcttaaatgcaattccatttattaaaaatactttcttagctcaaataaatcccagaaaaatctaggaattatagaattaagcaaagtatttaatgaaattttatctggccccattttatattggaatttattaattaaaattagatcttctcttctaggcttttaaaataaattctaaaaatttcatttaaacaacaatttatatattttgaattttcagggtgtgacaacaatcttctcggagaggtcaccgggcaacttctccacaagccgtctaggaggcggcatcctccaagagtaacaagcaatgacccggcgtgagatgatcaagtgccacactagctctacaatggaagcaaatgcacttgactcttggctaatcaaccctataacactagatggatgaacacaaagctcaagtgagtgtgagagaggtgcaaggggtgtatgcaattgaattgggtgccaagagagtccccttgctgctggtgggagagtatttatactcccacccaccaaaactagccgttgggggcgaaatcccccaactttgtgctctgccggtctgaccggaggtatgtggccggtcatactgt

SEQ ID NO: 28181 - DNA, 217 bp, Oryza sativa
ccctggatttcaaaatcatgaaggagaggatgtataaatcttctcaaatgcaattgtagtcagctactctcatcagctgccagtagtgccatataatgcgttcaatccgcctccgcaggtatgcatctgaaatcctcaatctatggccaaaacataattttatcttcatgctgagttgactaactatggaagcatcttgtgcaggaatatgcattga

SEQ ID NO: 28182 - DNA, 461 bp, Oryza sativa
ccagtttaactacaatgtaattacactatcgttacattataagtctctatataagttagatataaagttgcatatattattttaatacttatatgtaagttatattatagttatagtatagatatagtgaaattatgttataattatgctatagttagatttgaaagtttttcctaaaaaacttgtggcaattttttagatagtacctctatatttgagcgccatcaatgcgtagcctcccgtgccagcgcctcgccgccagctagccatcaagtagaagcgcaacatctggtgcactcaactccatccacgtataattgggttagagatggagagggtcagaaagaagagtggatcccctctcccctacgctagcttgctaacgtggtcatcttgtggcggtaaggcaccgcaacaagaagaataacatttggaaagagtctgccatagacctacgccga

SEQ ID NO: 28183 - DNA, 674 bp, Oryza sativa
attcagtttgagcctttgccttctcacttcttcctctccaccgatcttcaatctcagatttcgtgtgtgtgcgtgagtggttgatttgagtttgtttgagtgcttggtgttgacttcgtgaagatttgttgagcactcgattcatcgccaagaaatctctgtgcatttgttactcttggtggttgaggacacctagatggttaggagtaaacctcgagataccgatttgtttgtggtgtgccgagggagtatgtgaaggtcggatcttacctccgaaagggaagagcgaggatagagttggaaaagacccggcccattatgggctcctcaacaaagtgtagaatccccccaaggatttgatctttggtaacacatcaacttgcaagaatcctgatgatatctttttcttactcctctagctttgctatttggtgccgctagtagtttagtcgttgtttgtgcaaacccattaactacctgttacaccatccctttttgtttgcctttctagcttgctaaaaaatctgagatttttggaatatcccaaaatatttcagaatatcggaaatattccaaaatatccgaaaatattccaaatatccaaaaagtttatcttcttcattgacttacgagttttaaacgcctcttcaacctcccccccccccctccgcagg

SEQ ID NO: 28184 - DNA, 1501 bp, Oryza sativa
ctaataaccagcctgaggatggaaaagaaaatcaggtgattatccaaagagacatttgtttggactaagagtttcagatgtgtcttttccggatcaaaggcaatgacagtcagtgtagcttttggcgaaacacttcaaggtttcactgaaaggtagcagaccaaaggacctcctcgccaccagaagcatccacaactctcggagtgaagagtacttagtgaccaaggtcaaaagatgactgatagaagatatcgaaaaagatgtttattaccaggcaaagaagtaggtcgaaaggtgattaataagagaaatcgggaaagaacacatcaagggcaaaggtgtaaaggaatacgttgaatgctaaatgatgacaagttatgacaagcatggtatcttagtaaagacgagctgatctcgacgcatgacatgaagtgggtaacttgtatgaggttgactccaaagatatgaactatgcaaagttctggaactgaagccccatcttcaagtgccgcaacccagtcgaagtcagctaaaggttcaaccagggacaagtcaggtgaagagaagattccatctgcaacaggagatcgagccaagcagtccagagtgaagaagtgttgttaggcaagtttgttatagaagacggagcggaagaagtcagacaagaagagaagaccgcccaacctatcttcttgctagcctcctcgaatctcggggacgagattcttgtaaggggggtggatttgtcacgtcctgataaattcatcccgaaataaaattcattcgctaaaaggaataatagaattaattaaaattcgaaaagaaattggcaaacactaaaatacgtacaagaaaaattcgaatgtggcccggagaatttttgttaaattctccttggtctaaaacgagccctcaaattttacttgaattttcagagcgccggaaataattattaaacaacaacaacaattaacaaagtttattaaaaagaaaatctaaaaataaccctccttcctcctttgggccaagcccagcccaaaagtccttctctcctccctctctttctctccctccccttctctccctctctctcccgggcctctcttcccctcccgggcagcccactccctcctctcctcctccttctgggccgcccctccctcctctccttcccggcccatcttctctccctcccctcctcctgggccgcctcggcttcgcccggcccaagccgagccgcgctcccacccgtgccgcgcacgtgcgcgtgcgtgcgcgccgttgccgcgtgtcggccgcgcgcccgaccgcgtggggcccacgcgtcaggccgccgtcgccttcttcctcctccgcccggccacctctctctctcttcccgtggaaccctaatcccttcctccctcaaatccacgcgaatcaatgcccttctttccaaattgaataggggaaattaaaccccattgaatcctcttcaattcccccttaattcccccttgaa

SEQ ID NO: 28185 - DNA, 1501 bp, Oryza sativa
ttcgttcgagtcaagcccgtaatcgtcgccggcgcaatcaatggcggccgaaatccccgcggccggtttccttcctcctcggccgccctctctcctcccgacgctataaaatcgttgcccgagctccgctcctccgtttccgccgctcgccgctcgctctcgccgtcgatttcgtgctcgcgccgtactcctctctctccgccgtcgccgccgagctccgttccgccgccgccgccgctccggacttcctcccgactcggcgacacctccgtccgcttcgccgtgttgccgtcgaccccgtccgccgctccgcttcgcccgtcgactgccggagcgccgtcgccatcgtcatcccgagccgcgccgccgtcttcctccgctccgtccgccgtttccaccgccttcgccgtcttggggtgagccgaagaccgccgttcgccttccccctttcctcctctctctcgggtgccactccgccgcgccgttggtcgccggcggcgaccatcggggcgcgggtgcgcgccactcccgtcggccgcgccggcgaggccgccctcgggtgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggccccacttcccgtggacccggtccgcgcgtccgctccctcggctgacgcaataaacatgatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattcccttgttcaccctagagcaaacaaaacctcaactagtggacactctactcatggtatccctagtataattttaggtagatgcttcgctttaattaggtaaccttaggtggttttacaactctagactttgggatattctcatatcatttggacactatggaattgttggtttatgttggaattggacacacacctctcttcctctttcaaaacccctaaaacctgttttcggtggggtttgggtgcatgccagttgtgggaagtagcaccccggccactataaggattaa

SEQ ID NO: 28186 - DNA, 499 bp, Oryza sativa
ctcgcaaaataattgcaatctgtgcaattagttatttattagccaatatttaatacttcatgtaggtgttcaaacattcaatgtgacaaggtgtaaaatttagggtgggatctaaaagggcccttaattaagcacgcgaaggagatgtagattaaataaatcatcgccaaatgttacatcaagctgatcgtttcttcctctgattttctgtttggtgcctactcctacctgcgtgcttttcccgaatttatagcttgacaaaacatcggaaacgcttgctatcggccatccgatgaaaaccaaaatatcggacacctaaacaatcaacgaatcagatgagctctctccctatacacactcgtaggcacatgcgggcttcctacacacactcacacacacacgcacacctctctcattctctcccctacatgcacaatcatgcattctctctctaatttatgtatgaggctatacttggaaacttcaaaaattttgttct

SEQ ID NO: 28187 - DNA, 1501 bp, Oryza sativa
tttgtctcttagtcttcaatatttcttattgatttgaagagtgatgaaccaagtcaattatggtccattttgtcttagtattacaactccgaaaatgaccgtagtctaatgggagaagaatcatatgaaatggacaagtggcgcatatgaaatgtgcgatgtccatcccactaagtttgcacgccaattatggcggcaaatgtgcataggcactaaatttgtactaagcattagtcttgacaaacttctaaagttcatctcaacatttgctagatacagtttcgcaatgtcatgctcaaaattctcccctaacactaacagggatgataatcttaatatttatgagtgacatgcgaaacataacattatattggccttctcccaggctaaagatgcctctagagtttaggaaaaattagtgacattagctgcgggagacacaaggaatccttttttaatgctaagtcatactcaaataggccttaggctcagttaagtcaatgaggaataataataataattccatagactttaactgataaacaacattatttattgctgaaatattaagtggcactattattgtggttgcttgggcaaattacgtgcaatagtacattaacttgcacaataataacttaatctttatttcgctttgtatcaccattgggcagagacaaaatgaaggaatcaataaatgaaattacttgtaattcaaaatcaagtcaccgttgggcagaaatgatttagggaataaacattaatgtcttaaatcacatcaccattgggcaaaaatgatgaagttaataatttaaaatcctaaatcaaatcacgtaaggtagaaatgatataggaatgatgcccttagtgatgccatagaattaaaattaaaattcttagccatatcaccgttgggcagaaatggtaaaggaattaagcttactgacagattagatcctcgataacatcaccgtaaggtagaagtgataaaaggaattaatgcactaatggcataaataaaattctaagtcatatcaccattaaggccaaaattacagagaatatttaaaatagtgattgacaatacttagatttcttcccttaattacatcaccattgggcagaaaataattaaggaaataacaatcttaatgaaatcatctttctttctagataaacttcccgttggttccatttatcttgaaataatttactcagtattgcaagtgatcttaaataataagaattggtgattgcatataattagtttaccatggcttaatcaatcatatgcaaaataaacttagaatttcatagtcaaagcaccattggtcataaataattatgaataatcttaaaattaattccttaattatatcaccatttggtagaaaataactaaggaataaaaaattataattgtcatgcaattataataatgtgggttaaatataacttcaaatcttaatactttctagtcaaatttctcgttggttccatt

SEQ ID NO: 28188 - DNA, 229 bp, Oryza sativa
gtgcgcgttgtcggtgagcggctcgaggcgaaggggaggagaggagattcggccggatttggatggatgccttcttttcttccttggatgcttctccctcttgaaatgacggtattgccctccccctcctcgtcgttggtgggggcccaccggcttgaattaggcgcacacccccagctggctccccaactttgacacgtctctctgccgcgggatccgaattaaagaa

SEQ ID NO: 28189 - DNA, 1501 bp, Oryza sativa; identical to SEQ ID NO: 27322

SEQ ID NO: 28190 - DNA, 1501 bp, Oryza sativa
tttatttattccttattgtgcttctgtagcttttagttttctctctagatagcagtaccaaagaaatgttttactttttcatggattttacatttgttttttccgttgtcatgttaccctgcaggatagtgtgtatcggcctaatgccttatgctatgcattttttgccgaaagtgtttcctgctatatcaattagaggaaagtgggcagttgggttaagcttattctgttttctccaacaatcattttcctctcattagacctgaaacagatttgtttgttgtttgtatggcagtgtcatgaaacttttatcaacttcggttgtctagaactcattgcatgcaggactagtataaatggagctgcacatacaatttcattgtacatgctgcttaaactttcctgctaaaccagttttgggaaaaatgggcagttgagttcggccaatttatctatggtttcctcaacaatcatttttcccacatgttatcaatgttgatgttgagtcttcgcttgcttttctattcctagcttgtatcttctaaacagcaggatttttgtatcggcagcatgattcaatatgtgctttgctaccgagctgtttaattctggattgtaacttgtaagctgtacaattctttgtttataccaccccaggccacgtttccttcgccctggttgtccttgtcattaggttttgcatcaaagtcgtcttcccgtgcattagtagtgtactgttcagctaacatgatgcgaatatcactaatcacttcataggggttgtcacttatcagtggactccgggcatgcgtgcttgtgtttttgcttctctcatctctcacgaggtactggcttataatggcttctcgtttagtactacaaatttttagttctgtcgttgcagatgagtgattggtaccatgtgtcgtttcattttcaatatccaatgtaaagatggattcaaatatgaatgtgagcctttgcaattataataccctggctagcacgcctgatttcgcacttgagtttgatattgattgttgaatacgagtgttagcatcagcatttaggggacgtgtccttggtcgaactcgaatatcagtgattgccaattcgtagctactgactaatgttattataggtaggtacgtaatctaaacaataaaaattgatgaatgtaaaaccattacccttgtattctttttgatccaaaaacgaagatcaaagcactagaaaattcaagttgataacaaaatctaatgtaaaaccattgcccttgtattctaagtgatcgaaaaacgaagataaaaaacactagaaaaccaaaagttactgataaaatctaccggcatagctatgttctgaatctttggatacagtgccgtatactggagaacatcattatgcatttatgcggtatttcgttcgacatctctgcactgcaaacggctacggtacctaaatggagcaagaaagcaaactcttaacacaggacgcagta

SEQ ID NO: 28191 - DNA, 1501 bp, Oryza sativa
ttttttacaactttaataatattgaatggatgcttggtttactgctaattttttccacattagtaaaagttctattctaacaattttaggcgttgttcagcagtggtttttgcagcagcagtagctgcggcacgtgtttgcggctgcgacgcataactatggctagtagctatagctgcagccgcaaccgaacaagattttagtggtgccataacttgataaggttttagtactactaatattttttaccaaacataatacaaaggtagaagctcatataaagacatgcaagctcatccgtgttgcaaatatttaaaaaaatggcttcaaaccaaaattataaagaagctcctcatgaaaaatgtgttttcttacatatttgtatccctttggatataagttctttatataaaagtaggaaactaaaatgcaaacagaaagatgtagtaggaaatataaaagtatgctacttgcaccgtacaactctatttttaaaccactaaaaagttccattgtctttaaatagagttgttgccgttgtttctaaatagttgtcagcatagttgtgcatgtgtgttattcattctcaatacacgttgactttttaatagggacaagtgtacttatagattgaaactttataatactttaatataatttgtcatgaattatacgctaatcatgatttgttataacatataaaaatggaaactaacagtcaaaattaacattttgacacaagacaatcacttcctaagaatcaacaatgaaattacaatatgaacttggacatcgaaatacaattgaagttaatttactttgtaaagagacaatgttagcctctcaataaaaaccgatcgaaaaccacgaaatctcgatatttcgatgtgtgacaaaaacatattccaactaaaatctttttaaatgattttcagccattaaaatttaataaaaatagtaaaaatcgattaaaacttaggagaaaaaaaactatcacaccgcttgaatccagattcggctctgatatgcatggccctgttcttttctccaacaaaagttagattaacttttggatactcgtggcacgcttttcaaaccgttaaacggtgtgtttcgtgcgaaaactttctatatgaaagttgttataaaatatcaaattaatctattttttaagtttataataattaaaactcaattaatcatatgttattacagcctcattttgcatgaaacacttaattttcatcttcatcttcagaagattcaaacaccaataataatagtttttccttattgtacaagctgaccacgaactccaactcgaaccggacagtttttcctttttaaaaaaaagctcgaacctgaccacatcttggaccaaactcaaacccgaccccggccccgacgagtcggaactcgaagcatctcgcctcgccgccgccgccgccgcacgcccgacggaagcgagcgcctctctctctctctctcaccggcgacggga

SEQ ID NO: 28192 - DNA, 247 bp, Oryza sativa
tctccgtccataaagagaagaaaagtccagtttggaaaggaaagggtacatgtggtatccccttaagatataaaaggaggaccatgcccacaaagagagggggctggattttcccgagagaagagagggctggttgattttttgtaacttgctcttacacagatccaccaaaaacacaggagtagggtattacgctttccagcggcccgaacctgtatacatcgtccgtgtctcgcgtttcttcctg

SEQ ID NO: 28193 - DNA, 1501 bp, Oryza sativa
tcccctctctctctccctcggattcgtccggattcactcccgcaaagttcgccggcgcatcaatggcggccgagatttccgcggccgattccttcccctccggccgctctctccctctcccggcgctatataatcgtcccccgtgcttcgctcttccgtttccgccactcgccgcctctcctccccgtcggaatcgagcccgcgccgtcgcaccttctctccgccgtcgccgccgaactccggttcaccgccgtcgtcgccccggacctcctcccgcttcggcatcgcccccttcggcttcgccgcgtcctcgccgaccccgtccgctcctccgtttcgcccgccgaccgccggaacgccgccgtcctcgtcgacccgagccgcgccgccgccttcctccgctccggtcgtcgtttccgccgtcctcgtcgtcccggggtgagccgtggaccgctcctttcgcttcccccttccctcctctctctcgggtgccgctccgccgcgtcggtggtcgccggcggtgaccatcggggcgcgggcgcgccgcctcccgtcggccgtgccggcgaggccgccttcgggcgcgccccgcggctgccaggtggggcccggccgtcagccgcccgcgcccgcaggtgcggctgacgcgtgggacccacggcgccggccggcgtctgccgcgtgcgcccggtccaccgtggaccgagaggctgacgcgtgggccccactcccatggacccggtccgcgcgcccctcccctcggctgacgcaataaatccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccggtgtttgggaaagcgagcaaggcaagtcacatcatccttgagcatattgaatcccagtttataaaattattttgatttaaattaatgcattaccgctttatttcaattcccgcgttatcactgttttatttagccatgcctatttacctttgttaagacattattattgctattgttattattaccttgttcaccctagaataaacaaaaccccaactagtgggtactctattcctggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtctgggtgcatgccagttgtgggaagtagcaccccgg

SEQ ID NO: 28194 - DNA, 207 bp, Oryza sativa
ggctgatatacacctccatgaagttcaaaattgacagttcccaggatatccatgggagtgtcgaacgtgctgatggcgaagagcctcgaccaattcagaatggccctgtgcctacaaattccacccagacagtatgaattacatggtcatgctgaccgtgctctggaaatataaaaccaaaatggctcatctcttatttattgtagg

SEQ ID NO: 28195 - DNA, 1501 bp, Oryza sativa
atttcacctcctcttcttggaattggctgggagccctcacaattggagggggcttcaaatgacgcttcaccttcataggtggagggctacgggattctgctgccccctccttttccgatgccatcaaaggccgtagtaaactcttaccatacccactgccgggagttctcactccttggatgcggaatcgctcctccttcggagtagacggagtagcggtgggtgtggtatacttgtggagcatctcatctccttccttggtgaacagggtgcccacatagcgctcggcgagaggtggcgcggccttcccgtcatcttggaaaagccgtcgtgccttcaacaagccgagttctcccgttgtcggccgtcgcgtaggtgaatccccccagatttttgtccttgtgacatggcgaggggagagggatcacgctgccgaacggggctgagaagggttcggccgaaccagggagctcgtcgatcggctccaaaattgcaggggagcctggcacagctgcaaggggttgagcccatacagcgtttaccccttccatcgtgtattcttccaccgggatcaattgatttgccggtgtcgcctctccggtgaggtcgtacgtggaattggatgaagagccgatgaatgtaatcaaggatttgccagccattggtgggtatgagtgggaattcgaggaattgggttggattggagaggagagtatgcaaaggtggagagaaagaggaagaagaagtgttctagcgagatccgagcgttctacctccaaatgcgcatctaaacaaactaggaacgagcgggggagagcgaagttcaaaaatggggctgatcgggcgcctccctggctcggccgaaccagcaccttggtgggtccgattgagctccatttttttcctaggcctaataagtcctaaactaagcacaaaaatgacaacttaccgggttttaagcatgcaatagatgagatcatcatggttcataatcaactaatttaacaacatccacttcttcatctaaagtttcatttggctcaaggaaagtctttaagcgttgaccgtttaccttaaatatgttaccgaagtcatcgcggagtgtgattgccccgtgcgaagaggtgtcgatgacgtcgaatggtccttcccatttgctgcgcagttttccgtggccgaagagtttaaccctggagttgaacatcagtactttgtctcctggcttgaatttcttgatttttatccttttgttatgtaacgtcccgccttcccccaagccgggcccacttacatctgatagctttcataggtcatagactgccctcacagaccaacacatgtcttttctgcacattttgtcctcactcgtgtgcacccgggaaattcttcccggtcggtcacccatcccaaattgctccaggccaagcacacttaaccctggagttctttggagattggcttccggaaaagaagttgcaacttgttgatatgagtattctat

SEQ ID NO: 28196 - DNA, 300 bp, Oryza sativa
ataaaaacacatggacacaaagaggggaacaacaaacactgggtggagggagaggatcaaaaagctacctattaggaactatgcttactacctgggtgatgacataatctatacaccaatgccctgtgacatgcagtttacctaagtaacaaacctgaacttgcacccggaacctaaaataaaaaataaataaaaggggatgcataagggtgagagaagatgtgacgaccaaagcagaagtcgcagtaatatgggatcacaagctgaggaatgtgacacctctggaagctgaaaagacaa

SEQ ID NO: 28197 - DNA, 958 bp, Oryza sativa
tatgtactggtttttatcatgaaccgttacttataggcatcatatatgtgttggttcttaataaaaactatacttataggcatcatatatgtgttgattcttaataaaaactagtacttatgagctcatagatgttggttacaactaaaatcggcaccaataatgacacaatattttctatctaacattttcatataaagttggatgaagataaactttatatcaaatttgtagttgacgagacatataactttgtaggtgatgaattttttatttaatgtttttctgatgtccgaaaatgtgttataatgtttcagatctatttacataagtgaatatttaaaatttctaaatgatctcggatggagacaaaacatatatgaacgttgtaggtatagatgacgtctacaattttgtagtcgctaaaattttcagttgagcattataaatttggataacaataatcacaaaacaatagcatggtaagaatctttagaagcatgtctatgaatatgggttgcaaaaatcatgtgatatgtgggaagcgaagtgtgacgttatagggaagtaataaaaataccaaatattttttcatgtttttttagcacctataaaaataaaaaagggtgcacctctatgggtttttctgcagtagtgagtatagactaagtttagatctatttgtttagtaatttacatcttcatgatctatcttatcaatttaatatttctttttttttgtcagtacaagtctaacgcacacacaacacaatcgtgcaaacgctcacatatctaccaggaggactcgttttgtgaaaattttaaaaattttatatagctatctagattgcatgtatgcaactaggtgtgtgtatatgcactttggtgaaaagaatacattctgcaagcaccaaatcctatagacacagctagcatatgaatcatacgattcaacaga

SEQ ID NO: 28198 - DNA, 209 bp, Oryza sativa
taagtgtcatctgtcatttcatccccgatgaacattacttattacttcacttggtttcatcattccatattacaggaaaaagttatatgtttctatagaaaagtcaaacaacaagcaatggcccatacaacgccccctcctgttgtcacatgctgtagggttctgttggcatgtgttttattcaactgactattgcctacttgtacagg

SEQ ID NO: 28199 - DNA, 1501 bp, Oryza sativa
ggaaaatgtcagcacctaaatcacttcttcaccgtttaagcaatcatctatacaaagtacacgttatgcaattaaacaccaaaatatgcgtaaaatctaaaatgctctaaaatggatgatttgtgcacagtgaataggtactggtctaaaatgaatttaggtggaagaatttctatttcatctttttttatttgggagttatgaattttacaagtttcatcggtatagtataggatttatttaggtactattgtgaaatgctgttgtaaggtgatttttattaagtttatgtttgctgagtgaacatatgtgttttctaagactaacacatttggtttcacaatttttggagttaatatgaattctttatgcattttacaagttataacgtgttacgggtgtatagtgttatataggttcatggctttagaggtttaggtccagaacttgcctcatctagctagtgatgtataaaatgagtattttagttaactaatctaatcttagttcataattttagagtttatattattttactacacattttataattagggatgttctatgttagttacttaacacaccaacctagaaattgttatatgagttaagtttgataagttttggtggaaggggatggaactatgcattcactggtctaacaagttttatttgggtttcattatagctagagtgtatttctatatacatttatatatatacatattgctcaatcaatactatgtgattagtacctatcctataaatttaaagtttagagctataacctgtacagaaggttccatattttattttaatatgttgaagcccactgtttgctggttctatagatatttggttcacttcatttagactaaagatgaattttctacaaattttacaatttaaggttgctctatgttggttattacttacataagtatttagaggcttttatcatacagtaagtatataattttattttataatttggaagtatatgttttggtgattctacagaacttgggtttactcaaaaaggatctaagatgaattttatatgaacttctaaagttcagcttatataaaactagttatttttaaagataatagttttagaggcatttgatgcagaatgtgtagatgttttattttactttgtttttagagaaaatgttggtggatctgtagaaactaagtttgctctgaaatgagttgaaatgaattttgtatgcattttataattttgtgcatgctttatgtgtgatttaatttggataaatttgagaggctaaatttgtactgtgagtgcaagttttgttccataacatcaaagttcccaatttggtgagttcacagaaatttgaatcatcttaaaatgagctatatttaattttatatggattttacaagttttagttactgttcttttataatttcagattttgttcctaggtgtgcattgtcagtcccaggccaatatgcaaaaagacccctagag

SEQ ID NO: 28200 - DNA, 1501 bp, Oryza sativa
gctgttgtccttcgacttatgtgctcccatttggttttcccgtaatttggctagcgtggccattgttggaaggtgtgttacgtgtactaagtcgtaccaagtatgggtaacctgtttccgtaggtacatttgtacttctatgagtcttttttggataaatgaatgggggtgactaacaaagccgaagctttgtagagataaagagggggtcatggccccctccagctttacaataatcataataagggccttttaacttttactattttagtattaaccaaatagcaaaataatccctgctttcgaaagtttttttttttcacattggcctcctcaagtatatatttcttggatggatacctagagctatgtatcgatcctcaccaccaacgtatgtcgtatgggcagataaatcatacatatatggcatctgttgttgcagacacatctagtttcttcctgacccatcgtttttgcatccttcatacagtttgacggtagactaaactaactgcacccctagctagctaaccctcttgtagctagttatctcttgtttaatttgagtagccaattgaagggggcctaaattaaaacccaactagggtatcatcataggaaaagtccaatttgaccctctcaaatgtaggtaagatataatttgtatccatcaactgcaaagctgggtatatcgactcctccaactactaaaaggcaaaacaactccctcgactgttttgaggcagttttcgctaatgtggcatccactatgggctgggtgtttgttttttccagtttaatcgggtcggtttcatattggttttatgaaagatcggtttccgtagaatgacaaccaaagaaagtacgaataaaacaaaaaccgagtaaaaaagaccaaacaaaattggtttgtttttttggatacggtttttaccaactaaacccacccatcgatcaaacatcctctcaacgcacatcacttgaagcaaggcatggtaccacagcatgcaaatgcatggagcatagccgaggaatgctatgggctccaccgcccaagctcacaagaatgaaacactatactcacattcgaaaatcgtgtgaaatgaggaggaggccaattcgcttgaaccactcctgcatccgacaacttcagtttcgttggagagctcagttcacagcagatgaagaccgaagaaaccaccgaacaccagaactagaacaaaacaaaaaccacatcaccagccgaactctaaaaaaaccgatgttttggtttggtgatcgattttgaggtttttgcccacccctacgtcgacatggcagcccagtcatcagacaaattaaacaatagatatggggcccatatgtaagtcactatcttatcttctttctccactccccactcccctctctctctccacgaccatgagcagcatcaaagttcttttgccactcactcctcactccctagtctcttcttttactacagccagagagacaacaa

SEQ ID NO: 28201 - DNA, 600 bp, Oryza sativa
caattttcccggtcgcgacaagttggtataaaagccatctcgactgtaggataagccaagtggataaaacttaaggacatatgttataaataaaactatttgcgaaagttcctttttttcctccccctaatgctatttgcaaaaggtttactcccttcttccttcttcggatttcaactagtactagatggtcagttttgcgaagaagaagatgtcgtcagttgtttgccgaagctccggaagactgcaggatccgctagcaaagtgtaggaagcagtgaagccagccgtgaagctgaagctaagatcttggagaaccagtcgcagaacctaagccgccctatagggtagtgttgttagtcgtgtgtttcttgcttgtgtgtgtagcgcgtggtttgcatcggtgggaggtgatgtaaccatgctaggttgtttgcttaatcaacctgcagaataagcgaaacaaacaacacatcaacaaaaagagttagttcctttaaggtcttgtccctagttctggtctattctttccttgtatgcttcccctctcaacctctaccttgtgacagatggataacattggtaacaaaggctacgggaa

SEQ ID NO: 28202 - DNA, 211 bp, Oryza sativa
tgattatattctgatgaaaaaaaaatatgtttcagtttattaatactcaatgtttcatacgtgatagcaacatgtttcgacgtgtgtctttactgtgtttcagaaaaaaaaaaagttaatgtttcagtgactaaattttttcaccgtgtataacttaatgtttcactggtggtcaactacaacattttgaccgaccgattttttttacaga

SEQ ID NO: 28203 - DNA, 1501 bp, Oryza sativa
ccgagaaaatccttttttgactccatcttgtttcgtccactgcagcgacgggaacgcgacctcgtctacggagctctggagcgcgctccaagcgccgccgcagccgacatcgtcgccgttccgaccgctgtagaccgatccaagccgagccgtcacgccaacgccttctccttgaagtcctcctcaaaacccctcaataatcccaggcaacggcgcagcaagtgcggagatcggccaccgtcttcttcacctccggttgccatcgccattgtcgtttccgcctcctccggtgagccattgttggattactcgcgcacaaaccatccctgtgacctcacaaccctcgtgcacgccttcctttagcagctcgtcgtcccgttcgagccgtcgccgttcacccgcagaaggacgccgtcgccgggaggatgcgcgagccgttgctgtcaccaagaccccggaaaacatcaacctaacccgcggtgagtaccctagagcctggaagaccacatgcatgcatccctttgagtacatccagtctatagcacgacatgcaccaccacccgaaaacttcctctgctcggactcgccgctggcgctactccgatgtctgctgtctgagaaatgtataggaatggaatcgcaatatcatgcccttcattttctattttggtcgcaaccccaacggagtcaccgtttgtcgccgacaccggcgagcagagatgccgcccatggctgctctgctgcttatcgaatggaaaaggagacagggacctcgcttggagaatttaaacaactataaggttcattatgtaatgttttcactcaatgacatatgggcctaggactgcgggtttatttactgaaactctaggggtctttttgcatattggcctgggactgacaatgcacacctaggaacaaaatctgaaattataaaagaacagtaactaaaacttgtaaaatccatataaaattaaatatagctcattttaagatgattcaaatttctgtgaactcaccaaattgggaactttgatgttatggaacaaaacttgcactcacagtacaaatttagcctctcaaatttatccaaattaaatcacacataaagcatgcacaaaattataaaatgcatacaaaattcatttcaactcatttcagagcaaacttagtttctacagatccaccaacattttctctaaaaacaaagtaaaataaaacatctacacattctgcatcaaatgcctctaaaactattatctttaaaaataactagttttatataagctgaactttagaagttcatataaaattcatcttagatcctttttgagtaaacccaagttctgtagaatcaccaaaacatatacttccaaattataaaataaaattatatacttactgtatgataaaagcctctaaatacttatgtaagtaataaccaacatagagcaaccttaaattgtaaaatttgtagaaaattcatctttagtctaaatga

SEQ ID NO: 28204 - DNA, 1280 bp, Oryza sativa
aatgacattcgaaattaaatgcacatttaaaataaaagaagaatttaaatattttatcaacatgctcaaagggattgtttgggacatgtgtgacatgccttacaataatcaattaaacaatatataaaaaggatggaaactacaagctaacatgcaaaacgagaaaaaagactaataaaaaccaaataaacaatacataaaaagtaaacaaacatttagagctttattttagatgaattatgaactgcctcatttcgacttcatatgaattagtaatgaattttacaagatttaattcaactaaagcctatttaaaaggattaaatagatttattacataatttataattattttaaagaagaaaaagataaattatgatgtcatcagcaatcagtccaccgtagagtaggtccacagagattgaccacatgttcactgagatggacaaccgagattgatcttgaccaagagttaaccaagagttaaccaagatctgacggctcaaaccgattcaatctagggtttagatggaaccacgtggcaacatgttgacgtgaaatttgtcgcacacgaaggcctgagagatccacatagctcgtcgtatcaatcgggtgtagggcgtggcggttagtttgatcgtacaattaagaagatagatagatggattgtataagatcaaagagccgatcagccaataggctgatgtgatgtagcaaggctagccgatgtatataaggttttcatcaatcgtcaataaaccattcctaatcaaagataatcttgatagatcagacctaattaatcgagacggtatgatattgaagttgataaagagatatttaactattgattatacaagtttgagtataagacgatacaacacttagaagtagtaacaagataactaattggctagaactctaataaaatgttgcataaaaacttatcggcttagtagaatataattacatattagcacaatctaataaatcaaacctaaacgagacagtataagattgaagatgataaaaaatgggataattgcttatttgaccctgttttgaagcctaacttctaatctgactatgtttttcttagtttgcttatttgacttttttaaattgaacactccgtctgaccctctttccactacatcattagggtttcttctagaaaaagaaaaaaaatctatttactatttaaactgaccaaaataccatcaaggcacttcaaccctatccatcccaccttgtctctctcatctcttacaagcggcaca

SEQ ID NO: 28205 - DNA, 492 bp, Oryza sativa
ctgcgctgagcgcggagagagagacatgggctcaattcgacccagaactttggaggggtttctaatttattttatatttaaataaccattgaattgatgtttgtattgttaaaattagtaattgagctctgaaaaatccgaaaaaattctagagagtgtaaactaatcatggagaatataataaaaattaaatccagcaatgttttatttaggaaactttatttcccactttaattcattttcttaattaatgtacactttaatataaattctagaagtattttattaaataatttataaattcctgaaacaaaatcagggtgtggcactactaaagagtcttgtactaataatttatagatcaagggtttgcacaaaatataaattcaatcccatggttctttctgtgaacaccaacaaatgcttgtcaggtattcatcattatttttgtgttggctaattgttctagtttatttttgtgatcttttcagg

SEQ ID NO: 28206 - DNA, 433 bp, Oryza sativa
atatatatatatatatatatatatatatatatatatatatgattattcacaattttaatataagattagccgcgatttaatatgagattagtagcgatttaatataagattgttatacttatcatacatatatgattattacaattttaatatgagattagtagcgatttaatataagattgttagacttagcatatatgattattacaattttaatataaaattattagagattaaatataagattgttagagatttaatataagattgttagacttagcatatatatatatgattattacaattttaatatgagattagtagccatttaatataagaatattagagatttaatataagattagcagagttttaatattacggtacgcaaatacatcctatatacctaacaaattttttttgtatgcataga

SEQ ID NO: 28207 - DNA, 1501 bp, Oryza sativa
atatctgctattttaagtatgttttccggaagggaaatactaatttcagaagaatggataccaaaaattattgatatttgatataagttctctggaaacaacatcaaactctttatatttagtaaagttttatcaaggagtatttgatagttaaactgaaaggcgtaacctttggatttacctagattttaattgatttcacttaaatttcctaacaaagtgagacaaagatgatggctagctatgcacggttgggctccaatccacgtgtgtatatcgggaatatctccattctcccatctacttagggcccctttgaattggaggattgtcataggaattttagaggatttaatttcctaaggattttttcctatgaaaccctttgattcataggaaagtataggaaattttccttaggattgcattcctatagctcaatttcataggaaaataagcaagaggttcaacctcttggaaactatcctttgctttgtttgtttcctatggtgctatcaaagggaccctcttcatatttcctgtgttttccattcctgtaggattaggaaaacatgctacttcaattcctacgtttttcctattcctgtgtttttcctattctgcgtttcaaagggacccttaagttttatgatgatatactactactcgtgggataaaggcaaaaagagcatacttttctagagtttggaacaacaagacaacaaataaagcatctgcacttctctttcattaacaagataagcacaccttttagctatcgaaatccctatgccgttgtaggctaaagaagctttcgcaaaaaaatgacgactttttagccagaagctttctaacaacgactagtaataacaagcacaaataagcaatcaatccagcacaaataacagctggattagcatcaaccaaaccacagccacagcacctcacctcacctcacctcacaggtattccatcaaacacgtggtgagcaagcaaacgcgtgtagcaaatcaagaacccaaggaggagcaaccggagcgcgcgcgcgagcacacacacagaggagacggcagctgatgagtagcgggatcgggcgctctctttccgccctctttatagccgtcgtccgcactccgcagccaagcagccccccctgcagcgcgccaccaccactccctcgcctctcccgcgcccgcgcccgcgcgcgcgccagtaaaaagagaaaagacactggcgaaacgggcggtgtatgtggagcaggttggccgcgtctccgcgacgccgccaagcttttggttggttcgacctcgagctggattcccttttagggctcaggaggaggaagaacgcggcggcggcggcggcctctccgccggtgagcaattgattgcggggaagaaaggggatcgggccacctaactcagcttttgcacagagcccatctcattgcaggctcttagaggtggccaaacgggccgggccaaacgggcggcccggggca

SEQ ID NO: 28208 - DNA, 1219 bp, Oryza sativa
ttctttgttaggcttgcttcggagttgtagttagacatcgcaagatgcatcctttcgaggaagtcaatgcatcccctgttgttagctgaccactgtatatcgaatgcactgtgagttgtgttttaggccgtggagtgggtggaaatttgacttccccattgcaggatttggtaacttgaagctaaattccgtgtgaatttgtgacggtatcaagcgattgtgtctctgataagattctgaatgtgtgaacttgctgcgatatgttctgatttactagtggtttagcttttcaatcgttattctgattaagacaagggacttcttctgtgcatatggattggcaatttggactcgagaacaatccactaaaagttgtgtaggttatctctttatgatctgcatgtaataaatgtaaacctgagactgatgtaggctacctcttattcgagaaaaagaaaaagaggctgatgtaagctacctaatgtgcattttgtgcttattcctcttgatcaggttgtttctatataagaattttctgtctgtctacttagggtaggatgctgtgtgttatttgtagtggtactctttttaggttgatttatttgtttttttattcagttatttcctactcttgcaacaagcacttaacaacctactctgcctactctgttcctactgaacagtaccactattaagtattaccttattatgatattaaggtaatatcataatttatttgcttttatggttcagaatctcatgattcagttatttcctactgtctctattcagtattacaacatctattgtcgttttttttagataattcaacacctgaaagtaactatgcataatcatattccagttaatgagtagaaacctttaataggcatcttttgatagaaaggattagagctaatcctttgatgggcaacaaaatccccaccaatctgaagaggtcaggttaaaagccctatcagttcaatttgcttaagttaatgttatcaacttgtcttgaaggctaattatagaagtacacgaagaaaaatggtgcctggaccaaagtgagaccatctcataatgctaatgcttttgcgacaaatggaagatcatcgagcccatactacgcccaactatgtaagtagtagttattgatggtgcaacctgggaattgctggctttgctactcccatgagtaacacatttaccagctagactc

SEQ ID NO: 28209 - DNA, 619 bp, Oryza sativa
aacaaaaggcaggtttacccagtccaaagtgaaaatattgcttaaagggtggtccaaagtgaaacatcggtaacaaaaggtagcccgaagagaagtttactcattatattttaatagtattttcgttttgggttgaaaaggttgctaagtttctctataaatttggtaaaaatttaaataatattaaattttaaaaataaaatgtttcataatatgaaatgaagggaatatagaaaaagaggggacagtttatctgttagagtgctctctcctcattggttgtcatgagcgctaatcatccttgttagcactaacacacagcaaaataagcatggcatttagctgtccccgggtccattttccatttttaagaaaaaaaaagggaaattccatgggtcctgactagagagactatagagtcctgcgtgcatcgatctagggagtaaacgaacaacaatgtttcaaacgattctgtcgataaaattttgtcacatctacctaacacaagatatataaaaaaaatcacatacaaaatggtttgcaatggagcaattaataatgattttgttgtaaatgtatatgttatcaacatgtatgttatatcgtttgttaattaaca

SEQ ID NO: 28210 - DNA, 1501 bp, Oryza sativa
accacattagccttgccgggatgatagtgtattcccatatcataatctttaattagctccaaccatcttcgctgtcggggattcagatcaggttgggtgaagatgtactttagacttttgtgatctgtatatacctcacaacggttactgatgagatagtgccgccaaatctttaaagcatgaacgactgcggccaattccagatcgtgcgtcgggtagttgccttcatggggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacaacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgataacctgatcgcaggtctatcttagagaacacagtagctcctttcagctgatcgaacagatcatcaatccttggcaaagggtacttgttcttaatagtgacctcattgagtgcgcggtagtcaacgcacatcctcttggttttgtctttcttctccacaaagataaccggagcaccccaaggcgacgtgctcggacggatgtatcccttctgtaactgttcatcgacttgcttcttgacttccgccaactcgctggctcccattctgtaaggcctcttgtggatcggtgcagttccagttaccaagtctatccggaactcgatatccctttttggtggcattgttgtcagatcgtccggaaaaacctctggatactctctgactataggaatatcctctagtttcttagtggttttctccactgctacctcttgttcttcaccagcagcctggtttaaactaatccctggcttctgcggcactggagactggaagattaccacctctccttttgcattggtcaacttgatggtgcggctggcgcaatcaatcactcctctgtgccttgccaacc

SEQ ID NO: 28211 - DNA, 1501 bp, Oryza sativa
catatttccacatttgagcctgtaatatttgaactttggcaactccatattgctgcagtttggcgttcaaaaatctctattgtgagaagaggatgcacgagttaattagttttaaaattagtaacatactcatacgcattacaatacaatacaatagatccatataataattagaatggattgtacctgaacgcgttctataacttaggaatgaggatatattaagagtatgaatacatggtggcacgatgtggtactctgatttggcaaacaaaagcgccatcaaaggtgaaattatttatgtggttggccgaaaaaggacgctgcctcacggcggataatctaagtaagcgtggttagtcgcactaacatgtttgccaactttgctgggtgggtgatgaagattgtgagcacctatttgtgtcttgcatctacatgaccaggatgtggagaatgatcaagagctagattggggttggcttcctgctgccatctgagtcatgcttagacctaggagaatggtggttagcaatgtggcaaaattttcagaacagctacaaggacgccattgacagccttatactgcttgtttgttggatggtttggaaggaaagaaatacgcgtgtgtattttagaatcagcagcgctcggcaggtttcctgtttggttcaattaaagaggaagtggcgatttgaaaggaagttgtggtttttagaaatataggagagcaatcccttagtgtaatctgttttcttttgggaggttgctcttgtgacaacttctatttacttcgacagtttattgttgaagtcaaaactttatatatttgtttatattcctcagtcttaagtaaatcaggttggcctatcttgaccggcccggcaatatcaaaagtatgaattgaaattcagctcctcgcggataggaggaggattgatatgcgaccgattttctgggtggtgggaggagaggaaggcggatgaatatgcaagtagtactacttgaaaaaaaaagtaaataacaactcaaaaatattttttttctgctattttatattggagtagtcctccccccaccatcgtagtttcctcgtgtaagaaaacaactccctaaaaatactaaaccaaagaaaatattattttcatgcaaaaataaaaaatatatattaaaaaactgaaccaattataattccattgctacacaatgtcatggtatctctactatcttaaaaattcgtcctcttttcatcccctcctctcaagtctcaacgtgcgcagcacgtccgtatacctaaaagtaatcactgtccatccttatcacatggacttctcccatcaatatacggatttcctgtctatcactaatcctatatacttatatagttcattcccactaaatgtagttaatgaaatttctctcttctctcattaatccacatcaccctaattatttttagcctttggatgatagatatatgattcaaattgtctcttctttattc

SEQ ID NO: 28212 - DNA, 1181 bp, Oryza sativa
agtggattataaaaggagttgcatcatcgccgtgcaggattgaggtggaagaagcagccaaaaacagtaatggcgcagccggaaaagacgagcgagagattttctttgtatgcggaatctcctgctagcttgatgtcaggaacgcgccaggaacgggcctattcgcgtctgtgcgcggcgcgacgcggcgcgcacacgccatgccggcatgccgtggcataccagttgcgcaggggtggattggtcttttagaaaattatctgacctcttttatctcggaaattataaaatattgcctccggtgtctcacagccaatttcacaacattcataatgtccgtgggcaaagccaatattttgcagtgtctcacagccaattacacgattttcgggtgtcctgtagcaattttgcctattaagtactgtattaatttttaaaaatatgctacttaaaattttatttttaaaatctagattcgtagttaggattgtattttttatagaatgaaagggacactttctttgatctagtattagaatatatctcataaaaccaaactctattatattgtctccgtcataaaataagtttatttttcactcatcctactcatccatacttgatcaaattccgatacaattatttccaactttcacagactttgatatgatataactttaaaagcaaacttattttgggacgaactaaaaatgagcttatcatgggatggagcgagtagtttaaaaatatttatttttaaaatttaaaattaaaaaaatactatatccgttttatattataaaactttctagcattgcccacattcttttatatatatatatatatatatatatatatagatttattgacatctatatgaatatagacattgataaaagtcttataacctgaaacggtgtaagtagtaatcaaataaaatttcgaggggaatagtagctcattataacaagctactactactactactggtacccccattggtagcacgcaagccactttctccgagatcgccgcgatgacgacgacgacgacgacgagcgccatcggctccctcctcgtgctcctgcttgtggtggtggtgggagggtgtgctccgcctccgtgggcggcggctgcggcggaggggaaggcgtggcgggcggagcaggagcgggaccggg

SEQ ID NO: 28213 - DNA, 1501 bp, Oryza sativa
tgcgaggaccgctacgctattgccgtagtcgtaccttgaccatcagaagttaaggcacgagagatcgctacgatttactggttcgagaactagtgagtagaattatctctcgaacaccaattgaagtgcggtgcatgagattgcgtaccttctactacgttcgagcagccatcggagtatacattatgctctcgcaacacctaatggcaagcttgctggctgcgatgagcatactgctaccttcttacgtggtctcgtagagctcagtcgcagtatgaacttattctgctcgatacatccatatggcaagcttgtcggtgccgaggagacattctacgcttttactggcttcgagcagctcagcgagtagcaattatactctctgaacaccaatggtaagttgcggtgcgagtagactgctacccttttacgtggttcgaagagccatcggagtagcaattatactctcgaactaccaattggaagttgcggtgcgtatgagactgctaccttttactggttcgagaaccatcgagtagaattatctctcgaacaccaatggaagtgccaaagttggtttattacatgtgcatctcatatggccagcatgactcacatacccaacttgtagcatatccggatgtccgtccgcaatcatatcgggtgatcaagccgacatcattagcgagcaattatccgttaacaaccattttctcaaacagcccagccatagccggtgctatgagataggtcgccggtcttggttggtaggttgggcgcgacgactctgcatttgtcgagatcgttctcgataatggggtgtactcgaccacaacttactcgagtgctcaattgttcctgaaaaatatttttctagaaggcaaagcatatagcagagaatatcgagtatgtactcaaaagactgcatggatcttctagtattatcagggtataacgagcggatgtaaatatcaggcattacgtaaaccgtaagaaagcatgattcatacagaagagaacagagcgagcccccagcgttagaccgtagttggcctaacatcggaagcactcgcacaatagatattatataaaaaacatgctctaggtaaacataataaatcattaatctgacaatgctatatgatctgaattggtacgataaattgcatataaaatattgcgtacctttgtagatacatgccagatgtatctacgaaattagtagatcaatttaaaaaatcaatctaccaattaccttgttgcgtactcgttcgatatcatgtgatctgacatcttttggtacaccgcggagcttgaggctcgaatgatctcgatagatcaagttgttgacgacgatggttccgatcttgtcggaggatatattccggtcgggtttgatctccccacagccgaagtcgtcgagtagcttgttgttggagaatccatctcttaaacccatctcgtcaaaatcctgaagcaccaaaagtcccctacctggcgc

SEQ ID NO: 28214 - DNA, 1431 bp, Oryza sativa
ccgattccttcccctccggccgctctctccccctcccgacggtatataatcgctccccgagcctctctgctccgtttccgccgctcgccgctttctctccccgtcggaatcaagcccgcgctgtcgtcctctctctccgccgtcgccgccgagctccggttcgccgccgtcgtcgccccggacctcctcccgtctcggcgtcacctccttcggcttcgccgcgtcctcgtcgacctcgtccactcctccgtttcgcccgccgaccgtcggagcaccgccgtcctcgtcaacccgagccgcgccgccgcctctcgccgcttcggtcgccgtttccgtcaccgccgtcgacccggggtgagccaaggaccgccgtttcacttcccccttccctcccctctctcggccgccgctccgtcgcgccggaggtcgccgccggcgaccatcggggcgcgggcgcgccgcctcccgtcggccgtgccggcaaggccgccttcgggcgcgtcccgcggctgccaggtggggcccggccgtcagccgcccgcgcccgcgggtgcggctgacgcgtgggacccacgacgccggccggcgtcagccgcgtgcgcccggtccaccatggaccgagaggctgacgcgtgggccccactcccgtggacccggtccgcgcgccctctccctcggctgacgcaataaatccgatttttaattaaaatttaaatgaagaaattcgcaaatatccatttaaagagcatataaacttcaaatggccataacttggccatttgaactcggaattggaccgttcaagtctctaatttttccttatgaagccaagaacccatttttatgctttgtttctgctgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatccccgtttgtaaaattatgttgatttaaattattgcattatcgctttatttaaattcccgcgttatcactgttttatttagccatgcctatttacctttgttatgaccttattattattgttattattattattaccttgttcaccctagaataaacaaaacctcaactagtggacactctactcatggcaccactagtttagttttaggtagatgcttcgcaatttaattaggtaacattaggtggtttttcaactatagactttgggaaatattcttatcacctggacactatggaatggtttggttattgtggaattggcttcacaccgctccttctattcaaaatccccaaaatggttttaggctgggctcggggtgcatggttttgatagtagcacctcggccatataaggaccggt

SEQ ID NO: 28215 - DNA, 1264 bp, Oryza sativa
aagatagagccgtgcctgtgcatttgctgcttgtttgtgacaacacgtactagtgataaaccagcttagtgtaaaatatcataattttatggcctattccctctgtccaaaaatataacaacgtttagttatgaatctgaccgaaatatttatactttgggacagatgtactccctccgtcccaaaaaaaaaaagacaaaccctgggtttccgtgtccaacgtttgaccgcccgtcttatttaaaaaaattatgaaaaaaattaaaaagacaagtcacgtataaagtattaatcatgtttattatctaacaacaataaaaatactaattataaaaaaaattcggacagtcaaacgttggacattagtagtattcgcctagttgatttcttttttgtgagaactgcctagttgatactcctacttgatactgagtggctctgttgcaagtagaaaccaaaacatgccgtgaacattaggcaaacaaaaagccatggacacatctggtttggatgagaccaggacaatcgacgaaagaagagatggaatggaatttaagggaggattgtactgagaagttaggaatatgacaggtgaaaattgtaccttagctctcttctttaccactgaaatgagacagagcttcttcagcctttgtttcaggaaaacaaaaaaagattgtgcctagcatccaaagcggaaagaaggagaggagagctccgtttttgtatttaggtgtgtcaccgtttggaaatttgaagtttgatgctggcagtggcagctacgggtcgtcgtgatctcgatctcacatcttgtcctgtggatgtgaatctgcttaactatgacgtataacctccgtcctaaaatgaaaaatattacggagtaccatctaaaattggatatgatatatgatactaccacctagagtagaactagatatgatattacctaaatctagatatgagcatattcagattcgtagttataggtaatatcacatctaattacaggtagtaataccaattataggtagtactccattcgtcccagaatataagagattttaatattttgcttgcaatgtttgaccactcgtcttattcaatttttttaaaaattattatttattttatttgtgacttactttattatctacagtactttactttaagcacaacttttcgggttttatatttgaaaaaaaatttgaataagacgagtgatcaaacgttgcaaacaaaaactcaagatctcttatattgtggg

SEQ ID NO: 28216 - DNA, 1501 bp, Oryza sativa
gaccgtctcataggtggagaattttaccaacgtgatggagccaatgtcctcaatcgttaattctaaagtaaaacaaacataaatttagttaatgtgctaaagaagtggttttgagtagtctaaagtaaaacaaacataaatttagttaatgtgctaaagaagtggttttgagtagtctaaagtaaaacaaacataaatttagctaatccaaagtgaaaagtttggattaaggatggtccaaagtgaaaccgcggcaacaaaagttggtctaaagtgcaattcactcgttatactatttatggtcaagtttctttcacatatatttgctagcttggtactggtagtatttgggctcaagacctttagaagaaaagccataaaacttatgcgagcactgaagatgtatttttgatatttcattcctttgttttcatctgtgtcgattctctagattggcaagtaaatttatagggtgcacaagatcgaggagagatggtgatatatttttatactgattaagaccttggaagagataacaccctacttcagttgtttgtagattagatctgtatcaaagtgtgcgcaacacggtgtgtgaatagcacgtaacacgtgtatgatcaccctaattgtttccggcctaccgttatatagacataaggaggccggctacggtaggtagcgtaccccatataatccgggtacctaccacctatttatatcggataagatttatattcttatctttgatcccttttactccctctgttttgtattgtaagacttttacatctatatgaatatgaacaatgcttgaaagtcttacattatgaaacggaggaagtattggattacaatgtgccatatgggcttagacttcttagcccaccttatgtaatatagcccaaaggcctaacctcggctactcgggtaccgtgtcccctacaatctgcaatccacattacgtttgtttgttgacgaaactatattgcaagactgccacgtctttggtttttaatcatcaaaatattgtaccatttttttctctaatacgtacataacctgatacagtgaaagagtgattccaaagtcatatatatgacaaatttgcaacacattacgtctgtttgttgacgaaactatgttgcaagactgccacgtcttgggtttttaatcatcaaacgatcgtactactatttttttctctaatacgtacatagcctgatacagtgaacgagtgaatccaaagtcatatatatggcaaatttgcaacaagttgccaaaatgtctgaagatgttttaccagttaaaaaacttcattgactttttctacaacaatttttcatcccagatagaataccaacagatattaataaataatggaacacatttcattactaaaaccatttgatcccataaccaccgtagtaagtatttagctgccaattaattgatataatcaagtatttactcttatgagaaaaaaaacaaacaacaatct

SEQ ID NO: 28217 - DNA, 715 bp, Oryza sativa
aagccgaggcggcccaggaggaggggagggagagaagatgggccgggaaggagaggagggagggcgggcccagaaggaggaggagaggagggagtgggctgcccgggaggggaagagaggcccgggagagagagggagagaaggggagggagagaaagagagggaggagagaaggacttttgggctgggcttggcccaaaggaggaaggagggttatttttagattttctttttaataaactttgttaattgttgttgttgtttaataattatttccggcgctctgaaaattcaagtaaaatttgagggctcgttttagaccaaggagaatttaacaaaaattctccgggccacattcgaatttttcttgtacgtattttagtgtttgccaatttcttttcgaattttaattaattctattattccttttagcgaatgaattttatttcgggatgaatttatcaggacgtgacacaacccaggccaactattccacattttagttgataagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagc

SEQ ID NO: 28218 - DNA, 1359 bp, Oryza sativa
ggggagagcgacgccgagtccgacgccgccacggccgcgtacgccgggaacctggagacgctcatcgccaatgtcagggaggatcttgggatgcctcaactgccattcatccaggtgatgatattcatcatatctcggttgcctacttgatttgactctcaaatttagagaattaactggacgcgatgagccaacgataattttgttcaagaaatgtatttggggatttcttggccgtgtcatgtttcttgactgcgttgacctaaatgagaggcaatgcaaaaggaaaataatcaaaacactcccaatatttttagtagaagtggtttccccatagttgtacagtttagtaggcgaactccgataacacaaagaatgaattcaggatattgatggtgaattactttattttagtcatattcaatattcaattggtgttgccggtgctcaagttatcgtattcgtgtactatctttgcggctatggtaattataattgagcaaatatgcagggaaagcattattctcagccttgcaataatgtccctaatgtctatgtatcatgtatgaggtaaccgaccgctatattctgtcaccactttcaaaaggtgctaccatctgcaagagtaccatattgtttctttagaataactttagtcacaaacgaatctttataaagtaaagttggttgcaacatttttccatctgtaatactaaaaaatctttaaagttgaactttacctgttcccctcttgagttcatcggtacatttgtgttttgttgatttatactagagttgtactaaaatgtactaaccaattgttttcgtgcttttgctgtactactatatgttactctaaatataagtcatcttagtcttgtgcgtgaatttaggaagtgacttatatggccttgttaccgttcagttattacttattacactttggagaggatacctcatttattcgtaacagtgataacattcagtcattcaaaacataagagaaaaaaaaaaggttggacgattatacatgtgcctagatgttgctttaagggatgtataaagttgaagttaatagtttcgatttaatacatcatcaggccctcttttacatcccccagtacaagataactgattggttttaactagtaaactaatatgttttattttgcatggctctgtaatctttcttttgaaccttgaattttctttattcagttagcaatataagatggctggtttcactctttctacacacacgatgccatcttatgtgtcaaccaaccttaccctttatttgtactcgatatcatttgtaatatggggtatcatttatatcaagatttgtttgcattaaac

SEQ ID NO: 28219 - DNA, 642 bp, Oryza sativa
ttcgaatgtggcccggagaatttttgttaaattctccttggtctaaaaggagccctcaaattttacttgaattttcagagcgccggaaatatttattaagcaacaaaaacaattatcaaagtttaataaaacgaaaacctaaaaataaccctctccttccctttgggccaagtctggcccaaggttcctctcttctcttggcccgcggccaaagtctccctctcctccctctctttccctcctctcccgggcctctcctcctcctcccggcccactcttcccctccccctctcggcccactccctcctccaccctctccctcccgggctgcctctccctcctatcctcctgggccgcctcggcttcgcccggcccaagccgagccgcgcctccctcccgtgccgcgcacgtgcgcgtgcgtgcgcgccgttgccgcgcgttgaccgcgcgcctcccgcgtgggtcccgcctgtcaggcgcgtccccggcctccagccgccggcctccttcctctctctcccgtgaaccctagcgccgttcctcctccaaatccgctccattcaagccggctctttccaaattgattggggggaattaatccccattgattcctctttgatttcccccgtttttccccttgaa

SEQ ID NO: 28220 - DNA, 1501 bp, Oryza sativa
attggggttccacctctagggggtggccctgaacagctgaccatagccgtcgtcttcaaagaccaaagctcacaaacagaggatttgaatcagctgaaactggcattcaacactgctctgaagaaacttaaccctcttttcaaggttcttataccatccctgtgaatcatctcattgataactactgtaccctacatcttttacatggcacactgcgataacatcactaagcacctgtttcctcccatcatctctgcaggtttcttcagttgtggtagtcccttcgctccctagaacagcctcaaacaaggtcatgaggagagtcctccgcaaggagttcacccagcagccaaagcactccaaaatctaggtagttacaaaaaagcaaaattggttctattgcatcatacgtacacccaaaaggaaaaaacttcggcacagcaaactgtgaatacacatgtctggttaaaaatcactaaatcagttgtatagcaaggcttttgttctctccggtgtgaaatgagatgatagatcaggtcatgatgaggtactgaaagtgttattgctacattttcctgtcatatgtttttcgctatgtgaataaagtctttgtgggacttcagtgaaattcaggtggcctatagtgtattccagtgaaattcctaagctctattccctccgtcccataaaagatcaacctagtactaaatatttttgagagggaaacactgtaggggaagccccacggttaatatattaaacaaaacaaaaggttcaaattacaacaagttaatccacaattttagagagtctctcaaataaattaagcctataaactaagagggagatatcagtcttaagagctctccaagaggcaactgaaggggctagattattaaagattaaaccattcccattcctttgcttctaaatattccaagcagtatagagcaccttctcaacatagtgtgaagacatataagaattcttggcagcaaacaactaagggaaagatcccaaaccacaccaaattgagcccaacattcagagctaaataggcactgaaagaaaatatgcagggttgtttctcactcctgtagcacacaaaacacatcaaggaagcattttgaggagaacagtgccttctgtccagcatatcatgagtgtttaagcgatctattaaaagaagccaaccaaaaactttgaccttggaaacacacttgctctttcagattcaattgatataagctggcacctgaatctacgaaaaatttgtagcttacttctgagaagagaaaattccattaccccaagcatataagtccagctatccttctcatcattaagttgatctataggatcagaagttgacattatcatatattcctgagaggcttgctcagacaaaggcaagacaaaaagttctgaaagatcctttaaggagaacatatgaactgaaatcttgacattcctggaaaaagagtgaatcctaggaaataca

SEQ ID NO: 28221 - DNA, 406 bp, Oryza sativa
ctcctttggatgggtatggacgtttaaacagtattaactcttccaacccattaagacatttactttcccatttgtttgtgttttaattcctttcatcaatgactcacccagttcccagtgtccacatgttgcacttcttttgttaaatctattcccaaggatttaatgatttttgatgccattgtaaatagtatggttttctaaatttcattttagcatagttcgtgctcctatcggcatttacagcaggttgtatgagtgttgactctggctatttaatctggcgcagagcatgctgatagtgtctgtgaccggtccggggtgtgtgaccggtcacagaccggtcagatcgcgggttaggtggcaacaggctgcctgtcacacgcctcgccccgtcccgtcggaa

SEQ ID NO: 28222 - DNA, 801 bp, Oryza sativa
atatacggatccggtatatcgtccagtataaggagaggactcatttaagataaggaaatcaatgagttcttatggaaatattccttaagagcgggaattattagaatactactcgaaggggatagggattgtgtcataccatacagggtctgttgtctccaagttctacttagagaccaaggtgatttgcggtataaatacatacccccggggaggtacggggcatcgaatcttagcgcaagacacccgccaccacataagtaatccggaggacttgaagcctattcgccgatagatctcatcgagcccttctcgacaaggatctcgtcagtaatctcgtagttcggttgttctcttttataatatgtggtttcttctataatcccatataaactgaattagggctattaccttacgaggggcctaaaccagtataatccttatctttttgtgtgcttgatatcgtatcgtgtagatccttataccaacgtaccccaataccatcaaaatacggtccgcgggtatccccgtcaacaatatgtatacgaatgttttcagttttacatattgaaatactattttatttgtcagtgcaagatattaggtattatgtactaagaacgacaaatcagttaggccctatgcatagcatttcagatttcgattagaaatagcgggaaatattatatcacatgggggcacaatcttcccaaatggccagtgggttataggccacgtgagaaacacattattgcaggctggcacatgtgataattgatcttccttgggatcacgttaaga

SEQ ID NO: 28223 - DNA, 663 bp, Oryza sativa
  unsure (1)..(663): unsure at all n locations
tttagggatttttctttttataaaccccttttaactttgtttatttcttctcaattattatttgtgctctgaaaatttcactanaatttatttacgcattttaggcttttaggaaatacacaaaaatcctccaagccttatttgacttttatatttgcacattttaattgttggaggctttcacacgaattttaattattctcggcacaatttcgaggatgtattttagagtcgttttaggacgcgacagggtcccagctcgtcccaagccaacccaggccaaccattccacattttagttgttaagcaggttttaagaatttaaaacactaacttgggtacattgctaggcttgcccataaccgagggcgcggctattcgaataggttatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccaacctacggccggaacctccgggacaggtaggcaggattgagcccctagcagcaggacactagccctgtgccatgacatctcgactaccgggccgcagctcgtgtagccttcatttgtcctaga

SEQ ID NO: 28224 - DNA, 1501 bp, Oryza sativa
atgatcatcggtgatgcacccaaaccgccgtacctctgcagtgacaacggtaaatggtcgagagcaccaactgatccccagggccaggtcgagcgctgcttcccggagcgaggcccatcgatccactcgcctccggtttggattctcccttgagttgagatcgacgacaggtttggttttcgatcggcaaacgttgcgcgatatatcaacaaggtcaagttaattagttccatgccttgatctagctacattgtgtcgtttgcttcttgttgctgatgagttcaatggtgttgtcatgttgaaactgttgctgattagtactagctagcgtttgtttgtggtgtaaccatgtaagcagtaagatgaacaggattcatttagtgcaggaatgctacagatgatacttgctgtttgttcagtaccattcttcattgcgtttcagtgcattcagctacactctgtcctgttcaattcgcaattccgtttcaagattatgtttccgattactccagtagatagactgaatggcctgcatttgtttgtggtgtaagttagtgatgaagcaggaatgctgcaaaatgataccacctgctgttggttcagtgctattatttcttcatgtgatgtgggtgtgactcggtgcattcaactacactttactctcttcaacttgcatttcagttcaagcttctttaaattgtactgaatttttaatctgcatctcaactctgtggaatattatagatgcgacaatctgtgatacctgcagattgtactgcttctttatgataactacttgctggcattatgatcatattacactgctaataatctacactactgaaattagcttgtactatacattatttagtcctgtaacatgtgcccaatgaagcaaagtgtgtgtgaagaggttgaaatctcaagattaatgcagttattataccatgttattgaccttgttccgcttccacggttgctgtatattgtacttcagagactgattaattagtcttcacttcaacggttagatgaaaaaaagactacaggtttccttttccaacaaaaatcactagcaacaaaccatcaataatcatcgatgtgttaaaactgttaatcgattgctgcacacaatttgctaccttagcaagatgttagcatgagagagagaatcgtgtcctctgctccgtttaaattaagtgaacttgcatagttacatgcagtgccgtcctttgacgtcttgcccatccccgtcgccagcgctttctagttagcgtgtttggtcgtcgcacggttatcacgagaataggcttaagtccttgttttcagcgctttctagttagcgtgtttggtcgtcgcacggttatcacgagaataggcttaagtccttgttttcccttttttttctcctcgctccccccattccctccctctcttctttgtttgccgtttgtgtaaattttattcctcttaaggccatgtacaacgcgtgaccctagcc

SEQ ID NO: 28225 - DNA, 1501 bp, Oryza sativa
gtttcggtctcggcggagaccactcccagcggcgcgtccgctcgccaccgcgacagccactacatcgctgccacaacctcaactctccaccgacaccgccacctccacctccacctccacctccacctccgtgtagcagtagcggagaaccaaccaaacacacggcggagggagaggtgggattaagaagcgaacagagaggggacgtgtcgggatctcgggaaaagatggagaggactaagtaggaagaagagcggacggcgacccccgctcggatcgccggcggcggcggcggcggcggcggcggccaggtcagcgaaagagaagagaacgagaagaacggcgaggaggcacgccggcggcggggggtggcggctagggctagccgttgctttgatctgggccgttcgtcgtagaactcgtagatcggacggcacgaaacagtcgcacaaccacagatcagccgtccagtattttcaaataaacttcctttcacttcataaaacttttaaccaactcaacaaaaatttgccaaatatgaaagcaacacaacatgaagaccagctcaaagatggacccacatataattaacttttgtgtagctcttttatccatcggctattacttatttttattcataatcataatgatgaatataatggcaaatatgcaagggttttaggtaacttataccctacctatcaactaaagtttctgaaaaactaatatgtgtaaagagaaaaatagtctttcaaaacggttagtagttgcctgtgatttgattgaaaatacacgaattaaaagaactagacatttttactttaaaatattcagatcggtccagttctatcagcagtcaccaacttctagcttctaggcccttgcttttttgcttctagcttctagcttctcggttttcgttcgtatgcttttcaacccgttagacggtgcattttgtgaaagatagtataaaatatcatataaatcaatttttttcaagtttaaaataattaaaactcaattaatcattgtctaatcactttttttgtttagtgcacgtactttaatcttaatccaacgcacgtttgaattggtcctaaattaccgcaggtttttctaacccatggtcacaaatatttgccactcttagaatggtgtttaacgatttgccactagacctacatatcatagacatatgagggcccacatgtcatagatagtgagtggcaaatcgttaattgccatatcacaagagtggtaaatagttaaatttccctacatctaaacgggttgtaagaattttattagggcagcttagtagaaagaattttatccactcaaaacgggttgatttgttggacgtgtaaaaaaaattgcatggtacacggttgattttaaaaaaagttaaaaactctcagaagggttaaaaccatttgtaatttctagtaggttctagccagagagttacccgtgcctatataaaccagagagttacccgtgc

SEQ ID NO: 28226 - DNA, 383 bp, Oryza sativa
ggacggagggagtatcatcatagctgatattaaatttgatcctactgcaacatatcatcaaaatagtcttttaaaggttattttgttcactaattagcagatgatttaatgtatctttttcaatggaatagatgagtaattatatcataataacatctctggttacttgccacttagttatcagcatattcactgtgtggtagctacactctaaaaatgggaacatctctgtttgtcatcagatgaatccacaggatattatttacgtttactggtttaggtatggcttaatgtagacaatgtctcatatttagcatgatttcataaaatattgttgcatcacatgaaaattcaggatgaaatgactaggaactactttacag

SEQ ID NO: 28227 - DNA, 1501 bp, Oryza sativa
gccccaagccccttgagatcattcacaatgacattgagcctcccatacatgtcattcacactctcatgaggcaacatggagaatgtctcatattggatcttgaggaaatgaagcttggcatccttgtactcacttgtgccctcatggatctccgccaacttgttccaaatctcatatgtggtctcaaggtttctcactctatcaaactcctcttggctcaaagagttgaacaaagcattcatggcttgggtattgagttggaggttgcggtgatcaatctccgtcaagggcgtgccggtgatagcaaagcctacatccacaatactccaaatatggaagctcatagctttgaggtgagtagacattttaattttccaaatagaatagtttgtgccattaaacatgagagccttccctacatggttcacctcgttcgacatcttctctctaggcggtgaagcccaatcaagagagaccaagctctgataccacttgtaggatcgagatgtcgactagagggggggtgaataggcgatttaaaactaaaacacaactaatcaaaactaacctaaggtgctaaggttggtgagggtcaactctaactaagcaactaagttatgttttgcaaacctagggtgatagtggttcaattatatctctaggaaagtaaatcacactcctatgtcaatgtttagcaatcctagggtgatatgatctcaagtatgtctctagaaatgtaaattgcacaaatataaatgtgacaatcaaatgagacaaggagacaagagatttttccccgaggtttggaaactcgccagtttcctactccctgttgaggcgagcccaactccaccgctcaaccacgaagccgccgcacgcccccttcgtcaaggggtgggtaaggcgggagccggcccacggagaggactacccaagcctcaatcactagggtagttcttccttcactccgaaggtggtgaactccaaaccactcacaaaccggcgccgggcctcctccacaatcttctcggagaggtcaccgggcaactcctccacaagccgtctaggaggtggcaacctccaatagtaacaagcaatgacccggcgtggagatgatcaatcaagtgccacactagctctacaaatgaaagcaatgcacttgactcttggctaatcaaccttctaacacactagatggatgaacacaaaactcaagtaggtgtgagagaggtgcaaaggatgtatgcaattgaattgggtgccaagagagtccccttgctgctggtgggggagtatttatactcccacccaccaaaactagccattgggggcgaaatcccaaatcattgtgctctgtcggtctgaccggaggtatgtggccggtcagaccgtgctactctgcaacggctagaaaactagccattgaagagctgtcagagggccccatcggcctggccggtcagaccggcattgagtgggcggtcagaccggccacggctcg

SEQ ID NO: 28228 - DNA, 1501 bp, Oryza sativa; identical to SEQ ID NO: 27321

SEQ ID NO: 28229 - DNA, 171 bp, Oryza sativa
cccacaccgcttatcgacaaaaacaaacggcttcgcttctgccacgtcgctctccccgatgcgttcttatccccacgattcatcccactgcatcccccgcgccctcctctcctcttcgtcttcctcctcgcttcgcttcgactgcttcgatcgaggagatcgaggttgcga

SEQ ID NO: 28230 - DNA, 1501 bp, Oryza sativa
ccatgtcaaattgttgggcttcgcgcctgcatcagattggtttctagcccaaaccctcaagagttctggcgaatttgttcaacaattttgttcagtcaattttgctccatcccatttcccattgctgctctgaatcttacctcttttggcacactgaatttcttgctcaacattagagatgtctcatacactgcccctattttttaagataaagaaagctttatcgatatcagacgattacaagatgatataataattactctaatatcactcctaacttctaacttctgtatggttaggatgcgaacaacttataattattagaaaatcaaaagaagaccgatataacttaaaaaatcatgccatcctcccccgaatagttcaggtgattgtgaccaagacggacttggtgttcttctctggcgactgctccttgccggttcatgcatgatgatggcccgttaattagtcagtcgatcaacagccgatctaccagttgaccagctgtcagagcaggaacaacaataaaacatcggaattgctaaaaatatgtcgccagtttttttgggctgattttagtcggtgtcgctagccgtacgattgctccgtgagttttcgatggtcgttggatgttttcacgcacggcggcattgcagcaagccctaatcttctttattgattagcgttgaacgttgcactgataccttctcttatacaagttacaccacacttacacaccacttacatatgtaattagtatgtaattttagtatttacatatgtaattttaggacttacatatgtaattctatgtaattctaggacttacattgtaaatacactaaaattacatatgtaatttagggacttacaatgtaaatacatgccgactattttttggtgaaaaatatggcgccataaatatagttactccctaaaacattatcaaacaaagtttaatttgtagtcgcaaactcgactgctaaatcctacaccttctccatcatctctagcaccttcgtcaatgaagtcggagttgctctcgctctctattaaattattcactgtatcttttttttgaactcaattattcactgtatcttaattttggtatagagggagaaacccgtacgactgccactcgatcgagatttgacggcttggattgatagggctcaacgctcactggcctttggatctcaatcggacggttcaaattaagttcagttgacccattgctgggggatatttgtgttatagccctctcatgatgtagaaatgccttaaagatctctaatcttttgaacgataaataatgctgcgatagtggtgaacagtacactgaagtacagtacttcccttggactatctcatcaaaacataattcactcaaaactatcaataactttaaatataaaaaatctagaaaacaactcatatggatttgtctttcaaaattctataataaaagtaaacatgtatttatttattgtatatattg

SEQ ID NO: 28231 - DNA, 1501 bp, Oryza sativa
tccatggacagtgtcacgttttttcggtgtctcctagctaattacacattttttgcgtgtcctgtagcaaattttgcctttattataaccttcaagctatcttttttctgggctaaaatataataaatctgaggttaagactttaaacagaaatataatgctattgaaacatgtactccttttctctaagtttttttttggtgaattttgttctgtgcataatgtgtatacgaaaaatttatgtgcacagaatacgctccctaacgaaataggtagagaagtattaaaaaatgttagtgtgtaaataccacggtgcatacagctatctctctgcattttgttgtactccttccattcagtgaaacatgtactggcattaggttgtactccttctctctatttacctttttagtaataaagtacatgtacccaaaaaagttcaaaaatgttagtgtgcaaataacacattattcattatctgaaagggaagtttcatcttcccaatattctcataaaatcttcaaatcgttaattccttgtctgttgtttcacagggaaacagtgctcactccatcacccaataatctcttttcgatacttgagtgggtgcaagctaccaatcggaagtttctccttagtttaatcaagtagaaccaatcatcacccagaattatgcctgtgtaaaatcaaaggtatttttgattattattctgtgatgaacaaatgggtattggagattattggttttgttatttggaatttattcacgaagtggttttggagattattggatttcacaggtgaatatacaggtactgctggatttgggtccggttagaccgggcatgggttgccggtcagaccggcgtgtaatgcgcggtcagaccggcgcagcccgcggtctgaccggccgacactgtgttggtttcggtttcgggttgtttatttggatatccgagtttttttcatgattatgacttctaaatggatgctatatgtatgtaatactattgtttgctgctaatgagttaagttggagatagcttggtctcggaatatggtttctttgtttgttccatgtgtaggcgactcgatgtctcgggagagtatttgcggtgatggaccgggagtcggcttggggataagacgacgtccgttgtggtcagagatcatgcgggatacttaggctagagttgatgcacgtggttgatggagattccatatggcatacgatggagttattgtgtgcgtataggatgcggagtcgaatttggaaggagtccaaatttggtacgtttggttatgtaaagtttctttcttgtactagagggttttctaaggtgtttaggactcctagtatgagtttggttcgtggctttaggctgcctacctcatgtataaatagagggggagcgtgaggcttcccggtatcgctttagagagcaatagagttgagttttgagttagggtttcgagtttagtcgaaatttttgtaaagatt

SEQ ID NO: 28232 - DNA, 287 bp, Oryza sativa
atagatcataaattaagttaatggtaaataatataatttagtaaactttattttcaaacatattagagctatttttagttatttatgattataatgtgatatatgacactataacatatgttttcatgtttttttttgtctgtgagatataacgcaattggtcaaatcgatatgaactgatttaattctaaagaatataattgtggtcgaataaaaaaaattgtatatataatttaaaaattacaatagtttatttattatttatatactacatttatctcaaataa

SEQ ID NO: 28233 - DNA, 804 bp, Oryza sativa
ctctcctcgtcatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgtatcgacttccaccagatggtacaccgtgggatggtcgagaacaacttgaagatcctggagctgcgtcaggagaacctgcagctcaagaaggacctagacgcggtggaggtgcagctgcatcagctcaagatcgcccagggagaggtctgccgccccaagcgtcgccgtgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggaggatgcgctgttgctcaccttccgtcctggcccgtcgcagcggtagacgagcagttagtaggcttgcgcgtgtgttctttcttgtttgtcttttgtttgagtcgtgtggggcatggtcatgccggtgtgtggcataactgtgtcggagcctgtcttattttatttgcctaagcaacttgaactttaatgaacccatttaatagcagtaataaattcaagaattatggtagtcgtgggtggttagttttaattgttagctctttctctgtttgctggttctgtgtggggttttcaga

SEQ ID NO: 28234 - DNA, 598 bp, Oryza sativa
tatcctgtgggacgaagggagtagctcataaaaatttcaaatacttacataaaagtagttggtactctgctccggtctttcctcgattcacacgcgagtgaaacagcagccaagaaaagtgctcatggtaggagccacgcataccagcgcgagcacaaggggccgatgtcacggcgtcgtcatcaccgtgcgatccagaagctcaagacatccaaatcaggcgatccactcaggcgaggaggcccacaagtaaattccctcatagtgagtggacccggtgatgtttgccgggccacgggtcagagagtgagatctaatagctcattgctatataagatcggcagggtcgagagaaaagggacatgaaagaaattgtacaaactattccccaatatttcaaactctcctctgcttccttctccttcttcttcctctagctctgctcttcttcttcctcacgaaacttctatccgctgacttcttcgctacttgagtaaatcgaatcggagagaagtgagttcgtgacaatttggtattagagcactcatcctggagaaaccacgctacacctctaggttgcagctgcatgtggaggcca

SEQ ID NO: 28235 - DNA, 464 bp, Oryza sativa
acttaggctcatgcataaatggattgctatgaccttgttttctagaggtgatcatagatccattaggggggatgaattgattatcatgtttgccatggttagaaaaaacaacattgctcctatgaaatgtatgataagacaatggttagagaatataaagttctctgctcttgttgactgcacttctctgattactcggatagcaaaagggctagggatcattagcgaccaaattgcttttatcttagcttctcgtccgtgtattgatgagacttatctagtgcaaggtcatattctgaaacatggagtagatggatctttgatatactttttctccggttgtacaaatgaaatcccgttgccaaatgcggggtatcatttgtacaactgccgtgaactaaccattcccctgcaaaccatagaagaatctcgtgcaggtggagcatacagggagatgcgcaaca

SEQ ID NO: 28236 - DNA, 1501 bp, Oryza sativa
aacagcagcggactagcgggcctacggctccatcttcacaggcgctcaactggggtataagccaggactccacctaagacttcttctccaaagcttctcttactgaagaggggaaagattgagcaagaatgagtacaaccacagtactcagcaagccacaccggggatgcacaattaatgcaaaggagtacaaggggataataatatagaggttaagttttgcagtaaacagcatttaaaagccacttagttgcccaaagccattttgtaaagacgatcctagagctacacagtattattaatcaaggccgtgaaccctcacgaacctgccttaacccaaggcctacgatgattcggaccgaactggcaacccgaccctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaatcccacctacggccgggatacccgggacaggcaggcagaactgagcccctagcagcagggcaccaaccctctgccatacgacatctcgactaccgggccgcagctcgtgtagccttcatttgccctggagaatgtccatcgacacccgacttcatccatctccaatccgtgtccttttgttcaggactagactgagcaccgagttaagccttacccattagacatgtggttagtacggtagtgctttgcaacagaggcccgagcttaatccttatagtggccggggtgctacttcccataactggcatgcacccaaaccccaccgaaaacaggctttaggggttttgaaagaggaagagaggtgtatgtccaattccaccataatccaacaattccatagtgtccaaatgatatgagaaattcccaaagtctaaagttataaaatctaactaatgttgtcctattaaattgcgaagcatctacctaaatttaaactagggataccacgagtagagtgtccactagttgaggttttgtttactctagggtgaacaaggtaataataacaatagcaataataaggtcataacaaaggtaaataggcatggctagataaaacagtgataacgcgggaatttaaataaagcggtaatgcaataatttaaatcaacataattttacaaactgggattcaatatgttcaaggatgatgtgacttgccttgctcagagagaacggccttccgaaccttcggcgacgaccacgaaccacgcttcgggaacctccggaacgacagaagctacgcgaagcacacaaacaaagctacaagcctataaagaagcaataacaa

SEQ ID NO: 28237 - DNA, 1501 bp, Oryza sativa; identical to SEQ ID NO: 28207

SEQ ID NO: 28238 - DNA, 1501 bp, Oryza sativa
gttcgtgttttcagaggaaatatcatcgtcttggttcagactgctgcctgagaaattgcaatattcagaaagtgccaattgttttacttgcactacctaaacttcgggtacacaaaactgaaagacataccgagattgatagggaagcttagcaatctgcaaatgctttatctcaatggttctgtactggagttgccaagtgaaaccacaatgttaactaagcttcaccacctactcgtagatgggcggtttgggatgtcagcaagtagcaaaataagtcaactgcaacatctacagtctctgagaagcatagaagccaacagctacatggttaaaaacattggatgcttgacagggatgagatcatgaaggtactggagtcccacaacacagatctatgggcctcaatcagacatctctgaattcattgtccgttttcgcagaagatcgcgatcgatatattcttgatctatggacaacttgaaacctctatctcacctggagaagctaatgataagtggcaggatacataggcatctgggcttcaaaaccattacaggtaaaaatcaacccagtcaaccttttctctcttccttcttaatgaaacagcagagctcctgcttcagtttcaaaaagaatagggtatgttcactttgttgggaaaaacatgccaaattttaataatatagaattaaggttgggtggtgtttggtttgatgtcttaacaaattttactaatttttaagagtgggtaatttcaaaattaacaaaatttggtatcttaccaaaaattaataatgtcaaaatttgatacatttgacgttttgtagcattgaatgtttggtttgaagccttgctaaattttgatggagttttttttataaaaaaataccatttttatagggtggtccgcaatcatatagtaggccttggcttaacgtgagagttttctacttccgtgtcctctttcggcaacttgttggtgttaaggaattcgataagcggtgttcactagtcctgagtggtctcgatgtctgtgacgattttgtcaatctaagtagtagccctcgagccaacgtcggtggtgctatcgatgtcgtcgtctggcgaactcttgacggatggactggttaatacttaatactctaggaacatgctggattccaccggctttctcctggaagctcgtcgggtgaggttgtcgacattggtgttgtctttgcgatagacatggcgcacttcgagctcgtaatccttggacaattagggattagagcctccgtaatccttatgcacttggttggcgactttctgagtcacctttcacaatcagtcattttaccctgagtgttgtggctgcttgtagtccagctaggagtccttcgtactcagtagtgttgttggttgctcgaaaatctaattggtctacatgtaaccaagaattttgtaaaattttcttactgaattctagaagagttgaattttccaaaaataaaaattt

SEQ ID NO: 28239 - DNA, 1501 bp, Oryza sativa
aaactctctcctctctcactccctctcttttttctacccaatcattactttacacgtgggttatatcttactatccacacattatagatggccaaaaggcccgaggcccgatggcccggcccacggcacgacattttggcccggccgccgggctttgcctgggcccctccaccggcatgttgggccggtcggccaggcccgacaaaaaaataatagggagcaaaaatagacatattatatgtcacagttcaaagaatagggacgaaaaatagacttatattagctatatatatgtcagcccaatgaggagggaggaaaaatagacttattttagctatatactagaaaatgagcgtgccagttggcacgctagctaagttagttaatagcatgtgtgtatttcccttcagaaatcatacatttgaaaaggattgttgaaagtccattcccttttatttttatgtttgtgaacaaactaagatagaatagtaaaaccatctagattagtggtattatcatgctgaacagactatataacatcgagaaatgactaaagatgatgtacattaataaaatacatgttttactaatatccaacacaattctcatatagatgtaagtcattgagttcgtattagtaggaaatacatatccgaaataaatgtgtcttcgattactattttttatactaatttcatttagaaataaaggacgatgacatggtaaagacacttattttgatttcatatatccagatatactactatgtagagctcagctggtcaggttctctacctatacgagttaagttctaaacttagcatagacgcttgtatttacggctatttgttttttcaatggtaggaaacccaccattcttcatcactcctaagatatgcctgatggcccagtcttcgaaggtgcttgtagtgattgggtttgtatgtgtgcgtttacaggtgtgtatacacacgtgtatatgaacatctatatctactgtgtttcgcgataaaaaaaatagcagtatgattgttgttacttaccaatgttccaaaataaatgaattcctagcataaaaaagtataatgtgaggagaaaaaaacaaaaatactctgaattaataggaaagtagttataaacttctcggttcacatggaaatttcacttctattccttccgttctataaaaattcaggtattttcctcgtttcaagtaaaccttatctgaagatttttaattttcctaacgcaatccttgctgtcactatttgttttcatttgatttaactatttatttattttattctcttgaaacacatgatattaacatgaagtgacttttcctcattccgagtaatctgtagtaaattgcatttgttaaaagattattatgcaaaggctaaaaatcctattatttttttctccttttctttttattcatattattttattctaaactggcttagtaatatgtacctgtatgtgctagcttcacgctgca

SEQ ID NO: 28240 - DNA, 1501 bp, Oryza sativa
gttgccgacgccgccgtcggtaagccgccgcccaccccccctcgcgcccatcgtcgtcgccgcccgggagagcaagaagccgagagagagagggagaaaggagccgggagggagagaagagaggaaaaaaaaaagaagaaagagaggagaaagggagagagaaaagaaaaggaaaggaaaagagagggagaaagaaaagagaaaaaggaaaaatttaagagatttagaatatttaaaaaaaatattagaatttgattataggattaatgagaatatcattggatgaactcctactatttaaatacctaaagtgctaggatttgattatagaattaattatttacgaattaaacaattagatgaatctttatagattgttatagattatttttagtaatatcaataggagatcagttcgcggtaataatttagatgtaattaagtaaaaataggaattatcataaattattatagattatttttgggtaatccctataagtaatcaattaacggtagaaattcggatttaattactagggattttagccgtatattatatttaatcatttagtcatagactaaattaaattgtatagcatttctaggatttcgtccaatatttagctcgtggtagaaatttctaacctattatatacaatgctcgcggaaactaaattattgacaacgaaataattatacccgcaaaatagtttaaatcgaaattgggtttgccgtagttcgcagatagtaaagttaataaaaaggaatcaactttcgcattcgactttcatttggatttatttggatttttatttgaattctaaccgaattcaaatcaatttttgcacgtaactatagagcccgagggagttgcggatccaagtgaaggccaagacccgcaagactttgagcaaggcaagtcatcactattccttgaacatgttgatcctaattgcaaaattgttttgtttacaaataaaattgcatacaatgatgaacatcctacttgtgattatgccatgccttgattattgctaacccttaaatctttgtaaccatgtttacgtatgagtccctagtcaactatgacaattgcttagaaatgctattctagaatcatgcatactcatatttatcaaatgctatatgcttggggcaattacctttgggaaggtaattgagatgcggcatgtggagacataagcgccacattgccattatgttgatgacatgatttgtgaaaggagaaataaaattaaacaattgttttcgactggggcggacggaggatttgggtggtatctgggaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacctctgagtgaggcaggtgcgctacgttgggacagccgttgaggtag

SEQ ID NO: 28241 - DNA, 300 bp, Oryza sativa
aaatacactgttgaaaacccaccatctcacttgatgaagcacatgtcaaagcgtgtagtcaaaccaaacaggaagtcatgtcacctttcatgtcaagcaatgctcaacggagaggctggaatctaggattgctgacgacctgtattcctatataatgtctatttctgacgatgcatcattagagtaagtatcattattcttccagaataattgagtatctcaccccactaaatctgacattcatttttatccatggtttatttcagaaaaacatggctgcagagctcccatcctttcaga

SEQ ID NO: 28242 - DNA, 1501 bp, Oryza sativa
atcccaccaatatgggtttttccatatggaaacactgtttttttaattgatgcagaagtttctacattgattttcttttaatttgaacaattatagtttggtcccctaaatgcatgactatattcattgactgttcgtaattatttttaacaattttcttccacatatattactcccccgtcgctaaatataaggaaattgagtattcaaaatttatccccaaatatatgtaacgtattgggaagtactacttatcctatcaatgatcacacccatttaattttcttttcatcttatctcagaccaccccctccttacattcattaggcatacggttttttttcctttatccttattttctaaaaactacttaaaatccctaaaatttagggacggagggagcaataaataaataagttaaaatttacatacctccaatccaataatgatgtaattaaccatcattcttgtgttaaactgaagggaacacatggaataatttatttgatttgtcatctgcaacgtaactggcattcaaaagagaactaggtactaactgacaaacatgtgcaagaagagatccccacctactgttctttggggcccaccacacatgcactgatcagattgacaagtacacacagtggctggataatgcagctagtggcacgtaatagaaagtcatagcgtaaattcaaaggtgtttttgattattattctgtgatgaataattggcattggagattattggttttgatatttggaatttattcaagaagtggttttggagatgattggatttcacaggtgaatctacaggtactgctgttatttcatgtgaccggtcagaccggcggtacgtgcgtggtcagaccggctagcccacggtctgaccggccgactctgtgtcggtttcggtttcgggttgtttgttcggatatacgtgattgtttcattgttacgacttctagatggatactatacgtatgtaatactgttgtttgctactaatgagtcaagttagagatagcttggtctcggaatatggtttctttgtttatttcatgtgtaggtgactcgatgcctcgggagagtatttgcggtgatggaccgggagtcggcttggggataagacgacgtccgtggtggtcagagatcatgcgggatatttatgctagagttgatgcacgtggttggtgaagattccatatggcatacgatataggtattgtgtgcgtatgggatgcggagtcgaatttggaaggagtccaaatttggtatgattggttatgtaaagtttgtttcttgtactataaggtttcctaaggtgtttagaatttctagtatgagtttggttcgtgactttaggctgcctacctcgggtataaatagagggggatcgtgaggcttcccggtatcgcttttgagagcaattgagttgagtttagagttagggtttcgagtttagtcgaaattttagtaaggagtgctgttggtgcac

SEQ ID NO: 28243 - DNA, 1501 bp, Oryza sativa
tgtaaaattatgttgatttaaattattgcattaccgctttatttaaattcccgcgttatcactgttttatctagccatgcctatttacctttgttatgaccttattattgctattgttattattaccttgttcaccctagagtaaacaaaacctcaactagtggacactctactcgtggtatccctagtttaaatttaggtagatgcttcgcaatttaataggacaacattagttagattttataactttagactttgggaatttctcatatcatttggacactatggaattgttggattatggtggaattggacatacacctctcttcctctttcaaaacccctaaagcctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggattggagatggatgaagtcgggtgtcgatggacattctccagggcaaatgaaggctacacgagctgcggcccggtagtcgagatgtcgtatggcagagggttggtgccctgctgctaggggctcagttctgcctgcctgtcccgggtatcccggccgtaggtgggattgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccagggtcgggttgccagttcggtccgaatcatcgtaggccttgggttaaggcaggttcgtgagggttcacggccttgattaataatactgtgtagctctaggatcgtctttacaaaatggctttgggcaactaagtggcttttaaatgctgtttactgcaaaacttaacctctatattattatccccttgtactcctttgcattaattgtgcatccccggtgtggcttgctgagtactgtggttgtactcattcttgctcaatctttcccctcttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaatg

SEQ ID NO: 28244 - DNA, 1501 bp, Oryza sativa
atgtggttcaattgatcatcttcgttcgcattgtcctaagcttgggagaggcaaaagagaagacaaagatggtgagaagaccaacgacaacaagtcgaagggtacatccaaagggaggaagatcaaggagaatctcaagaaggcttttgatcaagtctacgccgtgtttgagccactaagcgatgtggatggtgatagtggagatgaagctaagggaaagaacatctccggtgtttgcttcatagcgcgtggtgactaggattcagagtgtgagaacaatgaggtaagtgcttttgaggaagctattaatattttgagtgcaaaaaataagaagtgtgagaagatgtatagaaaataggaatttatcattgaatctctttattctgaaattgctagattaaaatctcttattcctaatgatgatgattgcaaaagttgtgaggttttaatgaatgagatttcaaaaatcttctcttggatttaataaatcttctcttgcttgtagttttgctttgcacacacgtacgcagggtgagttgtttttaactaaaaagttgttgcaaaaatatcaaattgcttttcatgctagtttgatgtttaacatgatttgtgctaaaaagttaaaacaatctcatgatgttttggattgctcaacatgtcatttgaataagatgaaattgaaagatgctttaggtcgtgttgagtacatggaagacgttgtgaaaaacaatgaagtactttcttgccccaaatgtcgtaaaagtaaaggtgtcttggtagattgtgaaaattgtgctaatttggaaaaagaggtttcttatttgaaaaattctttgctaagattttctgatggtaaacagaacctcaacatgattttagatcaatctaaggttagcacaaataatcgtggtttaggtattatgctcataattctagacatcctcctgttgtgttaggtgttggtgctagaagtggtgagattttggttaaacctgatactaacaaaactgtgtttaaatctgctggtatcatgtctactttgagtgcatcttcttcaaaatccaatgttgtgcatgcaaaacctcctgttgttgcttgtgttgctaagtcttctaattctaccaatgtgtctaatcatcgtgaaaaatatacttattctttttgtggcaaagatggacatattgttggtttttgtttcagattagctcataaacagaaaaaggagagagagattacttttgcaaaatcgaagtggtaaaaatctggttttccctcaaggaaaccagacagaccgcagtaggtcccgcggtcagaccggcgaccggtcagaccggctactgtgcctcggtcagaccggtggtgaagcggcggtcagaccggctgcacaccctcggtcagaccagcctcggagaaatttttctgaaaattctcaaactgtttttgcacgtggatatatgcctattggatctactggttgtgtgtctcagtactagataatttt

SEQ ID NO: 28245 - DNA, 195 bp, Oryza sativa
ttatttttcgcatgaaaaaataatatgatttttgcatacgagaccttaagtggtccgcctgcaagatatgataacactattaaattgtattaagttccacagtcgtgcctcaccctcgctccactcttctccttcacttctctccctctccctcactttttcctctccctcctctctccctctccctctaccaga

SEQ ID NO: 28246 - DNA, 1501 bp, Oryza sativa
aaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatcgaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtttggcctgttgggagcaaaccccaaattacgggataagcagtccggtcttttaattagaaaaactaatcggatccaccgagccaaacccgttatgatgagggagggagtacatatctgatcgatcagatgaacggtggatgggagagggagtacgtactccctaggagtatagaaccattttcctatatatatatatatatatatatatatgattgttatatttgtaatgcaattaagattattatatttgtaattagacttagtatataattattgactagctagggtcctataatatacgtcacctagacttagcatatatatcactatttgagttttagtataagattattagatttgtaattagacttagcatgtaagattgtgtagggttctaatatacgatagttacacttagcatacatggctatttttgtcttagcatataagattatttgagttttaatataagattattatatttgtaattagacttagtatataattattgactagctagggtcctataatatacgtcacctagacttagcatatatcatcactatttgagttttagtataagattattagatttgtaattagacttagcatgtaagattgtgtagggttctaatatatgacagttacacttagcatacatgactattttagtcttagcatataagattatttgagttttaatataagattattatatttgtaattagacttagtatataattattgactagctagggtcctataatatacgtcacctagtcttagcatatatcatcactatttgagttttagtataagattattagatttgtaattagacttagcttctaagattgtgtagggttctaatatacgacagttacacttagcatacatgactgttcgtttagtcttagcatataagattatttgagttttaatataagattgttaaaacataaatgtctcatgacttagcagatgtttcctgtatgaacaga

SEQ ID NO: 28247 - DNA, 198 bp, Oryza sativa
tgttattaaagtgtgctatatcttaaatacaagcatcggacttttgttcactttggtctaacatttgagagaaaacaatgttcaatattcaaatggaaagtaaatgttgtcagttatttagaaacgaagggagtatatgtattactggcattcatcttaataattaactcagtaactgtttcttacatctcttgtagt

SEQ ID NO: 28248 - DNA, 660 bp, Oryza sativa
catctttcgaaagatttttatgatcgtatcacacagatttttaatctttggattaaaatccgatagatataataaaaagcaaaaagcaattaagaaacaccataatggacactaaattaccatatcctcaagaaaaagaccaaatccaatacaaaatttaaaatttacatgcaaaaattcaaaaattacagtgtaacttacaaaagttacagtgtaagttttataaattacactgtaacttacaagaaaatgcactgtaaatttgagtgagaaaatcgagtgagagataagaaaaaatctttcgagtgagatatagcaaaatcgggcctgtctctttaattctgatggaaagtaaacaaaaaaaaatcgttgaccatttatccatgttgaatttttctgcagacctcacgagaagcaaggaccacagaatttgatcccgctgcattttttttttttctaattggagtgtcacgtatacgtaaaattaaagtcacattggattaaaaccggttgaaccgtgaacataccatgtagaccgaaactgctatcaatattatcgagggattagatattattggttttagaagtcgggggaagctatacacggtacctggtattctgggatcgagcagatgtgcaatataaactctgtacctgtca

SEQ ID NO: 28249 - DNA, 266 bp, Oryza sativa
acaggcctgcagtattgattaggttcgaggaaaaaaatattataatgtctcttattaaatgatttatggttagatatgagaggatgattggaagtaaaaaagaaaaaaaatataaattattaaaagtgattgatgaaacaagtaatactgcgttctgacatctaccgtggcttctgtgccttggttctacagtacttcattttgttttacgttgagtagtgcagtgatgaggccaaactggccaagccatgagctgtgaattgtga

SEQ ID NO: 28250 - DNA, 750 bp, Oryza sativa
aagggaaattgttcagggggtaccatttttcagtcaagatgatgccacatcacacccgtgtggcatgccacatcagtgccacgaaggatcctagaggagctgtgatgaattggaacctagatgacacactttgacaacttctgggacttagatatgcattttgagagtttagggatctaaatgacacacctctataagtttaaggaccgcctgtgcactttactcttttaaatatataagcacccataccagattttgctcttgttcagcaaattagtttgcctttaatcatgaaatgtccatcttgatttgttttggaaaaactgatggtcagaaatcagttagtgtaacttgacttgtggaggaaacaagtatcatatgtaggtatcatccctttacaagacaccgacagctgacagcccaagttttttctctctctctaatagacagccctaatgatatttcttaccatgatcagggtagccctacagagtatttgacattgattatggcctgttacctgttattagacaccacatgtataatttggattcactgaatggtttgtgctacgtcttgttactgatgactgttaatcattatgttgctttttctacactgttagaaattttatgacatggcagttagcgtagtagacaagttggatcaatttattaatttaactttgcattagcagggtcattttcccttttgctaattattgttgccataccttctcactgtccaagt

SEQ ID NO: 28251 - DNA, 1501 bp, Oryza sativa
taaacatccctctaacaacaatacataggtcttgcttggagtaacagagttttttatttgtagtgaatcaaagcgggaagggatgagaacagtcgaaaaccatattgtttgtaagggaataaaggttctgtgttggttaggaaattccatctatcatacagccatttagccttcccgttaattatttagtgattagtgatgattgcaatacggcattggtaaaatatagaagaaaaaagatcttatatatggctagaggcaaaaacaatacaagttttacggaaaccatgctccgtcagttatgaatttccgtcaccgttttcgatcaagaaaactatggagcacagccttgtgttttttttttctttagaacacacagccttgtgttcggtggcatatgcctggttgtactccacaaaagttccgaagaaaatttactggattttgggtggtgaacgctcgagctgtaaacttgatactaaatcctaccatgcggagatgtggtgtaaaccgtccatatgtccaaaatatcaagtgaagaaaaaaaagacgttggtagcagtttcactttaacccaatcgtttgctagagaggatacgatatactatcaatttacccgtactccttttgttaaaaaaaataaacaaataatttttcatcttaaaataaataattttaagtaaacaaataattttttatcttaaaataaataaatttaattacggtttattttgagatggatggagtagcaagtaagtactctgtatgatgaagtaaattggtgtggcaccgcagaatcgccgccccgccggcctacccctagacgcacaacatatgtgcgacgtgagatcacgaaaattccaaaaatctttccttccccagataccacccgtatcgtatcggcagatcggttggcaaattcatttcatcaccgcgaccacacagctacagctaacccccccgcgccgtgcgcaccaaaacgctcgtgtgtgaagctagagctcagtcaaacagttttaaggtccatcaaaacaagttgggtgaagctctctccactaaaactgagagtggagctggatagagctctctcacaagataaactacttcagactcaaaatttaggagtcttagagctataccaaacatgctctacagaccagcaactcagccctccgcgatgcttgggctctgctctgcccacccaaacgcgtgccccccacgcacacacgaattcggcgtgaatttaggcacaagcaccaagaaatcgggggaaaaaggtaaagatctgcgcctctggtggtgtcctgcgcgcctctcgttttttttttcttgtttttatttcttggtggagctttcctaggattcggtttggttgagattttgattgcttagcttgtgacgcgtccatcctcagccgtccataccttttcttttttgttgtattttgaaaatatttgtccgcattaaaaaaagatagtagtagtacgaacttaaatgaaaa

SEQ ID NO: 28252 - DNA, 810 bp, Oryza sativa
ccatccgctcgaagattgctatattttgggacgaagggagtacttcatattttagaagaaaaaaatattgattctttactactcccttcataaaaaaaataacctaagcgaggatttaacaccaaatagaataacgaatctggacaacctcatatccatattaattatcctaaattatgttaaatcaacatcggaattatgtttttcttgaaatggagggagtactctaagcttgccaaattactggttaggtttcttgtggtggaaccaatcctctcgggttcaaatcctagaggttgttcatatttataccatttttaaccatactattttttaaggctataaaaaatacctacatttagtggccaacttgccaaaataagatttattttggccacaatataaaaaccccctagatttaacatgagtgcttgtatttacgagtaatttttctttcaatggtaagcgacttacccatcgacagcaagacgcttcgtgataactcttagagggaggttgtacatgtattgtggacgcttgcgtttgtatcgtattttaagaaaaaaaaactaatccagccctcaaaggtactactagttgtaataaacaaattaacaggagttagcacccagctgcaagcaagaatgcaaatggattacgtatgccactagctgctgcgtgagggtatcacgtcatgtgccgtctatgccttgcttgctgaatgcggccatactccaatgtctcacacacagtcatcttgcatgtgtgtttctgtctaggtgctctgtctttttttgcctcacctacagc

SEQ ID NO: 28253 - DNA, 1501 bp, Oryza sativa
gcccactaagccgtaattgtcattatcttttttatctgtttatatactagtgggtgaaaaataaactgatgtgtatgtcttacgcatgatagcatgctgcccgcttgcattcctagaaaatacttcctccgtttctccgtttcttaatgtaagtcattctagcattttcatattcatattgatgttaatgaatctagacatatatatttatttagattcattaacattaatatgaatgtggaaaattgtagaatgacttatattgtgaaacggatgaagtacttttgaagagataatatatattagtgggacaatcgactttggaaaagaaaaattcaccaagtaagagctctagtttattctctatgcaattagaaacacacgaaagtagtccagattcagaacaaaccatatgtgctaggcgacatcattcattcttagttaagctctatagaaccatatgcattgaacattcctatacgcttaaatataaaacttgtatttgaaaaagtccacagtgaaagctcctaatctttctttttttaaaaaaatatcttaatataatatttctccattgttcctatatttctaggttcccgcatggcccatatgtgtaaagaaaaagaaacctcacgtcagtgttgtggtaaatatgtgatgtcgtcttttaaaaaaagatatgaggtgtgttttttttttcaaaatgtactccctccgtttccggttataagacgttaaactattttaaatttgactaattctacagaagaaagtattaatatttacaacaccaacattgtttcattaaatctataatttaatatattttctgtaaaattagtcaaatttacagtagtttaactttaaacaaagtcaaaacgtcttataacctgaaacggagggagtatattctagagttaatgaaaaatcatgctctcttattggatttttgaaataaaaacatgggaatcgcatgcctctccagtccctagttggcgaaaagaaacgaaaataaaaaaacaaaaacgttttctttctgaaaggcaggcgaagaaacgcatctgtcacgcagcacttccacgcgttgctattcacacaaaagagagagagagagagaaaccaaacgaaacgaacgccaacccaagccaacccagcccaagcgagaggaagaagtaaacacggcaaataatcaacaccgcattaaaaatcttccatccaagtcaagcctcaagcgactcctcccccctataaaagccccctctcctctcctccaactctctcctccccaaagaaatcgcttcttcttccgcctccgcctcccatggcagctcccagctcgtgggacacctccttccacgaagcaaccacagcaaggcaatagcgccacccaccgctcgcatccacagctgctgattcgtaggaggagcaggccagggagggattcgttgattttatttggcagggaaggagatccgagaggaagaaggggaatatagatcga

SEQ ID NO: 28254 - DNA, 930 bp, Oryza sativa
ggcacggggctcggggcgggacgcgacgggcgccggcgtgcggcgcgcggacgagcgacgacggcgacggacgagcgacgcgacggcgacggacgagcggcgacgggacgggcgacgcgatggattttagtttatatttcctatatgaatttgattttataatttctaaatcttgcataaatgaagtttactcaatatgtgtattatctcaactaatgaattcaccctagattaatattactcttattttatttttatgtaatttatttgagttttatttagggttaattcttattccatcgtatttaaatttaattgatccaaatatggtcgcgataatattttatttatttctatcccacctaatctttattttaaattataatttatttatttctttaaccaaatctaattgcagggttaattcctaattatcttacaataggttagaaatttctatcgcgagctaaatatcggacgaaatcctagaattatcttacaatattatacgatttaatttagtctatgactaaatgattaaatataatacatggctaaaatccctagtaattaaatccgaatttctaccgtgaattgattacttacatagattacccaaaaataatctataataatctataagaattcatctaattgtttagttattaattacatctaaattactaccgcgaattgatttcctttagaaattaccaagaataatctataatttatattaaattttgcaattctacgactataattaatctataattaaattctaattattttaaattttataaactattaacctccctattctatttccctttttctcttttcttttctttctttttttctcttttcttttctttgtttttctcttttcttttctttccttttctcttttctctcccacgttttcttttc

SEQ ID NO: 28255 - DNA, 1501 bp, Oryza sativa
tgcttgcttgtgtgtgtgtgctagctagcttcttttgctgctttcctttgtgcttctggtgaggtgagctagatgtttgagatagatctaggacagtgcttgctgtgtgtagtatgctgctgcttcctttctttctctctctctctctctctctctcttgtgtgtgtgagatgagagagagagagagatgttcttctttggcttggtggtcctgctcttttcttgctgtatttatgttttttcctttctctctccactgtggcaagctgtgtgcttgtatgtctgtgtggcagagctagctgtagagatagatgaagagagagagagaggtgagctttaagatctctctcacacctcatgatgtgtatgatcacacacatatttgcacaaaaaatatagagcatcctggggctccattcatcatctttcccttttgtgtagctttgcttgtgtagaagcagatctctagatagcaaggagagtgtgtatggttggccatggcattgatgtactagtagttagtttgtacatgaatgtgccaagtgttagtgtatgtatgtttgatcaggtgataagggtagagggataaacaagcagctgatgatataacactctctctctctcttgtgttccagtttcttttgcatcatctcctgtttccaaccaatgagctgctagggttagggcttcatccccatgtgcatctctctctctctctctcatgagtgtgtgtggctgtgtggtgcaaattttagtcccgagcaacttcacgagggcaggtgatgcctgacagcaccactgtacttttgaacaggaaccaaacacaaagaagggatccaacaaagaaacagcagtaaagatgaaaaaaatacagtaaagtatataggggagtacatatgcatgcgtttgatttactgaaagaatttacacaaagatgattgttccatattttttgcatgtctccctttcctcataagctatacatactgaataatgtgattatataaaaatattagctagtctttttttacaaatgattttgttatgactattagttctagttatgtgtcgtatgcatgtaaataaaaaagtggcaggataagcttatttgttttttcatcaaataaagaaaactaaaatttgtgtaccaaaatatcagtttcaatgttatgtgaaaacatgtcatgcaggcataaaaaaaattacacacatggccactgttgtctagttatgttgaagaaaaaactgaaaaactgtggtctgcatgaagtatttgaaatcaattaataaaacatattgactttttcttttttgcttcgcgactaatcaatcctccttgaaaaacgaaattagaagcacatatatacgttttgttgcactgcttaaacatggggatcagaaacctctcatgtatcctcaccaaaaaaaaaaaaagagaaagaaaaagaagcctctcttgtacggatgacacgtgtccatgcagccactgtcgcagtagaaa

SEQ ID NO: 28256 - DNA, 204 bp, Oryza sativa
gttgctttgaactagttagtaaagtagttaatattaataccaaagtaattaaaaaagtttcatactcatttgaattgggtatatactcaatttcaacaatggtgcccgggcaccatggagcaccaaacaaatttaatatatatatatatatatatatatatatatatatatatatatatatgaaaatggttctatactcctagg

SEQ ID NO: 28257 - DNA, 299 bp, Oryza sativa
agcttttaagttgtctcacaagcttcctgtctttgccgctcatgaactgtgttgctatggttcttgactctttgagcccctcaagtatgggagtatttcttcttttgggcttaggagccacgtggttaaatagacatacttgtgattagtcaagtttgatcaagttatacatttgttgtgttttcgtagtatcgagtgtcgcaatgcagttttgatcccatacatgcaccagtgttcattgaaagcatggcgtgggttttatatgcaactaaagcgtgactgatttttattgttaaagg

SEQ ID NO: 28258 - DNA, 1501 bp, Oryza sativa
acaaatgtatcccgattcatctttaaaattagaattttttttggacggagggagtacggattaacttattggatattctgggacgattctgggatggaagtaacagtttcgatcagattaagcaaggttgatatactactttcgtcccaaattagtagtcgctttgactttttttcttatagcgtttgaccattcgttttatttaaaaaattagtgcaaatataaaaatagagaagtcatacttaaagtactttcgataataaaacaaatcacaaacaaaataaataataattccataattttttaaataagacaaaagatcaaaaattaaaaaaaactcaaagcaacaagtattagaggcagtaaaaagaacaagaaaaatggtgctttcaggtcagcaactaaaggcctgtaaatgttcccgtgtggcccggcccatcaacaaagcccattatccgggccttcaaaaaaactcctgtaaaattggcccgcttaaattctctcttttttcaatagtgcaaccgagaaacatgcatgaactgatcctcagtacattctcttcaaaaaaaatatttccccaacatttgaaaacgcaattaattcgatgatgacaaataatagaatgcatgctaccacttgtatagatattttagcactgaagattttttagcagcagcagcagcagttgctcatcacatacgctttggattgagtcgatatgtacatacacttatgacagcagcgtattcgccgccaccgccgccgccgccggcggcgatggcgacgacggcggcgacggcggaggaagaggagatgatcagttggtattgcgagcgcatcgggtgatggcagagcagccgcggcggtaggggttggcggccttctgcgaggcgcagttctggtagtaggactggccgcgcttgttgcacggcaccttgttggcgtccagcgccgcgtagctcacgtacctgttcgtcggccgccgcgccgccagcgaccgccgcatcagcgtctccccggaggcggcgcccgccgcccccatcagcgccatctcctccacctcctcctcgtcgtccacgtcgcactcccccacggcgccgtcgcacgtcgccgccgccgccgccatcttcctccgccccgacgccgacgccaccacgccgcccatgtcgtcggcggccgcggccgggagcaaggccaccgccgccatgacgacgagcgcgatcagcacgggcacgccgcggaggagaggcggcgccatgcctgtgatcacctgagcgttcggtgtgtttcttgggcgccggcgactgggattcttccgatcgatggatacgagtaggacgaacgaacgatcgatctccctccgcgcgcgatgtacgcgagcctaccctgatgaaatcttggttggctttgaaggaggagggagacgaggaggcggcggagaagatggaggggataaggaggagaggcggcgggatggaggggaggggagacgaaccagggc

SEQ ID NO: 28259 - DNA, 1349 bp, Oryza sativa
attaatcaagatcagcattgtgtgcagctagcagtaaaacatactaccatctttgatatcgactgccatggttcagttacttgtagattttgccattacaggttaattactcacaataacatcgctacaatttcagaatgaattgctgatcatctccacacacatgtcactgtcacagcagtgcactaagtcgaccaaaaaataattagggagcatgtcaagcagatttagaaagatcgagtggccagtcagtcagtcagttggattgacctcaaagtcctgctagatgtattagcacccatgcatgatggtttctaattagttccaccatatttgtctcgtagtttcaaaggctgcacctttacggctttacccagtttcctactaaccataattattatagagatctcaacaaactacaatccaaaaggatcccatcaactcctaataaggcccatttatttttctcaactttaaacttcaactttctcgtttattgttagtgtgctttttaaaggttaaatatgcgtttttggcaaaaaaaaaaaagttctatgtagaagctgtttttttaaatcaaataaatctatttttcaattttataatagttaatacttaattgatcgtgtgttaaataagttttctcgttttatgtgtgctgaaaatatcctctggtcaaagtaaacgaacggggcctaaaacatactactagtactatatacacatgaggtgctttttttttttcagtgaaagtccatcgtacattattcacaaattccgttgagtctctccgcacgaaattcggagctaccctaaaccgcttggtttgtgttgaattttgaaaaaaattaattaaacttcgtgaaactcttcatcacgttggaggctcacatcttaaataaactagggtataccggtacattaaaacgggatgtgtcaatggtttttacaggagggctaatggttgtccgtaatgttcttttttttttctactggtcccatttccccccctaaagggcggttgtttggtgtttttttctgaatttttggaggatggatgattgcgctttttaaatagtagagaaatgatattgtaaattaatctggaatgaatcgaagagcaggaagaggtgaaaaggaaaaggaatagcaaaatgtgggatgagttgccacattttcagtcggtttaggttacctcggagtagtgggcagcatatgttttgcatgcatggtgtgaaggcatggggggattggattggatttgggggcggcttaaaactggatgggcccttgacttggagaagacctcctctgctcctccttgtctgtgtgtgcgtgccctaatcaga

SEQ ID NO: 28260 - DNA, 1501 bp, Oryza sativa
ttttcgcaaaatcccaaaagatacagttgtcagccaagctggggcgattttcaaagcattgtgttgttttagaaaaggtacggtgtgtagatggtttgcaaattcctcgtaacggctcgatggtagaacacgtcaaaattctgctggcattgggtccacaagaagagtgttcaatcgtatggctttatgtgaagcgtgtttctttttattcatgatatgcatatgataatttctagaattattaatattgttcttttgactctactttgaatattgcatagcatgggttggtctccggaggaaaatatcaagctttttggaaagacaaaggtgcatagatggttaacattgcctaatatgagtttgatcttcggatgaaaagatcaatgcctacggaaaggcatgggcacaagaattagaaattgaattcatcaaattcatgcaagtttttggttagatgttatgttctatcttttgaatggacttttacaacattccagagatgcatgctaagtctatggcggttttcaaagtgttgtgttgttttagaaaatatgcaatgcatgaagagtttgcaaacacctcgtaaccgcttgatagtatgaaacacaccaaattttgctatcattgggtccataagaagagagtaattgtacgggttcacataaagtgtacttctttttcttcacggtatgtgtaaaaaaataaagatagatttacctgctaagccttattaatggttctcaaaacatcatgttgttttataaaggacacaatgtatggacaattttcaaactcattgtaacaccatgataatagaacacatcaaattatattttcaattgggtccacaagaagagcgtccgtttgtatgggtttaggtgaagcatgcttctttttgctcacaatacgcgttgaacaatttatgtaattatttaatatttttttggctctattttgaacaatgcttagcattagtttgatctccataggaaaatatcaagctttttgaaaaatacaaggttgcatggatggtttgcacactcctttttacagcttgatagtacctaaaagaaaacccgccaaattctgtcgtcattgggtccacaagagttgtcatttgaatggattcatgtgaaacatgctcatttttactccatgatatgtgtgcaataatttcaagaattatatgttgttaacactaatttttattctattttcgtaacacggtatagcatgttgatcctcatgagaaaaaatgatcaagctttattaaaaagaatggaaaggtggaggaggtatacacactactggaattccacggggtccctagggttttcaaatgttccctagagccctaattagaacccaaggggataataagttccctagagccgaaactaaaactcaagggaactgagatgatccctagagtttttgcttgctcctagggaaactagtacagttggcactgataggagaaccacggtggcagggtcca

SEQ ID NO: 28261 - DNA, 1501 bp, Oryza sativa
ttgatcattttttctcatgaggatcaacatgctataccgtgttacgaaaatagaataaaaattagtgttaacaacatataattcttgaaattattgcacacatatcatggagtaaaaatgagcatgtttcacatgaatccattcaaatgacaactcttgtggacccaatgacgacagaatttggcgggttttcttttaggtactatcaagctgtaaaaaggagtgtgcaaaccatccatgcaaccttgtatttttcaaaaagcttgatattttcctatggagatcaaactaatgctaagcattgttcaaaatagagccaaaaaaatattaaataattacataaattgttcaacgcgtattgtgagcaaaaagaagcatgcttcacctaaacccatacaaacggacgctcttcttgtggacccaattgaaaatataatttgatgtgttctattatcatggtgttacaatgagtttgaaaattgtccatacattgtgtcctttataaaacaacatgatgttttgagaaccattaataaggcttagcaggtaaatctatctttatttttttacacataccgtgaagaaaaagaagtacactttatgtgaacccgtacaattactctcttcttatggacccaatgatagcaaaatttggtgtgtttcatactatcaagcggttacgaggtgtttgcaaactcttcatgcattgcatattttctaaaacaacacaacactttgaaaaccgccatagacttagcatgcatctctggaatgttgtaaaagtccattcaaaagatagaacataacatctaaccaaaaacttgcatgaatttgatgaattcaatttctaattcttgtgcccatgcctttccgtaggcattgatcttttcatccgaagatcaaactcatattaggcaatgttaaccatctatgcacctttgtctttccaaaaagcttgatattttcctccggagaccaacccatgctatgcaatattcaaagtagagtcaaaagaacaatattaataattctagaaattatcatatgcatatcatgaataaaaagaaacacgcttcacataaagccatacgattgaacactcttcttgtggacccaatgccagcagaattttgacgtgttctaccatcgagccgttacgaggaatttgcaaaccatctacacaccgtaccttttctaaaacaacacaatgctttgaaaatcgccccagcttggctgacaactgtatcttttgggattttgcgaaaaaacttttcaaaagaaaaaaaacggaaccttcaattaaaaacttgcacgaaaagaatgagagaaatccactggcgaagtatgtatattcacccttacttaaacaaccatagccttttgattgcaattacaaacgtaaccctcccttacaaacacaataaaaattctccttgcattaagaaaccacagcaaattcacccagccaaagaacaacaagatccaaaccaaacccaagaat

SEQ ID NO: 28262 - DNA, 240 bp, Oryza sativa
tagaacttacattatgaatacactaaaattacatatgtaatttagatacttacaatgtaaatacatattgatttttttttaaaaaatatggcaccataaatatagctactcccatgagttttcttcccaaaattcaaaactatgaacacatttagtatttagagtatattttactgtgtcacctttttattatcaatgtttcgctttggatcacactttaaccattgttttcacttcagg

SEQ ID NO: 28263 - DNA, 1501 bp, Oryza sativa
tttgtatgaagagagtggttattacgagctgagtaatggtggccgacatgaaatgacggcactaacgaaaatgataaaagagtgcacagaggtatttcaccctgtgcaaaaagaaagagatggaaatagtagagggaaagagtggtcatgttactcaaaaaaaaaggtgtgattgcatggttcaggtgaggccggtgttgtcctcgagatataagagcatgagtggaggtgttggtggcgtcggtctcgcacttccaaatagcgataccgtagccatccttagcaccaacaaaaaaaattcgcaagacccacaactaaagccggtaacgtgctttgaaagagtgataccaacgatgttttcgcactttgagtgtgcgataccgcgggcccactctccaatctccgtgctcctcggtctcgcgcatcgggagtgcaacactgatacggtatcgcgctctacgcgtgtgataccgcaggcccacccacctccctctgtgtcccggtaatgcgacaacgtggatcccaaaactctctcggtctcgcgctgcgaaactatgagaccgttgggcccacccgccatactaccctcccaaatcgccagaacgggtcagtttttccacgtggcgctctcgctctacgaaagagcgataccgcaacgatctcgcttttcccacacacgataccgccaactcaaatgcaccctcgctgattgatagagcgatatcgtggcgctatcgcactttcccgttgcgaacctcggtatcgctcttccatcctgcaataccgatggtatatttgtgcaaatgattcgccatccggtatatttttgaaaaagaaaacgatgaacagtatattttcaaattttttttctgcaaactaacagctaagataaacaaatttcaaatgacactacttaggcttgcatctttgccttcgttttcttctagagcacaatacttccatggacctttttctttaaaaaaaaattcaaaccttctatggctccaagaaattaatttttatctaaacgctataagtttcatgaaaaaatggaaataaagaaggtagactgtagttagtcagttataagatgttacgctcatgaaagggcatatagtctagtggttgcagtgacctgagtagcaccataagatcctgagttcaaagctccataggagcgaatttcagattgggttatagattgggttatttgaaggctaagtttcctgcttaataggctaagttcctgatttaaaaaggctgcatatatatatccggttggtttacactatgtgtaaagcagcaaagccctgcgattaattagtctaattatatacaaggtgattccccacgctttgctgtgggaattactaagtaatttttaatatatattttttcgttacaatcaagctaggggcaaaaagaaaacaaatgaaatatcagggcttatcaatatttatcatgaaacagacaaatgaaacccacactttaatgtgtaaca

SEQ ID NO: 28264 - DNA, 1501 bp, Oryza sativa
tatttatggacactataatttaaactccggtggatatataaaaagaagtgtacatcgtctcaattattaataggtttgtacagagaaaatatgcataattagaaagagataagtacactttcgacagttctgactgcttacatgcaattgttttcttctctccactgcctcctctcttctgtagcctccactcttgctagtctctgtcctcctcctcagtacactccattcatgcttgttccttcgtaactacatatgttcgtaactacatatgttggtaagcatatgtttaaccacaccatatttcaccgttactatatgaaatcttatgtatgtgtactacaaataaaactaccattatttcagccttttttttcatttgttagatataatattggccatctatataaaaataaaacatcgcatgaacaactaataaattgcaacttaaaatcactacaaattaattataacattaattaaattttttaccatataaattaattatgtctatctattttttaaacctaaatcgactctaagtcatagcacacaaactacctccattaccattatcctacttaataataatatactacattataaatattttatatttattaacttcctatgttactatttttgcatgcgacgtataaaaatataatgtaaaaactaatatatacctctaattttctccgacataattaataacaaatatttactatcactaatataaaccacatgaactaatattttctaaatccttcaccctacaaatttttactaatcaacttacgtgtaatttatttcttttatccactgcctcctatcttctgtggcttcctctccccgtggctccgacgcctcgccgcccgcccgacccgccacccaccgccaggctaccgcctcccctggccatccctctaagccggcgaactcctccccttccctccccctcccacccccaccccactccgggaccctaacccgtagggtgtcactagtgccggagaagaagagaaggtcgccggagttggagaagacctggagcacgaatctcaaagctcatctggttgtccaaaatctgcaagatttgaggatacaatttctatcgacaggcggttagcaaatcagaaaaaaaaatactgattcccgcgactactggcgcacgccatctggattcttcctgagcccttttttggcgggaaccccaccccgacgacgcacggtgccctggacgtccacgtcgacagccacgcgcaacctctgaccccctcgccctccacgtcgccgcctccccctcccccgccgacgtggccgccgccgccgccactccccacctcgccgtcctcctcgatgatcccccgcctatttatactcgtctcgtcacccgcatcatcatcagcagcagaaagagtgatctagcattctagctttgctcgcctgagttctttgcttgtcctcactagcggtgtttgacagtttgagttgttagcaa

SEQ ID NO: 28265 - DNA, 1501 bp, Oryza sativa
ggtgattctgttattggcctaccacccctactgtataaattagtccatgatattatctaatattatgtaataatttaatatttatttaaatcaagtgaataacatatattcaaaatatggacattttactcatagcaaagcatgaacattttactactactctaggtaaaaataacattttactactacattcatatcagaatataatattttttaggtttatttgaacacggttattaagaaaagtagaaagaattaaatgagagtaggttgcgatttaataagaagtgaaggtagatggaaaattgaatggtagagggttgtgattagttgagaaaagaatgttggtcaaaaaattattatattttaggacaaattatgaaggctaaaaatatattttggaccggagggaatagtgatatagaaataaacaagcaaccattagtttttttaaaattctcaatagggtaccccatgactgcttttaagaatatctaactactccctaaacagagttcacagtaaaatgctaccaagatgcctttagccctaaatcatttttgacagaataacacataataactctttccttcaacactcaatcgctaagggttcttcatgcttctaacctaaagcttttttttagacatatttctaggtggcttttattggtagtagaatcttttatttttcatcgataaaccgtatttatttatactaccacctattgatacactttagtaaaatttaaaccagagttcaatcagttctaactaaattttaaaatgtgcaataccaaatgtatggatggactcatcggtgactccttgatatgttaacaaagagaacggctttagggatatactgtatttccatattatgtttagcatgtaaaccatgcaatgacatgttcgcatctatttttcttactagttggagcaaagctaccactaccaagagaattgaacataacttttccatgtggtgattgatgttgtcgttcattatcatattcatcgcctatgatgaaaacttcgtcaaggtttccatcatttgtttcctcccttagcatagtggtggatctgccatgagggcggcgagggttcgagccctcactattgacaagagactataggagcctcaccgagctctctaaaaatttctactatacatatatgaaaaagaggttcgagttttgtttagtttattcaacctctactattttttttcctggatccaccctagttagcatcacacctaatctttctttttttgttatcattcacaaactagagctcctatgcaaccacaaatataagcgcaattgcacaaaccacctcgcttagtttgaggaaggtaaaatgaacggttttaatcaaatgccacatggtttatgtattttacaggttttcttttttcttttttgtttcatggcttccaaaatccaaatgtttggtgcagtaaaccgatgttacccttttatggaaaaatgttgcaagga

SEQ ID NO: 28266 - DNA, 594 bp, Oryza sativa
tccaggttcttatctgggtccatgctcctgaattggtttaggcatctttttctctctctctgcgattatgaaattttaggagttggatgttgatttttcaatatatgaacaggagattttttttgtttggtcgtgttaagagaagtcgtaatctaggtaggtctctagtgctaattatagcaaaaggaagagatgtctttctctccagagtttaggtttcgttcaaaaattttgcgccgtattttgattgacaaggagagatgagatctgtgcagtatgtcaatcagtcaagactaatccagatgctgttcatgtcttgttcttgatctggtcataaccttgcactttcagtttctgtgatgcttcaattgtcaaaaccagcgtgttttagcactgttccaccatggcagttgttctccaacgcagctaaaaaaaagtcaattctttagtattatattgcagatatgtttgtctaccatttcagtctaataataataaatactactcgatttgtctctgtccattgaaccaaaacatattctatgaccaataattgacaatacaatactgcctgttgctaacccagttcagttt

SEQ ID NO: 28267 - DNA, 1501 bp, Oryza sativa
cctttttctctccgtgtttaatttttcagcatgcgcgaccagtaattcctccagaatgtccaatggctctgagaccgttgatcgaacagtgttgctcattgcagcccgaaaagaggcctgatttctggcagattgttaaaatcctggaggaatttcattctgttctctcccaaggtggctgcctcgactcactgaagagcagcaacagccaggatcagaaaaagcgacttctgcattggattcaaaagctgaaaccctcacatagcacctgagttcctgtagtctctagcatcctttctgccagatgtttttatccggttctgtatgctcagtagcttagcataagattttcatttttgttcagaaaaggtgaacctgtgttctaggatgcttggacatgtttatcaggtgaattgcaagtaggtttacagtacctgtatattgtgctacccttctgctctcttctctgtttttgtgaaatttagtagcagatcattcacatgcaggtgtctctaattataaaaaaggtagcattattggcctagatatatcgtaatcactcatttatattaagattttaaggcaaacctatgcagggttgactccaggccgtcagaacaggaaaatggcattcgttaatacaattattgtatcttatattatggagtcatcgtaattatgatgcgactttgagaaagcaacatctctgcttgcttgaagtctgctttatccttgtgctgtttttttcttgaaagatggatgtcagtttctgggagtttttttgttccgtagcagcatctttagctgaaaacttggttaaagtatgggctctccaaaattcgccatatgtgggagaagttggttttttttttcttttgaaaagttgggttgaattttgagtgtatatgaagccttttctcttcagatctccatcagtagtttgctgaatgtatgcgtatcttgtaagctctaccctgaaagtctgaagttctgaaacattcagatcactgtaaagctttactccgaatttttcttcttgacgaatctttctattgttcttggcaaagcagcacgactgcaatgaaatgagtgaacaaaatgccgcgtagtttagcacactaattacaggttcaaaaactctgaaattgagtatagagcattttcggcggagcaaaaactgcgcactgtcaccatcgaaaaactgtagcagttcagcactaatttcagcagttcttcaggcagcagcatcaccatcagaaaaagagcagacaactgagatagcagcacataggggggccacattgaaccgtttcgatctcgcgtagctgtaagcatgtaactgatgcaacaacatgtttaattagcagacaaagcaacatttttcccccatcttgtcgacgtcagaatgacagaatggacggtgcttagtactacgaaatgcaacatttttccagcttgcgaacgtcaagagtttgtgtgttggtgtgaactgtaagcaaga

SEQ ID NO: 28268 - DNA, 487 bp, Oryza sativa
tgtatatatatttctggcaacttaagccaatataaaaaaaactatgttaaaaatattttaaatttaacatcaaaattaagtttgaaaattcaaatttgataaatcaaaccgatagaaccctcaaaatgttaactaaaagacaaatcttcacacgattgtatgtgaaggtgaggagaaaagaggtgcgacgggcgaggttggcggcgaggcaagcagaagcgggggaggcgacaattagagcaggtacaatagcagaatattagccagctacaaatatattttaatgagataaaagatgagagagaagagcagcgggatacagatctgtagctagctgcagcacggactccaagatgcaatgtatgtatgacagtgggaccatatactattagtatagtaaacaactattgtataaattggctattagattagctatagatgaattagagctagtagttggctatactattaaccttgctcttatagc

SEQ ID NO: 28269 - DNA, 904 bp, Oryza sativa
aagctgtgcgctttgtctcctttttttccacaagtacatgaagcctttaatagccagcacacattccaagtgtatttttcctctacaatcttgctatccaagttgttctatttttttagatgaatatatttatttttgtgtacaatttcagaaaagacaaaaccaagtcaatgccaagagcaggagtgagatgttcaatcccagcaaggaagactctgcatctggctttccgattgagccacccaggccaactcatcctgctgaatcgtctcaagactctcaacgtgtctacacaagaacattccattctgggcctctagttaatcaaaataaaccttcaaaggctggacggagtgaaaatggcgatattcatctttctggtgttgcaaacgcatcggacttccgtgtggttgtatcaacaagatcaaatattcgttcagataatggcaatggaacagtggttactcaagccgaagcctttccgcatgaacggaggctgtctgaatctataaatgagcgtttcagtagtagtggaaagtatgatcaagtatttcagcagaaagatgacaggagtagcagggtggatggagctattgtaagtatctccagacctaagtagcaaaagtatgaaaacagtttgttatgccatttaattcatagttggcagtttttttgcaaatctcagttgtcaaattgaaaagtttctttcagcaaatccaaggtcctcatatattatgtattcagttccagcaggttattatgaggtttacctagcattatttgtagttcacgattaacacatttggaaaaaccgaaaaatattatagcactagctttgatgtcagataactttactttgttcccctgtctagatttctaattgactatttcttgtctgaacagg

SEQ ID NO: 28270 - DNA, 280 bp, Oryza sativa
atgatttaatgtatgatgtatatacaaccatgtgacactccacatacactgtccagtttctgtttgtcacataggatgcagagataatggctaagtactcaccagcagcagcctcctattaattcagcacagtcctttcagttgctctcatggggcccctatctcttcctcacataatgtgatgcatcatgcttgctgccaaccctctctccactcactccaccgtccatacatccccatcaccggctctgggccaccgccgcggtgcggtgcacgatga

SEQ ID NO: 28271 - DNA, 463 bp, Oryza sativa
aggttcctgaactgtgaaaagtgaaacaaaaaggaggaaagcaataaccggtcttgctgttcccacaactgtttttttgtgtctaacatgcagtttaccagtccaaacaaagcaagtttcagacttacagcaacaagaagcaaagctttgcaagcagagttacatcagagttacttgcattacatattctgaggtaaaatggatatggagacatatgtatctgacagcacagcactgcctgccaggacaagagatcaaagagtaaagactgatggaaagagagctagctagtagtaaatcagaaaggttgtggattgcagtcagaagaaacaacaagctagagatagatagctatcagattggaattggccacaaaagctactgctaactacattcacctcacatttcttcttcccctttccctcctcctcctcttcttcctcttcttctcccccacctctct

SEQ ID NO: 28272 - DNA, 180 bp, Oryza sativa
tccctctcgacgccggtggctcgctcgcagtcgcagctcaccagccgccgcccaggtcgccgccgcgccgccgctcgctcgtagctccgcacgtgcgtcgctgcgccaccggccggccaccgtcgttgcggtgggggagagggagggaggcggagagacaggaagcggcggcggcggcgg

SEQ ID NO: 28273 - DNA, 1501 bp, Oryza sativa
aatgctagatcactctttctgctgctgatgatgatgcgggtgacgagacgagtataaataggcgggggatcatcgaggaggacggcgaggtggggagtggcggcggcggcggccacgtcggcgggggagggggaggcggcgacgtggagggcgagggggtcagaggttgcgcgtggctgtcgacgtggacgtccagggcaccgtgcgtcgtcggggtggggttcccgccaaaaaagggctcaggaagaatccagatggcgtgcgccagtagtcgcgggaatcagtatttttttttctgatttgctaaccgcctgtcgatagaaattgtatcctcaaatcttgcagattttggacaaccagatgagctttgagattcgtgctccaggtcttctccaactccggcgaccttctcttcttctccggcactagtgacaccctacgggttagggtcccggagtggggtgggggtgggagggggagggaaggggaggagttcgccggcttagagggatggccaggggaggcggtagcctggcggtgggtggcgggtcgggcgggcggcgaggcgtcggagccacggggagaggaagccacagaagataggaggcagtggataaaagaaataaattacacgtaagttgattagtaaaaatttgtagggtgaaggatttagaaaatattagttcatgtggtttatattagtgatagtaaatatttgttattaattatgtcggagaaaattagaggtatatattagtttttacattatatttttatacgtcgcatgcaaaaatagtaacataggaagttaataaatataaaatatttataatgtagtatattattattaagtaggataatggtaatggaggtagtttgtgtgctatgacttagagtcgatttaggtttaaaaaatagatagacataattaatttatatggtaaaaaatttaattaatgttataattaatttgtagtgattttaagttgcaatttattagttgttcatgcgatgttttatttttatatagatggccaatattatatctaacaaatgaaaaaaaaggctgaaataatggtagttttatttgtagtacacatacataagatttcatatagtaacggtgaaatatggtgtggttaaacatatgcttaccaacatatgtagttacgaacatatgtagttacgaaggaacaagcatgaatggagtgtactgaggaggaggacagagactagcaagagtggaggctacagaagagaggaggcagtggagagaagaaaacaattgcatgtaagcagtcagaactgtcgaaagtgtacttatctctttctaattatgcatattttctctgtacaaacctattaataattgagacgatgtacacttctttttatatatccaccggagtttaaattatagtgtccataaatatggttgtggttccctctatgtgatatggatctgcgtcgaacatccaaatttctcaagaatttttgcaag

SEQ ID NO: 28274 - DNA, 1501 bp, Oryza sativa
ctcagtgagtcagtgtacatacttgtagtgcataaccaaattctttttcatatactagaaagattcaaagctgcaaatgtgcatgtgaggttgatgaatggaatacacaataatacatgacaataaacacatattaaagaatttagtgcaaaaaaattgtattgtcatggtacacattttaacaattttctttactttttatacattgtaaatattaattaatatctaaaacaaaatataaagtacgggaataaaatttaattggctaatgtggaaatggcatggagctaaatgttctatatatggtcctaacgtttaaagataaaatacatatgtgcttgtgttactaataatatctaaaagactaagtagtatgtattaaatatgctagagaacataagaaacttaaaaacttgacgtggcaaaatgggcgcttaagcgacacatattgcactttcagctgatcttattcccccttttaaatttcatgtccccattttgattatcacatggaatcaaccacattatacctatgcattcttgtgatttctgaaattaaactcgaaagcaaccaagtaaagaggagggggagaaaaagttagcagaaaacatggatgatacatgtcaataagctgctagcataaccataagtgtagggcacgtttcttaggacaatggtataaagttacaaactgaaatatcattgttaggtcagtttgatataatcagtttggattactatagacacttgtcatagtaaatagagatggatcatttcttaagtagcatcactactcttattcacgaatgtctttgctaccctttctgttatacttttcctctttttctgtagaaagccatttgtccttatattatcattgtcaaattaaggatgcgtaatctacaccctcactcaaaaactttgataagataaaaacaaataaatccatgcctttatagaaccttgtcaaaattatgctacacctgtgctaggaacaccataccatcgtagcttacttgcacgctttctgttaaccctttttcctaataaaaacgtattcgtccgtatcgttgttatcgctttgatcgtgtgggtttcactttatatccgttgaaacctctgttaacacgtccaaattatttatatcggtattatcactcaagatcgtgcgggttgttttgctttttacgtttcttgaagcttctaaagaggggacaaacctatataaataggagaggagagcaccctctcaactcagttcaaaattgaaaaaaaaaagaaaaaaaaagagaagaaaaaaaaacccatgggttgcgtagccgtagctttcccaccatttccttctctccgaagcctcctcctctccgcttcctcccgcgaaaccaaattccaaagcatttgatcgaatttctcccaaacttttccagcgttttcaatttcgccccgatttcggttcgaaaacccctcgcgaattcatttcaaactcgtccgagagcgcaa

SEQ ID NO: 28275 - DNA, 878 bp, Oryza sativa
ccattgcatatgatgtttaagtagaaccatctataataagtttgtgtgacagtgttaagaaaccatttgcaataaggtgtccctacgacttctttttaggtagtggatgttactcgattctcttttttaatgttgtcacaacccactaaacaactaaaactcaacatgcaagcatattaattattattagtgcatcctaaagactaacatgcaagaatgccacgtcaactcaataggtacctaaagctcaacatgcaactatagctattacatatacaattttattacatcctaaacctcaacatactaggatgctaaattatcattcctcacataatttttgtaatattaatttcaatccaaaccaaatctatccatgtcattgtcatgtggggcacggcctatacacggcgtcgccgggcgcgagatgtgcggagagctgcggagcgagccgcagcgcgtgtcgcggcgcagagcgcgatcaccatgaccgtggatggcaaggacgggctcagtggctaggatcggagtagccttgattctaggagggtttgtttccaagttgttagcgtttatttccaagttagttagccggagggctatatactcttgtaccgaaacatttgagaggaaagcatgaaagttatcgtctaatctccctcttattctgttaagccactagctgaggggtataacctcgcaggtgaggactggagcgcgactacgagttacgtagtcgcggcccgccgtcgttgagcgcccaggcgcttgacaacctggtatcgggatctcgtcgatcctcggcgtccgccgccgccgcgcctttccctaccaccgccgcacccgcgtctcccgaccccgcacccatcaaccctagt

SEQ ID NO: 28276 - DNA, 451 bp, Oryza sativa
tacgcatgcatgcgtccatgccatctccttcatctgctcgatcgatcactctcagatagattgattgattttactatctcgatcgagttggtcgccaattcgccatggccagcagcctcattaaccttcttctcacggaggtggccggcatcgtcagcattgttctcctcccccttcttgtggggctaaattcttaccgccgccgttccggccacccggggctccgcttttttttttgggcggcctcacaccttttcttcccgttgtgttcttacgcgtgttccgccgccgccaattggaacgccgcgcgcgtcccgttcttcttcgcttgaaccggtttcctccaaatgctgcgcaacaccatgaacaccgcccgttcgtccccgtcacacaatcggaaacggcagcggcagcagcaagttcaggccctccgtcaaccacctggcaagaa

SEQ ID NO: 28277 - DNA, 395 bp, Oryza sativa
tcttgcacctgcacccgcagcgtatgcttcctatgtagttacacccctggtcatgttttacacccagaatacagacattttctccataattcctgtgtaattgttcctgcaaggctgagttgcagcaacaagcaatcatatgcaaattttcagtcaagattatgtcatatcagtgcatgattctgtaggcacaagtgcactgcacatattaacccagcatgctgtggcatccccttggctacctccacctccacagtgtgggagaggggtacctgaggcccaccagagaataacaccacaagggcccaccaaacatattgtaacaactcacctccctggtggcctagtggtgcggcagggacacccgccatgctgctcctttgtgtcccctcagg

SEQ ID NO: 28278 - DNA, 895 bp, Oryza sativa
ctcgggctggaggaggaagaagacatatatatataggggtgggactttagtcccgggtggtggtatgaaccggggctaaagatcggcggagtcatgtcacgtcctgataaattcatcccgaaataaaaatcattccctaaaaggaataatagaattaaattaaaattcaaaaagaaattggcaaacactaaaatacgtaccagaaaaattcgaatgtggcccggagaatttttgttaaattctccttcgtctaaaaggagccctcaaattttacttgaattttcagagcacaaataataattaagaagaaataaacaaagttaaaaaggttttataaaaagaaaaaccctaaaaaagttccctttccctccccctctccctcttgggccggtccggcccagctccctccccctccctctcctctccccgcggcccattcggcctcctccccgcgcgcgtgccgctgacgggcgggcccgcccgcctcccacgctgacgggtggggcccacccgtcatccccttcctcccgccgttcccgccggctcgtccgtgccctagcgccgccgccggcgcaaataccgccgctcccgtccgccccgcgtgcaatcaagaggggggaaatattccccgtgattccctccctctttcccccccatttttccctccctctctccctcggattcgttcggaatctttccccctaaacctcgccggcgcatcaatggcggccggatcttccgcgcccgtttccccctcatccggccggcctcgctcactcccaaccctatataaacactccccgtgccttcctccaccgttttcgccactcggcgctctctctatctccgccggaatcgagctcgcgccgtcggtctctctctccgccgtcacagc

SEQ ID NO: 28279 - DNA, 338 bp, Oryza sativa
taactcaagttcttgtgagttgtttggcttgattggcttgactcacatggccttgtggcctctctatatttctatcactgggcttccccatatttgttttgtttcataaattaatttgttcacgtcacattatatacagttgtatagcattacattttcccatagtagtgctgtcaaagttacgcgatttccctgtatccaccaatagactttacagataacaatctaaaacaggttgtcaatactagtaccaccaaaataagcacgaaataaatatattttgataagtggaaataaatccagcaaaatgccaggttgtactttgtttctactatagc

SEQ ID NO: 28280 - DNA, 168 bp, Oryza sativa
tttttcgtttcaatttgttatcaatatatattagattgatttctaatctcagattaatttcttactattttttgttgttgttcgcatataactacgcggcactattgaggcgattgatgctggtcatggactcgaggcgtctcagtttccggtcgatcggccgcgagt

SEQ ID NO: 28281 - DNA, 1501 bp, Oryza sativa
acttgcaacttttggtgataagcttatttcgtttccttgctacagcttccatcagtgtcaaatgtgcaagtagaaccaattgtggtgaacattgataagcttgacctcgttcttgttgagaaggacaattctgaagatctttcaagcactagcaggcaaattcattcttctggctctggtctcatatggttgaatgagcacagtcatttactgatttcagtcttctctgtcattttgttttggtttgcagtgctttatcgccatcaccagctaaaaacagcggatatggatatgctgataaggtttatttctttgaccttgatgttcaacgtaaacacattccaaacttttactctgtaaaaaattcaatatgctgtctaaaaataaaaattgtcacttccagttatccatgatggttgcatccaatgcacctattttgctatctgatttgataattcttctatattcttatgtgatcttgtctgatattctgaaaagcaattctctgctcttttattacaatatatacaattttgaaaaaaaatacgtgcagaaaattgaactatggatagggcttaatttgctataccgtggttagattgcagatggaatgacagtccaagtcggtattgtgaaccttctattagaaacacatggtggtccacgtcatcaaggaggcgcaacttggtattcatctttgtttgaatgatttttggccctttttcttatggcttagctccatatctcagttcttgttcatttctcttattaatatctgtttcatgatgtagcttttccctgcaatgtttttctgcaaacaggaacattcattccatctttccttttcaggtcaccaccgctagcggctatcacatttcgtgatcttgtactgtacactacaaatgaaaaatggcaggtactcttgcaaattagattagcattaaatatagtaaatgattgcacttcagtacctgattagaatgccttttatataggctgtaaatctgaaagaagcaagggatttttcgaacaataaaggattcatttatatttttaaggtttggtactctccttttctctccagaagattaatgtttatttatgttgctaactgttctattgacatttcttaaaaaaaaaactgttctattggaaacataatgaactgagaaatgctacacttgaaaggatttatgaccacacacatttcttctttcaaattcacagaaattggaatggcaatcactgtcagttgatctgttacctcatcctgacatgttcacggatgctcggtttaactcttctagcagtgaagatggaaaacgagatgatgatggtgcaaaacgaatgttttttggtggtgaaagatttttggaaggaatatctggggaggccaacgtgagtgcttttgaacttcaggacatatcatatggaactcgatgtttttcttttcagtttctcttgaacttccctctttgtgtgcttggcttacacattgctt

SEQ ID NO: 28282 - DNA, 1501 bp, Oryza sativa
gaggagtattctccacttttgcttacatgcaatggcaatgtgaacgagctccttcacgtataaaagaaagttccatgtcaccaaaaaaaggttcacactctcattgaagctaggttaaccaaacattcagtgaacaaggaatttctccaacacacttagtttttcttcccacatcaacttataattcatccattgatcaataatctatcacatatgagtaggtattacgtatctgtgcaatctaaacctatatatgtgtgctcgtgttcatttttactatgcgattaaacactcgagcttggatcttgcaccctagccgtattcacaaaggggagtatttagcttcccctgttgagttccatactccaacagtactaaattagacttaatgcaattaatttggtgtggtagatgttgttaatatttttaataaacttggttaagtttttaaaagttagattagaaaaaaaaacataggtatttattaggtcttttcaagaaaatgcttaatgatttaatcaataggtcatcgggggaaaagaaagcgagggcttttcaaaaacaaatgtagttgtgtttcacagcattgatgattccaaaacctcgcacttgcaaaagccattcctcctttttatttgagagttgagactgagggaggaaaaaccatccccaaaagacagcagcagtagtaagggcctgtttttatctgagtttggtatgggatatttgttcgcacgtgaagaaaaaaactcattaacgtatgattaattaaatattaataatcataaacatgaaaaattgtcttatttatttttaaagatacttttatatagaatttttttagacaaaacacatgtttagcaatttacaaagcaacataaaacgatggagtttacagtttgtagctgaaggaaagaacctggctaagaatcatactgccaataattagagcaggtacaatagtaggctataagctagttataaacatattttaaagagagaaaggaagagagagaagagcagcgggctatagatctgtagccagctacagcacggacttcaagacgtaatgaatgtatgacatgtgggaccagttattaatagtatagtaagcaactattgtatgaattgactattacattggctatagatgatttagagttagtagtggcctatactattaaacttgctcttaatgacaatataaaggccattgttgaaaggaataattgcatatcccccaggggtatttgtctcatcttctatatggccctcctcctccacggcccacaacccatctctgtttctctctcctccgacctctactaaagaagagaagacaacgcctctctcctcactcctcccccactctctctctctctcctctctctctctctcgcccctcgcgccaccgcgccaggagctcgcgccgcgcctcgcctcgccgacgaagacgacgaggaggtcggtggtcgtggtggtctggtttggtgtccatcca

SEQ ID NO: 28283 - DNA, 351 bp, Oryza sativa
attccagtgaaaaaaaaaaagaggagaggggaggagaagagaagaaggggcgaagccctgccggattcagacgccgatttcaggtaatattcatagatcctatatcctatatgtgactattgagttaaatagtgtgtattctttaaaaatttgtttgaataaatgcattatatttttagggttttagttgtactaatcaagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagata

SEQ ID NO: 28284 - DNA, 1501 bp, Oryza sativa
gaatgcatcattgcatcagagtcacttgcaataaaatgaagcagtacaaattcttcagaaattagctaggaaaaaaaaacaaattcccaaaatatttgttgttaaaggaaaagagcaaagcatgtgatttttcattgtaactatatctgaaaatgtatcagcattctgatcatttcacatctgccaaggttcattcagcaagttgggaaagaggctcagaactgaagattcatacgagaagtcgtttcatctgtaccctgatgtctgaactattgtcgaaaatgatgcaatacccatctacaacaatatgtttttttaatacgcaaaaaaagaataaaactcttaataaaagataacattttggaacgacctagcgacctaatgcactataaaatatagcgacctagtaatacagtagtacaaaagctctgaatttatttgcatcggtcatgctctccatgattctccacgagctagcaatggcccatgggccatcggtgtgtgaggcccagtagattgggcttgggctagtctaaaaacaaagagttgggccgtgaggatatgccctagactttgtcatcggccgccgccgcctcgcgggcgacgagctcgtccgccgccggcgccgatcgtctacgcgcgcggcatgccatcgccgacgaggtctcgtaatggcgagcagcagcaagcgcccggctgccttgatcccgtgcggaggcagcagcaggagcacgcgccggcggctgacggccggtcggccgcctccgccgtcgccgccactcgggatgattcgtcgtgggcatctctcccggaggatctggtgagccaccacctgcccgcgcggccgtgtcgtcgccgtgcaagctgcgcggggttcgtcagcttcttcaacctctccaccggcggcgccatcgcccgcgtccgtctctctcatcttccgcgaccactgcgcgacctctgactctgataccatattaagtaagcatgttgcactttataggaaaagacaggcaattcactttatacactccaacaaccgccatcatccgcctcctccacccccttcaccggcggcatcgctgagttcccgccgctggacacctagctgccatacgtgagccatgtgaggtaagtggttttgtctcagagacgtcgaggcgcgcgccgctgtcagagtggccgccggtggagtcgtctcgctcacgatgtggctatttggaacggtgtatgtgtccgtcgccatctccggcgataagcaatggatgaatggaggatttcaacaaacaggagaatgaagaatttcttctccccattgtcattccaaggcaagctatatgtgttactctctctgtcccatttcaagtgcaattgtgagtttccgtattcaatgtttgactgtctatcttatttaatttttttatgattaatacttttattgttattagatgataaattataaataatattttatgtgtgactttattttttaattttttttata

SEQ ID NO: 28285 - DNA, 1501 bp, Oryza sativa
cgctaatccgttcaactactccaggtatgctctaacaactggcgatatttacttctttatctctttgcataatgttgctgtgagaatgtatgtataggcttgttactgtgacatcctttttgtaggggcaattacatggcttgattctatcagcaacctgccattgaaggtgattcatgcttcatgacaaagagatcaattttgtgttacttttttttttttggggggggggggagattcggagttataaaatatcaagttttatgcggtactttaacaagaatgtatgtgtaggctgaaaggtctttcatatgcaatgacactggggcccttattcaggatccacaaaagcgcttccaggtgtacaatgagtaagtacacacatgagactggtgaaccaaagcggtgttatttttgtataattttctgggttgggttctgtgatctgcttcttgattgcttcatcaagcgcagaagtctacagttatgagtcatggcacgatcattgtctcgtcattccgtcatgttgttccttttccgtttcagtttgatgcttatatttgtaatccaaaactactttatcatatattcatgcacttttttgcacagcaaaattgttaaattctctactcgtgaattgtctgatgtgaagagggtttcaagtcatcatctacgccttttaggattcaagccactggactaccttaaagattatcacaacttaagaccgtcaacatttatttaccccagtgatgaggtaataacattacttcatgtacttcttaacttcaatcttgaggccctcttggcacagctccggatccaagatttcttggagctgggtattccgagctccacaaatccatggatctggatctgtgattacgttgataaacatttggataaatcatcttgttcccatttaaaattttaaatcactataatttaatacacaaacttcaaatctaccgtttgagttacagtttgaagttatactagtacaattatctccttcatcttaattttttttgtcaaacacgcaggagagctgcgtagtcttgacaatattttgttatcttgttcgtttgttccctagattattgtacttctctagcttgaagcaataatataatagttgaaaaccttaatcattttatttgatgatattatttttcataataaaagatctatttgtgttcgatacacatccctgctgcatgctacttccaaactaaactaaatctgtctgaacatatttaggattgtattgtggtgtatgcttatttctttctcagtctttacttaaatctagggtgcatgttaggtttacctccttttgtttgatgcagcaaatatttggaagcactcgtgttttcgttgctttacatagctcaatgcggcgtcttggaaggttaagtcgacttattatatttctgccataatttctttaattttgaaagggtttagaaactgacatagttataaatggacataatgtatg

SEQ ID NO: 28286 - DNA, 1501 bp, Oryza sativa
tatacattttaatccttttcctccacgtctgcgcctcctaaataaataaatatgactcattttttcccaatatttcatttcttagttcctgtttgttttgtcgctaaaattaaccctaatgccaaattttggttatataaagatgttgatgtaatatttggtttagaaccttaccaaaattgggtgcagcatttttggagtgcaagctttcgaagttgccacaatttggggatttaattatttgacactctttaccatatccgtctcgtccttatcacaaagtggcaatttgccacccatctctctggagtggctaaaaggtattatcacgctaatatttgatagggtagtaatggccaatacatgtttggtttgttgcctttacttaaatttagcatcatcaaaatttgacacgtttagtttagcaacaaacaaaaccggccttcaattaattcttatacataactctaaaacaacttatattaaaatcagtaatgctacttctaggattgttcaagaatgataaggtgccacacatatcacataattaatcacacactaatttgagctttaagataaccaccctatctgttttagggggagaaaaacaaataacatcccccaatggacaaaatgtcaagatcagtgttcctttcttaaaatgcaaaaggtgtctgaatttgcaaggtgcagcatccccatcttaaaatttcacactgcatgctgaggtgagctttgcaacatgtaggtaagatcagatggattggacaccatgagtggacaatgctggccggataaaatcaagcaaaccattatccctgcttgccttaaggaagctaattaattaaagttcatttcacactcacacacaaacagcctctgtgtattctgtggcaagataattaacatggtgaggtgaggtgaggtgaggtgatgttgctgtccgccatgcattattaattagtgtcccccattatcgagctaagctagcgtcgcttttggattaagggtttggtgctttgtgctaatcgagcttggactaattagatccaggcgatccatccatcgatcgatccgtcattgaagatggccacttctcccctgtgatgacttttattttgctgctctatctgatactgctgaacggcagcagatcgatcgatcgcgatagtacgttgcccattgtctgactggggatggcagttagccagtagccagttactgctgagtgctgacgaattcacgggacagtaaccgttccaattcatgctactgccaccgttaattgctgctatctgttaatgagttttctttttcgtcccctcctcccatcttacgctcatgtacgtagcacgagagaaaaaaaaagtgttgaaaatgatgtccgtggtatatataatatatctagccaaaataaatcttatcaaattttggtaaagttattagatagtaaaaagtacgaattacccccccaaactatcgtggtcgtccgaattacccc

SEQ ID NO: 28287 - DNA, 1501 bp, Oryza sativa
tgtgtcgatcttgtcgacctgtctggcgacattgtcaagcagctgatcccaaaaccccaatcccaagtggggagaggcatggttgtgagtgcgacctcagacgacctcgtcttcctcgacggtaaggagcatagcattcacctgctcgaccctaccaccggatccatctccgccttacccaccaccgaatccatgtccgctttaccccactatggcgacgtcagtacagactgctcaatgctagcttcttgcctggtttgcatttggccaggtagcatctcccacatgagagcgtaagctagttcagattgtgaagacattgagagatcgttacgtgtccgaggttatcaccgtcagccgccgcggcgtcggtggacagcagcggaggaaggtggagaatccacctgtacagcttgattgtttctgcaccgatggagttgtgttcaaaggggctgcttacttcaacttcgatatcctccaatgttcgccctccgttctagaggcaggttgcctgccttccttcgacctcgcgatggagcagtggagtatgaccctctaggggccggcgaagagcattgttgaggaagccaatgacagacttagctatcatgaccttgactatcattttatgttggctggaattaaagacactttgtgtacagcgcattgggattatcatttttatgtggtggatctatggtttctaactgattctgaaaagggtacatggtccaaagagtacaggattaatgttgatccatctttctatgggattggagattgtgtgaaagtgcatccgttgcttgtgacggatgagggaaatgtagtactctggttgcagatgccatcggaagggatagtgcagatttataatccagtaactaacactttctgggatataactcaaacgagcatctataccggagtaggtgtgtacactggaagtttattatgtcgagggagtgtgtgacaaggtaaagattggtctcacatcatcatatagctcgtatccatggaattgtttggttatgtttgtgcgctttattggtttagccacatcaacttcatttggttatttatttttaaataacaagagcagttttattagttccgtttaaattttcatcgtcttagttgtttttatgatgctaaaaacttccgtaaggtcacaaaaatatgatgatctccaactccaattaggaaatggcctttgatgacctgtttcatcggaaataaaataaaatccatcattaatcataatgattcatattcattgccttagttgcttttatgatgcaaaaaacttccacaaggtcacgaaaatatgatgatctccaactgcaattagcaaatggacctatataggttgatggtctttttcagaaataaaatgaattcagtcagtaattaaacacttgatcatctattcattgagatgtattataattatgaattgctggcaagaggcaattcttgctgaagttgtcgcttaaggaggatt

SEQ ID NO: 28288 - DNA, 190 bp, Oryza sativa
atgcatatcaagcctagaggtcttaaattcgaatcacgactgactacaagtttttttaaaaaaaaaaagaaaaaaaaacaatggctgactacagttggcagccttcagatggacctcataaaggaagctgtctcaaaaaggaccaaaacacaccttagaattaatcgtcctagtgttggtttgtcctagt

SEQ ID NO: 28289 - DNA, 217 bp, Oryza sativa
tgtaatgaagaagttgtttgggggtggttaaactataaaagcgataaaattcaatggtccaaagtaaaaagattggtttactggtgattcaaagaaaaactataataataaaatatagcctaaatttcaataactatttttttatgaaggaagtagcagtatggtagcatggaaatgaaacgatggactaataaaccgagccatcatcatgtctagc

SEQ ID NO: 28290 - DNA, 1035 bp, Oryza sativa
cgctctctcaatctcacttctgtactccctccatctaaaaaaattaatctaaaaaatttaatccagtgtaaatctggacacatataactctattatagatgtgaatctggatacacacttagaattaggtgtttttttgaaacgaaaggagtacgcaagatatacgtatgtatatagagagaacaaaccaaatatatttgtatatacattagcagcagatcaagctgcctccaccactgtacgtatgtatatgtatacacactggtggagacagctcgaccattaccatttacgaactgccattaacatatgtaaaatttgatcgattcgttgcttctttctttattacaaactgtcatcaatatataaaaaaattgatcgatcatcgtgaaacgctattggtggtttgggcttaagaaaacagtatgctgcacacggcacggatgaatgatgctgggaataccttcctatacgtccggacacgaatgtctagctatagctagtagctgcatatatattcctctcgagaagtagaagatataaggatgtgtttggataatggaaaatagggggtgggattgggattggaaaatgaataaagggttaggattaaatggaagagggagaatgaatggttagtatttaaagatgggtgggaaatcatttccctttcccatttgccaaacactcactaagagcaagtataatagtgagctataagcctactataagcttagatggaggagagaggtagcgaaaaattaagaatgttggctctcatgcaagagctagcttatcactagctctaagacaaatgcattaaatatataagtgagagatagagagatgagaagaaaattatagtcaatcttatagctaatctattatatatgttggctttaagatgagctaataatagaaagtgtgctctattattatcttgctctaaagggaaaaaaaaaggaggaaagatggtagtaataaaaagctgggacgagtggatcgatccatgcatgtgttgttgcgtacctgcga

SEQ ID NO: 28291 - DNA, 246 bp, Oryza sativa
  unsure (1)..(246): unsure at all n locations
aaggctgaancctnactgtatagagacactatagaatactcaagctngacttgtattcttgttttcgtcgattgaattctatttgcttctctgaattattccaatcaaaactaatacttgttgttctctgaataactgttcaattaatagtagagattcagtaattctttattcaagatcacggatacacatactatataacacactatgcccaaaagaagaaactaaaatcggttgtatttttct

SEQ ID NO: 28292 - DNA, 156 bp, Oryza sativa
ttatattgcaaactgcggccaacatttcatgtgtaatttagagatgtgcattttgagaaatgaaatacttagtttcaaattatgggctcaaaataatcaaaggtgacctaccttgcttgatatcttgagcttcttcctcgtattccgcgcactagg

SEQ ID NO: 28293 - DNA, 1362 bp, Oryza sativa
tccaattagtctctccaacttgcacgcatgatcatcagtctggttcattgagtaaactcacgtatatattctgctgcatgccactagctctatacacatgtagccagctatgtattttccgcccgtgctccggctgtgcggcgacatgtcttcgatcgccggcgccgacgtgccacaccgtcgctccataccggccggcccgctggtcccaagctggcatgcagtcggcggccggcgccgttggtcgacatcgataacgattgatcatatgccgccgccgccgccgtcgcccgcggccggccggccggccaccggaaaagatgggtattgagcgtgtacgtgcagtggacattacacgggatgtgtacgcggtacgttgaaggaattaattaatttatggaagactaattttccttttattaaaaaaatagaagaaatacttcttccgtcccgaaataagttaatctaatatggaatgtggtatttcctactattataagtttgaacatatgtgtttgtctaaaatcgttgtattagaaatatcacattccatactagattaattttgttctgacgaaggtagtaggaagaaggaattaattggtaggaagattaatttcctcagacatatatgagtaagaggaattaatttgtaggaatattacattacgtcgatcgggagagagagagagatcgatttgttgcggtggatgccgatgggagtaagcggcaggaggcctcaaagtccgggaggtggcctgcgcgggtgcacgtgcgcgcgccgcgcgctcatcagcagctagctgcggcttctatcccggccggcacctgactttcagggatttatgctattttatttatatacactactactgctgctggataattcattatgaattcctgctcacaccttgtttggttgttaattcctaatacaaacccagtacacatatctaagaattataatttttttagtttcaagtactttttttgaaacaaatatgagtatatccatattaattttagaagttgagttgaaattattcgaaggtctattactgtatctatcctaaaatataagatttcactcatgcatatatagttgtatatatggacaaagtctctcatattataatataagtagtcaaagtttaaacatgttaactacatgtatctaaaatgtcacttattggtcagtggtggaagcaacttagtttttagagttaattgaaaaagacttcgataactttcgttatgcaagcttggctttcggttttggaccgccgctcatgagtcatgagccgcacaaccgcaaaaatgctttccaagcagctccaaattatttttctgtaattattaagt

SEQ ID NO: 28294 - DNA, 1501 bp, Oryza sativa
tgcctattaaaacgtcaacaatacaaatatataagtttacaggaatcctaattcgcgcgtatgcgcgacttctccaagtcgcgagcgtgccacgtggcgggtcctcctacgaccgagtctgcgcgcttcttttttcttttttattttctttttttcggtaggcacaactgccgtgtttctttcttgtttttttcttcttctttttttgccgttaactaccacacacgtctaagagtaggagtcaatatttgaaaaaattcaattcaagatttagaaacttttaactcagatttggaaacttttaagtaaaaatttaaaaactttcaactcagatttgaaaactttcaattcaaacttgaaaactttcaactcggatttaaaaactttcaactcgatttgaaaacgttcaagtcggatttgaaaactttcaactcggacttgaaaactttcaactaaagatttgaaactttcaattcaaatttaaaaaaatcaagtcaagatttgaaaacttaactcaggtttgaaaacttttagctcaaatttaaaagctttcacctcaaaattcaaaatatttgataaaatttgaaaactttcatctcaaaattcaaaacattcaacttaaattttagaaacttttcaactcaaattcaaaactctcaactgatattgaaggtgaaggtgaatgtcacgccccgaaatagtcccgaccggaactagcccgtgacgctccaaattaacctgttaatcgataccagtcccaggaaacagtgctggtatcacagggagacagaatatcacagcaacagaggtctttttattatagagtagtagtacagtcatgttgggctgcggacagaccccgagctcacaactgcattacaaaagaaaaccggaagcaggacttggaccaatcaatacaggcgcgacttgggaactagcccgaaaccctaaaactcatcgtagccggcttgctcctgaaagaactcctcatcagcaggatccgcttcatcttcttcagcaactaggggggaattatttatatagagcaagggtgagtacgggagtactcagcaagccaggggaaataagtgtttaatgcaggcttcaaggagagactggtgtttttgcaattgattttatttgaactcttttctgaaacaactaagtgagtgcttctcaaacgacacggatgagacagtgcgtctcgtccggtcggagtatgtgccatgtatcagtctttagaaatgaaaacaaggttggcacccggccaacagcttttcaacggtcacccgggccaacaacttttcaaacggccacccgggcctagctgatcccatcagctacagattttcaaacgtcgaaccccttttcacaacagcaatttcacaagcagtagtcaaacaaaactacgctaggaatcacctcacatccgcccatgaccgtgggcacggctgttcgaacagtttgttaacctctgcagagggggtacactttacccaca

SEQ ID NO: 28295 - DNA, 343 bp, Oryza sativa
cagtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctact

SEQ ID NO: 28296 - DNA, 199 bp, Oryza sativa
ctttccagatacagagggagagcgagagcttgagatttcaccctaagcccccggccgaactggcaaaggggggcctgcgcggtctcccggtgaggagccacgagctccgtcatctggcgcgccaggtagggggctcagcgtgtgttttctgagctctcagactcttccgtgtgcgccaagtttttcttgttcagcctaa

SEQ ID NO: 28297 - DNA, 158 bp, Oryza sativa
cccgggttcgccaagcggaggaagctgctcgggaggagcccgccgggctcgccaagccgaagaagctgcccaggaggagcccgcccgggctcgccaggctgaggcgacagctgctgctggcgcgtcacttgggcctactccctcgggcggccctcagg

SEQ ID NO: 28298 - DNA, 1501 bp, Oryza sativa
catactcttgttcagatagatacatagtcaaaaattgttatattctgatacacggacggagtatctggtaccatcatcggtaataagtattgggtgtttataagatttcaagtacaagattaatttgatcctaattttcattatatgatcgtcctggcggctgtacaagctgatcgagttctttgatctcaatggataatcaactaaccgtgcgtgtggtagttgcaattagttattggattctttgctatctgaactatgattaatgccgatgctgaaacagtagaaaaataataggaatgcatatataggccgcatataaccctcttaaaactttgatattttcctgacaaaattaaatgtttatatggtaaatagaggccgatacaggtttggtccaggcccaaaccagcccacggtatattgtgtgacatcccggcgcagggcttaatagaatactcatatcaacaagttaatctataaaagttgcgcacgaggcgggtagttacatattagatcaaggcatgcctctgcatggtgaaaataaatgcctctaaaggggtagcttaagacttggcgctgatgataattaattagatttattttttcacgaacgcgtaaaagattgctcgtaaatatatggtaagtagatttagatgtaactacaaggtgcctttgatatctcaagggatttgaccaatcaaaagcagataattataaatatttgatctgtagtcatcttagataaactaatctagttatgtgttggctaaaattgagacaccacactttttcacttaatttcggtcatttttttcctatttgattgcttcctctcctatatgtaaacatgcttatttctcctatctcttcttccaaatggataataaattatttttaatcctaattctcttatacatcgtgtattagaaaaatcacaatgaaaattacaatataattactctttaaatttgaaaaggcacaatataattataaatgcaagaatatatagtttatacaatataaaaaacaatttgattgttcttttgtgaaaatatgacgctataagtataactactctcccttttgagataacgtgactctacaacagacgagagaattattgccatctatatttggtgagtcccagccgtatctatagattcaatgaatatggccacatgcccacatatagctagcactaatatataccatatccagagacatttacagtatataccaggccccgggtcgcccgggccactaagatagactttatgctccttcggttaaaaaaattattttaacttttagacaagtttttatcatacttttagactttggccatcataataatttctcaaatgcttaatgtaaaaacaatgaagtgatatgcatagatatatcttgaaagatataatgatatcacagatttattagattttttactcttttttaaattattctaatagtattggtttcaaaagtcaagagaatatta

SEQ ID NO: 28299 - DNA, 1501 bp, Oryza sativa
taatgcaagcttcaaggaaaggctgtttgtttttgcgattggttttatttgaactcttttctaaaagcaactaagtgagtgcttctcaaacgacacggatgaggcagtgcgtctcgtccggtcggagtatgtgcaatgtatcagtctttagattttgaaacaaggttggcacccggccaaaagctttttaaacggccacccgggccaacacctttcaaacggccacccgggccaacaacttttaaacggccacccgggcctagctgatcccatcagctgcaggttttccaaacatagaacccagtttctcaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcatccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccggtacgttccccggtccgcggttttggaaattcatttagttcacaagcaccgacccaagtgtcgggttttccaagtcttttgtaaaactccagttttacccaagttgttactcaaattttaagtttgaaggcgaccgtcgatattcgcacagagtgcacgattatcgaggcgcatctgggtggttacaaggggacatggtgtagcaattttcaacggaaggatcaattgcaacaagttaggtaggtccgccaatctgccttgcagacgggacaacagattaagtgtgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaacggaacaactcaacaaacggcgaaaataaagccctattaatgacctctaagcgtgccattggatagatctcgagatttgggaaattttggaagttgaacggagtcaagcggagttatggttggaaagatattgaatttctaagattattggatttttggtctaaaggaaaaaggatttaattaaatccttttttggaaaaaggaaaaagaaatgatgaagggagggaatctagactttcctcggacggctagggcgcggcccaagggaaa

SEQ ID NO: 28300 - DNA, 652 bp, Oryza sativa
aacctagatgacacactttgacaacttctgggacttagatatgcattttgagagtttagggatctaaatgacacacctctataagtttaaggaccgcctgtgcactttactcttttaaatatataagcacccataccagattttgctcttgttcagcaaattagtttgcctttaatcatgaaatgtccatcttgatttgttttggaaaaactgatggtcagaaatcagttagtgtaacttgacttgtggaggaaacaagtatcatatgtaggtatcatccctttacaagacaccgacagctgacagcccaagttttttctctctctctaatagacagccctaatgatatttcttaccatgatcagggtagccctacagagtatttgacattgattatggcctgttacctgttattagacaccacatgtataatttggattcactgaatggtttgtgctacgtcttgttactgatgactgttaatcattatgttgctttttctacactgttagaaattttatgacatggcagttagcgtagtagacaagttggatcaatttattaatttaactttgcattagcagggtcattttcccttttgctaattattgttgccataccttctcactgtccaagtatcaacttttatagg

SEQ ID NO: 28301 - DNA, 1501 bp, Oryza sativa
cactctcgcacttaaggaccgattccttggaatttcatccaaacataaggcaagtacgaccacatgggtggaatgggacacccctggctgagtaactagcttatcaggggagccttgatgccgagagacttgtggatttgccggggtggtgtcagggaggacccctaggcttcctggcacagtatggtctaggacctaacctgttgttggtctgggacccctctcgtcggcatatggtaaacctgtgtcggctttggaaatgccttgtcatgaaagcttggaggtctcccgacgtggttgatccccacgggctgggtgatccgggttagtaatgtcgtgtgggtaaagtgtaccccctctgcagaggttaataaactgttcgaacagccgtgcccacggtcatgggcggatgtgaggtgattcctagcgtagttttgtttgactaccgcttgtgaaattgctgttgagaaaatgggttcgatgtttgaaaaatcagcagctgacgggatcagctaggcctgggtggccgtttgaaaagttgttggcccgggtggccgtttgaaaagttgttggcccttgaaaagctgttggccgggtgccaatcttgtttcaaatctaaagactgatacattgcacatactccgaccggacgagacgcactgtctcatccgtgtcgtttgagaagcactcatttagtcgtttttagaaaaaaaaaagggagttcaaataaaatcaattgcaaaaacaacagcctctccttgaagcctgcattaaacacttatttcccctggcttgctgagtacccacgtactcacccttgctctatataaataatccccccccagttgctgacgaagatgaagcggatcctgctgatgaggagttcttccaggagcaagccggctacgatgagttttagggtttcggcctagttcccaagtcgcgcctgtgatgattggtccaagtccgggcttccgctttccttttgtaatgcagttgtgagctcggggtctgtccgcagcccaacatgactgtactactactctataataaagagacctctgttgctgtgatattctgtcttcctgtgataccagcactgtttcctgggactggtatcgattaacaggttaatttggagcgtcacgggctagttccagtcgggactagttcggggtgtgacaagagatggtatcagagcacaggcttggccctagggcgaaacccgatgtttaggacgaccctaaggatactaagttcaaaactacttgcgaaaagctaaggcttcttttggtttccttattttcaatagtttgtttctaaaatggttactgatctttctccctctttcaaaattgtagatggcagtgaacgccagcttcagttcccatggttttggtgagggtcaccacgtcgctcagcttcgtgacctcgcccgtttccttggcttctcgtgtcccgagtacacggggtactccgtgggccgtgttccccctcactg

SEQ ID NO: 28302 - DNA, 1501 bp, Oryza sativa
acagtcccatatggtagcaattttttccttcttggatatggttagggctatttctctaacaagatcatgcatctgggcttctggaatctctttggccttccttccatattcattcatttccaaaacctgaagcaatgatcgactagcaagttccttcaggtgacaatgctgctacatctgccattggtgtctcaggttctctgtcctgaacagtttcttcatctattcacaatctgattaaccattttctgtcgatccgataatcttcagggaacaggccgcagtaaagaaagcaattcttgaggtaaaaccaggttgattgtaactgagattcttaacactagtgtcccagctcagctctggattgtttactcagctgccacctaagttgattatagaacaactcccttctcatgctcctccatttctttgtacgataaaaggctccctatagctacaagagccagtggcaaaccttggcatttctccgtgattctttcagcgacagtcttcagattaagggggcaatttctgtcatccaattttgagaaagcctttacatagaaaagagtccagccttcctgcttcggtagaaccatagaatttcatggtctgcaactgctagagatgccacaatttcgattcgagttgtgataacaacttggctgccattgttgttcttaacaattgcatgaccgttcggtgtggcttcagtcagttcagtaaactggaggaattatttttttactccagagaagagagagagagagcagagcagagttcatctgaaaaatctgacaaaaaaaactctctcacactctctaaaaaagagacattctaacagagaactagcaagggttgggctaaatcaatttcagtgcttctctaggtgacaacctactgcgaagtgaactgcagttagtgcaccctaagtattactaagtgctgaagggggaaataaatcatatcagaatagagaaaccaatctctgatccaaccatctgcaaagacaaaaaaaaaaaaaagcgaagaggcacagtaaacaggtggtgtggaactgtggataacttgcatgttaacatagtatcttatctcaagctttgccttttgtgcttaagcattattgactgcattaccaaaagatacataaggttaattaattttaaattcgtccatgtgtccaagtgagacaagtccttcagagctttcttgagtacggatttgacattaatgaaccatggatagtatgaattgcatacagcaaattggacccaatacaatggcagacacaatcttcaagtgcatgtctcaaatctttattgcaaacaaagaaatgaatataaatgagacactagtatagtcgtggataagttttatggaattaatgtacgtagctgaaagcatttcgcatcaagataccaaacaggcatgtgttaaaaacctttccgatgtatgatatcaccagatatagaacaaattttgccaaaaagaaacagtgttc

SEQ ID NO: 28303 - DNA, 1501 bp, Oryza sativa
gaggcccactaagccgtaattgtcattatcttttttatctgtttatatactagtgggtgaaaaataaactgatgtgtatgtcttacgcatgatagcatgctgcccgcttgcattcctagaaaatacttcctccgtttctccgtttcttaatgtaagtcattctagcattttcatattcatattgatgttaatgaatctagacatatatatttatttagattcattaacattaatatgaatgtggaaaattgtagaatgacttatattgtgaaacggatgaagtacttttgaagagataatatatattagtgggacaatcgactttggaaaagaaaaattcaccaagtaagagctctagtttattctctatgcaattagaaacacacgaaagtagtccagattcagaacaaaccatatgtgctaggcgacatcattcattcttagttaagctctatagaaccatatgcattgaacattcctatacgcttaaatataaaacttgtatttgaaaaagtccacagtgaaagctcctaatctttctttttttaaaaaaatatcttaatataatatttctccattgttcctatatttctaggttcccgcatggcccatatgtgtaaagaaaaagaaacctcacgtcagtgttgtggtaaatatgtgatgtcgtcttttaaaaaaagatatgcggtgtgttttttttttcaaaatgtactccctccgtttccggttataagacgttaaactattttaaatttgactaattctacagaagaaagtattaatatttacaacaccagcattgtttcattaaatctataatttaatatattttctgtaaaattagacaaatttacagtagtttaactttaagcaaagtcaaaacgtcttataacctgaaacggagggagtatattctagagttaatgaaaaatcatgctctcttattggatttttgaaataaaaacatgggaatcgcatgcctctccagtccctagttggcgaaaagaaacgaaaataaaaaaaacaaaaacgttttctttctgaaaggcaggcgaagaaacgcatctgtcacgcagcacttccacgcgttgctaatcacacaaaagagagagagagaaaccaaacgaaacgaacgccaacccaagccaacccagcccaagcgagaggaagaagtaaacacggcaaataatcaacaccgcattaaaaatcttccatccaagtcaagcctcaagcgactcctcccccctataaaagccccctctcctctcctccaactctctcctccccaaagaaatcgcttcttcttccgcctccgcctcccatggcagctcccagctcgtgggacacctccttccacgaagcaaccacagcaaggcaatagcgccacccaccgctcgcatccacagctgctgattcgtaggaggagcaggccagggagggattcgttgattttatttggcagggaaggagatccgagaggaagaaggggaatatagatcga

SEQ ID NO: 28304 - DNA, 1501 bp, Oryza sativa
ataataataataaaattaaaatagcatttacccgttgcaacgtacgggcattttttctagttagataaaaaacctagaagatagattaatataatttattaaaacaactattttacatattttctaaaaaaatacatcaaatttcgcagtttggaaagcttctgtatagaaaataaaagagcagaagttgtgaaatgtagagatgtttggttgggatacactattgccaaagtttgccataattccgttagctaacacgcctaacatgtgcttaacaaatttgaagccacactttagctataagagagcaaatttgacatacttttatatgccaatgacatgtgaaactcatatcacagtgaatgaattttgccttaagtatggcacaaactaaacagacgcctaacttagtaaaacatgcctaacttaagttatggtatggtgaggtaaattattattgtgaaccaaacaatttcgtagtgcagaacacagcctaaaccagctaaagggaatgtggagctgctatcttctcaagaaaactgtcatgactcggtctgaattcgaagaaaataaaataaaatactactactaattttttttctgtattgcatgaaattattcaaattattttctaagaagaactagagagtataaaaatgttatttcctttttaaacttctagtattttttttaaccgtagagcgtagcaaaatttcccagaatcatttggcacagtcaaattcgaacagaaatcaagaaaaatagaaccatttggccaaatctggaaaatggaattttttgaattggatctaactcctgcaaaacttctgcgtataaagatcaacgaattagcaatttagcacaaactaagaacaaaaacttaaagttcgctatgaagaggtgctaggaaggatatgcaaatatacattgcataggaaggatatgcaaatatgcaacgcaatgtgacgtgacatagtaacttcagttgcaaccacattgatttatttttgttaagttattattgcatcatgtgtttaaattcgaatagccagaaaagatgatacattgtcagtttgtcacacggggtaagacaaaatccaagctcagaatggcaatagcaataatgatttaactatgttttcggatcaataaacctaaccgaatgccattccctaaaaaaaaaaggctacactgttagttaccacaaaagtactaacgaacagagttttgagaaaactagtaattatatacaactttttagtttgttattcatggtgtgtttagattccaaaaaaatttggccaaaaatgtcacatcaaatatttggacacatgcatatagcattaaatgtggacgaaaaaaaatcaattgtacagtttgcatgtaaattgcgagacgaatcttttgagcctaattgcgccgtgatttgacaatgtggtgctacagtaaacatttgctaatgacgaattaattaggcttaataaactcgtctcgcagttta

SEQ ID NO: 28305 - DNA, 1501 bp, Oryza sativa
atttgcctctgaacccatatgtcatagacacatatggatccacatttcattgagataggggtggcaaatagttaaataccaaatttaaaagtggcaaatagttaaatgccccggaaaatgttagctcgaggtcctcctcttttattttagtttttaaatcgtactttgaacaatattacgcaaatcccattaacttttaaaacatttgtaaatgaggtccatcgacggtattgtttacggttttagctgaggtggctcttttgactaggtcttcgtcccatatgacatttgcatgacgcttacgtggcaattcaattcgataaaaatcgtggagctcatgtgtcagtttaaccaaaaaaaataattaaaaaacatggggccttacgcgggacccacatgtcatctcattctcattttctcttccctttccttcctgtcttatgttatcccttccccactcctctatttctctcacacactcctctcaggctggttaatctcagcgcaaagacagtttgtgctgagttcacggtttatttcttgttaaagtgtcttgtactgtatagtttcacaataagttttttgaaaaggaccatttaaaaaaaaacgggaggggggagagagtaggaacaggggacccgtgggctggtctgtcgggacaagttcgcggcccatgaaatgaaatccggccattaggcccatcccagtcatggtgccctgtcttgcatgccatttgttcgaccgatggaatccagtgtcgcacgctaaatcctcttctgctcttcatccatccgatcactctgaatccaagtgaatctccggattaggatcggccgcgagttattttgctctgtgaaagttgcttggctgcgtatagcactcctcattcatcaacatcgtggtgaagagaaacgaggggctcaaaaatcaaaggcaaattttactacagtacatcgtggctttgcagttttaactgcaggacaccaaagtgactttggggtgaagacactttcaaaagttggatatttgctggtggacactggacccactaaaataataatttttggtttaagaggagggagaaatcgtgtgaaatgtatgaaatgtccttgggcccacatgtcagattcccatctctcttctctctctatcccctccttccacactggcacacagccatgcgacgggcttcagggggcaggaggagggttgtgacgagggggacagcggcagccaacggcctaggccttgccgggccagatcggcgtcgccgccacggagcccgcatcttgccaagaccttaagagtggcatttaaatgtcgttcacgaaatcaacacgacatgttgtttcttgtttataggataaattatatgaatatagccacatccactatcagggccggccctggccctatggagccgaggcgaccgccgggggcccatgatggtggggtggggggcataatggtggggggcaacacctaatactagtagtctagt

SEQ ID NO: 28306 - DNA, 318 bp, Oryza sativa
agtctattaggacttgatatctaactggtatcatcctgtttttgaacggattccggtatatagcagcttttttttttcaatgcacggtatattcatcagctggttggttatttagccaagaataaaaagatagaaaaatgttcttcctaggcccgagggccgagagctgttcggtatggccgggtggacgcgttagcccttagcagcttattgggcctgaaaagccgaaacagtgaacgtcgtacggcccattaaagcccaggcccaaaagagcccacccacctcctctcttatctatgggagacgcgctctccctct

SEQ ID NO: 28307 - DNA, 202 bp, Oryza sativa
acttttctatgagcgacttaaaaatcaatttcagaaaataaactatgatgaagaaaacattaaaattaactccaaaattaagttttaaaatctaaaatttggttgtagccttgtaggtgataacttaaaaaacatcgaaatccttccctatgacctgataacttgaaaaatgctggcttcctagttcctactcatgcacagc

SEQ ID NO: 28308 - DNA, 1501 bp, Oryza sativa
aacccggcggcgtcggaggtgacgaactgcgtctcgatgaaggtcaccttcacgccgccattgccattgcaacccctctccatggaatcgaatccgatcgaccgatgagatcagctcgatcagttgcgaccctttccccttttcttctcgattcgattcgaatcgacgaaaagctctctcaactcaaggttgctggtgacgaaatcttcccgtgccgatggggtttttatacagagcgcgcggcggcggcggcgcgaatgcaatacatacggcacagatgcctgcactatccgaatgacatgtggggtccaggttaggtggggcccacgtggaggtgagggtgtgggtttttcgctggatgtgtgactggtgggttgaagctttagcattagcgacaaggtttgactggtcgtatccagtgagtgactgggttggtggtcagtgacggacaacggtcaacctttctgggaacggtcaaggctcactccctgcctcgtgcgaggaggaggttcactgtatccttatcctattcttctctgcgttctcggcggcttcgcaccgatccggtaagagcaacggtaattaatgtcgttactcctccgttttagttatttgactaaatttataggtaaatataataataaatttataaaatgatactatttttttctacaaatttaaccagatttaaaacagtttgacttttgaccaaagtaaaaacgtcttaaaacctgaaacggatggagtgatttttataggtatgtataactgtttaccttatttaaaattattggtatctatatataagttataaatgcgattgaattgtttttaatgataaaacaacttataatgaataatcagacatatgttggaaatctaagcccgtcgcttattacagaaacggaaaagagaatttcctgtgcttggctcagctaccgattactataatcctttgtgcaatttcatttattataattgtaagtacatttttttcttgtcttgttagcaagagtcgaacaatataagtggcgaagaggatgcgggaaagaagaccacctgctcctgctaccaagcattagtcttgaaaaaatttgataaaaaagttatcttcagacttcggtctcagtttctgtctgatccttctccaccgagcggttttcacaaaaattgatcgattttcacgaaaccagtagtgtcaattttagttggtatttttacgatgttgactgaaagctattagtttttatcggttttaggtcggtatacaataaaccggtcaaggatggttttaatattaaatacggaaaggtaaaacctgccttcacctccaggctccacattatagctggaggtgatgagggagaggacccatctccctttcgtatttactagtatttagagttttctcaataaaatgtttggaggatttgttaatctacactaatcgctagtccgtattgcatggatattgttattcctatagttggccataaggtcg

SEQ ID NO: 28309 - DNA, 775 bp, Oryza sativa
cctttgaacatcttgagcctgtatttgaaatttaattatgttgcttgaaaaatattatgcattgttaggatcgcacttaatctgttgtctcgtctgcaaggcagattggcggacctacctaatttgttgcatttgacccttccttcgttaattgttatatcatgaacccttgtaaccatctagttgcgtctcgatattcgtgcaccctgtgcgagtatcgacggacgccttcaaacttaatatctgaataacaacttgggtaaaacttgggttttacaaaatacttggaaaacccgacacctgggtcggtgcttgcgaactaaatgaatttccaaaaccgcggaccggggaacataccgggtgtacggtttcccactctcgcacttaaggaccgattccttggaatttcatccaaacataaggcaagtacgaccacatgggtggaatgggacacccctggctgagtaactagcttatcaggggagccttgatgccgagagacttgtggatttgccggggtggtgtcagggaggacccctaggcttcctggcacagtatggtctaggacctaacctgttgttggtctgggacccctctcgtcggcatatggtaaacctgtgtcggctttggaaatgccttgtcatgaaagcttggaggtctcccgacgtggttgatccccacgggctgggtgatccgggttagtaatgtcgtgtgggtaaagtgtaccccctctgcagaggttaataaactgttcgaacagccgtgcccacggtca

SEQ ID NO: 28310 - DNA, 1501 bp, Oryza sativa
cggcgtaacggcgggcaagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcccccgagacggtggctgtagtcgtgggccaggcgacgaagcgcagtccaggagaggtcctggtacgcgatctggagagtgggcctggccaaagtgaagtggtgtgggcaaggccagctccgtgtatacctccacgggggtagaggtacacagagagctcacagtgagggggaacacggcccacggagtaccccgtgtactcgggacacgagaagccaaggaaacgggcgaggtcacgaagctgagcgacgtggtgaccctcaccaaaaccatgggaactgaagctggcgttcactgccatctacaattttgaaagagggagaaagatcagtaaccattttagaaacaaactattgaaaataaggaaaccaaaagaagccttagcttttcgcaagtagttttgaacttagtatccttagggtcgtcctaaacatcgggtttcgccctagggccaagcctgtgctctgataccatctcttgtcacaccccgaactagtcccgactggaactagcccgtgacgctccaaattaacctgttaatcgataccagtcccaggaaacagtgctggtatcacaggaagacagaatatcacagcaacagaggtctctttattatagagtagtagtacagtcatgttgggctgcggacagaccccgagctcacaactgcattacaaaaggaaagcggaagcccggacttggaccaatcatcacaggcgcgacttgggaactaggccgaaaccctaaaactcatcgtagccggcttgctcctggaagaactcctcatcagcaggatccgcttcatcttcgtcagcaactggggggggattatttatatagagcaagggtgagtacgtgggtactcagcaagccaggggaaataagtgtttaatgcaggcttcaaggagaggctgttgtttttgcaattgattttatttgaactcccttttttttttctaaaaacgactaaatgagtgcttctcaaacgacacggatgagacagtgcgtctcgtccggtcggagtatgtgcaatgtatcagtctttagatttgaaacaagattggcacccggccaacagcttttcaagggccaacaacttttcaaacggccacccgggccaacaacttttcaaacggccacccaggcctagctgatcccgtcagctgctgatttttcaaacatcgaacccattttctcaacagcaatttcacaagcggtagtcaaacaaaactacgctaggaatcacctcacatccgcccatgaccgtgggcacggctgttcgaacagtttattaacctctgcagagggggtacactttacccaca

SEQ ID NO: 28311 - DNA, 445 bp, Oryza sativa
caccgccgtcgcctagggttagggttcaggactgggaaatcgggttggggagggagatggacagctgggcgcaggggtagattggtcttttaaaaaattatctgacctcttttgcctcaaaaattataaaatattgccttcggtgtctcacagccaatttcacaaatttcgtagtgtccgtgggcaaagccaagattttgcggtgtctcacagccaattacacgattttcgggtgtcctatagcaaattttgccttatttcaatgtatatgctatgcacatggtagtctttttcttcaaatctcaactttcaccaacagtgttcatataaatatggctgacatcaaattcaaatggtgctggtggccatgtgttctaaagcaaaccaagctacatagcctagctattcctttccacattgagaaactgctctgtatataactagt

SEQ ID NO: 28312 - DNA, 783 bp, Oryza sativa
caccaaatgtacatgttttaaaatacaaccaaaaatcctcttttgacaaagcacctaactcgattggtttgactgtgcctatcctctgtgcgagagacaaaagtctagttgtcacaaggatcatattaccttttggatgatttgatttcaatggatccaacaaaatattccatctgtaatcatccatgctgtcccatacgtcatctaaaacaagcaaaaactttttcgactggatgtccatatacccattcaaaatctcctgaagctttgcaaagctacttactcctttccgtatttcttttctacagggagattcttcgtgtctttcttgagagacaaaatctagaatctccattgtgatcctcaattcatcatagttatcagacacccaaacccatatccgctcaaagtcacgtttcaccgttggttcgttgtatacaagttgagcgagagctgtcttcccaactcctccgatgcccacaatagggactacagttactccgtcataactgtcatctgtaataatcttcatgatggtgttcttctctgcgtctcttccatatattttgtgtggattaagacttgacgttcttctgcagagagttgtggttgtactcgtacgatggtttgaatttccaacagagcacggtccatgtagcttaagaatttcactcacagccccccgtgcatcttgtaactcacgagttatttgctgtatccttgtggaacattcagcctttttccaagggtgtgcataaggtgcatcgttgtgtgttgactcac

SEQ ID NO: 28313 - DNA, 1501 bp, Oryza sativa
acggcgtggtagtcttggagtccgaggcggtcgacctccacgggggcgttgaaccagatgctccgcttgtccttccgcagcttcgccaggatctggtcgcaccgcttccgcatcgccgccctgagcttcgccggcggcggggggaggccccggcgaggcgagccatgggcgcttcggcggcttctgctgttgctgaccccacgagccaatgcgggagatgaggcgcggaccaggccgaggcccaactcgcctgcgactccgcgaggcccatgagagttcgtttgggctatcagtccattacggacaagaagcccgagggcgcggcccacatccttccgtcttccccgcctttccttccctgcctcgtcgaccgcgttatcccgtctcaagtctcaactcccaacctgcgatgcgccgtagaaatttgatactcgtgtcactcgtcgtcttcctttgcttcactaatcactccaatgacgcgacacgcatctctctcaaaaagaaaaggattggtatgtaactgtctacaagtgatgaattcatcactcacgcagttcactgcacatcgtcccagtacgcgcactatcttggcagcaaaaagttgtaccagaatgatcttgcgttcttggcaggacatgatcgatcaaaataatctcaagcactttggctacacacaatgaacgaaattttgcagctcggcagctcaccaaggatgggcgcaactcaaccacgactgaaatcggtgctgacacttttagcagcatctttgtgattcagccgtggtttctccggcgcgtctccttctgttcagagaaaaccgaatagttcgggttcggattcagttcgaagcaagcatggcttaaaatcagttcatgcacacacagctgcccccttggcatttgtgtgcactgacacgatgccgtctgtcctacgcgggttggtagtatgatgaaagggtttggaaaccgatctaaaaaaccgttcggatcatcgggtttttgactagccatgaaagtgaaattgtccgaaaaggataaaagagcgaacgacgtcgtcggtccagcacaaagctcagcgctcaatcacgtcagagaaaccgatcacttcgggtccgggttcggttctggagagctaactaaggacttacggagtggtatgttcaactgttcagagtatttaacttcacggccaatacgttgtcgtccaccagagtgcatgtgagcgtcacgacgcatcggataatttgaccattcgtaggttgctgttggcgagcacggcgaaacccgagacgcgggttcggtttcggttaatccgtttcgcggtcgcgcgcggccacgggcacacggccatggcgccatgccgctgtctccccctcgctggctgcgacgcttgactatttttattcttcatctccatttgattgatttaatctctcgttgcagcagcaggcaacgtgcaatcggttcggttttgctactgttcgggttcccctggccctctc

SEQ ID NO: 28314 - DNA, 1023 bp, Oryza sativa
agaaggaaggaaggagtatttttcatgctcgtatttaccggctaccacatctattttaaaagagagaattcgatctatagcacagaaaaaaaccgatataaaaaacagcacacaaatttctctcttttagtcagaagcacgtgccactaattttttctttgatccgtaccactcctgtcaattgtttaggggcatgaaataattatttttgctcttcttttctaaccaaacatgaaaacttggactattcggctcggctcaatcccgatggatggtgagagtgagtgggtgtaggtgcggtgaccgagcgggtagtggctagcggtggtgacagagaagaaggaggaggaggaggtgcggccgatggaggtcgtgctcctaaaagaaagggcaataacgacggctgcttctaaggcgcaagtcacacacctcggaaaagggtaacaatagtgactacttgcgaggcacggtggggtgatgacattggttgcttgtgggttgttcgatcacgtgcaggggctacgaggtgcaatgacttggttgacaatgctcggggccgccgcatgatagagacttttacggatgaggtgtgcaccaatgaactagccagagccgccatggccgacaaaggcacgtcgtgaacgagtgctagggtttgggggagtgaatgcgagatgtcgaatgggaaagaacgaagaggcgacctagtcatgtatgaggaaaacaaagggtaaattagtcaaaggataaatttatctgctctaatctaatgtcgtttgctcaaaatgcgatggaagtggtacatatcgaagaaaaatcagtggcatgtgcttctagtcaaagggggaaacttatgctatttatgctattttttgtatcaggttgtttctctatagcaaccgttggaagaaagtgcatagtcgtaagcccacgcttaaatgagtggcttatactctcgctcacatcgtttgctcttccgctaataagtcgatgctaaaatttaaattttaaatcgtaattttg

SEQ ID NO: 28315 - DNA, 356 bp, Oryza sativa
ccaccgaaagcccgagagagagacagagagaaaaagagagagagagagagagagagagagggggggggggtagcacgatggcgccgcccatggtggtgaggaaggatagggttaagtagtcggctagggtttgagactttgagatgttaatatatatatcgccccatataaatgggctattgggccattaggggggaggttaaactattaaaggcatgatggatatatatgggctaaacgattttcgggtcgggcatggattatctgtaggcaaaatataaaacctatctgcgcccactaagttcgctggtatcggatcaggcgtgcccacagacaaaaaaaggtgcccatggcca

SEQ ID NO: 28316 - DNA, 1501 bp, Oryza sativa
ggtagtttcactaaatatttaacgttggcaatgttttttaaaaaatacagaggaagttccagtagtacctagtacgtatacatgcagtatgctttttctatttaactcgtacgtacgtatatgccttcttggcttattccggccattatatttaggtaagtattacatggtaaattaggagagatagattactattaaataatggatctaatctaacggtgtaaactaatgggtccaccaacttaaatgaaaatcgagggctagtttttttcttttctcagaatttctaagattttctctattttattagagcgccatgtggcagcttgatagcgtttttagagcgccatgtggcggcatgcgagcgtttttaggaagtttaatggacttttagtatataatagaagatagaagatagataatagatagatagaagatagataatagatagatagagttcttgttacgcaatcagccaaaccggtctataccaaggaaagaagaaaacagagacaaaaaaaacaaggaagaaaaagaaaaactcgtacgacgggttacactactccaaacagcggaagggaggcagaaccacgctgtactcctaacaagtccccaaaggaagcaacgtccactaacgaccacagccggtcatccgaaaggatggactctagaaccaccgagaccgaaaagagctcgaaaactgactctttcttatttccttctttacaacacatcaatgaatcatccaatcctgatgccctgtttcttgaccaatttaaaacgatgtatttcccctcatcaaaataaaagagatttcggtttactccccttatcaaaatatgagtttttggtagaattggatatatcatagtattagtaaatctgaaatccaaataaattctcttatagtttcacttatgttttaaaatggagggagtaaagttgcagtttctttcacagtttgtgtactagtgtgtttagttcacgctaaaattaaaagtttggttgaaattggaacgatgtaatggaaaaattaaaagtttgtgtgtgtagaaaagttttgatgtgatggaaaagttaaaagttttaaaaaaaagtttagaactaaactcggtctaaacgagacctattcaggagatattggatcagattcgggcggaaaggggtctggattgtatgcctagattacagtgcatccgtaaacatggaaaccatgtgctccgagcctcgggtttcggtccaagctagtactagcctcccacaactccggtctcgtcacccgcataaaatggtgtgctcgtgtgatgcgagttggtgcgtgagaagaaatgctcattaggacatttcacagtgcggtgagttggcgtgtggtaatctttatccacgttagcaaaatgcatgtgtggaggagaaatggaggtggggcccgtgactacacctggttcgcgcattcttctttagttccgagagccacgttagagcgtaacaacttttgtcagag

SEQ ID NO: 28317 - DNA, 863 bp, Oryza sativa
cgtgcatatgtgccgtgcgtatatttatacgtgtagctttgcacttgcacgcccgcggtgatgcgtgcgtaaaggctgacgccataccggaaaggcatttccatgttagacatcagccgtccatctgctttgagattcgtgctaaatttggtacgcgcctaaccctgtattgtttttttttagcaactgtataataataacttgtgtctttttagtaagaaaaggagagtgggtgaattacatgtaatagctctaaattcttcagaagggagtgctgcagactgcagccagccaactagccaagcagggtttatttggagagattaagattcttaaaaacctgatatctaatttctgagaatctgaaaaaagctttaaaaaaaccctagttcgtagttgctaagtttattttctagattctacaactatagtttattaaaatctaaacaaaaagctaaactactttgtggagcttctgatttaaaaggaattgcactacaataagctcttcaaataggccctaggaatgttagtaaaaagccggattaaccacttacttgcccccttactagtcatcacggtatcctgcaagccaacacgccgcactttgatagttcgacgcccgccagcaaagcccggtctctcagtcccaatcaaggaacacgttaaaaatgaagaccacctccagtagtccagcgtctggatagcatatactccaagttccacggtaatctcgcaccgaatttccacgcgaaacgataaaaatggcagattattttttgggggtttccaatgtcaaacaacacgtggctgatttaatccatctttggaaagggaatcgtatcgccaaacatgaaagcgta

SEQ ID NO: 28318 - DNA, 1501 bp, Oryza sativa
taagtgtttaatgctggcttcaaggaaaggctgttgttttgcaattgattttatttgaactcttttctgaaacaactaagtgagtgcttctcaaacgacacggttgagacagtgcgtttcgtccggtcggagtatgtgcaatgtatcaatctttaaaatagatcaagattggcacccggccaacagctttcaaacggccacccgggccaacaactttcaaacggtcacccgggcctagctgatcccatcagctgcagattttccaaacatcgatctcctttccacaacagcaatttcacaaacagtagtcaaataaaactacactaggaatcacctcacatccgcccataaccgtgggtacggctgttcgaacagttagttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccaacaccaccccggcgaatccacatgtctctcggcatcaaggctcccctgataagctagttactcagccaggggtgtcccattccacccatgtggtcgtacttgtcttatgttcggatgaaattccaagggaacggtccttaagtgcaagagcgggaaaccgtacacccggtacgttccccggtccgcggttttggaaattcatttagttcgcaagcaccgaccccaggtgtcgggttttccaagccttttgtaaaacccaagttttacccaagatgtttatcatattttaagtttgaaggcgaccgtcgatactcgcacagagtgcacgaataccgaagcgtgactgggtggctataagggaacatggtataacaattaacaaaggaaggatcagatgcaacaaattaggtaggtctgccaatctgccttgcagacgggacaagcagatcaagtgcgatcctatcaatgcataatatttttcaagcaacataattaaattcaaatataggctcaagatgttcaaaggtggcttgccttgctcgagatcttgagcttgatcctcgaaatcctcgcactgcgggtcttcgggctccaaaactacgcgcaaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttgaaaaagaaaagaaaagaaaagaaaagagggagggaaattagacttccctcgggcggctagggcgcggcccgagagaaaaggggcggcttggccgagctaaa

SEQ ID NO: 28319 - DNA, 184 bp, Oryza sativa
tattacattttttttaaaaaaaaatccatgctattaggcaattagagccgacgggaacccaaaattaaaccatgaaattggcttggagttgagccagaggatgagaggagtgctgctgctggactaaggtataagctttattcaagtttcaaagcacatgaattcatctctgtctcgggatagg

SEQ ID NO: 28320 - DNA, 197 bp, Oryza sativa
ttgggcgtggccagcaacgaccaagaaattataaggagttgttcaatcataggcatgccatattgcggagtcacataaagagagcaattggtgttcttaagaaacggttccctattttaaaagttggaacgcatcattctattgaaaaccaagtgaagattccagttgcccagtggtgttctacaatcttatacgga

SEQ ID NO: 28321 - DNA, 217 bp, Oryza sativa
ctttgtttaggttttcgattgtttgcgtatagtggcggttatcggattttcgtcgatcgcgggttttctcgaagattcgtgaagcttcgtgaagaccttgagcaaggcaagtcaccctttgatcaattgctcctataattggaaagtcattattattttgtttgcaacttgcatcattagaatcactcacgtttaacttgcttggcctcggtttgca

SEQ ID NO: 28322 - DNA, 387 bp, Oryza sativa
aggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaggcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacg

SEQ ID NO: 28323 - DNA, 1501 bp, Oryza sativa
atattattttttgattacgcgtacttagttaataccacgcgtagagaggtgtgatttttctcacataactcaaggtagtggtccaacttgtcttaaggcaacatcacacaatccccttcgttccatattactccctctatttcacaatattagtcattctagcatttcccacattcatatcttctattatattattaagacagctcgaaaagaaggcaccacgttcactgtgggggctagaaattctcacattaatcggagaaaaagagaaaattatacaccgttggattataatagatttagattacaacggtttagatttgctatagaaaaaataaagaattatagagctttgatatagattaaaaagtcctgtccgtttagaaaaatccaattggattactatacggtatcaaaaattcaagcgggatacaatacggtacagaatttgttatgattccaaaacgcaagtatatatgcattgttaccgcacatataaaacgcagatatatgaagtagatatacttgggctgctgcggcagaacaagtgacaagcaaagttgattaccatcgcccccaataggtaaagcaaacaaagcaaagctgcaaccagcattccagaccagcaatgcatgcaacccacccagaagcgtccggccacattggcaactgacaacaaattataatcataatcgtgtaaatttattttaaacgtattcagctcggagctgtattcacctcggagcataatttagtgttaattaatgtagttaagcctaaaatataaggcttataggttataagttttacacagaccatctaaaattcaaaatgagattaattatatttataataaaatatgaaataaatttcaaattggattttcaatacggaaaaaatatcattgaaacgagtccatgctcacgaggcatcgaagcttacaaggtgtcggttgttaagaaaagaccatctaaaacacatgacgagataaattaattaacaggcctataaaggagtagagtggtggcggttggtacgacatataaaaattgttaataaaacaccaaattgaatcctaataatgattaaaagaagggatatcaggcagaccgtgaagtaaacaagtaaggcggttgccgggacttctagaaagtaaaaaaaacccattgataatcatatttgatttttaaaatctcaatgacaataaaaaggagaagcagcgggcggggtgcataagagtatagttgcagagctgtcgacggttgacgggacttctagaaaataaaaaatgaattccaacgatagttatattcgatttttagaatcacaatgacaataaagagtaggtggcggacggactgtacaggagcatagtggcatcgtttgatgggacttctaaaaattataaaaaataaaactacaagttcaattttttaaggttcagaacttctaaaaagtaaaaaaaaaacaattattatcatgttcgattttaaaatctcaa

SEQ ID NO: 28324 - DNA, 1501 bp, Oryza sativa
tcatatataaagatgacaaacacacgtgacatgtcttatagcgaggcacgctactttgtaaactattctaacctaaaaaataaatattaccaaactacatgaaagataaagatttaatttttttttagaagtactcaagctcagatacaaattaataaatcaaaactatatataagaataatattatagttaaaaataagtaaaattgtatattgcataccgatgcagttttaggcttatgaatgtgtaatttttaggtgacctaattttcgcaaatttttatgctcttggaatctagcaatacacattttttaaaatgaaattcatcccaacatatgctacaaagaagctataaccaattattacgtaggttgtggctggatcgaatggctacgaattaaaaataccaaccttaagataaagataataggtattgctaaactttaatctatgtttggcgagaatctacatagccattcgttgtttctgctcaatggcttataagttgcatgaagtctttatcttctatgaaatcagtggttgattattgtgctaatcgaattttgtgttgtatgaagtccttatcttctgtgaaatcagcggctgattattgtgctaatcgaattttgctcacatctgacatcgaacctaaatagaactggagtaacatcggagaatatcagtcgttgacctagatattaccacctccaaagtcatcaaagccgactaggcaaggatactgccacaaagtacacaccacatcctgccgcggttcccgtccgctaaccacgctcacgaaggtcgccgccaaacgcacgacctcgatctaagcatatcaacactgctccatgtgccatccaccaaaaaaaaaatcagaattgttgattaggcttgcttgtttcaaagacaattaataatgttgagttttaaagcgtactcttaggatttattgggaatttttcatcgttttatcacttagctatatcttttggtccactaactaaaggtaagggtataaaagtcttgctgtaaattaactgcgtttttccattagtggtcacatttttttttcacttacgacccataaccctgaaatgcctgaatgcccaacgttttgaatgcgtacgttgtgccccatacacactccggttagttgctacatatgtctgtgtcaatcagactatcaaagtacctagtttacttgcgtttacttgactggttcaatgcatatactacttttttagactatttttattattattatttttagactagttcaatgcatatacttgcggtcatgtcacttgcaagttgcaacatgtgtcctgatccacataaatggcgtagtgcctaaaacgacagctattaatctgatccatgtgcttgtgcatattatcttgcggcagctacacctacaaactagatcgatcgaccacgaattaacaacgcgttaactgaataaagtcgaatataaatttgacatgagataaaactacactac

SEQ ID NO: 28325 - DNA, 398 bp, Oryza sativa
cgctgcctataaaaggcttgccgcctagcccccagccctcattcttccctcctcaattccagtgaaaaaaaaaagaagagaggggaggagaagagaagaaggggcgaagccctgccagattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcattgacagata

SEQ ID NO: 28326 - DNA, 1501 bp, Oryza sativa
aaaacaaataggctgtaaaaaattcaatggtggtgatgaaactaattttatgttgtagatttcgatttttttttataaaccttatgtacttaaagaagtttaactcagaataaactcaaaatatcttatacttcctccatttcacaatgtaagtctaacattttccacatttatattagtggtaatgaatctagataaatatatatgtctagattcattaacatcaactagctgggtggcccgcgcaattgcgcggctagtacccaaacaaaatcatatatttttttagtatgattttacttaaaatttattaaatagctatctcattgtcttaagattttgaaagatcaaaccttatcatcctcgtgtttctaattatatagtttttaaaagtcacaccagttgctaccccttatgtcatctacttctttatttgcttgctcgatctaccaatatttctattcattcttcttggaacctttaaaaattggattttatagtttttagagtttattgtcacattgggtttcatttttataatttctagatgttccgtcaaacgttaccattatactcctgtgtgacatgtccactgtctcttctctttattgtcattgagattttaaaaattgaacataattatcgtttgggttcattttttactttctagtagtcccgccaaaccgtcagcggctttgctattgtactcctctacggcttgcccgttgccttccttctttattgtcattgagattttaaaatcgaacatgataataattgttttttttttactttttagaagttctgaaccttaaaaaattgaacttgtagttttattttttataatttttagaagtcccatcaaacgatgccactatgctcctgtacagtccgtccgccacctactctttattgtcattgtgattctaaaaatcgaatataactatcgttggaattcattttttattttctagaagtcccgtcaaccgtcgacagctctgcaactatactcttatgcaccccgcccgctgcttctcctttttattgtcattgagattttaaaaatcaaatatgattatcaatgggttttttttactttctagaagtcccggcaaccgccttacttgtttacttcacggtctgcctgatatcccttcttttaatcattattaggattcaatttggtgttttattaacaatttttatatgtcgtaccaaccgccaccactctactcctttataggcctgttaattaatttatctcgtcatgtgttttagatggtcttttcttaacaaccgacaccttgtaagcttcgatgcctcgtgagcatggactcgtttcaatgatattttttccgtattgaaaatccaatttgaaatttatttcatattttattataaatataattaatctcattttgaattttagatggtctgtgtaaaacttataacctataagccttatattttaggcttaactacattaattaacactaaatta

SEQ ID NO: 28327 - DNA, 1501 bp, Oryza sativa
tagtagaatgaagaagcgctttagtgtttattttgtcactgtcaactctgtttgctaattttggtatcttgtatgactttggatgcaaccaactttctcgtctgagctcttgtttctggtatggtgctgatgccatgttggaattgcatgttctgaatgttacaagcgtcagtgttttacaatcttgttgtagccctgtgcaccatgacttatttttgttccacttgattagagagcgctgcagaaattacttgtttcaatcgcatattattcatcccctttgtgaccatatgtttgtcattttttgcttccctacgatacttgttgaatactgctcagttgaaatatactagggactgtaatgcttggcctttttcttgttgccagctcccgttccatgtgttctgtgattctgtctgcttgctttttctatggaccagtttcgaacagcagtctgaaccagagagagaagaaatttagatgtctcggaggtaattcttttttcagatcttaagctacctattcccaattaccctgctctctccagtttgactggagtattaatagttctttttgtggatttaattgctggtaaaatatatttgaagatattgttcattgaacttttctgagtgtgttcctctgtttcaatttctgttttctatcatgtgcttctctgctccaaacccgataaattgcaaacatgttaatttcttgattatttccatgtatctatcgacgtttttttttaaaaaaaagaaaaacatttacatggctatttgttttgaacccaatctcgctaatcgtcttcattcgttatctggtgagcagcgacctagtactctagtaggtggatattggtgggttccatttgcatgatcaattaagattatctgtttggttttgaggccatggcctcagatgccacttcaacagttgagctatctcacgtttacctagaattgcatgtatattgtagcacctattgcagtttaaattggttatagaatcgcttgcatattgtagcacctactgcactttaaactggttatagaattgcttgcacattgtagcacctactgcactttaaactggtttactttgacgatatcgctttgcgtataatcaactagctttccaaggtcagctggctggttctcttccttgtgttccccttgtgcatgcatctttacactagtcatgctcttttagcgtgttggttagatgatgtgccagtagacagatgcttctagaccccttctttttctcccaaccaaattaaaagcaaccttcgtgctttagccatgtgtccctcgtttctttgaggtagaagcgctttgccctgatctttagagtcaatagcttaaaccggccatattagcatagtggcaccggacaaagttagttgtggcgaggggtcgatcggtcccatgtgcgtgtgacaacaatgctttaccggctcatatgtcaaatatgcttctcacgctaagtgtccgttagg

SEQ ID NO: 28328 - DNA, 1501 bp, Oryza sativa
ctttggtctctggcatacaaaggaagtgatacaggtcgtcatgtactgacatgtaaaaagcccaattaggcacaacgagtgtcgcaagacaaaggaaccctctttaattcaaagaaagtgatcagtgagctctatcaaccgagaaaaatgttgacttgatgaaccctgtttctcggtggagacgccggcaagaccaccaaatcaccatcatccataaacggatgatggagctagaaaccagggtcgtcccactgcaggacagctgagcccacgttctgctccctcttgagcttgtccttgacgaaccagtcgcaaacaaggcctgcgttgagctcctcaatggggacgccttcttgctccgaaatcactctcaagagattcaacgacgatatctgtcacaaaaaatcacatggttactcgtcatcgtcaacggctcgttgagacaaacacctcacctaaacttcacaactttgatatgctaatctgctcgccactgtaatatctttgcaatcgatcagtagagatgcacacttacggtgaggcggcagaggaatcgctcgtgtgtgctgaggccggacatctccaccagcccggcctcctccaagctgagaaatgttctctgctcttgctccccatcaccaccaccgccattgctccgctcttcctcctcctgctgttgctgctgctcctcttcttggcatctcctcctgaccaccaaccgcgacgcggcgctggccctcctgagctccccacccgctcccgctgcacaattgcatccagttagcactaagcagtaagcacacacgcgaagaaccgatgcagtgggaggtagtgtaacttgtaaccacctgcagggaggcagggggacgctcgccggagcaacggccgcggggacagcagcgcggccggccgaagttgatgggccttgcacaagccgaccgcctgccgcatcgcctcgatccgtcgcggcacgtccccccctgctcaattccggcgacacaagatcagcttgggagaatcgaacgtgacacaaacacgagggacaggaggaagaggtggtgtgcaaccggataacgttagcttgacacacagccaggccgggccttcgtatgatcacatgggccttagattcgtccatgttaagattcgagagcccaaaaaggattaggcgccgagagaagagaactgtgtgggatgcatcagctcgctagtggcgcgcgtccttgtcaccttactccatataaacccatattatccccacgaatccccacgaatctgccagttgcgcacttgcgcgtgtgggacaaagacgagacgggacgggcgccaagatggtgagtcaccaacccagccgggacagatagcgaggagcaagcggctgaaggaagcacccggtatcgcgggaaaaccagcgagcgcggccacctgtttcgcgccacccccactggcctccctccagtataaatccagctccactccaaccctcctcctcaacaacaac

SEQ ID NO: 28329 - DNA, 254 bp, Oryza sativa
ttgtgcgcgcccttctcgatgtagcaatagcaatgggccggcccatcaaggcccattaatatcaatacacgagcccactttccatatacacggcccgttttcctctagggttaggtcaaggtctcttcccctcctcacctctattaaatccgcaggagaggccgccgccaccaccaccgtccgcatcgcgatcacccaccaccacatcacgccggagaagtagtcggcggcggcggcggcgaaggcgaagatgg

SEQ ID NO: 28330 - DNA, 572 bp, Oryza sativa
tccgatgatctcctctttaaatttctcgcgctgttgttgttgtgatttgtgaactgaattgaacgatgctttgttgttgttgttgaggaggagggttggagtggagctggatttatactggagggaggccagtgggggtggcgcgaaacaggtggccgcgctcgctggttttcccgcgataccgggtgcttccttcagccgcttgctcctcgctatctgtcccggctgggttggtgactcaccatcttggcgcccgtcccgtctcgtctttgtcccacacgcgcaagtgcgcaactggcagattcgtggggattcgtggggataatatgggtttatatggagtaaggtgacaaggacgcgcgccactagcgagctgatgcatcccacacagttctcttctctcggcgcctaatcctttttgggctctcgaatcttaacatggacgaatctaaggcccatgtgatcatacgaaggcccggcctggctgtgtgtcaagctaacgttatccggttgcacaccacctcttcctcctgtccctcgtgtttgtgtcacgttcgattctcccaagctga

SEQ ID NO: 28331 - DNA, 1501 bp, Oryza sativa
accaagaccaagaaaaaattaaatcaccttggatgttacaaaatcaagtagtgaatgcaagcatgcaaccaatgagtatttagatgacttcttgggttctaataaaacatttaatttatctcttcatttaagtctttaatgcataaagactacaaataggaacaacttatttggaaaaactagaatgtgaaataggtgtaacttttgtagatggagggagtaaatcattaatgtataatccacccacctctttcacatagctggctacaaatctatagcccacttctctcctctcatctctcttccacacaagcacaaatttaatgtggcaacttgtatagcccgcttatatcaccttattgtactcactcttagagcaagtacaattagagtaagtacaatagcagcctataagtcagttacatattttgaggagatataagaggaaagagaggagcaacatgctacagatttgtagccagctgcagcacgaactcaaagatacatgtgtatgagagcaggtacaatagcagactattagccagctgtaaacatattttaatgagataaaaagatgagagagaagagcagcgggctacagatctgtagccagctgtagcgcggactctaagacgcaatatgtgtatgactggtgggaccatatattaatagtatagtaagcaactattgtatgaattgattattagattggctataaatgaattggatctagtagtgggctatactattaaacttgctctgatatgtggaaacatgtattagttgtatagtatatgtttataggcaactattatataaattggctattaaattggctatagataatttggagccagtggttggctatcctattaaacttgctcttagtaatatgctcgtcgtggcggctacgcgcgagttttggctatgttcgggaggtgaggttgggaactcattttctacccacgcaaaatgaagcgacacaattttttttatgattaatttattatttttttaaaaaaataaattaatatgattttttaaagcaattttcgcatataaacattttttaaaaaatacatcatttaaccgttaaaaaaagtacgtgctgaacacgaggaacatcgtcggaaaggtgggggaaaagcagtctgctgattaaacaagtgcttagagcaggtacaataacaaactataagccggctataaaggaggtaaaagaggagagataagagtagcggccaacaaatttatagccagctgcagcacggactctaatatacatgagtgtatgataggtgggaccagacattaattatgtagaatatatttattgataattattgtataaattgactattaaattgaatatagcctgatttagattcatacttggctgtaccattaaacttgctcttaatggacacatcgaagcacagttgcaggcttgcagcagtggtccagtggatacggaggtggtggcaaccggagatgacgcctc

SEQ ID NO: 28332 - DNA, 156 bp, Oryza sativa
gaaaatcagggaagccatattactatcacctcaagagctaatggagaaaagaatgtcaagaagaccaaatctactgagagagagagagagtagaaaagacaccgaagaggaataagaggaatgatgttgttgatatgatggaaagttacttggaga

SEQ ID NO: 28333 - DNA, 1501 bp, Oryza sativa
cttcatttcagataaccaatccctgctctccatgctacaaacaacaacactttgcacattatgcactacactggagtcttcggcctcttctcttccattgcagattttaacacaaagagaagtaaccaacatatataagagggataaaaggagaggcaaacaaaatggatgattatctatcaagaaaagttaggactacagcaacagtaagtactccaagagttagaacacttttaccacaacaacactcatctgttactctgctagctgtcctacttaaggataatctgttattttccccaatggaggatgtcaacaaactcatgtactattatgtttctagttacaaaaattactttacaaaatcatgtctaatctatttttaatatttttcaagctaatacttaactaattatgtgctaatgagcagtttcgttttgcatacatgaggaattagttcgtcttgtatgcatggggaattagtttgcaacttgcactctctaacatagcccaatgaagagcatatcggtcggttcatgttgtaaaagatgacaaaagtaagtaaatcaattagtaagtgatgaaaaggcatttataagtgttaacacatcagttgggtttggtattttgagaaatcatatttacgagatgatattttgacgaagcccagttttaacggaggcataacccctaatttgtcaccaccattgcttgcattgctcccggtaatctcgttatttacaaaattgaaggaaattttgcagcttgccagcatttcggcatgtggtctgtgggaagtgaaatgggcttgcagagttgcattaggccaatctaccggctgcaaacaaggaaaaactacttagtactgtagttgggttgggttagagatcttgcagaaaaggacgcgaatccatgtaccatgccaaatggcccatctctatgtcgctctattctattgggtggcatggatcaatcagcccaacaaaacgggaaactaaattcaatcttaaggcatggtgcctcgtttttcataacatctaaaaaggtaaaatgtcattagaaaaattacaagatagatctatactatgatatattacttcacaacttattactacacatttaaattgaatctatacaaatttgaattttttttcaatcaatacaaattattactatgcaaacaattcaacacataaaattatataaagaaagaaaaaaaaatgtagtaggcacaatctgtttgtttcaacttaaataggtggtatttaaacttaaatgttcgtggagtgatatatcttatatttaccaatcttgtcaacaaaaaattcatgactatttgaatacataaattaatcaagcggaccatccctcgacaaagggcatcattccctataaaatacctcaacttataccactagccatcacaagactatacaacgcggccttcaacccctttttgataaaccagttggatgtatagcctactggtacggaagaaaca

SEQ ID NO: 28334 - DNA, 1501 bp, Oryza sativa
gtccaccttaatcttacaaattccagccagaaagttcacttttaggatctcagatttaccttataatgcgagattttaggttcacatagattaagactaggaagttcatgctttatttcaactttttaagtcatggtctgcaacagtaggagcaatcctttgctggtaatggttgctttatgaaccttttttaaaagaaaaactctatatgtctgcaatctcaagcttgaagcatttactctctttgtaattcttgcactttcaccgcctgctgaccatatgccttctcatttttctccatgtcttccatcatgatatcatgcatgtcatgtactgatgtgcatattttcccccaaataaaacatgaacatttcaaagtttacacaaggttttgctagcttccacttatgtttagtaattagtacaatttgaaagtttccttggcgcagcataagtcaattgaagttcgctgtcagcaagcttttactccatatcgatttcagtcaatttatatcttccatgtattatggtagagaagaatagtatccatataacttgctcctgtaagttcataaccaataactcttgctaatgacattttgaaaggttgtttttaactgtatatgcaaaattttgcggtcacagtttgttgtcacctatatgggtatatgatagcagaccacatattcggaaatatagctggctactctcaaaagtaaaactcaatgtgcatctttcgttttgccattccgcaccttttaacactataatcctttgttgtcgctataatatcaaatggaactttaccagtggcctgcaaatgagattattataagatactccctccgtttcgcaatgtaagtcattctagtatttctcacatttatattgatgttaatgaatctagacatatatattcattaacatcaatataaatgtggaaaatgctagaatgacttaacattgcgaaacggaggaagtatatatttattatttatcgttttattattcttttatttttgacaggtaacaagccttttaacttcttcagttaatcaggaccaagtgcagctttggtagtttctttggattggccatcaagaatcacatgcacattcgcgtatgcatgtggagttccaaaaccaatgttgcatgattacgtaccgatctctgtaaatcaaaatgatggcataccgagtttggtgttatgtatacattgtcgtgcatgatcgtatacagatttttgccgtatcaaagagatatttttttcttgcattgtcggtacgcacgcgtttcttgctagtttcgctcacccactgacggcgtttgtttggatgaaaaatacccctcttggggctgcctacctcgaatttttttatttataattttttttattaaaagttttacaaaaataattttccattttaaaaattgacggaagtagtcgcctaccgccctctgggagggcgagagggcggcgaaaatgacgtggcagccggcc

SEQ ID NO: 28335 - DNA, 187 bp, Oryza sativa
aaatgctagaatgacttacgttatgaaacggaggaagtagtagaaaataaaaacatacctgcggcctagaatggcaagctttgacattgcggcaaaggaatttgtttgcaaaagggtactgccacaccagcactatggaattagagataatgtgatcactctttttttttttgtccaaattgttagg

SEQ ID NO: 28336 - DNA, 1501 bp, Oryza sativa
aaatactgtaaggcaggtatatccatcatctttgtcatctacaactgccttagctatacaaatattcaactctcaaagtagtttggtagctaattaatcagacaggtgatgtaaatgtatacatcgtccattgattcacagtggatactcagttgttgcatttaaatgtctcttttcaggaaccataagttcatttacatggctattttaagagtccactgctctgattagtaacataacactgactgaaatgaggatctgttcattaatttgagtttcttctactgactcagtaacatctctccatgtgctgacttaattctccaaactttgagttctactgacttagtaacatctctcaatatgctaagttaattctccaaactattaacttaggaatgatttaacttggcacatattttcttagtgttcaagaaatgattttagcagatgcttgccattgcacctggtgatctaagttgactgaattgctgaggcggatatgtttcttgaacagaaagttctcatagtgaagtgtcaagtctcttcttaaaactaatgaatctgaaatatgtagtcggtctttcataccatagttgataaatgcaatactattgtctcatctgactgggtttttggccagttctagagtttacagatattatcttaatactgcagtcctcgcaaacaaaactacgagaaatttaaccatgttccattttcagttagttgacataacgaactgcatcttgtgcccattgatattggatgagtcatactatgcttgccacccctgctatgtattgtgaaattattgtttaaattattaactatcaggaactgtttctggcgacttcagttattaaaaaaaaaactatacaggttaaataatgttcttagtaggtacacaaggaattgactgttgttgttaggtaatcctcttagacaaaccttgcaatcgtacatttctttctgtgcgttacagtcttacatgctacaataccgcgcagcgtagcgcgcgagctcactctagtaatctaaaaagagtatggcctagtccgttaaccatagtgcatcttgaaatcgattggaagaaggaaaaaaaaaaggcatagtccgttcatttctcattgtgatacagtgatactgattttacctcatttttattagcatgtttttcaaactactagacagtgcattttgtgcaactttcttatatagaagttgttttaaattattagataaattattttttaatatttgaagtaataaacctcaataatcatgtacctgcagttaatcttcgtccaccgcaagttctgtggttctgtggaatatattccaagtttgcaactgaaaaacttcatgagcactgactgcatttgcactgcagttcagtggatgcatcgacggagaatgaatacgcattccatgacagaactaaaacgcagggaaatacagagttacaaatcatatggcacgaaccgatacacatttcgtg

SEQ ID NO: 28337 - DNA, 1501 bp, Oryza sativa
  unsure (1)..(1501): unsure at all n locations
aaagcagtggaacaaaaagtctacaagctactaagttcgaatcgaacttaaaacatcaaatattctccacctcggtgtcgtgtctctcctctggcggcgatagagtaagaggagagaaataataagggaaataaaagggaaaccgaagaaatcaaagaactgggcttatgtattctagtggattttgctcctagcctacatataagttagatttcgtgggtaaacgggcaaagcgggcatgggtagtgattacccatacccatgcccatttactcatcgggcatagcttttgacccaataagatacccatgggtataaaatggagaacaaacccaaccctaatagggtttttacccgcgggtaaacgggcaaacgggcacaattgccatccctagtcccacgttgacgaccggcggaggttgatgccaaggatattgtcgttgccggcttgccgcgcatccatcgccccggtgcctggttacgtgcccgtcgcgctcaaaaatctcgtccacgcactgcacaaaagatcaggccggccaccgtgcccaggtgaaacacgaggtggccagtacgtgacagagccaggcagcgtgtgacgtctgtggtttttgcatgctcgcattgcccgcatccgcatgccgtcgtgtagcgtgagcaattgaccgatcgatttgtggccttggccttctcaacctgctcggctgcacctgacagcagcagcagtgtcgcagcaggtagaaacgctgttcagagagttttttttttttcaacgcgtgccagaccacaacattcccattacggattcacatggatccatagtaaagagggcccacatgttagtgactcaaagtcatgtggcttagtccgtgtttagattttttttttttgctaaaaaggtcacatcgaatgtttggacacgtgcatggagtattatttgtggaaaaaaaccaattacacagtttgcatgtaaattatgagacgaattttttgagtctaattacgccatgatttaacaatgtgatgctacagtaaatatttactaatgatggacacattaggcttaataaattcgtctcgcagtttatatgtggaatctgtaatttgttttgttattagtctacgtttaatacttcaaatgtatatccgtatactaaaaaaaatttggccaagaaactaaacacaaccttttttttnnnnnnnnnnnnnnnnnnnnnnnnnnnnnaaaccgggaaagtacgttggtattgcaaaaactattagaggatttcagctaatcctttccggagaattagacagcttaccccctaagaggatctcaaattctcaatcctcctcttacatgaacagaacgaagtacagccaaaccgccaaatgtattggaacttggtactagtactactagcaatgtagcaatagaatgctagacacaatagtatttttgaaagcaacacacgtttggtcgtaatcgccaaagcagtggaattacgccgcccatcatcac

SEQ ID NO: 28338 - DNA, 187 bp, Oryza sativa
atgaggccgcttgcttcttgtaacttgtacagtaggaaggagagtggcactgcgctagtgcgctgtgagcagaagagaacacgcatgcatcatgtgttttctttctgttgtagctgatttgagcaatattaactgcattgcaatgtattttctggagtaactttgtatgcaaccgtgggttccaaaa

SEQ ID NO: 28339 - DNA, 1501 bp, Oryza sativa
tacccgcgggtaaaaaccctattagggttgggtttgttctccattttatacccatgggtatcttattgggtcaaaagctatgcccgatgagtaaatgggcatgggtatgggtaatcactacccatgcccgctttgcccgtttacccacgaaatctaacttatatgtaggctaggagcaaaatccactagaatacataagcccagttctttgatttcttcggtttcccttttatttcccttattatttctctcctcttactctatcgccgccagaggagagacacgacaccgaggtggagaatatttgatgttttaagttcgattcgaacttagtagcttgtagactttttgttccactgcttttgttgtggcgggtaaacgggcacgcccgcgggcaatgggcataggtaaccatccttacccgtcatgtagtaatgggtatacccacgagcacaaataatctcacgggcatgggtataggtaggcactacccgtgcccgtcgcgcccgattgccatccctacgtgggacaaggcgaacggtggaaattagtgcagagaaatcagtcaacggatcgcgcatgcgacctcccgctcactcccggcgcgtggtcgcgcattcccgatcccctccctcgcgggctcgcggcccaccgcggcctgctagctttctagcgcgcgcgatgggctgcccctgcctgctcggcatcagccccaattaggaaaaagtggatttttttttatttttaatttttttattaaaagttttacaaaaataatttttcattttgaaaattgacggaagtagtcgcctaccgccctctgggagggcgatttttaaaaatcgccatcccagagggcggcaaaaatgacgtggcagacggccgttcgctctcgggcgacggccgtcaacgaaatttgtaggcggcccccttgccgccctccgctagggcgattttgtactgtgcggggggccgcctgcaaatgggcggcgagggggcatggaattttgcaggcggcccccttgccgccctgggggagggcgatttttgcctcccccctataaagcccagtccctcctctctgaaatttcattatattcactaaaaatccaaaaaaaacgaaagagagagaggggagggcagcagaaggggagcggcgaagccctgctggttcgctcacttcatcacaggtatgctcccatacatcttttacatttgtactaatatgttatgtttgagtatatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaa

SEQ ID NO: 28340 - DNA, 534 bp, Oryza sativa
aatggagaaatattagtgtaacatagttgcgaggcagcttgccataaatctcaacaaaatatatccaacagatgcatatttctgcatactgcactgtttctagtgttttgaatatttcaatgctctaaaaaattactcacatactttttgatattccgtctttaattatgcattggctaccattgcatagaaactgcaaaacattagtgcaatgtagttgccgggcagcctgctgttaatcttgaaaaactcaatattaaaactccaatagaactcttgtttttatgtgcaccgagacaggagaggggcatgcatagtgtgctagaaagttggatgtaacaaaaatttaattacatctcctgtgttctgcactaattttctctgcttcgcagcttttgttcttaattttgacacctgaggcagttgttagaaatttgtaatttgcaatggacttagctctgagcaatcttattattactgtctagtgtgttctcaagatagatagccactgatgactaatgtattcaaattcat

SEQ ID NO: 28341 - DNA, 468 bp, Oryza sativa
ataagtcatgcttaaagttccttaacggtaaaataggtcacagcaaaataaacgatatttacaaaaatgttttgaatacgacgaatggtcaaacgtcatgtcaaaagtcaaaggtgtcttctattaaaaaacggagggagtatgtgtttaccttgctttgtttgacaatttggctgggaaccaaatttggttacccatgagtgtgacattccacaagatctgttcttgccttcttggttttcggtgccatatgtgtcacccctttttctgagaataagtaatttaaagttggtgtcagaagtgttttatagtcaccactagagtaggaaaattgttgatggttgaagatatgtcatgatgcattggtattgtaacatggtaaacaagtatgattgggaagaaaatagcttgtatactactatatacaagttttatgattttccttaccattgtggtctttactttgta

SEQ ID NO: 28342 - DNA, 1501 bp, Oryza sativa
tacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcactttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctaaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatatactcaaacataacatattagtacaaatgtaaaagatgtatgggagcatacctgtgatgaagtgagcgaaccagcagggcttcgccgctccccttctgctgccctcccctctctctctttcgttttttttggatttttagtgaatataatgaaatttcagagaggagggactgggcttta

SEQ ID NO: 28343 - DNA, 1501 bp, Oryza sativa
cagcattgtcgtcggcgtcagtagtgcagaatcccgagtgccatgccgtactccacgaaggcatcatcgtacatctcatccaccgtcttgtacatgaactcgaacccttcactggtcagcttctccgacgagaggaggatcgtcggcttctcagggaggccgccgccgagtctgcatgttccgccgccaccgtcggagtcagctcgcagtggacacgcataatctttgagaccagttcatgattttgtcttacgcatcgatgtcaacgttgtggtgcgggtatttggcggccagggaacgggcgatctgccgcatggtggtgttgagggcgcagcagatgtacctccccgacggcgacggcgacgctttctcggcgaggaatatctcggcgcggcagaggtcgtcgacgtgaaccagcttcagcccgccggagtactggtcaatcattctcagggtgttgatctcctcgttgcctgaaatcgaatcggacacgtgagtccgaaccagatactccctccataccatgaaaactctcgttatactaaattatattacattctaatactaggttgggtttttggaagaaggagtttattctagcacacttaggtcgtgtttgctactgagggttctcaatcttctctctcgtttttctcgcgcatgcttttcaaattgctaaacaatatgtttttgcagcaactttctatatgaaagttgcttaaaaaaattaaattaatctatttttttaaaaaagttaactaatacttaattaatcatgtgttaatgaactgttccgttttccgtgcggagggaaagagtttccatccatgatctccaaacaatactgccggtgcttacgtactcaccggacagcaaggagaggacgttggcgacgctctcgttggccaccggcgccggcgacgcgccgacggtggcgaccgggcacaccgccactaagctgatgccgttctcctccgccagcttgctcgcttccttctccgagagaaccttggcgatcgcgtaagcctgcagcgcaaacaccaccgctgtgctctcacgcaagcgactgtactatcaactctgactgaacatgtaaaattttgtaagtttgtgtgtacctgagcaggagatatcccgttggttgatctgaggtagtcgaggtcggaccaggacgactcgtccaggacatggctgctgccgttgccgtctccttgcagcggctggccggagacggcggccgccgacgatgtgaggatcacgcgcttaaccgtgccggctttcacgcacgacctcagaacgttcagagtgccttggacgccggcttccaacagttctttctgccattaccaaataatactctagatcgttatttcagctggttattatggagaggatttactagacaaaccaagtaaattaatcgtgacgatacaagtaaaagtactctcccgtttcaaaataaaacaacatagtattggattggacacgtacataataaagt

SEQ ID NO: 28344 - DNA, 1501 bp, Oryza sativa
tatgttaaacccgataatactaatcagtgcaagtgtggtatagtggtatgtcacaaacctgtaggaatgtgaaaaggatgttttgcagtttacgattcctggcttcattcttgtgggtctgattcattctcctgatactgtgtacaatatgtgagaatgctagttttttgacagcccggtcccctataacttgaagctccataaataactccattgtgtcctccagatcaacaatctaaacatcaaaaagcaatgtatacgaggagaatttactctacagtcatacgataatcccgttccaatccacacgatttgaacaaaatttaacttaatgtgaaatgaacagatgaactaaacaggcgtcaccttccgattcaccagtagtatcagcgcctgcacgaggtgcacacggagcccggacggcagcgcgcgcgcgttggtgtcaagcaggccaccaatctggtcgggcaagtcagcgaggtcgtccgggtagaagggcgcgacgtgggcgaggaacagcgcgaggtcgccgagctccttggccacctcccctccgccgccggacgaggacgtggaggccagtgccgcctgctgccggaagaggaacaccgatgactcgaagtggcgccgcagctggcggagctcctcctcgtacccctccgggtcgcgcttcatcttcgcctgcagcgccgggaggctctgccgctccccggccccgccggtggccgacgccgacgccgcctccggcgtgaacgccggcgcgtgctgacgaggcatcggagcggaaaatccggtgtcccccgccgccgccgccgctgaggtgagaatgctaaaaccctaggccgccgcaaaacttcccgggagaaccgatggcaagaggtagtcgacgatgcgagtgactgggctggccagttacagtacacgtccggcccattaatctagctaaatttggaccagtaaggcccatttttcctccctctagcaaagaaaataagtctaatttgaaagacctcggtcaaattgcatcaatcaaccgcaaaaccgggtatatcgcactctccaacttcaaaaaccggtataaatcgactcctttgatggtttgaaaatcgattttctactgatgtgttaaattaaccgtgatcaaacttattatatccgaattttactattgaaggagacaattcaattagaagcaagagatgagggaagaaaaatatacttagagcctctttatttagggaattttttcttggatttttaagtcgcctttttagtttatatgatttataggctaatggattgaagtactaagtttaatagtagggtcataactctatctagcgtaagaaaaaaaaacttcttcaacataatttttgatgatgagtacaaacgaaagaactgcatatttgttaagcttagactttccagctcataaggttaagagcctactataagcttcaaataatctatagtcaatctaatagttaatttatacaatagt

SEQ ID NO: 28345 - DNA, 1501 bp, Oryza sativa
cgctccggcgatcgacggcgaccgatcgatcggcagctagcgacgcccgagcttacatgcgcgcgccgcgtcaccttcccgcgaccgatcgatccgtcaatcttccgctaccgtgtatacgcagcagtgtcggctgggacatgtacatacattatactaaaatacagtactacgagccgctttctgaaaaagaaaacgaaggccattattttcctctgtttcttctcttgtatttttctggttgcagcacagacgtcgtcgtcatcgttctatggagtcatgtacaaacatatttaaaaaagtcaacggaaacattttgagaaggagggagtattaaatcagcccgcttgatcgatatgggacctgttttctttttctagaatctatcattaatcagaaacgtacgcttagctagcagaaactggtagtctggtacggcgttctactgtacatacatcttggcaagaggtacaccggtctaacatcgactataccattgtcacgttttgcgtgaactgcaagagaacgcatcactgggcatcgctaggccactatcggtgccattatgtaggagtacaaggtaatcaatacactccctaatcaaaacaggattgcaatccagaacagcggtgacatctgtattaagctcgcagatactgtaccaattataactcgattactcaaacaacaaagcactggcacttcagtggaccacgtttggcaaggacgaaacgtggttttaaggcgaaaaaactcaggagctttgagaggggacagcagcggtcatgctcttttcccccaactaataaagcaccagaaatagtaaatggctagctgacaacgtacgccaagcatcattacaccaaacccccttcacaaatccatctttaaggccctcgtctgtgggccaattgtcgaaaatacgtcgtacggcgcgttagaaaagaatagtttataggttaaatttttctatatactagaaaaaaatgcccgtacgttacaacgggtgaagtcgattttaatcttattattgttatatgttttagttaaaatgaaattcactgtgagagttcgctttatatatttttagaaaatcatgagctatatttaggagtctaatcatctcaagttagcatgcaagttttttaaaacaaatttcttatatgatttcttctgtattaccaaaagtggacgattttaaaaaccgaatcaaatacggatacatatttttaaaagcaaacaaacttaaaaactgacgtatacacatatgacgtaccaaaataccgataaaaacatcttaaatttttataatagtagagatatgttcaatgaaaaaaattaaaataaactctaaaatttaaattttgacagcggttaattctatatagaggaaccaatgggagcctaagctcttttcagttactgtctgttggcttatgatgacacgctttttatactgtttgtaaaaaacttctctatatatatttttaaaatagtcttt

SEQ ID NO: 28346 - DNA, 302 bp, Oryza sativa
ggcgcccccccccccgaaattttttatttttgttttatttgtttgatatttttttcacgcttagggacacacaaaaaccaaccatagaaaaattgaactcaaatggacgtaatatatgacatgtagaatttttcctctcctctcctctctccgaactagtgcagaggagagagatgtgcaacttttttatttttattttatttttttgatatttttttcacacttaggaactcacaggaaccaaccatgtaaaaaataaactcaaacggacaaaatatgtggcacgtggaattttccaaagc

SEQ ID NO: 28347 - DNA, 1177 bp, Oryza sativa
ccaaccccgcctaatgggtggtaccgcttctgtagataataattcggatatccggtgaacaatgctatttggatatccacataagccatgagacataccccatttctttttaactctataacatttatatattttaatagtagtttatctcttaacactagtgtactattaatattatttaaattctaaaaaatatttataaattatacttcatatataaaatgagctaattatatatgttgatatttgtttctattagaagttgagttggttttcgtgtttcgagaaaaaattgtttccgtattcatgtccgattatattcgattcttattcatattcgagataatccgtatttgtttccgtattcgaactatccgtattcgttttcatatccgataaaaaaaatgaaaacgaatatggtacaagcattatcggtccgtgtccgctcaatttttatccctgggaggaggggggttggctggaggtaggcagaattttttttatttataattttttttattaaaagttttacaaaaataattttccattttgaaaattgacggaagtagtcccctaccaccctctgggagggcgatttttaaaaatcgccctctcagagggcggcgaaaatgacgtgacagacggccgtcaacgaaatttgcaggcggcccccttgccgtcctccgctagggcgattttatactgtgcgggggagggcgatttttgcctcccccctataaagcccagtccctcctctgtgaaatttcattatattcactaaaaatccaaaaaaaacgaaagagagagaggggagggcagcagaagaggagcggcgaagccctgctggttcgctcaattcatcacaggtatgctcccatacatcttttgcatttgtactaatatgttatgtttgagtatatatgttgcgttttagttttagttccatatattttagcacatctgtagcacacaacacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 28348 - DNA, 303 bp, Oryza sativa
ccttgctgattttaggcctcttttcatggtaattgattaatgatttcttgggagcatccatggtcaacaggcataaagtttattggcaccttcaaaagttcaaaaatcaagctttcttggtatttgtgaagtgttttgtacgtttgcttgctttggaatcttcaattggtaatatgatacttgcgtgctgctaatgtttttaaatttttattccttttcatgcttgtggtctgtgaaatcccaaatgaacagattgaaataaattataaattgatttctcttgtcccatcctcctgcaaaagt

SEQ ID NO: 28349 - DNA, 312 bp, Oryza sativa
attcctgcagcccaaaagtgtgaattatctctctaaattactgtaacagtactaattacacccataaactataaagccagatattttaaacatcagacccttcaacccaaacgaattatcccctaactcggtacagagtggttttatcatacatttaaattcgttccgcatcagaacctcgaaatctcatggttttcagctggttttggtcggaaaacgtgcagccccatcgtttggttgtttggtggaataagccaaacggcatattctcgaatggaaattaatttatgaataaaactttatatacatact

SEQ ID NO: 28350 - DNA, 263 bp, Oryza sativa
tttcattctgctccagtggaagaatgctagtagcacagtgaataatccacggggaaagaagaaccttgttttatcctcatggggggatgagtcagtgcttactgaagattatgttaatcctcattatacaactgattgctatcagtcatacagcgaaaggaccaaccaaaatctggtaagtttcatgccccaaaccaaaaattttgcgctcttttttaaaatataactctggcggactaaagattttctgttgctacctcaga

SEQ ID NO: 28351 - DNA, 1272 bp, Oryza sativa
aagcatttactctctttgtaattcttgcactttcaccgcctgctgaccatatgccttctcatttttctccatgtcttccatcatgatatcatgcatgtcatgtactgatgtgcatattttcccccaaataaaacatgaacatttcaaagtttacacaaggttttgctagcttccacttatgtttagtaattagtacaatttgaaagtttccttggcgcagcataagtcaattgaagttcgctgtcagcaagcttttactccatatcgatttcagtcaatttatatcttccatgtattatggtagagaagaatagtatccatataacttgctcctgtaagttcataaccaataactcttgctaatgacattttgaaaggttgtttttaactgtatatgcaaaattttgcggtcacagtttgttgtcacctatatgggtatatgatagcagaccacatattcggaaatatagctggctactctcaaaagtaaaactcaatgtgcatctttcgttttgccattccgcaccttttaacactataatcctttgttgtcgctataatatcaaatggaactttaccagtggcctgcaaatgagattattataagatactccctccgtttcgcaatgtaagtcattctagtatttctcacatttatattgatgttaatgaatctagacatatatattcattaacatcaatataaatgtggaaaatgctagaatgacttaacattgcgaaacggaggaagtatatatttattatttatcgttttattattcttttatttttgacaggtaacaagccttttaacttcttcagttaatcaggaccaagtgcagctttggtagtttctttggattggccatcaagaatcacatgcacattcgcgtatgcatgtggagttccaaaaccaatgttgcatgattacgtaccgatctctgtaaatcaaaatgatggcataccgagtttggtgttatgtatacattgtcgtgcatgatcgtatacagatttttgccgtatcaaagagatatttttttcttgcattgtcggtacgcacgcgtttcttgctagtttcgctcacccactgacggcgtttgtttggatgaaaaatacccctcttggggctgcctacctcgaatttttttatttataattttttttattaaaagttttacaaaaataattttccattttaaaaattgacggaagtagtcgcctaccgccctctgggagggcgagagggcggcgaaaatgacgtggcagccggcc

SEQ ID NO: 28352 - DNA, 817 bp, Oryza sativa
tctgaatataatatacagtggccatgaatatcccaatattaggtagttgatccatcgaactttctagctagaaataaagaaacaagtaatcgtacagtttagaaacgttttaaacttgcttatatcggagagatcaataatatcaattagttgggttttaatgaaatggttatggtcatctacttagcttaacgtatcatgacgataatccaactttgaccagggtttaacgaatgaaagaacggagagattacgtttaattttatagaaaggttgcgataataatataaatgtcgctactatactaaaattgtcattttggcacgtagcaatcgctagcaggtaatttcatctacttttctgaataaaatttggttcaagtcaagggtcaatcgagcatggatctatcgacttggtttgacgtgtgaaccaagttagctagatgcaagaggttgtagagacaagccaggatttgctactaacttcacgctcaagatcatgggttaattaacactatagtatctgttcctgtcaacattttattatcatacacaccattcgagctgcctgcatgccaattgaaatcatttaccacattaattgttaaattcagacagtacatgcaagtgcacgttaattaattaaagctacaaattaagccaggttaggtacttaagtgagctatgggcgttcattagctagaccggtcgatctgatcgatcatgaaatatatggttgtgaaaatgtagctctaacctctaaagtaatccagatcagactgatgtggcatggatttaattttgatggctctttcagt

SEQ ID NO: 28353 - DNA, 1501 bp, Oryza sativa
ccgagagcgattccccctaggctggcaaacttcctgtcgatgccgtctgctccctcgcgtggcagcacccgcgttgacgccacccgacgcgggctcgccggccatggccatggccgcagccactcgctctcctcccgccgcgcggcgccgctcccgtgccgccggcggccgccgccgcacgggattgggtcaaatcaggccgcatgtacgggagactcctggtccaatgggctagtgggccgtactgagttattgaggcccataaatacgaggccccagacggctcaaggcctaccaggtcggcacataaaacgagaaagtcattagtttaagattagtcaagttttaattactagtatgaattagaaaattaaatttatttgtggttttagaaaaacctttgtatagaaagttttctcataaaacatatccttaagcagtttcgaaacgtaatagtgaaaatcgagatagaatctacatcttaatcggaaaataacagggttcacgcgggctttttgaatgaggcgagatgttaatcagatgatcactacgctccttgcttttctgcgcgatatgattctgaaccacttaagtacagtagtactagcatttagcacgacttcacggatctttagctaggtcaaacgaagtttaataaagctatcgtcactttaccagcagttttcaacagcacgactatgatagggatgtgttgtggacttatcactttgatgaattatggtttccttttcttggggtcgagggcaacagtatccctcacttatgtttccattcatctctcttttgaccattgccatgaagatgctttaccctggctatcacgacggagagtacaccatgcatgttatatgcagtcacgaatcatccatgattccatggacagccaatcttctttgcagtttgcattaccatgcaactcacccatatggattcatctagctagtcaatcatgggatattactgtactacctccgtctcagaaagatcatagtttcacgttatttatgttcaacgtttcaccgttcgtattatttaaaaaattaaaatttttaaataagatagtcaaacgttagagacgagaatccacggctgcatttaaactggtacggagggacggaggtggcaggaagtaggaacgcacttgcagtcttcctatgcggcggggcactactagttcctagattccgtatatggctatgtttagttcagcgtaaagtttatattttggttaaaattagagatgatatgactgaaaagttatgtgtgtatgacaggttgatgtgatggaaaagtactgaagtttggatccaaaatttagattaagcacagcctatgtatggtgctcgtgagtcgtgagacactgaggccggccggcgtacgtgctccctgcacagcggccgtgaacaattttccaaggagatgcaaggaaaaaaagaatcaacagttatggaagcagcaaccaccaacattttctaccgtc

SEQ ID NO: 28354 - DNA, 1501 bp, Oryza sativa
atactccctccatcccaaaacatttgacgccgttgacttttttaaaaatgtttgaccgttcgtcttattcaaaaaaattaagtaattattaattcttttcatatcatttgatttattattaaatatactattatgtatacatatagttttatacatttcacaaaagtttttgaataagacgaacggtcaaacatgtttagaaaagtcaacggcgtcaaacatttagggaaggagagagtattaacattacactaactagaatatgtggaatatgtggttctcccaagattgtgtgttgtacaaaagaatatttcaacatcctttcaggatcagtttcgtcaaataactgctagtaagttggatgttttagtgtttcaagaagtcggaagttctacaccaggttatacgtaccaaaaaggaggaatgcacggtgaacatgcataggagtaattaatcttaaggagctagagtaggatcataacatatatgccatataattatattctacaaaatttattattctaagtttctaacaaatcttaacaaattccttagtacacaaactttgatcccattgtactggaaacgagtttccttttttattttcccaaagattatagctgatcttgaaatagaattcgaaatcgaaattagcaatacctggcttggatggggctcgcgacgtcgcgtcgtgtcgaggtggcaccgcgaacttgtgtcaccgccgcacaagcatgtgacacccgtgagcggccggaacagtgcaggttaggctcgccgtgtcttccgcctcatcagccggctgccatggccgctaatccgtccccctccctactgcctcagccgagcgcttcttctgtcctctccctaggcggcaatggcatgatgcaacccctccggcctccatctcgcgcgcgctgcattgggagcggcggacgccgggcgtcggggcacttggacgtgcgggccgagccgccctccgccggttcactgcccctgttcgacggatggctccgcggcacccgcgcccgctcgccggttgacgtggcgcctccgtgccggggcagccgacgtcacttgggtcttccaccggccaccgcctcagccctcatccaagcgcttccctctcctgatctcctccgctacctcgccgagcgggagtgcgggacaatggggttggacgcggcgacccaacgctgggtcaccggctcactgcccgaccctactcagctcggctcaccgctctgccggtctccagcactcacggctcatcgaattttttttatttataattttttttattaaaagttttacaaaaataattttccattttgaaaattaacggaaatagtcgcctaccgccctctgggagggcgatttttaaaaatcgccctcccagagggcggcgaaaatgacgtggcagacggccgtcaacgaaatttgcaggcggcccccttgccgccctccgcgagggcgattttctactgtgcggggggccgcc

SEQ ID NO: 28355 - DNA, 1501 bp, Oryza sativa
gtgacacaaatatatcaaccttcccacaagtctttgatatctctctttattaactggatctccagattcagcacataacttatgattttgttcaattggtgtagaagctggccgacatccaagcatacctgtatcactgagcagatccaatacatactttcgctgtgaaagaactattcctcaaggagatcttgcaatttcaatacccaaaaaatattttaattggcccagatctttgacctcaaactccttgcttagattttgtttcaacctagatatctccaagcaatcatctccagtgataatcatgtcatcaacatacacaacaagaatagttttaagacctctattatggcgatagaaaactgtgtggtctccattgcactgtttataacccataccacacattgcacgtctaaagcgatcaaaccatgctcttggtgattgtttaaggccatataaagattttttcagtctcaacactttaccttcagtttgtgaggtagcaaatccaggtggaatttccatatacacctcctcttgaagatctccatgtaagaatgcattcttgacatctaactgatgcaatggccaatcaaaattagctgcacaagagataagagttcttaccgtgctcatctttgctactggtgcaaaagtttcatcataatcaattccatatgtttgactatatcccttagccacaagccttgccttgtatctttccacatttccatcaggattttgctttactgtataaacccatttacagttaaccactttcttccctttagggaatggtacaaggtcccatgttttgttcttttcaagagcctctagctcctctagcatagcttgatgccaccttgggtcttgctttttttccctccaatcatttggaatttccactgaatttagtgatgtcacaaaggccttatatgtggatgacaaagaagcataagagacataattggctatgttattctcatcatcattcacaccttgagcttcaaaaccatacttttgtggaggtttacctgcattgcttcttaccccctttcttatagcaataggaagattagtttcttctccccctgtttcaaactcctctccttccgtatccgatgaaatctgtatagtatcacactgatcagatggtttatcacctacttcagcaacaattgaagattgttgctgctccatcccatccataggagactcatgttgccctattgtttgcgcctccaaagaccttgttttcctcctagtataaacttgtagattttcttcttcacatggccttctccaattttgctcatgaatgggttcactaacaggatatgggattgagccaaccacaaatttcatgcttcttgattatgtgtcttcttcagtacctgatgatccattctccccctcttgtccatcctcatcaataattggattgtcaagatcaacaaacaaggaactcaaatctgttctttctccatagaacggaaca

SEQ ID NO: 28356 - DNA, 1501 bp, Oryza sativa
tgcagggttccagaaacttatactcaacatgcgccggtactttccccgcgatgtatcttttggctgcatcaaaagctttccgtgcttccaagattcctcctttcctcataggcaagcattcacccatcgtcaaaaggttcttatcatagaagttggctgtatccagcgtaatgcacttaagcgatggtgcattctcaagaatgtgacttgttagctcaatcatgctctttgtagagttaaagccagtgattgtcacattctggaggttggcatgtctggggtgcagaatttgcctcaaatttgtatgttctccatcaagaatcgaatcacgcctttcacatcgctgctttacctgcaaaggataatagttgctcagtaaaccttggtcatatcctcctcagcaagtgcgatcactagtgatgaatatataagcttaaaacaatttatcatgataagcccacactgaattggtgctgttggcttctagtgcaataatacccatgaagcaccacagggcttttctaattggttgccttagtgcgtatttaagtgctaaactgctgattcagcccctatctataatctgttgagagaaaccatatgaagaataactacagcaaactaaaccaatttatcctgccaaatttgcagaagtccccaaactacaagcatcaactgaatttttatgccaaagtgacatacatgcaagatgaaagtctccaaggcaggggaaccatccaagaaagaaaccagagaaaagaaatcatagttgggaggaaaagccagtaattcagcaagataaatttccaataacttgaggtggaggaacttgatgggcaccattggtgtactgatcatctgaaagaaaagaagagatgacttaggattaatcatatgtttcatgtgcacctatgacatgcatatgaccagcctgtaattaattgtagttacaaagcaactggatagtgcatagaaaacaataatgcatacctcatcagtagatgacacaataagtgattcaacatttggcataatggatggaagctcagtacgagcaaaacagactgtgttgggttggttgtaacccatcagacgtatgtctttgacttgcagtggatctccaagagagatttgtattccgacatccccatagataaaagaggagagtttgggagcatctatcgatatcacctctagcatttcacattttgtcacctggaggtacttgagctgctgcatcaggcaaggtaccttaaactggattatgtcattgcaatcagaaattaccaatctctccaaagcgaatgaattggaaaggaactgccctatctcctccccagaaatatgaacttcatataaatgtaagcttgtcaagcttatgttgcaacctagagccactgtaggatgaaaagaacaagaggagaggaaaagtgactgaattgtccctccacctgccttacttgatagaatggaacatgggaagttgtattctgtccttttt

SEQ ID NO: 28357 - DNA, 1383 bp, Oryza sativa
cagggagaaataatatcttcccattaaataaaatgacaaggaggccaaattttcgtgccactgttcaagaataacatttacagatatataataaatatacatattttaatagtgaacattacagagccacataaatttcagaaaaactttcctcttcctctgtagttagcttgtaggcaaacaaatggatacatatgcacatgaaatttccacagatcaacacaacggcagagtcacattctccataatatccagcctcagcacgcaacatgatcacatttcttgctgcataatacaatgtaggcaacttcaatcatctcatgtgagcaaacagaaagatagaaaaacacaaaaatgcttttctttacagaacagcatcacagcctggttgcatttctgtcaggaatctcccaacctccatatatgattccaggagaactttagatcctctttaatcaaacaaaaaaatgtaggtaaaatatatacgtataaactttgtaaagagcaacacaacaatggaatcacattttcctatacacacaatatacttacacactacgccatccagtcatccaaaggatatagtgtcacacctcacaacttcttttgaatacttcctagaaaagttttcatcctaagacgctaacgcaaagagaagcaaatcacttctgtcaaaagggcaaaatgccacaatgatcttatttcttccacggttcaggctcatcaaagaacatggtcaaatctcctgtcttgctgttgcatactgccagaaaactttctatccttccatgtagagaacaaaaaacacaagaccttttgtgagcaaaggtaacaagagtcacattccctctgggacaatcctagtcacaaaatggatcctttttctttgccgcaagctttcattgcatccacccgtgcaaggaaacaacaagaagaagatatcaacaatttataccatacggcaaactcttctcaagcgtgatcctagctaccaactatttttattgtatattgcatcacaaaggttatcacaaggccacgtcaagactataggcatgtcatgctggctcgttttgttttgttcctttttttcaccgacatctacttcgtgacgaaatgtctctctctaatataccaccatgcccctaaacttggctttaatattgtgaaatgccactcaccttcgttgattctcccctcacatgtttcctatatttactgaactgccacttgctttctaagcttctatggggatcctctgtgacccacagatttgaatatttatgtggcataataacgtttgcaccaaaccaaaattactaagagcatatttaatgttaattttaccactttacatatgtcccattaatttacttttttagc

SEQ ID NO: 28358 - DNA, 1501 bp, Oryza sativa
cttattgccatctcacttcgataaatgaaagttgtatgattataatttttgacgctgcacgcttcgatgacataacatattttcagctgtttatgatattttgctaaataaagtggtttgaaattaaatattttcagtgtcaattatttaagaaggcaggtactatcattttagagcatgcatgccatcatcgaagctcaaagttctagcaacaattaatagttgcactcttaataatcatatccatggagtatcataatgcataatatgctgcagagacaaatccaagctcatattctgcagaaacaaacaaaaaagatttggtgcaaatgatctggggacatagcaggaaaagtgatttaacgaatcctacttctcgcaggggcaatcttgtactcacaaaaaattaaatcctatgtcaacaattaatgttaaactcacctttattcctagttttaagctatataaacaagactagccactttgttatcattgccctctctcagctcccaaaaatctcactcatgtttgattgctttagttattctccatcaagaggttgaaggctaaactactcttagttcaatgtttaactaaacatatccatacccatcactttggtaagtatcatttatgtgccacactatatatgtatatgcacgtcatttattttattggccacttttctagaaatcttaacccccttttcttacaaattcatgtgttgatgggtatattctgtggatttttattattatttggcatttattatggaggatggattcgaaggtaacatgtagagtaaaatacattgttggtccttaaagttgttgtgtgatgtcatactagtccctaaactttgaaactttgaagatggagtttgagaggagggggggggggggagagagagagagagagagagagagagagagagagagatggtaaccacaccagtatccgaaggagtatttggtattttaataagattaggatgtgtacttttttctcaaagttaagggatcaacatggcaccatgcaacaagtttagggagcacttctagtgtattttaatctttacttaaatgtgggaaaattatgtcttttaagtacactgtaggtcttgtgggagctacttttatggatgtgcctttttgtgtggcaacactatgttcaatttatttaggatattgtgcttatgtagtgtgattaaaatgatcaaatcaaaattgtgattgatgtcctaacacatactcctttgtcccaaaaaaaccccccaatcctagggatgtatctggacaacgtgtatgtctagatatatatctaggattggattttttttttttggacggatggagtactactttaattaatttcacaataactatatttggaattcgaaatgcaaagttcctttatctatgttcttacaactatttctcttcatgtacttgatttctggagatggcttccaagatattgtaattaaaaacacatccctcac

SEQ ID NO: 28359 - DNA, 1455 bp, Oryza sativa
  unsure (1)..(1455): unsure at all n locations
atgctcggaagatattcgaaaaatacgcggaacatgaatggggcgaatatctcattcccgagattcatctttgtcagacacgcaggtttgatgaaagtggacactactactgctgctcttcgcttcccttgcccgggaatatgcaagcggagcgagcctcggaataaccatttcatcccccaaggatgaaactgcggtttactattactgaaccaataatgtgccattgttggtgtggcattcttgagtgagtgagttcatataggtcttttcttttgatagtggaataagcagccatgcataatcctgtgtggcaactcttcggttttttttccttcttaatatgaagcaggagctacctgcactcctttatgaggtttagtacctcaaaaataatcctgtatggtgttgtaaacctgttgttggtctggaccttgtacaatcacactactgcaagtttatttctctgttgtttttactaatatatcttcagtttgaactcatcaatcatcttagctcccatgtgccgttttgctgctgttctgggctggaggtagccgtgctattgcatgttcagcgttcttgaaattcttttcaaaactcaatccatcattttgagagtgttttcgcggctggctttctcacttgcaggtgggcccttgtcctgcatgtcagtgggagcattgaaccgcaaaaatgaaatgtgatctcccccttagaaagccctngactctttagagcttcnatcacttctacgtgatgctgccttgtggtgtgatgtctgacagagaaaagacatcacctgcctacgaaccaaaatttgcatatgtatgcagaagtgcagagaaaaagacagggttgcagctgtatcttgttaatttgtcaccaggaattatctttttttttcctgcatcaaagcagatgtcaacagtgcaaaaacatactatcacttagcacaagagtggccagagtatgtgatgagagaatcatgtatataagaaaaaagttggcaatgttgaacttattagaatggccaatcaacaatagcaccggttcaagttggatcggagtaaattagcgcgcactatacaattacaaaaaggtcggtagctaagctgatgacaaggaagaatttcaaaaaggaaaatattagattgtagaataattagtatgagatgatcacggcaagaacaatttttcgtagctgatagaaagaatgagctgatagaaagaatgagagaacctaaggctataggctaacaattacatagatttactctacaaagcacaaaggtctataaaggtatacggtcactagtttttcttgtctacagtttgccatcagtaacagatatcggtacctgagagaacctaaggcattctaatttgaagtcaaaatgcaccctgcaaaatcattggtaatgttaggtttagtcctacatcgataattgatga

SEQ ID NO: 28360 - DNA, 1501 bp, Oryza sativa
  unsure (1)..(1501): unsure at all n locations
tcatatagaaaattttcacacgaaacacgccgtttagccgtttgaaaagcgtgccattttaatccaaaagtttatctcccactttcataagaaacgaacaggccaaattgtgcacatctcggtattttttcaagaatagtaaaattgaccttgtgcttatcatcaatgacaaattttataatagcaggtttaagtagttttaggagtgccaaaaaacctacgcaaacttttatagtttcaattttttaatcacttgtgcattatcgatgaattttgatatgaaactaattattacccctgccatcctaaaatataagagatgtatgtgtcttatccaataaaaaaaatcttatattttagaacatgagagtgctattttatctattagagtccgcagcctggtccactaaccgtgggccacccaggtcacattgggcctgctctaccacaggcccaactggagccacaactttagatcctgggcctacacacccaaaagactagtttgataggtgaggactacactcacattttaagtcgtgctccctcatcatcaattatcgatgtaggactaaacctaacattaccaatgattttgcagggtgcattttgacttcaaattagaatgccttaggttctctcaggtaccgatatctgttactgatggcaaactgtagacaagaaaaactagtgaccgtatacctttatagacctttgtgctttgtagagtaaatctatgtaattgttagcctatagccttaggttctctcattctttctatcagctcattctttctatcagctacgaaaaattgttcttgccgtgatcatctcatactaattattctacaatctaatattttcctttttgaaattcttccttgtcatcagcttagctaccgacctttttgtaattgtatagtgcgcgctaatttactccgatccaacttgaaccggtgctattgttgattggccattctaataagttcaacattgccaacttttttcttatatacatgattctctcatcacatactctggccactcttgtgctaagtgatagtatgtttttgcactgttgacatctgctttgatgcaggaaaaaaaaagataattcctggtgacaaattaacaagatacagctgcaaccctgtctttttctctgcacttctgcatacatatgcaaattttggttcgtaggcaggtgatgtcttttctctgtcagacatcacaccacaaggcagcatcacgtagaagtgatngaagctctaaagagtcnagggctttctaagggggagatcacatttcatttttgcggttcaatgctcccactgacatgcaggacaagggcccacctgcaagtgagaaagccagccgcgaaaacactctcaaaatgatggattgagttttgaaaagaatttcaagaacgctgaacatgcaatagcacggctacctccagcccagaacagcagcaaaacggcacatgggagctaagatgattg

SEQ ID NO: 28361 - DNA, 1501 bp, Oryza sativa
catagaagatccaaaacgatgacgacactgagacatgatatttggtaacggagttcagccgtagcctacatctccggggcactgattacgggcgctcctccccgatccagcatatacaacgtatcagagttacaacgactcacggccggtcgacgtcggcaaccgctccctctcgctatgctaagtcgccatgcagttacaacaggcacgtccctctatttatgagagatcctaggataaagtccgactcatactctagtcctacacctagtacaactccaagtcctaaactcatattcgacacaaactctaacataggaagtttttcatgccagttagattcatgtcgagttcatactgaagttgaagccatccttaagaatccatggcatgattcctgtacactgaagtgatcagtctcagatgaaccatgggttcttgttttgcttcttgccattcttcttctcacatttccttttgtaatagttttccaagatttttctctcaaaaagtagaacagagtataatgacttctcacttgagcacccattttcactgcattcaaacatgtacaagtattctttatgttctttcgataatgggaaaagttatctgtcagccgttctaagtattcttttctgtaataaagtaatatctgaatcagctcttgaatgtaactaaacattattagttgcttgtgcttcatatatgaataaaaaggttccaaacgttgattaactacctcttgaaataatcatccttgtcttcaaaacttagcagtctcattgactatatctgatctgattccagcataacttagcagtcccatttcatcgttggaggtagttttgcattatttaggctttagaaatttggaccgttaacaataatcgcgatcccagattcccagcctccatctacacttgtactgatagcatctccatgacaatcattttcataagaggaaaggccaaatggccctacttttctttctttacatactacttcaaccgctggggaaaccagcttgacatatacttcatccccagtacagcaaggaaaaaactactgactaacagtaacaccacctaccaaaaggaaagctgaaaacagagccaagatgataatcatatgtggactactgattcaacttggagctttcgcacagtcaaaaatgtcagtaataagaattacattccctgcagggctcctgaaccttcaacttaacggatgagggggcctcttcctcaatgcatcttctaacagcctcatgagctttatgggcttctatgagagcttctttgctcatacgcagacatttgccaattttcagaaggtaaccaccataaaatttggctgtatccagtgcaatgcactcaagtgacagtaggtaaaagtctggcttgtgacacaatgctaataaactgtggcaggcggcagtagtggagcgtttagcaatgacatggtaaacttatacatgaacggatgaaccaaacaactg

SEQ ID NO: 28362 - DNA, 1501 bp, Oryza sativa
tcatactctagtcctacacttagtacaactccaagtcctaaactgtaaccgactacgtacacatattcgacacaaactctaacaaactccaccttggcgaatatgccacgccaacctgaattcattacttgctcgaacctccatgtaccaagacttgagttgatcctttttcgccgctcacaccgagctaccccaataagcctccaccaggctcaccgtaacaagagactctgctatccctgtaacttcctcctcttgactccacctgcaacagtgctccaccttctctcatatcaccacagtcgtcttgccaagcgaaattgaattccttcctagctgtcatatcatagactccccgaaaaccaagttcaacttcatctaccgtcttaaatttgacttgatctaatccatggcccgttaactgacgtcatcaccaaatagataaatcaaactcaccagacttgaatagaaccttttcttccttatcgtcttatgaacaaagctagcaaatccaacatccacgctttaccgcatctgtagactgaattcctgataatctgagaaaattcacggttgccttgaatcacccgaagaaattaccaccatagcgattgctcttctccttcagtgacgcagtttccatatatcgccatcatgcaatccacgcagatcctggatatatcctgtcacgccccgaactagtcccgaccggaactagcccgtgacgctccaaattaacctgttgatcgataccagtcccaggaaacagtgctggtatcacaggaagacagaatatcacagcaacagaggtctctttattatagagtagaagtacagtcatgttgggctgcggacagatcccgagctcacaactgcattacaaaagggaaacggaagccaagacttggaccaaacaacacaggcgcgacttgggaactaggccgaaaccctaaaactcatcgtagctggcttgctcctggaagaactcctcatcagcaggatccgcttcatcttcttcagcaactgagggggggattatttatatagagcaagggtgagtacgggagtactcagcaagccatgggaaataagtgtttaatgctggcttcaaggaaaggctgttgttttgcaattgattttatttgaactcttttctgaaacaactaagtgagtgcttctcaaacgacacggttgagacagtgcgtttcgtccggtcggagtatgtgcaatgtatcaatctttaaaatagatcaagattggcacccggccaacagctttcaaacggccacccgggccaacaactttcaaacggtcacccgggcctagctgatcccatcagctgcagattttccaaacatcgatctcctttccacaacagcaatttcacaaacagtagtcaaataaaactacactaggaatcacctcacatccgcccataaccgtgggtacggctgttcgaacagttagttaacctctgcagagggggtacactttacccaca

SEQ ID NO: 28363 - DNA, 1501 bp, Oryza sativa
gatttcgaggatcaagcttcagatctcgagcaaggcaagccacctttgaacatcttgagcctatatttgaaatttaattatattgcttgcaaaatattatgcattgataggatcgcacttgatctgcttgtcccgtctgcaaggcagattggcggacctacctaattttgttgcatttgatcctccctttgttaattgcgataccatgtccccttgtaaccatctagttgcgtctcgatattcgtgcaccctgcgcgagtatcgacggacgccttcaaacttaaaatctgagtaacaacttgggtaaaaacttgggttttgcaaaagacttggaaaacccgacacctgggtcggtgcttgcgaactaaatgaatttccaaaaccgcggaccggggaacataccgggtgtacggtttcccgttcttgcacttaaggaccgtttccttggaatttcatccaaacataagacaagtacgaccatatgggtggaatgggacacccctggctgagtaactagcttatcaggggtgccttgatgccgagagacatgtggattcgccggggtggtgtcggggaggacccctgggctttctggcacagtatggtctgggacctaacctgttggtggtctgggacccctctcgacggcatatgggaaacctgtgtcagctttggaaataccttgtcatgaaagcttggaggtctcccgacgtggctgatccccaccggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttggggaaaggagttcgatgtttgaaaaatctgcagctgatgggatcagctaagcggatcctgctgatgaggagttcttccaggagcaagccggctacgatgagttttagggtttcggcctagttcccaagtcgcgcctgtgatgtttggtccaagtcctggcttccgtttcccttttgtaatgcagttgtgagctcgggatctgttcgcagcccaacatgactgtacctctactctataataaagagacctctgttgctgtgatattctgtcttcctgtgataccagcactgtatcctgggactggtatcgattaacaggttaatttggagcgtcacgggctagttccggtcggggctagttcggggcgtgacagattggaaggcacatatgtgcgtatatttagttgcagcagttttagtgggccatgcgcatagaagtccagcttgtcccacgatgccacgtccttgtcctaggtggaacagccacatcatctcgcgtgtgaattcattcattgatagtgtagttttgtgaaactacactatcaaaatatatgtacttaagtgccaaatgtcaaagtgtgtgtagttttctgcaacttggaccacaaaacgtgtagt

SEQ ID NO: 28364 - DNA, 1501 bp, Oryza sativa
tattcttctaatatattgacgtgcaatccttttgtgcgttcgtggaaaaattaacctttattttggtttgttcaaattagcagttcttgtctgaattacattatcaaattcggaatctaatagttggtttttatctccagacgaattgggcacatctgcaaaaataattgacgcaccaccgcgacgaggtgatatttctactggcataatgcgagaactcccgctcgataaacttccagaggtatggattgctaagaatgttttgattactatcgttgaaacttctatgtcttcgtgtgcttggatcgtaggatttatttttcctcgagggattgattgtaggaatttggtggtgaacacatatttaaacaacaaatcaacaatgtttgggcaaactatctaccactcaatgatcctgaattatcattgttacaacctttacagtactactagcagaacaaactgcatttctttgcaccacacatccttttatccggttgatttaaactagtcatcgtcttatctgagttgggtgaactattactgatcttcctgtgcagccatgtggtttgctcatgttgattcattaatactcactgttgagtgtaggcgtgtgtatttcagcccaatagggcccattccaccaatgtatatgtatagtagatgagaaaggaaatgaagtgaagcttctagaggaaaaatcacaaaactacatggtatcagagctgggtcaccggcgacctcgccgacgcgaaccctagtcggcggcggcgctgtgaccagagcggttctgcggcgacgtcgacagctgaggcggagcggcgacgtcggacagcggaggcggagcggcagtgtcgacggcggaggcggcgacggctgctgcagaggttctcgacgcgagcagcgtgaaggaggagcagggcgcacgctcgctggttgagctgcgcaaggatttggtgcagcacaagctgtagggagcacagcggctgagagacgcgcagctgttggatgtaggatcaacagagaaggatttggtgctattggctattgttgtccgttccagtggtggtgactttggtggtgctgttgctggtgctgctgctacttgagaaggtgaggatttggaggtgaagtggaagcttggtttgctgttgctgttgttctgatttggggaagaaactgtgtacgagagcttggcttgctgctgctgttgtgctgatttgggggaaactgaaaagtagtgctgctgggaggaagtagtgctactgctgctgttctgtttttggtgagaaactgaggagtagtgttgttactcctattaattgatttggctagtatcctagaagatttggttgatctgccatgggggaaattcaaggaattgagcaaatacttgagaaattggctgaagaagttgaagaaataaggggaagaattcagaaagtgaaggagaaaacaacagtgcttggcaactttgttaatctcgcacatcctatgcagg

SEQ ID NO: 28365 - DNA, 1501 bp, Oryza sativa
actgctcttaggctcctccttaacctgattggttcttcagctagcttataataaagtgcaatttagacaggggaatttttaactcttatctggtctagtgctcaaatcttcaccttattttggtttatgcaaattagtggttcttgtctgtaagccttgaattgcattagcaaattcattctctaaccttttgtttctatctctatctctagacaaattggacacatcttcaaagataatttacgctccacggcagcaagatgatatttatgcgggcataatgccagaactcccgctcgataaacttccggaggtatggattgctaataatgtcatagtctgttaactactacagtatcattgaaactgctatgttttggtgtgcttggattgtaatattttttttctcaaggggtagattgtaggaatcggtgttaaacaacaatgttttagcaaactatctcaatgaggtttcagaatgttgtgcataaattgaattcgaatgcactgttactttttaatgtttggctttctctgcacattgtctactactccatgctccaaaattatcattgttgtggtcttttcaaaactactagcagaacaattaactattaccagattacttctgtagcattagctaatttgttatctcccgatatgagctttacctatcatgaagatgacctgtgatgctattttttgtggattgatgacatataaggactaaggagtaccgtgtgttatgaagtttggttaaatgtcccaatgagaaaaatgtatatccacttataagtcttttggtaccgcatatagggaaatttaagaaaaagcacttgacctgttggccactgtccactagtaacaatttaagtatattttactaagcagctggtccttctgtttgttctaagtgaagtgtgcattgctagtactctctgaatgctgaattattcaaacatgtttttttccaggatatcttgcatcatgtatattctctaatgccattgaaagatgccgctcgtgctgcttgtgtgtcgcatggatttctacgttgctggagacgctatccaatccttgtattaaatagcaaaacaataggtttggctaagagaaaacttagtttgtatgcggaagatgtgccattgtatgagccagcgcttaaagtggatgacatggaaagctatgccatcagtaaaattgaccatattattaataaccactctggcattggggtcaaagtgtttaaacttcaactgtttgcctgtccgaacatagatgcagctgttcttgacaaatggtttgtacatgttatcaaagctgggatcaaagaactctccttggagatgtctttatgcaaaaaaaggacagaatacaacttcccatgttccattctatcaagtaaggcaggtggagggacaattcagtcacttttcctctcctcttgttcttttcatcctacagtggctctaggttgcaacataagcttgacaagcttaca

SEQ ID NO: 28366 - DNA, 1501 bp, Oryza sativa
agctttttttctgctagaaaaataatttccggtagccaatatccaaccccttccattttaataccatcaatatattaaatggtatgatgttagtctattaaacctacatactcattaagcatattgtgcaggttataaaattgtaagcgtgccaatagtcacgctcttctagtaattatatattgcattgttgaagtgtggagttttttttttccaagtgtaccttaaaaaagttctatactgcattgttgttagtatctctgcacgggacctcttcttgagatctgccagcgaggagcgcgcggagagctcatttctgtgggtcaagagctcatttatgtgggtcgaatctgtttccaacctggtaacgtttataaaatctacgtacaaggacactttgtttggactaatgcgtccacgcaggtgaacactttttcggtttgatcgctgcaacctataaatatgaatatgactcctttccggatccatgctaggtttatttttttcataaactaggacggagagagtaaattgacgtgtggtatccacgtgaagacggtctcaatctcacatgttatctgtcctttttttttaacttgacatgttatctcacatgttatctgcaggtgaacacggaggtttattttttatttgatattttaaagcaacttcttaccagaaatttagcactttataaaaatgtggtaacagaaatcgaggtgaaatctgcatcttaattagaaaaaaaaaggacctagattttttttattaagattcagatttttacctcggttttcgttagcacatttttcaaactactaaacggtggtgttccgtgcgaaagtttcaaacaagctgggcaaacccgccgacgaaggaagcgagctcaatgttgtttttcatcctgttaatgtgatgtacctttgttccgcttgtcatctaaatagctactccttccgttccacaaaatgacattttagcttctttatctcttttctaaatttactaaaaactcatatataaatctaaacacatatatagagcatatacatatgtctatgtataaatttatttaaaagcaaaacatctagcattgtgaaaaccgaggaaatatatttttttagaaaaaaagaaaaacagacaaggttagtggagtaatttagcagcctccatccagcatcttccctccggactcccgtctccaaagcaagcgccacaactcgaccctctttgcacggttctctcaagcattcacccccaatacctgagcgctccaccttcgtgcccccgactgccgacgccgcagaagcacgtacggccttgggtaagtcgtaacgtacgtatccactctcctctaacagcagccacgaatcaacaatagctgaataccactgtcatattactgttcattcgattgcatttgagtgagaattaatggttcgtcttctcgattttgcatgcagcatcttggactgaagcgcaaccgcgcgcatcggatcga

SEQ ID NO: 28367 - DNA, 1501 bp, Oryza sativa
tgtctcattgtgcgttctgcttaccagccacagtgttcttggtcactgtttaagagctgactcttcataagctaatctctatttagttagtacatactgatatgaactaaggtttccagatgctaaacagttcattttatattttatgatttttgctaaactcttcctctgataaggcgcatgaaaaaacataaatcactagagacatctgtgtgtgagaattttattcaactgcatcttcatgtggagggaacattgatcacaagttttacaatatggagtttacttgaagtacagttctacaagtttcttcagggtgtcaaacacacttgtgaatgggttgaatgcaacaggtgcactcagcttcaggtctgggaactgattcgtcaaagcctcagtcatcccaggcattgacatcatcagaccaagctggtccgtggacatcacctcgcaatcctgtggggtgtccttgatcttgctcggatcataaccgaagttggcagcgtaggacttgtacttctcgatgaattctggtccaggattaggtgttcttgagtatatctgatgcattgccgagagacgacacaatgttatgatatttcagtttacaaaatgcgtcagaataggcatatgaaggtaaggaatattggcttgatttctcagtgttcaagtccttgcttaaccctatgttgtctctatttgacactatatttggttcatggaacagcttacgtaactagattgatctttcaatatgcagaataagcatgcagagggctaagaaatagtggtcatttgcagttcagagatcagtttctgacctggataaagcttgtgtctttagcaccagacacaacggcgtaattgtcataatcggttgcaagcacatcataaggttccttgggtatgaatggtagtgtggggaaacggagaaagcatttccccttgatcatctcctgcctttcaagatctgtctcagcactcgccatgtcctcttcggacaggcattgcacccttccccgaataccggtgatgtaaccatcaggtccaccatgaacacagaatgtgtccacctggattgagcgtgatttctcatcaaatgaatacaccccctgcagtaccaacaaatttctgtaacaatcttcttacacattatatggtgcaaatggcatagaaaaaatagcatgcctgtgataacctattccaaatcagtttgatacaaagatgtcagatatcggtgttttcaggaatcaggattcagaggtacatattgctggggcatcatacagattaagatctactagtatttgtgtgtgaggattctggcactacaatacctgagtacagtgacagtcctcttgtccctgaccagcaaagccacgtttcagcgatgctacttcgaaccatctaccagagtagcgaattgggtcaaagttcttggcagtcatacccttcatcatcaaacctgtgccgccatcatcagaagggctatcgaatttca

SEQ ID NO: 28368 - DNA, 1501 bp, Oryza sativa
  unsure (1)..(1501): unsure at all n locations
aaatgcaaatcagcatcggattactacaaattaagcaagtgtgtccgggaaactaattcaactggtaatctcgctggtattatggcagagatcttcgctgatctcaaactgatatgcgacgatttttctaattaagcaacgacgacgactgggtggatgatcgaatggttttgatcgagacgtgatcttcctaggacacgggagggagatcgatgtgatctgctagctacctcgcacgtttaccgctgtctgaatttgttaattaaccacttaacatgcatctcgcagcactgttcagatatcaagaaccctttgttaattgcgtgctgggatagttcaggatgtttacaggttggggcgccgatttttggaagatctctggtagatcgatccaactcagagatgacaacgatatatttatgtatagtgtggtttttgctggtgtgtgtatgtagtatttgctctctgacctgataattcagttcgtttcgcctttttcttttcattcaagttgtttgattagcccatgcgatcagtacagtgccttatataggcttatagccaactggggcggaacacgtacattatcccccaagaatatactccaactagatgaagggtgtgtttggttgcaagccacactttgccacagtttgccacgcctaaggttaggcaaatttgacaggtgtttggttgtagccacagttgtggcaagattcccctccaacaaattgggtcccacgtgtcaatggctcaaaaaagtgtggcaagattcccttaggcttagtaagttgtggctaacaatttgatcacctcaccttaggcaaggtgtggcaacttttattggcaagtaatggtaaagtgtggctgggaaccaaacagccccgaacccaacgacatatatataagggtattgctaaatcacattccatataaaactggacaaaataactttatttttcacccatctcacatataccaatgcaaaagcaaaaataatatcttttggtttatcgaactttaataaaactaattttttaccttatttagttccaatgtatttaatttgttctcactttcacaaactctaataaaaaggttacgttaacttattttgggacaaataagatggtgataaatatagttactttggaataactagagtgggcaaatgacgggcttttcctgctttctttcgcgtgggaaatgatgggcttcttggccgaactagcaacgaaaccacaggaagatagctacacatttggcccacgtagtggaatttgcatcgaacaagtccagttaccttccctcaacttacatcgaagttaatcagcatccttaaacctcttatcttttcaaatccgtccgtattgcgattagggatgccaatnaagttcgatgtgaagatgagggacggtcagtggacttattccttctgcatcatgcaaaacagcccgattccggatacatctcatcacgttttgtctagtcgcctcgaata

SEQ ID NO: 28369 - DNA, 1142 bp, Oryza sativa
gcatgccctgtaaggatctagatacgatttcatttgcttcatatattcccattaattatttctggttcagagcagtgtactatatatattacgcagttgttgcgtcaactacacgagttgccaattgtttaatgcctgtgtgattagcagtctgaaaaaggccaagacatgagagaggcacgcacacacacacgcatgattgattggatcgatcgatatcaccaaattgatgatccagtttaatttgatcgatcgttagatcgagagatccaatccgtgctggatttatacgcagttggggctgcaatttgcattcccgcgacatgcgtggcctccttgaaaatgtgccttaccggtcgcatggcgactatcatattgatatccaaactataaattatatgcaaaacccccaatctcgcctgctacggagatctcgcgaactggtagtcactgatatgtaggtcaggctaacgacggcaacattactgatctactccctctgtctcgaaatataagcacttttattatagtgtcaagtcaactatttttaactttgactattaatagcaaaaaaaaaatcaaaaaaatcaataatgtaaaattgatgtaactagatttattgttaaacaaactatcgtaatatgcaactatttttaattaaaatatcttatttttatacttattgttagttaaagtagtatcttgaagactgtgtaataaaaaatgcttatattttggacggatggagtagcaaaaatgatatagaaatatgcatgatttgatgagctcccggtgttgtagtattatatttgcacatcatgtcgcaaaagtcaccaacttgcattgcaatggcagaatgggttagctagctagctaggtagggatcgttcttggaagtagaactttgggagatagcgagccatagaaaatcgctggagcagatcggcctgaatctttcttaggatccattaatctcagcttaatttgctctgacgacgtccagctcttcctcccatgtggcttcagctaagctaagctaagctctgtataaataggcagctggtcgccatcgctgcagctactacaccttgcattgctcgaagagagaagacgagaacgtagaggttgttgcagctggttga

SEQ ID NO: 28370 - DNA, 1048 bp, Oryza sativa
cagctactacaatctcagctccaaatccagctcctccgacgagctcccggcgctgctccggccgccggagtagccgtcgtagctggagctcatccaggagtagtactggggctgcctctgctgctccgacgagccatactggccgtggtgatgatcacccttcacttcatacgccacgaacgccggcgacgccgccgccagccggccggagccgtacggcagcatgccctcgtagtacggctgcacgccgccgccggcggcgatcctccggtgatccgccgcctcgtagcaatcctgctgcaacggcggcaagtggaagggcggcgaggcgaacggctgtggctgcggcggcggcggagagtacggcgcgtcgccgccggcggcggagcggagggcggccaccatctggttgtggaggcggatcttctccagctgcgcgacgccgagcccgcgctgcggctgcttggcgaccttgtgctgctgctccgccgcagccgccgccgccgccttcttcccctccgcgcgcctcgccctgccgccgccgccgccttccatgcacatctcgccgccggcgtggctgctgcccatcaaccagctgcaacaacctctacgttctcgtcttctctcttcgagcaatgcaaggtgtagtagctgcagcgatggcgaccagctgcctatttatacagagcttagcttagcttagctgaagccacatgggaggaagagctggacgtcgtcagagcaaattaagctgagattaatggatcctaagaaagattcaggccgatctgctccagcgattttctatggctcgctatctcccaaagttctacttccaagaacgatccctacctagctagctagctaacccattctgccattgcaatgcaagttggtgacttttgcgacatgatgtgcaaatataatactacaacaccgggagctcatcaaatcatgcatatttctatatcatttttgctactccatccgtccaaaatataagcattttttattacacagtcttcaagatactactttaactaacaat

SEQ ID NO: 28371 - DNA, 1501 bp, Oryza sativa
gttacattggtactctgttaatgatgctagcatgttcatctggattactactggacgtggtaatgtactgcgctataaattaatcttgattaagactgtgttctttcctggggtgatctgagtgagtttgtttcgttttccgcgtgtacacttcccaaactactaaacggtgtgtttttttgtaaaaaatttctatagaaaaattgctttaaaaaatcatattaatctatttttgaagtttaaaatagttaatagtcaattaatcatgtgctaatggctcaccttattttacgtatctttccaatctcctttatctcctctcctcaaacacatccggaagaactatactgttcgtcatgtaattcgaacacaactctttgtgtttctccctcagaaaagcgtattttcaatgccgatgttttcgcttaatttcaggtctccaacgaaacaacgaaacagtcagggtagctaatcaactagtagttgaaactattgtaaatttactttcacacaagtgcatgtatatctctggttaattggtatctccggccctctcgccggccgtcgcctttttccctcttcgcgtgcgctcggctgcgagaaaggatggccaggagggagagaggagacgctggttgctcctctcccatcgtccgtggatagaaaggatggtggaacctactgataggtgggtcccactacttttttcttttgtctcactgacatatgggcactatgttttgtttttattttaattttttatattttgcttctagtgtcgcatcaccgttacgtaggacgaggataagtaaaaccggccatgtagacgccacatcagccaaaatcatcattaaaactgctgagagacctgctttgtacgggttttgatagttgagggatctgttgtatttgatttttgggttgaagaacgaaaatcggattcgttgacaagttaaggaaccttcaagtgaacttattccctacaactaaacattcctgccttaaaactcaaaccaatttggtccatgccgctagaatgggccatccaattgctcgcaccagctgcaagcagaaaaagtacaccgaaggtccctcaacttgtcagcgggatacaaaatcgtcctcaaaccacaataccagatatccggcgtctcttaactaataaaaaccggtcacaatagatccgtcggcggttttaattccggttttattctacgtggctgctgagtcaggacccacgcggaccccacatgtcagtatgtccacctcagcctcctctctcttccccctcttctctcccttcctcctctctctctctctctctctctcaattttctctctggggctctgggctgggcaaccggcgggtggggaggagactgacggggcgaggcgggagaggaggtccggtggccggcgacgccgcggcggcggcggcgacgcgggagcaggggagcatttcgcgaccgttttcttccgctgaatctggtatttgcggcaa

SEQ ID NO: 28372 - DNA, 1160 bp, Oryza sativa
gtttttttagctataatggctaaaatttggcttagagaggttgttggagatgttcttattagttgcttctgatttgattagaggcgctgttacattggtactctgttaatgatgctagcatgttcatctggattactactggacgtggtaatgtactgcgctataaattaatcttgattaagactgtgttctttcctggggtgatctgagtgagtttgtttcgttttccgcgtgtacacttcccaaactactaaacggtgtgtttttttgtaaaaaatttctatagaaaaattgctttaaaaaatcatattaatctatttttgaagtttaaaatagttaatagtcaattaatcatgtgctaatggctcaccttattttacgtatctttccaatctcctttatctcctctcctcaaacacatccggaagaactatactgttcgtcatgtaattcgaacacaactctttgtgtttctccctcagaaaagcgtattttcaatgccgatgttttcgcttaatttcaggtctccaacgaaacaacgaaacagtcagggtagctaatcaactagtagttgaaactattgtaaatttactttcacacaagtgcatgtatatctctggttaattggtatctccggccctctcgccggccgtcgcctttttccctcttcgcgtgcgctcggctgcgagaaaggatggccaggagggagagaggagacgctggttgctcctctcccatcgtccgtggatagaaaggatggtggaacctactgataggtgggtcccactacttttttcttttgtctcactgacatatgggcactatgttttgtttttattttaattttttatattttgcttctagtgtcgcatcaccgttacgtaggacgaggataagtaaaaccggccatgtagacgccacatcagccaaaatcatcattaaaactgctgagagacctgctttgtacgggttttgatagttgagggatctgttgtatttgatttttgggttgaagaacgaaaatcggattcgttgacaagttaaggaaccttcaagtgaacttattccctacaactaaacattcctgccttaaaactcaaaccaatttggtccatgccgctagaatgggccatccaattgctcgcaccagctgcaagcag

SEQ ID NO: 28373 - DNA, 396 bp, Oryza sativa
atatctttactcgtatatatatactcctatcaatccgaaaattccccatttctattcccctgcgcccccacaccgaaaattctctgtcgcgcgcgctccttcctcccgtctcctctcctctcctccgctcctcgcgcgcgccatctcgcggaggggatcctggtgagcatcgcacttcctctctctgattcatctctctctcccgccctcgattttttcgcttgcgttcgttaaccctagcttctcttgtagatctgcaagaagttcttctcttaatttcagagccttaataacagtttgagtttgtttgttcccccgcaaaaaagagtttgggggggttcaattgaagttggatccgccgcccctgcagatttggtcgcctagcttccttaccta

SEQ ID NO: 28374 - DNA, 1501 bp, Oryza sativa
cagcatggatggtgttgcgagcaccggaagcaagcttgcggatgccgccgccggtggcctcctcctcctcctcactgtcatggtcgttgtatgaccaaccacagcagaggccacgtccttgcgcaccttgttctgatcttggataggtgtgactaccattatcagcagcagcagcacaggagcatttagagaatcccagccgtttgctggcagctttggcagtgtgggtgacattgaggaagaggttgcgggcgcaaccgccggcgtgctcatcggcggcgtggtaggtgccgtcgagctcgtcctggatgcggaagtagtcgagctcgtccagcacgtcgtcagcgtcgaacgccaggtctcgcagcttctggaggagctccttgagcgcagggctgcgtatgtctttgccctgcgcgttgtcgagcaccccctgcgcgtagagcagctccatcttgagggcgtccacgttgggtccgagctcccggctggccgcccacgcctccaccaagccgtccgagacggggccgagggccttgcccaccacccaccgcgccgcgctcacggcggaatccatcgatccgatgcgcgcggttgcgcttcagtccaagatgctgcatgcaaaatcgagaagacgaaccattaattctcactcaaatgcaatcgaatgaacagtaatatgacagtggtattcagctattgttgattcgtggctgctgttagaggagagtggatacgtacgttacgacttacccaaggccgtacgtgcttctgcggcgtcggcagtcgggggcacgaaggtggagcgctcaggtattgggggtgaatgcttgagagaaccgtgcaaagagggtcgagttgtggcgcttgctttggagacgggagtccggagggaagatgctggatggaggctgctaaattactccactaaccttgtctgtttttctttttttctaaaaaaatatatttcctcggttttcacaatgctagatgttttgcttttaaataaatttatacatagacatatgtatatgctctatatatgtgtttagatttatatatgagtttttagtaaatttagaaaagagataaagaagctaaaatgtcattttgtggaacggaaggagtagctatttagatgacaagcggaacaaaggtacatcacattaacaggatgaaaaacaacattgagctcgcttccttcgtcggcgggtttgcccagcttgtttgaaactttcgcacggaacaccaccgtttagtagtttgaaaaatgtgctaacgaaaaccgaggtaaaaatctgaatcttaataaaaaaaatctaggtcctttttttttctaattaagatgcagatttcacctcgatttctgttaccacatttttataaagtgctaaatttctggtaagaagttgctttaaaatatcaaataaaaaataaacctccgtgttcacctgcagataacatgtgagataacatgtcaagttaaaaaaaaaggacagat

SEQ ID NO: 28375 - DNA, 1501 bp, Oryza sativa
tttattctctttcattgtaatttgtagaagttatatttaaacttacatatttatgaatatcatatattgatcttatcaaaaaaaaatttaaatatttcatagttgtttgaatgtcatgcaagaattgattgatttaaagtgcaaagaatcgacgagaattatttgcagtactgacggtcaataatacatgtgactgcagacaatccatatccaaaaaagaaaaaaaacatctcccatgccatatctatgtttcaatgtgtgttctcataaaatcactgcaagatgaaaattccatcagttgcggactttcagtaaaccatgatcaattttttggctgtgatatgccaggataagcgctagctacggcatgatagctagtgaaggaaaaaacacagaccatctaacatggcaggcgcataggatcttttgattcgctttatcatcattcaaccaaaggccgtcggcctgagtatatgcgccaaattacaagatgcccgatgaacacatagaccaaattgaagatatgtatggcgcctccctggctgcaggctcgaatgacgagagatgcctatcaagataaaaagttgcacaacatactccctcaattccaaaatatttgacgctgttaactttttaaaaaatatttgaccgttcgtcttattcaaaaaatttaagtaattattaattctttttctattatttactttattgttaaatatacttttatgtatacatatatttttacatatttcacaaaaatttttgaataagacaaacggtcaaacatatttaaaaaagttaatgtcatcaaacatttagagaaggagggagtatatctcaccggagagagattctaatagctcaaggaacatcctattagtatttattacatgtaaccaattagttatattatttttttagaaataaactttatgttataaccggtaagagttaactttgaattttcatgatttattatctattaatctatggccttttttatatccaaaatttttggccgaaaacatcacattaaatgtttggacacatgcatgaggcattaaatgtggggaaaaaaactaattgcacagtttgcatgtaaattgcgagacgaatgttttgagcctaattacgccatgattgacaatgtgatgctacagtaaacatttgctaatgacatattaattaggcttaataaattcatctcacagtttacgggcagaatctgtaatttacggacggaatatgtaatttgttttgttattagtctatgtttaatactagtatattttaaaaaaaaactttacccccaaaaaaactaaatacaccctatatttattagtatttttaattttttatacttgacatgcagcatacagcggatgccgactcgattaaaaaagtttatcatatcttaccgattagatgcaccgcccatatgtgccacgaagaaaaaccgatcgagcacaaatgctcccgtcccgcgcgcgcgcccatctcc

SEQ ID NO: 28376 - DNA, 1501 bp, Oryza sativa
tgatttaacacattttcttcctgcagcccatgtatatagttccccacccggccaccccctttctaacacctattatatatgcacggggtccatctatctttactcgttgttaagttgtgctcgatcaggaagaacttcaaaatggtggaaacattgcagattgcacatctctgtacatctctgttatcgatcccatctgtaatccacaatatatcaggatgccatctttctgccttttgttcaggcagtgcaattcattgatgacaactaccaagcaggacaagaacaataatgaaaggacatacattcacaagaaaaaaacagtgtgagtagcagaacagctcaaacacaaattgttcctatcaattggttcttttataaactgtaccttttttttggtgaggtttcataaaccatactaaaggatgtcagtttggtaggtgtagaatgaaaacgagcttcttgtgaaaatggatatataatgcaattttgcactatttgttcatattagtttacagattccaaatattcttccgcatgtacaggattatcgtttgttcttttgcaagtttttattttaatacttcttacatatgatatggtcatatacttataggattgctccgcatatataaatatgtaaatcttaatatactgtatttgtcacatccatgccatcacaacccaaatcaaagtactccctccgtttcatattataagattttctagcattgcaaacataagaagatttcacccggatattaattgaaacaaagttcagtacagagtaacatactcatcaaattctggaaagggactgaaatttactttctccgataaaaccatgcataaatcagacaatggtttccttcatacagtatgccggtatgcccattcatgctaaaggccgaattctaaagaacaactcgaaatggtgtatttattgtaaacgttttctatacagaagtctctttaaaaaaatcaaataaattcattttaaagtttatataattaatacttgactaatcatacgctaatgatttatctcgttttgcataccgctaataattaagcaagccccacaactccttcgaactgaggctaaacgttcacaatatacgcatgcttctttttccaacaaaacattacattaattctttgttattctcatctcttctagtttgcaggatatatatactccatttaccaagcatccaagctcttcttttattccatctacattcttctttgcttcaatccatatgatctgtgtaactgtctgccttccctaggccctagcttgcctgaaactttcagctcagtcagaaattcgcgggcatattgataggtagaaatgtgtctagatttctctcctaccttcccgtcgaaacggccatctggcacgtctcggcagacagcaatgcacaaaggcatctatctcagaacaaattcccttgcacacacgcacgcacacctttgggggctgctggtgttgcaggca

SEQ ID NO: 28377 - DNA, 161 bp, Oryza sativa
gtgggaaatgctagaatgacttacattatgaaacggaggtagtagtacgtagctgatgtactgtactaatgtctgatcactattagcaatatgtttatttttttctgtagtgctcataaatatgcgtcataattttattattactattattattttgtcaa

SEQ ID NO: 28378 - DNA, 1501 bp, Oryza sativa
gtttgagctgttctgctactcacactgtttttttcttgtgaatgtatgtcctttcattattgttcttgtcctgcttggtagttgtcatcaatgaattgcactgcctgaacaaaaggcagaaagatggcatcctgatatattgtggattacagatgggatcgataacagagatgtacagagatgtgcaatctgcaatgtttccaccattttgaagttcttcctgatcgagcacaacttaacaacgagtaaagatagatggaccccgtgcatatataataggtgttagaaagggggtggccgggtggggaactatatacatgggctgcaggaagaaaatgtgttaaatcaatctacagtctcattaggagattggaaaagaattgaaggtaaagactacaagagtgtcctgaaatgacgagagcccgcgattgagtgcatcatgcatcgattggatcaaacagggatcatgattcatgagcatgagaggcaggaggagcacgaggatttggcgagttcgctgccaacgcacaaccatgtttagatggtgcttgttcgtaaggcgttttactaccagtttaaatcatgctgaattttcctttttgccttctgttcttctgttcttctgtaattggctttaaattttgttatcagctacacgatgttaattatcagtccttatcttttcctaaaaatttactagctagaattctgataagaaagatggttcaatacaaggaccattgtatattccatctgtcttgaaatacttttctgtggatgttattcacctcttaacttggttgtttttttatttgaagaaaatgtttaattacttagaagtatatttcctaacaaaatatattacattctaatataatcataaaatgttattatattttcctataaacttgatcaaacttaaagaaatttaacttgtaaaaagtcaaaatgacttataatatgaaatggaggtagtagtcaataggcatcattatttggaacgtgagagagtatgtaaagaataatttttaaagataataccattttaatagaaaattgtaaaatagaagttggttggctgaaagtttgtaaaaacagtattactttaacaaaattcagtatgtaaaaaagtaattacttacaaatgacaacgccgtaatagtatagtaggagtaaaatttagcatatatgttaaaattaaggaccttctaatttagcgtgttacaattaggcaccgttattggctctcataccctagcttccatacgattggcgaagagccatatatagttgcaatgagatcatcacgatcattcacgatatataactaacctgatggttcttccttgtaagttaccggcaggcagcgacgatcgatatagctaaacctttttctgggcgtctggctgcttcttgcttaattaatgttgcatacgaactgaaactttatactccagactaatcactatcacactatcagagagattcagaacagtaatcg

SEQ ID NO: 28379 - DNA, 181 bp, Oryza sativa
attcctgcagccctgtgcggaggcggagctcgggtggcagaggaggagcctgtagctgccggcgctcggggcggcgaagctcgagaagcccgcaactgccggtgcacggctcgtcgaggcggtggagggggcgctcgcagagcaagcagatgacggcggcgggcagagctcgggccggtga

SEQ ID NO: 28380 - DNA, 567 bp, Oryza sativa
atggtatggatccaattaacctatgagaaaaaaatacttaaattgacaaacatctttgttccatgggaaaaaaaaaaagaaaaaaaaagtacgaattaaccccctgaactatcgcggtcggccgaattaccccctaaacctaaaaatcagacattatttaccctaagctttcaataccagacgaattacccccctcgatccaatccagagcggttttggcctatgtggcgtacgcgtgccaatccagtcagcattttcttttttttaatggtagggcccacctgtcatgtatactctctcatctccactttccccttttccccacttcctctctctcggcgcacacggcggcgtgctggggcgggtggtgggcggcggcgctcggcccactgcagcggcacgcgacgcaggtcaagcggcagcgggtggtcgtgaggggacgcgggaagacggcgcgggcgcggtcctagtgcgaaagggcgtcgctcggccgtgcagcggtggaaggcgagcgtcgcgtggcgcgcccgggcgtcggtgcagtcggcggtggcgatgcacggcgga

SEQ ID NO: 28381 - DNA, 1476 bp, Oryza sativa
aacgacaatgataatatagtggttatgttttgtgaacccttactgtatatgatcagtatttggtagtttgtagttgtgggcagtatactgtaactgaaagcgaaatattaatgaaagttatatatttttaggaaatacagtacaaatacatacgctcacaacacgtgcacactcacttctatcaatacacatatgcatactctacttcaatgaaccctcgaaagactgggccgatatatatcctgagattacgaaggtatcatgagtacctcgttgttaacgggtgtgtcgtctatcactgaaagaataataagtttagaacttgaacttagggtgtttagatcacaattttttttttgccaaaaatgtcacatcaaatgtttggacacatgcatagggtattaaatgtggatgaaaaaaaacctattacacaatttgcatgtaaattgcgagacgaatcttttgagcctaattgcgtcatgatttaacaatgtgatgctatagtaaacatttactaatgatagattaattagatttaataaattcatctcgcagtttacaggcggaatctgtaatttattttattattaatctatatttaatatttcaaatatgtgcacgtatactttaaaacaattttggccaaataactaaacacggccctataggtggaatggttccaccgcatgtagaatctaactagttaaagattaaaattttgaaagcacggaaccgctaattaccacggcgttaagggcgctaaatggtggatctatttaattaaaatcgtttataccaaaaataaaaatgctgatcagtactggagacttgagtaaatccaaatcaaagaaccttgaccggataaggtagtaaggctcttgctggtaactgtcaccaaccaatacttaattaattgtagttgagttatcataagaaccaattaactaatgccaaccctccataaactgctcccttttgcccagaaattgtgtgtcgcacatagctttcccgatttctgttgataaagcaaaagtagagagagagagagagaggaggcttggaaaaaaaatggacatcacaaaagcaggagaagaattgcaggggaaagttcagaaatgaaaggagtgaagcaaaaggaagataaaacaaacaaaacaaaagcccagattcctctccaaacatgccatgcccatttcccctccaatctctctcatctcctctctctctctctctctcttggttctctctctctttctctctctcactagacccatctctagaaagataaaggagctatgaaagaaagctctaaaaaaaggccatgagagaccttaaagattgacctgagatttgcacaggaaatttgcaacaacaacaacacaacgagatatatcaccttgatatatatatctgttgcaattgcaagaaaaattcttttctccccttgcaattattctgtgctcatctcaatcaagc

SEQ ID NO: 28382 - DNA, 1501 bp, Oryza sativa
  unsure (1)..(1501): unsure at all n locations
aaaaatatcacataccacctacttactcctgatccattgaaaacttatctcctcacgcagagctgctagtgcgcgcacgtacacagcaaatgccttctccgtctttgtatgccaccacaaatccacaatatatatgcatgctgctgtcagtgtggtctctcgttttctgcctcgaaaatgaccggagacattggtgttttctccggtgttctttcgatctcaccacacaatatatcgagcaatccgttcgtgaacgatgaaacccaatcggataatacatggttcgcacgaactgcgggtagagatcgccgagattgagcggagtgacgcatggttcttggacgacgtcgatctgctagtgctagcccgatcggtcctgtaaattaattgccccgtcgcactattaaaaagcatntttacgtacggtaaaaactattttttttcatgcaactgtcttgcatggaaataacgattttttcatgcgggtgacaccatcgcatacgaaaattccgttttttcctctttacatgtgaacacagtgcgcatggtgttctgtttgatggtgcccactacggtctttagtttgcaagcacgcctgtgatatccataggacatgctgtctgattattgtattacatattatttcttattgcaataattccagtttctcttggcatttggctggacaactcgaggatgctataaaatatgttcgttgtaacctggacacaaatctgtatgtaagctgtaggttgataaatattagctaggcttactgaatataataattttatgtatcaatttattccatcacctcattctatgctcgctaaaacatataccattgcttgtttgagttgtattatcaaatgttaccgtagtgttagcacagataaactacttgtgtgtttcaatttaagggcttctttaatttgtaggaataacattatggaggactttaatcctatgaaaaaattttctatgaacgtctttgatacagaggattgaatcgtgccttatcctttaaaattaatatggaatagataattctgtagagattttagagaaaacttattaagagcgtcaatctcgaaaaattttcattgagcgtcaatcttttcatacagtctaatcaaacgaacattcatatgtatttcatgcgttttgcaatcctctgtttaacatttgtatttctatcagaattctttattccttcgttttttttcattcgtgggattaaaacgtccctaagataatatgttttgaatctaacgtttggctaccgatcgacgaaaagcacgttctatttttctcatcgcctcaccatgtttagtttctctagtcaccaaccttgctagcactatatatctaggcgtcaattgatacactccagcatccaactcaccatctcctcctgtcctccctcgcgggaatcacctcacctagctagcttgcgagtgacacgtcacccacacgcacgcacgcacgtacggcgcggaca

SEQ ID NO: 28383 - DNA, 1299 bp, Oryza sativa
gcaacattgtcgccgttatccatgtatgccggcaaggacgtcttttggcggtgaacatcgtgatctggcagatttgagcaagcaaagccattcgatctgtataaattgcaggggaatcgatcaggttgcgtgtcgctgatagagttggttacaccctctcctctactagtagtagaactgaatttcttgtgaatatgcaactctggagccaatcttcaggacagaatgcagaggtgactacatgacatatgacaccttagtggacctcactgtgatttgtctccgagcaaataaactgattacgatgaccaggtaaacttgccatctgtcgaaccaggattgctcaaatcgattgatcttttcctttccttctactgatccaaggccaggagagcagacagacagatgcaaataatctcaattttctctccaaagattgaaaggaagaaaagggaatacgaaaatgaaaatgaaaatggaaagggacaagaaatattctgacgttttgcttccactctgttgagttctctgaatctgaatccagtgagtcgcgctcctcgtactcaagcttgctcgcacgtctctgcttccactcagttgaattctttcgatctcgacgtcggtctagtgacgttctcgatcgtaatctcgttgtcaggcactaattaacctgttccaacttgtcggaagctgatatacagtaacatagtagtactatagactacagtgtatcttgttgagatatcagtctttgattgtttcggagctcggcgagatcgaccaatcgatgcaagatggagtagtagtaatagctgcacgaatgaataagcttcaatgttcaaaaaaaaaaaaagaatatgcttcgagtactggtgatcgtcgtgtcactctccactggagctagattactgctgacagcaaccggataggccaatttggctgcatgggcttcatgtcttgtccttctgctgttaagtgcctggatttttcacattttggttcttctgaaaaacttattttataaatggacccttaaaaaaacttatcctagaagtggtcctttttgaggccgctgcatgtgcttcatgtcctgtccttctgctgttaagtgcctggatttttcacattttggtccttttaaaaaacttatttcgcaaatagacccctgaaaaaacttatcccagaagtggtcctttttgaggcgccagagtggctggcgccgtcattcaacgggacggcgcccgttctcctgccaccgtggcacacgcgaaccgacgtggcaggacgagggcgccagca

SEQ ID NO: 28384 - DNA, 447 bp, Oryza sativa
tgttgtagacatcgataggttaattagcatgtatatatggagaagcttttgcaaaggaggtatgcatggtatatatgagtagcaaaagtaaataaagctttctggtgtcctctcaaagaactatacatacacgttaacacgtaccatttgttttcactctttttgaaaggaatccctttgtgactcaaaagaaaaagaaaggatataagcagtactagtatatgataattatacagtatatacaattatctatgagagaggagaaattacatgcaatatatagctaggaggatatatatcaatattacaatatatgtactcatcagtactacccaagaaacagaaggaataattagtgtgttttggctgtgtttagttcagcgcaaagtttagattttagttaaaattagagatgatgtgactgaaaagttatgtgtgtatgacagg

SEQ ID NO: 28385 - DNA, 1501 bp, Oryza sativa
gcatttgcaatagaagaacgtccacaataggttcaatccgcatctcttcttttcttttttctatcattaaagaagatccacagtaggttctcttcattcgatgagcaaaatgcttcgtgtgatcgagctgcggaaaacccggattgcaagtgaataatttttgccttacaaattggaataaatttctctgattaagaagacagataagaaaaagaagacctgaatcattatctttctttttgaactaaggaatcattatctttccgtaagcataccaatcatgaaccatctttgtatcacaactcctggggttgaagcagacaagaccgtgtgatctgattaaacgcgaaattatctctagtttataagctagttggagaatcatcataaggctggctaattaaactgtaatgcgcttattgcatgtcttggggcttgtccatttctcttttctttctttctgatgttctagatgatattggctcatatcatgggcactgcactttattctagtatcttgttgctaccaatgattcagattatgcttgcgcacgtaagagcatcatcacccaattatatacagtagccgtatatacttagtatctgtaattaaagtattacaccatgcatttgatcctgagtgaaaaaggcccagtatatggaatgctttctttcatttattctgttttctcatcaagaatgatcattcagtaacttgggttcagtctttcagaattcaaagaatattttaactgaattctgtgaattctgtgaattctgaaagagttctaactgaaatcttgaagacagacagaaatccacgttggacttgctatgctaattgagttgctaaccaaaatggtcacaactacatgtcttgctcagctattcctgtgataattataataaaacaagaccgcatttctcaaaccaaaaggcacaagacaccaaggtctccacagaagagcacactagaaacagtccgttcttccaaaggcaaactttgagctcttttgtagagatgccatggaaatgcaaaaaaaaaaaaaaagtgacacttgattagaacccactaactattgcatgatcccataagcacaattaatagcactgcctaccccctcttgtctttctcctagctcccataaattggacaacctgacagtgtcctccccctgtacttgtctgaacttttgatttgagttacttctgaaagtgagcttataatttgatgctaatctccatcctacattcctacctccaaactcagtcctaatcctatcaaatctactcatctaccatcaatttctaagtgtgtgtaagtttgctaaaatctatattctgattctcctccttaatttgttcttgatatgatacacttttagctgcagttcattctgcataaaggctactaattaacttgttgacatgtagatttaagctataatcaccaaacacaatcaaatggttcttgctaatttcctcttcactcttcaggcaa

SEQ ID NO: 28386 - DNA, 835 bp, Oryza sativa
  unsure (1)..(835): unsure at all n locations
tggagggtatttacaaaaatccatatgcatataaacttctttactattatttctatttagcctaaaacggtcgtgtgttccttcatcaaacaacctacacatgtgtgggctgtggagtacttatataaaaatgcattattgacacagacacaacactaggaaagtccaaaagtggctttctagagttgccagaaatccgggggggngggggggggatcaaaaatggaacataaagcacttgcaaaatcagcaaagattttagaccagggcagaagcccttattatcctcttttactctgacagactcctatgcttgaacttgcattctattgaaacactaggcctttctaattgcttgtgttaatagtacatttcatccatagaactatagaagtatagaacttcacttaggtccctatccttacctttatattcattagaagtcaggattgacctcttgaattcattcagcttatcaacaagttgtgggtggatacccaacggaagcgagatgaagtgagtgaagctagacattggactgtcaacagcctgaaacaaagaatgagttcatcggtccagaatgataatcatgattagctgacataactagcatttttaacatgataacatagttgattcaatcagcttataacatgtaaccccaaacataatcttttcccaacaaaatccataaaaacaaaaaaaaaaagaaaaatcccaccaccactagctcccaactgacaaactctggatcaaacagctgccaggctaaacctagcaagacgacaatgaatcagaaattggtctgtgcgtgcgtgcgtgcgtgtgtgtgtgt

SEQ ID NO: 28387 - DNA, 320 bp, Oryza sativa
cccccctctctctctctctctctctctctctctctctctctctctctcacacacacacacacacacacacacacacacacgcacgcacgcacgcacagaccaatttctgattcattgtcgtcttgctaggtttagcctggcagctgtttgatccagagtttgtcagttgggagctagtggtggtgggatttttctttttttttttgtttttatggattttgttgggaaaagattatgtttggggttacatgttataagctgattgaatcaactatgttatcatgttaaaaatgctagttatgtcagctaatcatgattat

SEQ ID NO: 28388 - DNA, 792 bp, Oryza sativa
tccagatttggactgataagctagaccacactattccattttaatttcccgacatgttaagtgcacccaccaggtcaccaccactgctagtgctttcctgccaagttttcagtttctacaccctctataagttattttaattagttttttttgaagttaaacttcttttaagttttgctaaatttatataaaaatatagcaaaattttcatcagaatacaaaatatattgaatatgtacatttaatagtgggtctaatatatgaaattaatttgttggaattgtagatatagccgtatttaatagaaacgcagtgtcgtatgacatggaacatttggagttctaatggttagtaatgtgataagattcatgtacagatctgagaaacagcccacttaacacgcaacggcgattgcatatctcgatcagtttcgtcagttaattttctctgcaacttcctgaacttctgtttcatttcgtcatttccctgaccaacccaaccgatcgtcatcagcacgttcatcacggtcagcgtctagaacactgtggatatatgcttgatagtacagtagtagctatagcttggcgtgatcccaaattaaatcatccccatacctgacgcgagaaactccagagactagcagttcgtccagcccttcaagcaactgcagccatgaccatgaacatattcagatatatatgccctcctagatagctgcagctacagctagcaccgcatgtggcgcacatggagtgaagctgttcatccgcggatgaatccaagcgacgccca

SEQ ID NO: 28389 - DNA, 217 bp, Oryza sativa
atattatagctaatttagcttgcgttaattacacacttaccgacgacgacgtaccccggccctttggatcaattattccatccatgcaatgtgtgatagatttacttgaggtagacgctagcttagcttaattagctacatctaccgacaattcagcactgagacacactcaggctgcagtgatcgatctcgatcgattgatcaatatcgatatagg

SEQ ID NO: 28390 - DNA, 1081 bp, Oryza sativa
atatatatatatatatatatatatatactccctccgtcatataagggatttcgacattttgcttgcactatttgaccattcgttttattaaaaaaatatgtataattatttattttatttgacttactttattatctaaagtattttaagcataacttttcgctttttatatttgcacaaattttttgaataagacgagtaatcaaacgtgacgagaaaatagtgaatatctcttatgttaggggacggaggtagtatattaattggacataatgatatgagtccatatgtgactgtaataatgacagcattaaaagtctaattgcttgacgtacggttgataagtcgtaagaaaaaaaacgaatcaatacaaaataatttataggtacattttttatatctatattatatattatttatgatttaaaagtcagtgttgaaaatagactaagataaaaaaattcttagaattaagttttaaaatttaaattttagttgtagctgataagctaataagtaaaggatgagctgtgcacccagtgttgatatacactcatcctttcctaaatactgggtaccagacattattcatatgcaatttttttgtcactcttattttagcaacaaatttacaaatatttgaaatataacatattgtcaaatgatatcatgtgttaaatatataaccatataatttctcgcttagaaaacagggatataatccagaaatactgatgatcatagttgaaacaaagttggcgagcgacagatatcacgagaagaaccgcataaattgaagaggagtttctttgagagattgcgaagaaaattattgggacaattgcatccatgcccccagttttaaacccaattactgttttacccccactttttagggtttgtagttttaccctcaccttttgaatctgaatcatccgtctatcctcacttgtaacggccgtttggtgggtcccatgttttgtgttaaagaaatacaaaaggaaataaaaaaaggttttagaaaatatgaatttacctttatgcccctgagggaatggataaggtcctcccaccccgtgca

SEQ ID NO: 28391 - DNA, 212 bp, Oryza sativa
ttttgttttgttttgtttttgttttttttttccctcttgcctgtactgattactgaaattcagatttttcttgttagtgtttcttagcattaccttgtgtgactttttcatgatataggacgtactctttaggattaccttgtgttccctacatatcggtatatcaagtgtatgctggaggattatatatttcaaatataacccagttttga

SEQ ID NO: 28392 - DNA, 155 bp, Oryza sativa
ccgaatgaggccacataaatatctatatgagtctttcaaaccccatttagttttaaaggggagattcatgagctagcaattatatatacatttctcaaaatcttacccctcaaaatttcacttgacatgctgatggctttgatcacatgcggaca

SEQ ID NO: 28393 - DNA, 537 bp, Oryza sativa
cgcacgcttttcaaactactaaacggtgtgttttctgcaaaaaaaatttctataggaaagttgctttaaaaaatcatattaatccatttttgaaatttaaaatagttaatacttaattaatcatgagctaatggctcacctcgttttacgtatcttctcaatctcttcaattcccttctcctcaaacacaccctttgtttttatacgggcaaccaacggccaccacctcgctgtacgacttttttccaaatttaaattttgaaaatctgaagcaaagaccaatcaaacaaatccacattaatgcactggctagtggggccaccaaccccgtcgtactctccggaaaatgacccaaaaaaggagtaaaaaaaaaggcgaaacgaaaaaaaaaaaggaaaaaaaaatcgcatcccacccaactcgctcatccgtgcgctgcctgccactcggcccaatcccctccgtcccctcctcccctcccccttctccccaaccgaatccacgcgccccacctcgccgccgtcgccgccgccgcga

SEQ ID NO: 28394 - DNA, 239 bp, Oryza sativa
ttttgtggagcaacgtcttttaagaagaaaatgttgctgcagagacatcaccgtcgagtcgaaacgatgaaggctagattcggggaaatatactactaccttcgttttataatatataagttgatttgacttttttctaataaaaaatttctaagattcacctaatatgtaaaaaattttagcaacgtctataacaacaacttagttttattaaaaccaatgtttactatattttgaca

SEQ ID NO: 28395 - DNA, 1501 bp, Oryza sativa
acgacagtgattgattcttgcggtttctaaggtggaagcaggcaattctgaccatgcaagttcatctcatgttgatttggcctagacgcctagttggctgtccgtgcgtggatggaggcagttgttcagaagtttaacttatgagtttattctgtttattcgaaacatattctttagctctagcgttggtgaaacattagcgcagatgattcttgtagctcccatctcattattatgtataatatatatcaggtttgttatctgaattttcgatcgtgtattcctgtagactctagtttgaaagcggcgtgacattcctgtatcggacagttattttattagttcatcacttatagtgttattttagaggaggaattcagcttttttttttactatttcaaaatctatttggtatttttttataattagcaaggttcacttaatattaactattcgctcctggtagcaaagtttcatattgtgatctgataggcttacttggaaaatcaaacaaagttctcaaaccgtttgatttaattaaatgtaggttataggatatcgaaatttaattacacagtgctacatcagtgtagtaagaatttgtaagaactgtgtaaaaagtgagcatagtcaactaaggtttcttgactataaaagcaagtttaatagtatacttagctactagctccaaattatctatattaaatttaatagctaatttatataatagttacttataaacatgtactacactattaattcatggtcccatctgtcatgcacacattgtgttttggagtctgtgctgcagttggctacaaatatgttgcatgtcgctcttctctacttttttatcttctcgatatgtttatagttggcttgtacctgctctaagggtacttgtggtggaatcagtctattcgggtttaagttctacactcaatgtgagtgttcgtatttaccataattattcttttagtgataggcgacataactatcgatagtgagatattcatggtgattttgtcaacttcaagatacattggcctagtctctagaaggtgtttatgagggtatgagtgcctgtgtactgtaacgtggttcttaaaaaagagaagctgggtaagacaaattttcgtatgtacggattatttctccttgcataaaaagaattaaattgccaagttgggccccaaagcacacggaatcgccttgttctccaggcctaacgggccggatcgatcccgccaacccgggccccgccttttgtgctgacgaacgaaaggaacacagtcgccgcacacatgacacgcacgaacgcctctcgtgtcgggtcggatccggatcgtgagacgtcgccgccgcccgcgcgtgctctcctctcctctcctctcgactctcgtggtggcgcagcaagaagaaaaaaacaaaagaagaaaccgaagcgtcccaaaagaaagaaaaaaaaatcgagccaaaaaaaaaaagaaaaggagaaaaa

SEQ ID NO: 28396 - DNA, 587 bp, Oryza sativa
tgccagttggtggcagcaaaatccacaggccagccttccttagccatctcctcccatgtcggagaggatgacatgttggtggtgaagttggaatcgaggagtttgggttgtgtctccaacacctgcaatccatcaccgcgagggatctagatgaggaaggagaggaatacaagcttacatgttgggtgaataattatttttttatatttttaataatattattgactagattgccacataatcagattaatgccacatgtacaccagctaggaccaaaacccctcttaggttgaggggtgtaactcatcgggtttgaaagattttgaggcacaaaatctttggtatttgaattgaggggattgtcgacgtgggatacccctagaccggataaatagggtattggggtacgttggtacgaggatctacacgatacgacgtcaagcaaacaagaatatagagattatgctggttcaggcccctcgtaatgtaatagccccaatctagtttatatgagattgatatggaaaaccacagagtacaaagagaacagatgaattcggtgttaccagcgagatccttgtcgaga

SEQ ID NO: 28397 - DNA, 1501 bp, Oryza sativa
ccgaaagaaaactcaacgagagtgagtaaaaataaaatttcagctaagctcactggcgaggcaacacagacaaagagccccccaccacaacctgctctcgattccgaatccccacaaccacccggcgacgaagcgcgaccgcacagagagaagcgcaagtaccccgccggtcaacggcgatatccgccgccgccgccgcgagatccgcgcgcgccgaccagatcggatcacgagccgccgccgccgcagcgcagatcgaggagaggaaagggaggggaggggaggggaggaggggctacgtaccgcggggaagcgggtgcccagcttcttcctcatcttcgtcttcctcctcgcgttcgcctccgcctccgctcctccacgctatcgcagtcgacctttttttctccttttctttttttttttggctcgatttttttttctttcttttgggacgcttcggtttcttcttttgtttttttcttcttgctgcgccaccacgagagtcgagaggagaggagaggagagcacgcgcgggcggcggcgacgtctcacgatccggatccgacccgacacgagaggcgttcgtgcgtgtcatgtgtgcggcgactgtgttcctttcgttcgtcagcacaaaaggcggggcccgggttggcgggatcgatccggcccgttaggcctggagaacaaggcgattccgtgtgctttggggcccaacttggcaatttaattctttttatgcaaggagaaataatccgtacatacgaaaatttgtcttacccagcttctcttttttaagaaccacgttacagtacacaggcactcataccctcataaacaccttctagagactaggccaatgtatcttgaagttgacaaaatcaccatgaatatctcactatcgatagttatgtcgcctatcactaaaagaataattatggtaaatacgaacactcacattgagtgtagaacttaaacccgaatagactgattccaccacaagtacccttagagcaggtacaagccaactataaacatatcgagaagataaaaaagtagagaagagcgacatgcaacatatttgtagccaactgcagcacagactccaaaacacaatgtgtgcatgacagatgggaccatgaattaatagtgtagtacatgtttataagtaactattatataaattagctattaaatttaatatagataatttggagctagtagctaagtatactattaaacttgcttttatagtcaagaaaccttagttgactatgctcactttttacacagttcttacaaattcttactacactgatgtagcactgtgtaattaaatttcgatatcctataacctacatttaattaaatcaaacggtttgagaactttgtttgattttccaagtaagcctatcagatcacaatatgaaactttgctaccaggagcgaatagttaatattaagtgaaccttgctaattataaaaaaataccaaatagattttg

SEQ ID NO: 28398 - DNA, 218 bp, Oryza sativa
gatttaacaacccaaactgttgagtttaggaaaaaaaatcaaatgggaaatagaaatgggccagtgtgtgggcgagcgcgccttgcgggccacgaaaccgtgaacgacatgttccggcctgcccacgagtcccgcactaatcgatgtaccccttcgtctcggcccgccgccgcctcctccgctcgagccgcaccgcgcagccgccggcccaaacccta

SEQ ID NO: 28399 - DNA, 174 bp, Oryza sativa
gtcacacaaggtaatggtaagaaacactaacaagaaaaatttgaaattcagtatccagtacaggcaagagggaaaaaaaaacaaaaccaaaacaaaacaaaacgttcagtaatcagaggtctcaaaaaacgcagttcacagtgccatgtcacatgaaaggtctcaaaatagtaa

SEQ ID NO: 28400 - DNA, 242 bp, Oryza sativa
ccataaatttttatgaacgcaaaggcacctcccttcctcttttttttgtgtctctaagatggagagggttcatctcacataacttcccacctaatgtgagtacgtgatccctgacatgtgggtttaagggtggtggggcctacatatcagcgatcacgtctttatgtgagaagattccaatccctctaagatattgggagtaatttcgagttctctttctttttttttgacaattgcagcaa

SEQ ID NO: 28401 - DNA, 326 bp, Oryza sativa
ccatcaatggttggcttccttgattcttctctcatctgcctcacaaatggaagaagaagaaaaagaacaagcaccagcagctggctgcaaaagagaaaagccagagaagcccctcacctccacactggatttttcacattttggtccttttaaaaaatttatttcgtaaatagacccctaaaaaaacttatcccaaaaatagtcctttttagggcgccagagtggctggcgccgtcgttcaacaggacggcgccagcctctttggcgccgtccccctgccgacgtggcggggtgatgctgaggtggctagggggagtgcgccagag

SEQ ID NO: 28402 - DNA, 256 bp, Oryza sativa
tcaccgccatcgacgataatcaactcaacagctgttgccctgttaaattgatctgccttggttcaatcgaccccaccgactaactcgaacagtaccagccggaccgaaccggtttttttttctttctccaaaaaaccggaccggtttcttttacttggtcaaccaccagtcaaagaaaaacagatcgatcctgtctcccttcttcctttggcttcctcgctcctcccagaaaccgcgcccgcgccgcttttcccga

SEQ ID NO: 28403 - DNA, 352 bp, Oryza sativa
aatgtaaattttcaattaatctaaaaatacaatgcaaccagtttctgacaaactggaaaatggtgggcttttccctgtttacagacacaaaatattaataatcttcaccagttttgttacagttcatgtctttgtagtttataccagtaacgggaatcagttcatcatatacagattgttcaaataataatcttcccttttacaataataagtttgtcccagttctgctgacaaaattatgaaaatggcaagccacatacaaatagaacatatgcctgccttcaaactaaacttgtccaacaaagaatagccagcacaactgctttgctaaaagagcaataaaccaccacca

SEQ ID NO: 28404 - DNA, 1501 bp, Oryza sativa
ggggatgggcaattgggcatttctggttgtgagtgtccatgaaggttcaagtttccaacggaaacagatctaaaaccgtaacatgtttgtcaggtaaatataattgaatcgtagtgtgattatatttgtagtaagtagtaactgtcgtataactataacttatataacttatatctaactttaaaaaacctgtggtaacgcattgttctcacgatggagacatctcgagactgaattccttcacatcgtttgtgcagtgtaatttttttcttttcttcttgtacgaatcttaaagcaaatctaatggtttgtgaaagttatattataattataatgtagctatgtttatcaaatttactgtatataaaaatcgaactaaaatgccgtaaatattttgttttcggggatcagatgtgatcgtgccatgcactagaattagcaacccacttttggcccagtctgagcagtttaagcaaatgagaggcttgttcgggccttctgtgggcctttagtagctgacgggttggtgtggcggcccattttaagaacacagcccaattagtagttctaactgcatttcggtccagagccgataaggtctcgtcttgagtctttgaccaatcatcacattcagagaattttttttatttataattttttttattaaaagttttacaaaaataattttccattttgaaaattgacggaagtagtcgcctaccgccctctgggagggcgatttttaaaaatcgccctctcagagggcggcgaaaatgacgtggcagacggccgttcgctctcgggcgacggccgtcaacgaaatttgcaggcggcccccttgccgccctccgttagggcgattttatactgtgcgggggggccgcctgcaaatgggcggcgagggggggcatggaattttgcaggcggcccccttgccgccctccgctagggcgattttgtactgtgggggggccgcctgcaaatgggcggcgagggggcatggaattttgcaggcggcccccttgccgccctgggggagggcgatttttgcctcccccctataaagcccagtccctcctctgtgaaatttcattatattcactaaaaatccaaaaaaaacgaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 28405 - DNA, 1501 bp, Oryza sativa
atgcgattggtcctggaaatgatctacacgaaggcaagcatgaggaggtaggggacgaggagggtttacatgagaaggagagaactgaagagctgggatcagcagtactagaagggcgaaatggtgatgagctaccttgcaatgagaataatgctgaggatggcactggcagttcacatgaacacgagcatcttcttgtgcaaaatgagcagactgtggaagagagcaacctttgtgttgagcagcaaatggaactggatggttctagtcctagtgagcaattgaaagaggttcagcaggatgtacagacaggtggtgcctcaaatgtagtactgcccgaggaggccccaaaggaaggagtccgcaaatttccagtttcggaagaaaaacagggtaccatggagattaaagaagggagacgttgtgggctctgtggtggagggactgatggaagaccacctaaggttgcattacatgatacagttgacagtgataatgaagcctatgagggggctttgccttcagaggatccaaactatgatatgtgggacgggttcggtgatgatcctgggtggcttggaaggttattgggtccaatacatgatcagtttggcattgctcgtgtctgggttcatcagaattgtgcagtttggagtcctgaggtatgccccacattattttataaaattctcaccctcatactattcctgtaccttctgccttatactgggtcattgtctccttgtgattttcatgaccatattctctcaaaacaatatgcccccaatacatgttttgggattatcattggttactccggactttggaagcaagcaaaacaagctaaatgtgttgcaagcaaaacaaactaaatgcttcaacatagtgcatgctttgaccttgtggtttggatgtaatggaatggagttatgaaaaacttgcttttgtcacattttcaggtttactttgctggtttgggctgcctaaaaaatgtaagagcagcactttgccgtggaaggcttttgaagtgcagccgatgtggcagacctggtgcaactattgggtgtcgagttgatcgatgtccgaaaacctaccatttggtaattggtttttacttaaaccacattttaccattctagttttgccctttagcctttaatatgcattaaccttttcgatttgtagccttgtagtcgagcagaagcctgtatatttgatcaccggatgtttcttatagcctgcaatgatcatcgacattacttccaacctcaaggagataaatatgttgaactgctcagaaaaatgaagataaaaaagatgaaggcagatatcagaaaggtgtcacatgatgcatggagaaaggacatagaggccgaggaaaaatggttagagaactgtggagaagatgaggaattcttgaaacgtgaggggaagaggctaaacagagatctttcgagaattgcacctgtttacataggaggcacttctgaaaatgaaaagg

SEQ ID NO: 28406 - DNA, 983 bp, Oryza sativa
tttgctcagctttcctttccctttttttttttgtgagtaggagtgctagccggatcggattgcttcatctctttgaaaataagtacagtactgaagtattactactccggacaaatagtacattttagaaatacacgcagcagaaatgcggagctgggagcatgttgctacttctatattttagaacgggtggttatttattaagttcacttttcaaaatgtttgattcattttcataattaagcagataaaataatctgtctctctctctctctctcgtttggttgttccgactagtagtaataataataataattctacagtaggagtaaaacgggagtagtaaaggtttgcagcaggccttactggcctcctcttttctgcttctgccgccgctgcatcatgtctgacagaagcaacaacaacaaacaacaggcaggctaatgtgtctatctgttctggtagttttctttcaccgggaaggcagcagtgtgcagcagtgggcagtgggcaccaagctggaccaaagcagtacactcattaccacagcagcagtggcaggcagtgcatttgtactaccgctagtcctacaattgggtcgagatccttgcaacttttttgaatggagtacgagtaccagcagtctcacagcagcattggggggttgggttggtcggtgtcttcttcctcgcgtctcatcgcatcgcatgccattggaaagggagaaaggatggagaagaaaaagaggcatctgctgcgtttgggtcgtgttgctttcgctcattgaggtcaatgactcgagatgcttgatttttcacattttggtccttttaaaaacttatttcgcaaatagacccctgaaaaaacttatcccagaaatagtcctttttggggcgccagagtggctggcgccgtcatccaacgggacggcgccaacctctctagcgccgtcctcctgccaccgtggcgcacgcgaaccgacg

SEQ ID NO: 28407 - DNA, 980 bp, Oryza sativa
agtgctttaacttcctctgttttggtctcccgagtaataaaatcaaagactgtgaagggctgaagaatagaaaaaatcaggtgcatcgactagatgcacctaattaggtgtagcccccgactatgtggttagttaaataaaactaaacatatagtcagagtgcatcaagacatccatccgagtggttttaaaccaaacggtctaaggctaagcatgtgcagcatctgataaaacctcctgccgactgcttttaatgcgccaaagaaacataaagaaaaacccgagcgagaagcactctaaaggtttataaatcaacatagatgataaaaggccgagtaaaaactctcaaaagacctatcaaacgtggcataaaatttgataaaagatgagtttaaatagcctaggctatgactcatgccataatcaaaataagcatataacatgccgaatggatgactgcattaaaaccaatcatctcaagaaaacccgaacagcatttgcagcctaaaaggcctacaaaattagtataacacttttctgttgggcacctttttatttgcatcgtagtaattccaaagaattatctaactgcatcaaaaaggattttagcagcatcgagtcacatcattatgagcacaaattgccaaagcaaaaagcgcctaagtccctaaggatcacaacgggccacgctgataataatattgggctgaagtactgtacaggcccaggcccattagtactcccgataccctaacaaaacaccgaagtccaagcgacgcttcgtcttccccgccgagactctcgccatttccccactccttgctacagttaaaaaccgcaccgacgaagctagggttcatcaatccgccccaatccattctcaaaaatcccacgaaacttctccgcgcgtcctccgctccgattcctcattcccctccagctatatcttggaccaaatcaaaccattccacacgcatcca

SEQ ID NO: 28408 - DNA, 236 bp, Oryza sativa
tcttgaataagaaggcctgaacctatataaaattccttgtctctgaacccatctactttttcagcttgatagccacccccttttagtattgccgaaatcttgtttcgacactgcgtggtcagagaggagaagggtgtaggagaacaacaggaggaagaagggaaggtaaaggccaagcaattttggggtttatggtgacttcgcaactagtgggtttgttcttaaattctagtatc

SEQ ID NO: 28409 - DNA, 224 bp, Oryza sativa
cccatctcctccacccttttgtcgaaagcggctcgcccgcaaaacgattacctaagtgcataaggcaaacgagatattttggaaaaccggtgtattttggaacaagccgttgtttacaaccaccatcggattgccccggttaaacggctataaaccctatagaggacacaaggtaccactgcaacatccgaccatcgcgcgccatacccgtggccaggcacgca

SEQ ID NO: 28410 - DNA, 1019 bp, Oryza sativa
ggggtggttgtcaagaatggtggggcctatacaacagggtatgttgtatagcgttggattaatattgtttaatgacttaactgttttatcaaattctcagatgtttgctaaatgctgcttttgcaaatgcaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttatccatagaagccctctaaaaatattggaaaagtagaactgttctcctccctttctcttttaattaaaccaaactaatggcacatgcacttcataatctcttttaatggttctcattaaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaaagcttggtttactttatttacttacctttttactctgattttctaactttattcaaattaatccaaaaacttgtgctattaattggataaaggtcttaactccctcctttcacttgtctttaga

SEQ ID NO: 28411 - DNA, 329 bp, Oryza sativa
aggtgtgaataaaatacccagctccaaaacagagatatggcggactaactagcttcattccatattacatcatggcactgggagatacattccaaaaggggagaatgggactgccaactacaacgcaacgcccaacaaggactcacatacttagccttacacagggagacaatggaggcgagagtggatcgatcgatagtggaggcttcctacgagttcttccgacttgttggcctaggtcaggttgacagtcgcgcgtgcctgtgcgagcagagcagaggtgttcttgtgggagagctgctggaaacgggcttctaggtctgtgtaaa

SEQ ID NO: 28412 - DNA, 1501 bp, Oryza sativa
caaatctaaattgaaattagctcaaataattgcagttacaagcttttgtacaattcacctatgttctcaataaaacaagtcagaattaattaacaagggctaaaacaatcgaactaaattataaagaagaaacatatcatttttaaagaaacacagttttaaagacattgagtaagtaaattaacctactcatacagatagggtgtatgtgtgtatgttcaaaggggtggttgtacgcgagttgtggacgcatacgtctatacagtggtggatccactgttggggcttgtcagtgcgcaagtcccagctccatgatccccttcctctaattagcaactaatgactctattagcatttagtgtaaatccagtagtatgacaaggaaagctagctcaagcactcaatgtccaaattaaattgcaatgtcaaatatgttataagtataccatatcaatttcttgatacatttgtgtgtatatattaatatagctgcaaattaaaatggagaaagcaatgggttgtcttttgatcatatgggtttgggtttcatcgaaaatacttagttgatatatcctagtttgtttcagtcacattgcccatatttatacaaagccctccctcaatttatatctagattcgccactgtgtctatactgtgtttttcttaaaaaaaagacgtggagtaaataatcatacttaaaaacaaggcgagatgagatgacaaaagatgagagagagagtaaaaatcaccactttggcttgtatatatcccggccgccgcttgctgctttcttctagtcttctccaattattcgcccatctctctctctcttcttcctcctctcctccatgaaagctagggaaattaactaagggcagtggtgcaccacaagttggtgaagctgccagcatgatctgatgatgatgatgatccacctctctcatctgtgttcttgattaattacggatcaatcgatcaggtcatgctgtagtttcatctgctggttgggagcacagcaaaaaaaaaccctaactttgtagccggatttgcatggattaatctgctaggtagctcatcagattctttgagagtctgccttgctcttctgcagatgaagacgtaatctttgaacagatgggattctcaactctcaaggtgaggtagtcatcaatccaatccatatacctgctcaaattcagttttaattaaagactagctgcttctatggagttaattagggatccttttttatagatctctcttgatctgtttcttagtctgttctttcttaataaggcatatatacctcttggatttggattttcttgaaaattaaggtagtttatgagttggatgtgttgtgttatctgcccagccttaatttaactgtgcttcctaaaaattcgtttgatttgatggtagcatctgaattgtgaactcatctttggagcttggactttagaccaggtgccttaattccttaacataagatttggtcca

SEQ ID NO: 28413 - DNA, 694 bp, Oryza sativa
tgtaaatgagactaaataagataagactcgagtaaacattagtttcacacttatatatcaataacatggaaatcatatatatgaacctatcaaaaagtaggagataagaagtggtacatatcgttttatctccatgcatttcatccttgtcatgattaaggtccatcaaaaaataatgcatgtcttccacacctcattatcgggaaataacctagtagacaacttatgcaaaagagaggttaatcccataaacatcggtttatcatctatcaccaaagtaacaattacacaaattgtttaatccaagatctttcaatcttctctctttggtgatggataataacctgatataaacaattagagagatgagatggaagatgatttcaaatcaagatagaaatcttataataaacaaaatatagaataagctccccctcaagatgtgcatacatatggatataaaggaacacatatgcacataatcaatcaagatcaatgaggtagggcgaattcgagctcggtacccacaagagagaccaagttagaatatgtgaagtttaatacatacctctcatcatttttattttcatatccaaataagactagtcaaagaaaggctcgtaaaaacgttagtctcatataattagatttgtcattaatcaccaaaaccaaattaaggcacttgaacttacaa

SEQ ID NO: 28414 - DNA, 1501 bp, Oryza sativa
gagcactgtagtaggtcgctgcagattactatgcacgcatcaggcttcagttcagacagcaagcaggcaggaggaaacaggtataaatttcatacgagaaaaagaggagggaagcagcgagaagagtgaacagtggaagggaatcggcaacggcaagtgcagtcgcattcatctccaagagtaaagaagctagataggcagcctaccttgctacgaacatgggcagctgcagaagcagcaatggcggcaacgcatcagcagagcagcagcttaagaattcagatcaatagcgagcactgttcattgcgtagcgtagttcagaaactgaagctcactactcctccgtggtactctccgcctcaaaataacatcatttttcactcatctcacacatatcaatacaaagaaaaaaactatagtaccctcactttattaaatcctaatgcgtcaatgtaattatttcatactttattatttttaatatttatcccctatttttataaacttatttcataaattctgatgcaacgattatttaaaattaaatttattttgagataaacaggagaaataaaagatgaacttattgagtatggaaccggatcctctgacgtagcgctcgctacgtcagagggacgtccggcagcgctcgtccatccgttcagcatccaacggagttgagcgcgcacagcacacaggctcggcccacggcaaataaaaaacggcccacatcttcgcgttgacgccacacaagccgctgcggtgcagccggtggtgcgccgcgccgccgccacaagtgagggaggggaggcctatgccgccgccgccacacggccacaacccgtgcttcctgatgaagccccctctgccaccgccctcttccttgaccctgtcccacgcctccgcgtcctccctcgtgccgtcgtgcgggagcctcgctgcgctccggctgcgtggaggtccgattccagatcgcgtatctgacggcatggcagcattcgctccgctgcagttcgtcctttgtcgttcgtcccagaagcgcgtcgcccagtcgttcaacccatgtcgccagggaactccggccgccagaatcgccgctcaatctcctcgagttcctctcgagctggtggagcgcgtcggccgtcgatgttccccgtgcgtggggcacgcgatgtcacctccagcgagggcagagtagaaccgatcgaagatgacgctttctttccatttgttaaagaagacatcaagagagtgtaatgtgttaaccaagaaaaggaatttgcggccatgaactgaagagaaaacgagtgatttttttatttttttcttcaatttgttcctcgtctagctcctcgacggcgaggacggactagtattccagccgaccaagttgaagatcacggcggggttgctcgatccttacccctaggaccttggcttcctgctctgcttcttgctcctctagccaaacagcttggacacagacaaattgatgtgacca

SEQ ID NO: 28415 - DNA, 458 bp, Oryza sativa
ttcggatccacggatcctatgtctccgttgaggggccacaagaccgggtctatttcaaccatttcctacgagattgcacaaatgcactcctcggtttcactcttgatttcttcccttacagaggcgaaatcgaagtcttcacaaactttctatggcacaccacaaccttgggtgatcaccgacgatgcctagccatctggaaaaccttagtccccaagagtaacaaacacaatcgaagatttacttgctatgaactcgagtgctcaaagtatggagtgaaactcactagctctcaacttctcaatctctcaatccaactctctcctcttctcaaatccctctaacaaagaggcaccacaaaggatggagtgaagctcactagctctcaactcctcactctctcaatccaactctcttcccttctcaaatccccctcacaaagaagcaccacaaaagga

SEQ ID NO: 28416 - DNA, 1501 bp, Oryza sativa
acgaagcgaatcctccgcggtaacatcacctgactttgagtgactgacgtgtggaccctagcaaaatgaacaatgacccaaagtcacctctgaacttgttccagctaaagcaagcacctctccatctacactactaccatatctgaatgaatctgttatctgtgaactttctcttgagttcagaagatgccaaacaaaggctacatccaatgggctttctgtacatgtgtttttttttcttttcagatgcctctaacactgcttggatagttggattataaaatgtttcacttctttgtttgatagtgtaattgtgaagtagtataatgctgcaagtggtgttagtagtagttgcaggagaaatggctacattataaaacaaatgtgtatagtgtgagccccatcactaatcaccctaacatcatagacaaatgatacggattttgtcctattttttaaaaaaaagttaaaaaaatgtcaagagaaaaatgcatatacaattcaactagctaaatagaatcagtttccagaaaaggaaaaaaactagtagctgtctttaatgaaattatgctattttggtgtttcttttcaagcaacgaaaacatgtaaagagatttggacaacaaaagtgaccaagaaatctctaaaactagtcataaaatcaaaccccccaaattttaaaatcaagcaggctcgaactccgtactgatttgttctttgatttctcatctgatcacatgccttctcctctcagttcatccaaaaaatcaaaaaaaaaaaaaatcagtggtacccacacctccacaagtaggtactttgtataatcacacactgttaccatatcattagtgtagccatactcacactaatgacttcctttttgttctcttcacaaacaccaattggatcaatgcaacctaaaagacccaaaatattttcttttaaaaaaataaattaaaaaaaagagagcactaatttgactagaccagtggggcccacaccccctctttctctctcctcagtcatctctcactcttcttcttcttcctcctcctcctccctctctctctcttcagtgccatcaccatctctctctctctctctagcattgctcttgctttctctctcctcgaggagcttgaggagcttggcctcttcttcttgctcctcatttgctttggctttttggaggctatataaagctgaggggagtaagcgagtttgattgaaccccaccaaaaaccccatcttttttttcttttcttttcattttcgttcttccctcgctgcggctttcaatttcgcggctcgtgttcttctcttctcggtgcccctgccttggctctcctccgatcaaatgcggcgagatctgcgcgcgtgaaggcgtcggcgcgggggcccaaagatcgatcctttgctgatcgggagtttgggtggggggaagcgagttcttggatcttcgcggtggtttcttgggggcgtctctcgtaggaaaaaggga

SEQ ID NO: 28417 - DNA, 174 bp, Oryza sativa
aacaattcataaataggcagacatcttgaaatttataatagtcaatttctttaacagaattaggatctagttattttttacatatgtaaatcttcaattttctgttacggcttctattctgaatccatgacattgtctcctattaacacctatctggtttctttttttactagg

SEQ ID NO: 28418 - DNA, 1501 bp, Oryza sativa
tatttagtttgtcctaccaaagcttggtaatactgtcaacatggtaaaattttagcgttcccaaattttggaaaggttcattttacagtaatctaaataggtccaaacttttcaaaccggacgaataatcccctctattcctatacattacgtactgtttcgattagatggcatccaacgtgacaattaaatctatttttaaacctatgtgtaaatgaggcacatctgacaacctcacccacatttcttcaacatagctaagtcaagggagggggtgggggagcaaatatctggttggcgatggtgcaagacgattggtcaaggatgaagaggcaacaaccaacctctaggtccacctctacttattgctgccgtcaaccattccccttcttccccacatgccgcatggccgatggaatcgtgctattgttgagtccagctccatatatcaaccttccacaaggccaccaatggtgctgctgacactgctaccttcttcatcgggaccatcagcgtcacccttcaagaaaggggaaggaggtagtcagatagaatatataggagaagagggaagaagattaggatggttgggcgggtggatttggattgctactgccccttccatccacttcgaggcttaccaccatcatgtgtctcctacccgacctccatcgctactccccctcctctccaacctccgctgctactctccctcttcttcgacatccgccacttattcctctcctccccgacctccgctgctaccccttctatcctcccgaggtccgccgtcatcgcacgtctcctctctgatctccaccaggctgaagacattgctcaatcacaagatgatttatcctcattgaattatatttaatttttttgacaactccattagtattgtatggatgtttggtttgatgttaaattttatacacacaagtacaaattctattataacaaatttggtattgtcaaaatttgtcaaggttttggcagtgaaaaattagcttgaaagcaagcaagctctatatgataggtgataatatagatgataggctaccgtgttaattccgtatggctttcaataccgactttacgaagagagatctagtgttaaacgatctaatacgttggttttatgaagatatgaattacaaagtaccaggaatcggtcaattggatcgagttagatcagagtttaaaattatgttatcattttattttattttaacgtgtatatatatatatatgctattatgtgagcaaaattataataatactggcaccacaatctacacgtcattaatctcactcaagttagtttcatatcgaactagtactatattaaagcatgacaattaatatggataacagttactacatatatattaaagcatgataattcataccgaactagtgctatattaatagggaccttggactgttggtcctgcctgcctgagtgcgcccagggttttggccgcacatggcaaagcaa

SEQ ID NO: 28419 - DNA, 500 bp, Oryza sativa
aagtaatccagtgcatctagcatgaaccaatgcccttttgataacgaagaataaatctgaccaatgaaatccaaagccctacctcggtacggtcatggttccatatgcgcctactaaacatttccaatccgttgacgagcttcacttcctctgtagcacttgaaataatcatcaattactttcggccaatagaattccactcttataagcaaccaatgcatcttatgggccgattaatgaattccacaaatcccttcatgcacatctcccctagcaactttagattaatcattgtctaaacacatcaatagcattccatctatatttcagcgatataatatttgaacgcttgccgccgaatcttccggtcaaccccaagactaggatctttcaaatattctattcaaagggattctccaatctatttctgacttatgggcacaaatgtccgaattcacaattaatccggtctttaaatcaattgtaacgtgccccccagc

SEQ ID NO: 28420 - DNA, 208 bp, Oryza sativa
tctaggaccgtgcttctccggtttgatccccctcctcatcgcttccatgtctatcactttgtgtgggaggagatccgcatggcttcaattcagtacaagaaggggttggtctatgcccctcacattatgcggatgatcgagactgtgactcagctccagtttcgccatgatgtgactcattctcagcttcacttgcgccttcttaagg

SEQ ID NO: 28421 - DNA, 1501 bp, Oryza sativa
caagataacgaacaaaagtagtcatagttcttttcgtgcagggcttagcaggatgagaatcctaataataataatgatcacaatttcaatcgcaaaattgtgcgagagcaccgtagttgtccttcctagcccctcatttattttgtgctgatcaatcttttttcatccctcagtacgtcttcaagttgaccaagcttgcaagtttgtgggggctaatacactacacatgcatttatataatccaacaacaatcaagatatacatatatattctttacttccaatgatcatacttgtctccggtgatcgtatgattgatatatcgagttcgagacacaaaaatcatgaaacattaatctaacatggaatcaagttgatttgcatatatagtccatatatatcactaattaatactacttggtactagtagtaattaattaatctggataataatggcagcaaatatatacaccgtgtttagttgcaaacttttttttcaaactttcaacttttccattacattaaaactttcctacacaaataaatttccaacttgtccgtcagatcgtttcaatttcaaccaaactttcaattttagcgtgacctaaacacacccatagtttagttttcgataatggcgatcttgcacgtaattaacttgctcgatcgatcagaagctccagagatcatcgccgacgtgctcctgcccgtcgccgccgccgagcaggagctagcatctcctggatgatctcaggagcaggagctaacattattcagaagccaaattggatttgggcgttttggctaacaattaatgggcccctggtgaatctgagacggtaaactgtgtgagctagctagctgcattttgataaggaacatatatataggaaaactagctgctgcggtcggtataagtaaaaggaaaattggctagcacttaattggctgaactcagattatttatgatttgtattaggtatatattaactaattatatactacaatttctgttgtacagctagaatgccggttagttttttttttcataagagataaggagaattgccatacaatgtcggtttgaatttttcttttctttatatttttcttcaaacatagggaggatatgatggttacaataaatatctctgtttggatgactctataaaagggcttggaatacaatcttggatatgcatgaatttacatagtagtgtacgtgtatcctttataactcagagctagctcatgagatgagatcaataagaatgcaacttatcctccatagaacttcttgtgaaaataaaataccacttcctatctttcatattaaaagttgtttatataaaaatattgtaagattttcaatacaaaacaatcatattatcaaaatatattcaatgttaaatttaatgaaattaatttggtgttacagatgatgctaattttttttataaacttatcaaaccaaaaaaaatttaactaagaaaaaaatcaaa

SEQ ID NO: 28422 - DNA, 1146 bp, Oryza sativa
gaccaccgccgccgcttcccgtgccgccggtcgccgccgtcgtcggccgcatgccgtcgccgctagacttggccggccggtcggctttgatgccgagccgagtcggcggcggcctttatcgccgcccattccctccccttcctagccgccgcttagcgcagccgccttcgcgtcgccttttgcgccgtcgctttcgccgccggttgccgtcgccggcaacgcgttcgcgcgcgcgccatcgccgtcgccgcggtcggtcggccggccttgagccaagccgagccgcgtgccgccgccctttctttccccccctgagccgctgaccggtggggcccgcatgtcggcgccgcttcccctgtgctgacgtcagccctggaaaatattgcgcaataaattatttaaggatttctgttatagtaataaacgcagtgcatcttctaaaattcataattaattcatccgagctccgtttaagaccgttcaagttccagtaaatcaagataaatgtgtagaatccattaaaaatggttttgttccctgtttcagtagtcttatagcctgtttacaatgtttgctttgtatgtcgatagattccaattcgtccgacgctccggtgtacttcgaaatagtcgccgaggttcctccagcagcagagcaaggcaagtcatgcttgtcacttgaacatgttgatcctatattgcaaatgctctattgttttctttcaaatattgcattgttttataatgttactatgggttgtttacctattgtcatagccatgcgattgttgtaccttgtttctttgtcaacttggggttctaacatgattagagttaggactggggattgcttagccatgcttagttcagctagttcacattggggaaaatcctattaatgtttagactgttggttccaatggtgttgttggattagtgacaccgttttggtgttggttaattaaaataaaccacatggtgggctgtgggtgcatggttttgctggtcgcacccatggcagttaaggaccggttcgcgggatgccctggaagaacttatcgtacttaccacaagccagcgtgggcaacggctgggcttgtagtgtagctctcctctagtagacgcatccaggcaagggtgggcgtga

SEQ ID NO: 28423 - DNA, 162 bp, Oryza sativa
cttggattaaaatatgccgattaatgactatatttccaacaatccaaaaacctgataggtcattttcggtagttggctttgctgctgcactgaaaccacatgcttttgatggttcaaactataagagatggaaagcacgtgcactattgtggttgacagcga

SEQ ID NO: 28424 - DNA, 518 bp, Oryza sativa
tattgtctttatgtggccgtgtctaatttattacttccccacatcttgattttattttctttgccaaaaatgcacagggaggaacaactccataagtttttatttttaatgatttcagaataactgattttcatatttttatttcttggtatgtcacatgtactacccttgactagactcatagattttaatactgcatagtgtagagatgagagacatgagaaccttgcctaatgagtgggaaggttagtatagagttggtataagatgaatgtgagggtaaaccgaaccaagcgaggcttggagaggtggatgaaccctggataattacaacttcaacattaacgttgtttttagttaaaactgctaagtcataggtttgtgaaatgaattgtgaaaactagctttatgcaaataaaccaagccatccttgaacccctgtgtacattagattcattttgtagtagtggcttgctgagtacgtatgtactcactcttgcttaattaaatcttttaga

SEQ ID NO: 28425 - DNA, 1501 bp, Oryza sativa
tactcctagctaggagtaacacaagctgtttgagatagctagccaggtactagtagctgtaactaaaagctgatgagaggtagtagctggctggctagtgatatgcacatagatgaaaggtctcatcaatgccaagatttgagcaacctgttcataactggcaaagattctcctcctgaaaatggagcacataattccatatatactcacactatttcaaaataaaccaatatcgtattacgatgtaacatattctaattcaacgaaactaaacatattacattttgatacgagtttggtttattttagagcaagttcaatagtatagtcaactactagcttcaattcatctatagccaatttaatagctcattcatacaatagttacatactacactattaatacctagtcccacatgtcatagacacactgcgtcttagagtccgtgctacagctggctacaaatatgtagcccgctgctcttctctctcctgatttatcttcttaaaatatgtttacagctggcttacctgctcttaggacggagagagagtacatacatgtacacatcccacaggccaaggggagaagaagaagaatactcaagaaacaaatcattaaattgtactctctccgtcccataatataagggattttgagtttttgcttgcaacatttgaccactcgtcttattcaaaaaaatttaaaattattatttattttatttgtgacttactttattatttacagtactttaagcacaacttttcgttttttatatttataaaagtaatttgaataagatgagtggtcaaacgttgcaagccaaatctcaacggagggagtagaacaaaagaaatgcaaaaccctagcatagcatgcatcctttgctttccaatcaggtacagaccatgcacacatatttgtagcaatataaccaccttcacttgttcaggcatgcaggacccctctatatatctctgtcactactagctcctgctctatgatctacacaagtggtggtcccatctctagatcctagcaggggctatatatgtgtaggtagtggtagatagctaggtctacttaaggttattttttcactccttggtgccatttactactcaccatgcacattgccataaggcttttggcagttagaactactgccctttctactgaaaaggagcacctatagccggaggaaaactatctttatctatccatacctatagctatagcaaaattctcattcatttttctatttttaattgacaccgttcaccagtatagttttaactttggcaaccaataagttcaaattaacaaggtttcggttaagaaaactgttttagggttcacgttttttttacagaaaccgatcgaaaacccataaattagatgaccaaacggtttgattcacaatttataccctaaaccttacagacacaatcgtctaacatctagacacgatctagaccttttagactatggtttagg

SEQ ID NO: 28426 - DNA, 354 bp, Oryza sativa
ggttattatccatcaccaaagagagaagattgaaagatcttggattaaacaatttgtgtaattgttactttggtgatagatgataaaccgatgtttatgggattaacctctcttttgcataagttgtctactaggttatttcccgataatgaggtgtggaagacatgcattattttttgatggaccttaatcatgacaaggatgaaatgcatggagataaaacgatatgtaccacttcttatctcctactttttgataggttcatatatatgatttccatgttattgatatataagtgtgaaactaatgtttactcgagtcttatcttatttagtctcatttacattgagaaca

SEQ ID NO: 28427 - DNA, 1501 bp, Oryza sativa
tatttaatctgtgtctgaaatgattttctggctacattatgaaaagagaagattaagaaaatacgcaaaacgtaagacattagcatataattaattgagtattaactattttaaattttaaaaatagattaatatgattttttaagcaactttcctatagatttttttttcgcaaaaagcacaccgtttagtagtttgggaagcgtgcgcgtgagaaacgaggtgttttctctctcaatctcccggaaacgatatctcaaggtggactctttggataaaaaacctagttacagtcttacagatggctgcaacagctatgatgatatcctaaatgtgatcttttttttttagttgttgcattctcgatggttgtattttcgttggatcggttttgatggatatggtgatggtaagatattggtgaaagactctttgcagctaagtcatcctctgatattatcttctgctttggttcatcagtcatcgacggtgatgtgtgcacaattcggttgacactataatcagttaatcagtcacacatttcgaatattttgtttttggtttgagaatgacaatgactgcatatccaacttgtaagctattgtgaaaaaaaaagaagtgatcataatcacactaataaccataaagatgggcgaatccaacatgggtgttagagggattcaacttcgagccctccctaccccgttggatcctcatgaagaggagagggaagggggaagaaaagcagggagactgaaggagaaaatagaatatcggtattataagcatgttttatttctaatcaaaccgagattttataatttgcaaacattcattctacccggccctttttttaaagataaccttatagctaacctattatacatgttagctttaacattgacttatagtcagaagtggatcttactattaaacttgctcagctagctattgtaagcaacatctcttagagcaagtataatagagggatgtaagaaggctgaatgctaaggtggatgagagaggagaggagagagatgagaaatgagctgtaagcttacagtcggttcaaatctatgaaaccgataggtggaccgtatattatagtgaagagctaaccaccatatgagtaagctgagagatatgccataaagatctatgtagtcaataactgtctgttttattagtcttgctcttagttctatctcttgttgacacgtacatttttacagtcatcagccgactatactattaaacttgttcattagtacccgtccgcaaaaaaaaacaaatcctagctacgaacctggatatatgcgtgtctaggttcgtagctagaatttgttttttttggatggagtagtatgttatacttttggataaaagtggtacgcttttcaaatttctaaacagtgtgtttcgtgcgaaaactttctatataaaagttattataaaatataagattaatctattttttaagttcataataattaaaacacaa

SEQ ID NO: 28428 - DNA, 287 bp, Oryza sativa
ttttctttatctttgtccggtactgcttttacatggtttacttctttaccggcaaattctatttatacttgggctcaattagaacaaaaatttcatgattattttcacactaatgaaactgagcttaagttatttgatttaacatcggttaggcatgaatacaatgaatccgttgctaattatattgaagggtttagagatgttaaaaactgatgtttcaatttgaaaataactgacaaagatttagccaacattgcatatgatagattgcttgattctattaaaga

SEQ ID NO: 28429 - DNA, 754 bp, Oryza sativa
ccataaactcgcacatagagctataaaaagtgcctgtatgacatagggtgtcccatcacatcataactgtggacaatgcaggtgaaaacaaaaaatagtcgcacaaaagaaagaatacagtacaccactgcagcctgttgacaggcttataactggattaaatgcaaatttaacaacacagagaccaagcatatagtgttttatctaattaaccaaaacaggtgagagtgagtgaacaagagcacccttccgttcgctagtaaggaaatactcactaaactagcttgatttacaacatgccatcaggaattctggaccctatatcaattgtatgtcctttctgatacaatgagcacaattactctcctgcatccataagaactgtgaacaactcgcatgagtgaatcacctgttaagtaggaaaatatattaagctacattcaatgtgatctcaacagtgagtagagatacacacactttttccgagccatatgatgctttttttgcatacaacagaacaaatgatgaacaacagataagctaatacaaaacaatatctgaactatacaatctagccaacacactttctaaggaggagggaaaaaatgattgtgtgtttaaggaataatagagttaagagacagagagacagctaaagaggggacggacctaggagggaaaacaaaattactagttgaaatattaacttaaagcgaagcaaaaaaaaaaactgcatcaatgttgaatcaacagc

SEQ ID NO: 28430 - DNA, 368 bp, Oryza sativa
tcgatttgtccaacattcctaagggtagtcattatgctcgatatctgtggaggcaggctgtgctgcataggtcccatttataacgatgccactccaaatttcgatgcggattgctcgcacaaatttaaatacaaggcctcttgctgaaggttgcgtgaattattagaggggataaactgactgaataatttctggagaatctatattactctatgataaataaactaggctcttaataaattatagaatgaatatgtttatgttcaactggcgtactattctagggatgtatagtcttagccgatgatgattccgaattaatccacatttgatgggattgtatgggctatcaatctaactgagagcta

SEQ ID NO: 28431 - DNA, 1501 bp, Oryza sativa
tccagtaactatagcttttgttcttagcagcctgtgactacttcttatcgttaatttttgtcctatgtacttctgttaagtcaagggcacatggtactgtaacgttatttatccactcttgttatgaaagtgaaatcctgacagaagtcactgttgcaaaataaagtttacactattcaaagaaaatagtgttaacaagctttatacgaaacaaacttgagtcaagtcgattcttgatcgggttcgaacctatcctatttttgagtttgaaggtcattctgagctcggctcaagtctacaccaaacttaagttcagctcattgacaatttgacatgccatcatcttaaggtatcataaaattatgatcggtgacatgccatctatgccagcatcagtgattttttataagtatcatcggtgatatgaaataccgttaatatctatagatactacttcctttatcccaaaataaatatatacttttaaattagagaagtacacttcttttgagaacaaaagaagaactgtactccactaacgataagtttccttcctacaaggaaaatcaacattaattcatcgagaaaatctattctataccactgagtttgttcgagttcaatgatttaccatcgacattgtctccttctataatataccgataactttattaattgttctacaatacgccaatgggctgggctttcttttcaaaaatacccaaaatacccttagagacatacaagattaacaattgatttatctcattagaagtttcaaaaaataataaaaaattttatgtggcctcgttacacaacatggaagtttgtgtacatgtttttaagttttttctggtatatttagattttaaaaaaaaataatatttttatgtggtatatgagagaaaatttgtttatacgagagataataacgcaaaaatatcttatgtagtgtatgaaagatgatttatattaaaaacatcaataaaatgtattttgtatagcatataacaaatgagttatatattgtttaaaaaaattataaatgtaaaaaacttgaaacttctatacaaacttccatgttgtgtaagtaggccatataatttttttatattttttttgaaacttctaataggataaatcaattggtaaccttgtatgtccataaaggtattttgggtatttttgaaaatagtgtccaacccaatgacgtattatagaataattgataaagtcagtagtatattatagaaggagacaatattaatgacaaattattaaacttgaacaaaatcagtggtacaaaatagattctctctaattcatccgatcctgatccaacaaccgaggttcatcagatcaactcgccgctcgcagccgtcccagccagacccaaaccgacccgagtccgatttcagccttcaggtcaggccgcaccatataagggtctcagcgccggccgcgcgccgcaccggcatctcgttcccccaccccccaccca

SEQ ID NO: 28432 - DNA, 443 bp, Oryza sativa
ctataaagcccagtccctcctctgtgaaatttcattatattcactaaaaatccaaaaaaaacgaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 28433 - DNA, 579 bp, Oryza sativa
agtcacactgatcccaaacaaccctttgagcatgttgatcctatttaaagctattgtttctattcaactattgcatctattttcgaatgtcattgggtggaattgacctattctttgttatggcccttttgtacttgattaccttattccttgataccttgggttattacaatttgactagttgagctttatttatattggttcaactagatattagatataattgcttagccctgcttagaaacattagcacacattcgggataactaatgactcactaatatttcatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttata

SEQ ID NO: 28434 - DNA, 1501 bp, Oryza sativa
tcttgataacatagatataaaaataatattaaaaaataaacatattttaaattgttatttagagaagagtgcacaatgactctattttgtgtagacttgaccatgcaaggcagtgcatgatttgattgatcatgttactatttgcacgaatgagattcgctgtggaggctagaaattcccacattaatcggagaaaaaaaaagaagagtccaagtagaaatgcaatctaaaaatagctgaaattcggaattaaaaataagcaatatcgaaagaggagtccatataagaccctaatacgagattaatcaaaattcaaaataaaaataaaataaaatccaaaattagaaaataaaaggagagtccaagtaggaatatattttaaaaataaccgaaattcggaattaaaaataaggaatattgagagaagagtccatataagaacccaatacgcgattaatcaaaattcaaaataaaaataaaataaaatctgaaattagaaaataaaaggagagtccaagtaggaatatattttagaaataactgaaattcggaattaaaaataaggaatattgagataagagtccatataagaacccaatacgagattagttaatattcggaataaaaataaaaataaaatccataattagcaaaaagaaaagaagacttcaacagaaattcggaattaaaaaaagcaatattgaaagaagaattcatataagaacccaatatgagattaattaaaattcagaaaaaataaaatgatatccaaaattagaaaaaccaaaagagagttcaagtaggaatacaattttgaaacaactaaaattcaaaaaataaaaaataaaaatattaaaagaacactatacggtattaattaaaatttgaaaaaaaaattctgaaactagaaaataaaaaaaatcaattaggaatacaatttataacccacagaaattgatgataaaaaaagactattgaaaaaaaagactatctaaacacatgacaagatgaattaagtaacaagcccataaaagagtagagtggttacggttgatacgacatataaaaactattagtaaaacaccaaatataatcctaatgatgattaaaaggaggacgacaggcaggccgtaaagcaaacgggcaaggcggttgccgggacttctagaaagtaaaaaaacccattgataatcatattcgatttttaaaatctcaatgataataaaaaggagaagcagtgtgcgggtgtataggacttctagaaaataaaaaataaattccaacgatagttatattcgatttttagaatcccaatgacaataaagaataggccgtaaaggagtatagtggcatcgtttgataggacttctaaatattataaaaaagaaacccaacaagacaataaattctaaaaactacaaggtccaatttttaaaggttcggaacttctaaaaagtaaaaaaaaaaacaatgataatcatgtttgattttaaaatctcaa

SEQ ID NO: 28435 - DNA, 635 bp, Oryza sativa
ccgatttgtgaccggtctgacaatggtcatgtcgtcagcagacagccatgttcccacgtcgcgcctgcttccggcggaagtggaggtaggtatgggccgtcccatcagaaggtcattcggacagcagccatacaaatctccgtccattaatgaagagaagtcaagttggaaggaagagaggatgagtccccacacaaaagaaagagagagagagatggtgcatgtggtatccccttgaggtataaaaggaggaccttgcccacttagaaaggggggatgatttttaggagaaaaacgatcccggaacgatcgggggcgggctcgcactttgtagcttcttcatacacagatccaccaaaacacaggagtagggtattacgcttctcagcggcccgaacctgtatacatcgcccgtgtcttgtgtgtttccactctcgcgaaccttccacactcagaccaggagcttagaatctcacccagggcccccggccgaaccggcaaaggggggcctgcgcggtctcccggtgaggagccccacgctccgtcatctggcgcgccaggtacggggttctgcgtgtgttcttctaagctctcgcactctttcgtgtgcgccaagcttttcctgttcagcccaa

SEQ ID NO: 28436 - DNA, 727 bp, Oryza sativa
gcgcaaagacggcggcggcaaccaggacgagggcggcagtggcaagagcgcaggcgtgtggtggctatggctggctgtagcgctctcctttttccttttcttttttcttttttttatatataaaaagactaaaaggagatctaacggcccacgtcgtttcaatccctgggacttcgttcgtactccgattgaaagtgtcaattaggcctagaggggggtgaataggctaattcaaaaatcaactaaaagcggaagcagtaattttcggatatttccgaaattttcggatatatccgaaaattttcagagtcagcacaaacaggaaagtaaatcctagatctagttgcctacaacaagaatatgctagcacaaacagcaactagacctatagcggctcaaacaagcaaagctagaggagagggaggaagtaaagtcaccaaagatgaagctcacgaggttgttcccgaagttcgaatccttgaggggattctactctccgttgaggagctcactaagagccgggtcttggctaaccctttcctcaagaggttgcactaagcactcctctttccactaaggctatctcttccctttcggaggtgagatccgaccttcacaaacttcccccggccaaccacaagtagatcggtggctcgggagcgacacctagccgcctaggagtcctcaacctccaagagtaacaaatgaagtaaagaactcccggaga

SEQ ID NO: 28437 - DNA, 790 bp, Oryza sativa
aacccatgcacgcggcgcaaaatccacaagggggtcggggcgccccagccctcggggccgaaacgggagcggtccgacccctcgggggacaaagaggggggcggctacatcaccctcgggcccgacccccccgagggggtcaggcctcgtgggcgattgctcctgcccaaacctctagtcatgatactcccggtcccatgtcaccgacagtagcccccggcgttatgccagggcgatcgccctcctcgagggaagcggtcgggcgtgacgccacttcctaaggcctggtgacaggtgggaccggtctccacagttgggcagaaacccaacggtcgcaaatcacgcacatcggcaatggttactcggctgtcaataatgagcggtctcttcaagactgccacattactcgagtaacacgcgaatcgggacgagccggttcgttttgcctggagatatggtgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcagatagtgggcgcgagaaacgaggagccgggcatagcgttggcaagggtataaagtcgccgaggaagagatttgcttccttcctctcgccattattccccttgtcttcgccgcttgtgccctaactccttgtttcctgtgccctaccttcgccacacgcgctcgctctcaaacatctcttcttccggcgtca

SEQ ID NO: 28438 - DNA, 395 bp, Oryza sativa
agggatcgctctcccacacatcttctaattataattcgaacagtgattggtccggtgcaaagtatgcgcttcctcaggttgcccgggtgtctcaacggtcaactcatgctcatgatggtggtggtgatggtaaggactcctctcgtcaaccgcgtacgccgctgtccaaacccaatgtccccattgggcctctccgcattcataccccagagagggatccggcggtgattccccaagtgtatgattggcggcgcaagtctgaggttgttgctcctcgtcggtatgaggatccgcgctcctttctccgcaccgccatggatccgcggttttgaactctctttcaacaagccttttatgagtctgtaataagtctaaagctcatcccactgttacca

SEQ ID NO: 28439 - DNA, 646 bp, Oryza sativa
atattattttgagagtactgctatccgaacatatttaacacaatatatgaacttagatgaaaattttgtcaactaaaaaattgtagatcccatttagatctacaactttcatataggttacgtctccatctgaaattttttataaattttaaatattcacttacgcaaatagatccaagaccttacaacatatgttcagatccccatcgaaacggccataaatcaaaaagtcataaaaaaggtgtaggtctcattgagctctacagttaatataaagtttgttttcatccgccattatatgaaaacaatagataaaaaatgcacatatatgagttccacatcataaaccgacacctatgggctcataagtgccggttttaattaagaaacgaaacatatgtgaagtccatatgtgttgattcatgataaaaaccggtacatatggcaccgcacttgtaggtgccagttattatatgaattggcacctatataatgttcataggtaccgatttattataaaaaccagcaccgatgatttggaagactattggtgccgattttaggcacctataaggtcagtctttatgtggtgttttgtagtagtgggaagggctagaagagggggttgagctttattttagtgaca

SEQ ID NO: 28440 - DNA, 1501 bp, Oryza sativa
ttcgatcccttaggtcccccgggggttcccttttatatcgcaggtcaggcggtctccaagtaggactcggagacatcggaccctgcacgatatagtaacaacccagtcctatacgggtaggaaccttttcattggcagacttcgtgatggacttccttagcgtattcagagaacatccgtatatgcaccgatataccgcattgccgtatagcatacatccaagggtagagggtataccttatccgtaaccctgacacttattattttttattaaaaataattatttagatgacatccaagaaaataggtgacatcccctaagagtctaaaatcatttatgtcaactttccatgctttatttccctataattatttttcattctaaagcatcggtggtatgattgtccagtcacttgtgcgtaacttcagccactatgattcattcatattcatatattctcttacccacaaatattacatgagttagaacaaggatatacccattggttttcatctctttgtacttgtgtttttttagggggaggagggagggggggggggggcacgcaggtgtgtaacgggctgtttagttcgtgaaaagataattttttagacacgaatgaaaaaactaatttcataactagtctggaaaccgcgagacgaatcttttgagcctaattaatccatcattaacacaaacacatgtgggttactgtagtacgtatggctaatcatgaactaattaggctcaaaagatttgtctcacgatttcctcctaactgtgcaattagtttttttaatctatatttaatgctctatgtatgtgttcaatgattcgatgtgatgtttttgagaaaaaaatttagggaactaaaccaggcctaaggctgcgttcgtttccctggttgggaacggtaccctccaagcacggaaaaatagagcggtctattagcacgtgattaattaaatatttgcttaaaaaattggatcaatataattttttaagcaactttcgtatataaatattttgtaaaaaatgcaacgtttagccgtttgaaaaacgtacgcggaaaacgaatgagagaggttgggaaccaggtggaacgaacacagccgtgtggtatgcctaccgtgcgtttgtgcgacttccgtttaatcggagaaaccggggggaaaaagcttttcgttaaaaaaaagcaccataactttgcgcttggctacttctactagcctactactacactggacaggcactactgccaacgagacactgccgaagttgcgtggttgcatccgccagccgggctcaatgaatcgcaagtatcatgtggatccacgatttgttggctagctagtatggggtagtagccaattccaatctttgttatcaccggtcaccaccaagcacaatttatagctgtacgcccgcatacttctgcagtcagcaaatcatcatccagccaattcaggcattttacttgctctcccactcggacgacgc

SEQ ID NO: 28441 - DNA, 339 bp, Oryza sativa
gtttggacgagcgcgtcacgccgcatgtatcgcagtgcagcgcgcttgttcatccgatctgtgatcagtcacagaccggtcagatcgtgggttaggtggcgacaggtggtctgacgcacgcctcgccccatcccgtcaggacgagagcctccaagcactcgtccctagccggagccggcgtgttagctcctggagatggctcgttggttccggtcagatatatgccaggcttcatcctaaccattacagacaagatattgtatgaagaagggcgaacatgcagattgttaaactgacacgtggtggacaagaatgaccgatttgtgaccggtctgacaa

SEQ ID NO: 28442 - DNA, 605 bp, Oryza sativa
ttcagtagtcttatagcctgtttgcattgtttgccttgtatgtcgttagattccggctcttccgacgctccggtgtacttcgaaatagtcgctgaggttccttcagcagcagagcaaggcaagtcatacttgtcacttgatcatgttgatcctacattgcaaatgttctattgttttccttcaaatactgcatttgttttgcaataacactatgggatgtttacctattgttacagccatactattttggtaccttgctcctttgttagctcgggttataacatgaatagattttggactaggagttgcttagccatgcttagttcaactagcacacaatggggaaatctcatttaaaatatagcctgtaggtttatatgataatgttggattagtaccaccgctttggtgttagttaattaaaatgaatcacatggtgggctgtgggtgcatagttctgctagtcgcacccatggcaagtaaggaccggttcgcgggaaaccctggaagaactcctcgtacttaccacaagccagcgtgggcaacggctgggcttgtagtgtagcttttctctagctgacgcatcctggcaagggtgggcgtga

SEQ ID NO: 28443 - DNA, 1501 bp, Oryza sativa
ccttcagcgacgccgccgcctgatgatccacgagcggcccgatgatatcagtcagagggagagcctacgcttcatgaagttacaatgctatctcggaagaaaaatgcaaaagggccgctgagtacactcacattgatggcagcttcgcgttcggccgcccccttatcgcaaagggggacggggacgttgctcgccatcgtcgggccgctgatcatcaattggccgacgcggcgctccacggcttcactgctcaaacctgtagatcgagaactagaattcgataagtcaggaggaacacgcacacaaggaagtcagttttaatacaagaaaaataccccgaggagaaacccgggtcgagtcctccagtccagaatagtcaaaggctaggtgggcccgagcctggagcggctggatccgtctaccaatgaagtcggcagcgacttcataccccgacaacccccgtactcggaggtcatcaatgatatcgatgaaagactggagggatggggtcaaggcgggtttggcggtccaagacaaaatcttgtctggtcattcctcaggaacaacgaagactggatctgaattttctatctgaagatagaaccacctcgcccgccatttgctacgagaagaagggcactggaaggggatatagcgcgacttcaggccatccctgagtcggaaaccgacacattcggataccctgttgggttccatccagcgcaactcgtagtagaaacgaaagaggtcaagaaacggctctaccccaatgtaggcctcacaaagatgtgaaaaaatactgaggaaggcgatgtaactggggctcaaatggagcaaagaaaggccgtagaaattcaagaccaagagaagaaatttagaaggcggaggaagaaaaccatagagaatgtagtcctcgatcgcaaccatgcgacccaggacaggctggggttcaatacctcctacttctctctccatggtcccgtgaccgggaagggcaccatccgcctgtagtttcttcagcgacgtgctggtggaggtggacttgtcgagatccattgccgccggagatcgccggagaagggaccgagatgaactagctagggttcttatgggggtggagaagacgaggaacgcttggagactggagaatcttttcacaataggcggacttcgaaatggatccccaaaactcccttaaatagtcgcacttccgacggtgcgaattccaaggaaaggagagagatagccgccggaaatttctaggtccgttacgcgcggcaatttttcagacttcaatttaaattcactcatgaccgttgagcttcactgggcgttgtcgattactcctcgtctctcggtcctcacatcgagaacaacaacaacctcgacatcaaaagtcacgatcggttacatgagttcatttaagcagaagtcgggggctactgtcaaggttacgggtaaggtataccctctacccttcgatatacgtcacgtatcgata

SEQ ID NO: 28444 - DNA, 922 bp, Oryza sativa
aatgtttattaaatgctgtttatgcaaatgaaaccctactaggccatcctttggtatcctgtgcacttgcatatttgctgcgtgacttgctgagtatgtcatatactcccctggcaatcattcatcagaggaagagttctacaatgatgctgatggtgtggaggattaggtgtagccctggtcaagctgcctgtggagtggagccgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccccttctcttttaattaaaccaaactaatggcacatgcatttcataatattttttttaatggttcgtattcaaaagtttattccagtgttattagtgctgtacatctattactgtactaatagctcatttaccagcaaaagttttacaacattgttttatttaatcttgctgcaatgaaataaatttagcatgttgattttataactttcttttatttcttttggaacctgttgttcaaaagtacaaaatttgtgacctcgtttccaactgtttcaacttatcttgcaagctcggtttactttatttacttaccttttactttgattttctaactttattcaaattaatccagaaacttgtgctattaattggataaatgtcttaattccctcctttcacttgtctttaga

SEQ ID NO: 28445 - DNA, 1501 bp, Oryza sativa
tagaagtaactttgttccaaaaatatcatcgctgttagggttttgctagcatccctctgttaagcgatataggatgaacatcacatttaagggcgcgggatggacggaaccctgacgatgatggtatttctggaacaaaatcatttgtacaatggcattttatgaaactcgcattcgtcgatggtatttcttaaattttggcgtttgtcaatggtatttattgtttttttcttaaattaaaatgatgccataaattaatcaccgctcctctcctctgaaagctctctccatttaatctaggaaccaataagtcatcaacgtccgtaaattctagaaacattgttaacatttaatttatatcttcagtgtcagtttcacatgcatatatatgcttgatgaagaattaagaacgcgccctatataggatagggttaattagatacattgccattaaaaatatgccagttttaaaatatgccatcagtatttgtgaatttggatcataccattataattttgcacatattgagatatgccactgagatgcatttacaataaatttttgaccaaattacccttgttttcttcttcttcctctttctcccctctcctctcttccacgagaccggcaatggcagtggcaagcgtggccggtgatggacaccgcaatcgctttcccctccctctccatcgagcagatctggtgggtatgtcctcttctgctcggtgttcgagccgttccacaactcctgcacggccctcacggccaccatccccgcggtcatcgcctccgtcgacaccgatgaatccgcagatgctacatgtgtgtattactagctcagctcctccatgccactagacattgccacccatctcggcggcgacctgcgtgccatgcgccgacttgagcatgaacccgccgatgccgcggtccggcttgccactcacgtcgtcgtcatggtaacccgccgtggtgcgcctggtccatgccagccatcttgtgcctcggctgagatgcgcagcaagcccagcttgttgagcaccaggaacagcagcgccatggtgaagctcacccacgccacgatgacgaggatgaccactatgtgtgccccgagcagccggccgccgccactgcccatgaacagcccacaagatgacgcccaacgcgccgcactcgctgtgcagctacgcggtctcgagcgggtcgtcgaatttgagcctcgccgctagcgcgttgagcccaatgagcacccacgccgagacgaacccgcagatgaccgcctccccgccgcgttcgaggacgccgccgacgtggtccggtgggtgcgctcgtacgccgcgggctcgcccggctgcaggcccctgttcctgatcggcagccgcgccggcgcgagcatcgcgttccgcgcggctctggcgcggcggtggacgggacgtggtgcctgtcaaggttacgggtaaggtataccctctacccttcgatatacgtcacgtatcgata

SEQ ID NO: 28446 - DNA, 1501 bp, Oryza sativa
tgtcgtcccagccgtgcacgcgcgcccgcgcctggcggagctgcggcgccggcgcagcgtagtgcaccgtgagcccgtgcgacgacgacgcgagctgcagcgacaggtgcaggagctggttgaggtggccctgcgccgggaacggcacggccacgatggcgaccgcatccgctgggtttcccttcgctgccattgtcggcgtcgtccgagtgggagagcaagtaaaatgcctgaattggctggatgatgatttgctgactgcagaagtatgcgggcgtacagctataaattgtgcttggtggtgaccggtgataacaaagattggaattggctactaccccatactagctagccaacaaatcgtggatccacatgatacttgcgattcattgagcccggctggcggatgcaaccacgcaacttcggcagtgtctcgttggcagtagtgcctgtccagtgtagtagtaggctagtagaagtagccaagcgcaaagttatggtgcttttttttaacgaaaagctttttccccccggtttctccgattaaacggaagtcgcacaaacgcacggtaggcataccacacggctgtgttcgttccacctggttcccaacctctctcattcgttttccgcgtacgtttttcaaacggctaaacgttgcattttttacaaaatatttatatacgaaagttgcttaaaaaattatattgatccaattttttaagcaaatatttaattaatcacgtgctaatagaccgctctatttttccgtgcttggagggtaccgttcccaaccagggaaacgaacgcagccttaggcctggtttagttccctaaatttttttctcaaaaacatcacatcgaatcattgaacacatacatagagcattaaatatagattaaaaaaactaattgcacagttaggaggaaatcgtgagacaaatcttttgagcctaattagttcatgattagccatacgtactacagtaacccacatgtgtttgtgttaatgatggattaattaggctcaaaagattcgtctcgcggtttccagactagttatgaaattagttttttcattcgtgtctaaaaaattatcttttcacgaactaaacagcccgttacacacctgcgtgccccccccccccctccctcctccccctaaaaaaacacaagtacaaagagatgaaaaccaatgggtatatccttgttctaactcatgtaatatttgtgggtaagagaatatatgaatatgaatgaatcatagtggctgaagttacgcacaagtgactggacaatcataccaccgatgctttagaatgaaaaataattatagggaaataaagcatggaaagttgacataaatgattttagactcttaggggatgtcacctattttcttggatgtcatctaaataattatttttaataaaaaataataagtgtcagggttacggataaggtataccctctacccttggatgtatgctatacggcaatg

SEQ ID NO: 28447 - DNA, 1501 bp, Oryza sativa
cgcgatcagcaagcatactctcgaggtctgctcaacatgcaaacacctaagtcaagctaacctaagtcaagctaatcaagacagacgaggtaaaggaaagggaaccgtcaagaaccaacctaaagaagtcgacgccacgtccgtctcctcgggcagatcctggtctatgccgtcccacggcacgtacggctcgagctcaagtgccagagcgtataggcaattcaggctgcccgcgctgctggacatcctcgacatcgacatctctacaaacaacagacaaagtacccggaatcaaaacgccaaagaaaactaaggcaacgattgcacacacaaaagtagtcggaaccaacgaaaagttttacaaagcgcgattggttaaggggtacaggcaagcggcggccttactcttcaaaaagcgggaggacggactcccccagatcgctgacttcttccatcacatccttgcgcgcgtcgctagccgccccctgatccaggatcttctgaagatcgagtttaggatacgccagcctcacacacgcaaggacatggcacgccccggtatagctcccgttggacatctcctctccgatcctggccgcgtgcttggaggggatcgcctccatcaccatcgccagttccgcaaatgaagtcgtcagcgagaactcgttgggattcgtcgggatggtggtcttgatgccgcactccccggcgagctggtgcagaccagtataggtgacccgcagcgagccacggatttccgacaagttgttctcgagctccgacatacggtgctcgagcccttgccgttgtcgctcattgctggccaccagctccctcatcttctggaggtcctcgcgaacctccgccaagtcgcgcgttagcctgtcggcgcgctcattcgccgccgccgccgccgccgccctcgcctccgcgatctcgcgactaatgccgcaggcaccagcctcgaggatgcgccccatctcgacctggagctccacccaggtgagggaggcagccggcgggccttgaccagccgcgatatcgctagccgggccgctgggcgtcacctcacggctcctgggcacgaccacgacctcggttgaggccactgcaggagacacgctggagtttgctccagacccatcttgcgccgccttcgcccgcgccctacgaaagatggccatgtcggtcatcgcaacaagacgataaaatctgattaagtcaagagcctcaaatttcgtccacttacttctcgccgagtgtcaccagcctctgccgtcgcggaggcgggggagacgcatccgaggcctaagtaaaccgagtacgacatgaggacgacattctccgactacgtaaataaatgacctaggaagcttaccgatggagtgggcgtcttccggcggttgccaagcacagaggaaaatttcctccccgtcttcggaaccttgccgccgctggtcgttgcagcagcagcggcaacagccgcatcggacgcctcccg

SEQ ID NO: 28448 - DNA, 1501 bp, Oryza sativa
tagacggagggagtatattatctaatgggagtagaaaatagggaaaattagctgtaattagagtaagatacgtaagaagataataaaataaaaaaacaaaatgatgaaatacgaacggactaacctattcttgattaacacatattcttggttgatgccataaacggtacgttcagcattgagcattgagcagggaatacaggaattgtgggtaaacgaatatatggttatcctgtaggttaattagatacatgccattataaatttaatggatttgaaatatgccattacaattcttgtatttgtaccaatgccattataattttaatatagtttaaaacatgccactggtatacatattttatccatattggacaaaaaaaaaaaacccgtcttcaacctctcgtcgttcatcgtcgtcgtcaccttgcctcgtcaccggagccatcctccgcatccccatcctcatcgccgattcccctcctccggaccatcgccggtttccccacctccgccgctgcggcctaggacttcgccaacaacccgtccgacgtggcgttgttcctacacacctccggcactgtcgacgggggatacccgtagatcggatatagatggtactggggtacgctggtacgaggatctacgtaatatgatatcaagcagacagaaaacaaagattatactggttcaggccccttgataggtaatagccctaatccagttgatatgggattatatgatggaaaccacagattacagagggaaaagcagaactcgatgataccgacgaggtcgtaatcgaacaggttcgaccagatctcccggcgacttggcttctgtagggtttaactccgtaggctgtggtggatgtgttggctatgagattcgatcacttagatcctcccggggggtcccttttataatcgcaggtcagctggtctccaagtaggactcggagacatcggacccagcatgatacaatgacgacccagtcccgtctgagtagtactccttccatctgtgaactccatggcgaatttctttaacgtatgccgaaaacgtccgtatacgcgcaagtataccatatcgatacgtgacgtatatcgaagggtagagggtataccttacccgtaaccttgacagtagcccccgacttctgcttaaatgaactcatgtaaccgatcgtgacttttgatgtcgaggttgttgttgttctcgatgtgaggaccgagagacgaggagtaatcgacaacgcccagtgaagctcaacggtcatgagtgaatttaaattgaagtctgaaaaattgccgcgcgtaacggacctagaaatttccggcggctatctctctcctttccttggaattcgcaccgtcggaagtgcgactatttaagggagttttggggatccatttcgaagtccgcctattgtgaaaagattctccagtctccaagcgttcctcgtcttctccacccccataagaaccctagctagttcatc

SEQ ID NO: 28449 - DNA, 362 bp, Oryza sativa
attttggtaccttgctcctttgttagctcgggttataacatgaatagattttggactaggagttgcttagccatgcttagttcaactagcacacaatggggaaatctcatttaaaatatagactgtaggtttatatgataatgttggattagtaccaccgctttggtgttagttaattaaaatgaatcacatggtgggctgtgggtgcatagttctgctagtcgcacccatggcaagtaaggaccggttcgcgggaaaccctggaagaactcctcgtacttaccacaagccagcgtgggcaacggctgggcttgtagtgtagcttttctctagctgacgcatcctggcaagggtgggcgtga

SEQ ID NO: 28450 - DNA, 192 bp, Oryza sativa
ttggaatatgatatattatttaaaataaatgctcagctagaatcctagaaaggctaagaaattcttgctcgaaacaatatttgaacatggctgaaactactatttcttttctaaataatgttgtgttaaccgacactggttgacattcagcaagaacattcaacctttcatttgatgttccttaaacacagg

SEQ ID NO: 28451 - DNA, 1501 bp, Oryza sativa
cgcgctgacgtgccggtcccgtcgatagccaatacctcgcgtggcgtacttgtcgacgatgagccatagtcttcgagcaggtgtagaactgacggctcgtggggatcgatgtcgattacccccaacgaatcgatctgagatcagcgtcgctccttgttccttgtcctcatccctgagggggatacgtgactgctggaccttaggaggtgacgtcttcatggcgctgagaaagaccttgcagcttgagaggtcgtgattctttgtcttgtgaataggacaatagacatcacgagttggagaagtacgctgaattccacgctctttgtaggcacgaatttcagcgtggacgttgagaaaaacccagcaggcttgcaaggtgtgttttttggttttgtggataggacaccaggaccttgtcacctcggaagtcatcctcgtcggctcgtgattcttgtcggaaagacaaggtttggccgcactaggatccttctcgggctcgaatgtcgtcgatgttccgttctccgcttcggcgggaggatccttcgacatggagttgtcctgggttgtagccactgcgttctcgcttccggtcattgatggaccagccaagatcggcaccgtggtgtaaaccgggaagacgatttcgccgacttgagtccgcaccagcattgttgaagcaggaactccttggttgaggttggtgttgacgctgttgtcgacgaagctggatgatatagtagtagaaccttgagcaccaagtccccctaccgggcacgccactgtcgacgggggatacccgtagaccggatgtagagggtactggggtacgctggtacgaggatctacgtaatatgacatcaagcagacagaaaacaaagattatactggttcaggccccttgataggtaatagccctaatccagttgatatgggattatatgatggaaaccacagattacagagggaaaagcagaactcgatgataccgacgaggtcgtaatcgaacaggttcgattagatctcccgacgacttggcttctgtaggcttcaactccgtaggctgtggtggatgtgttggctatgagattcgatcccttaggtcctcccggggggtcccttttatatcgcaggtcagctggtctccaagtaggactcggagacatcggacccagcatgatacaatgatgacccagtcccatccgagtaggactccttccatctgtgaactccatggcgaatttccttaacgcatgccgaaaatgtccgtatacgcgcaagtataccatatcgatacgtgacgtatatcgaagggtagagggtataccttacccgtaaccttgacaggcaccacgtcccgtccaccgccgcgccagagccgcgcggaacgcgatgctcgcgccggcgcggctgccgatcaggaacaggggcctgcagccgggcgagcccgcggcgtacgagcgcacccaccggaccacgtcggcggcgtcctcgaacgcggcgg

SEQ ID NO: 28452 - DNA, 929 bp, Oryza sativa
ccagtgagctctatagagtgctcgtcatggcttcgccggcgtcggtcgccggcggtggtgaggatagcaatggctgcagcagcctcatcgacccgctgctagtgagccgcacgagcagcatcggcggcgcggagaggaaggcggccggcggcggcggcggcggcgccaaggggaagcactgggccgccgccgataagggggagcggcgcgcggcgaaggagtgcggcggcgaggacggccgccggccgctgctgttcaggtcgtacagggtcaagggctccctcctgcacccgtacaggtacgtacatccgatcgagtgtacgatcgaaaaatcagcgacattgcaatgaaaatctttttatgcataaagattattattagtactgagcttgctagatacagaatctggacgctatacttttgttacttcctctgtataagttattttagtatttcccacatttatcttgatgttaatgaatctagatagatatatatgcttagatttattaacatcaatataaatgtggaaaatggtagaatgacttacattgtgaaacgggggagtatctaaaaattagttaagccgggaatgtatgcgttttctagttggtagaatgaagtatatatatatgcaagtcaatgagcacgttgatcatttggatggatcgtgagtgatatatattctgctcccggatttctttcagtgctaatccgttgactcgtagtaacccacagtacggcctcatgtttccaataatgtctttgcagcttataattggatcaagaatatttaccctttctggtcacctgggcatgtgcatttacttgcatttctagaaataattgtttttaagataataaataaaattcagccttcgtttcaatagaaattaactacagtcggatcatgttttttttaatctctt

SEQ ID NO: 28453 - DNA, 1501 bp, Oryza sativa
aaatgtctcgatggcctagacgctgccatcctctactggatgctgtcatcacaagcaggttggtttcatcatgcctcaagcggatcaggaccccagcggttgtagtagggactacaaatttagtagtcattgggtgaccgtcatatcaaataagagcagctcagattcggccagggtaatgtgtgctactgtagcccgcacatttagggcttgtttggttgctatcctgagcaacctgcctgagcattttacatccctgagagtagcctgagcttagatagcaaagttacctggtcaggcatgtctccctgagagtagtgtgtttggttgatgccctaaaaataagcctgatgggatacaatggtcaggtgttgtttgattcaatttgtgcctgagattatacttgccaaatgttagagaagtgaagatattaggcttttatattcacttttgagagcaagaagggggaaagtgatgcccattttttttacttggtcagtacatggggtgatcaggcgaccaatttcctaggcctgacttaggcgtgcgcacttaggcaagttttatcaggccaatatcttcagggcaccaaccaaacacaacacaggcaagtcacaggcttggactcaggtttcagggtagcaaccaaacaagcccttagtcctattgtgcactgtagcatggtccgtagcgctagcagccagttggtgacgtggcacatctctttgacgttcattagcttaacgaacgattgtagatggatataactgtttaaataccgtcattgtactaacaactgcacttgatcggagatggccattgttcccaggctaccgtcgtggtcagtgtgtagcataaacattgtgatttgccgtgagatagtagtcgagaggtgataggccgaccttctttctggatgtcgaggaggaacatcgtcgtcgtctccagcgccggcgaggtgctcagtacaagacctagccctgcggcgtctcgaggaaggtgttagagtgcatctcgggctgcaggctgatatcgttgggcgtcttcccgtcaagcaggctataggccatcgccggtgagcctggttggccgtcggcatggctctgctacaccaacaaagggtaaccaacagtgaacaacgggatcgattcgtctgccattgttgttgacgagagtacgagacgatttcagagtcgcaaacgaaaatctctatcactacggggaaaacacgtaatatccgatcgaaatagggatacgtacatgtaccagcaaaattctgcatgaacacggcacgttagttaaccattgatgttttggagtagacatatgttggactccggagagagtttctggtcaactccaagagtacttcaaaattatactcctaatagagatatctttgacgatacttctttactcttaaacacaaattcttcatctacttataataaccatcaaataggttgggccaaatagactaaggttgggccaaacagactag

SEQ ID NO: 28454 - DNA, 1501 bp, Oryza sativa
tgcttcttacccccattcttataacaataggaagattagtttcttctccccctgtttcaaactcctctccttccgtatccgatgaaatctgtatagtatcacactgatcagatggtttatcacctacttcagcaacaattgaagattgttgctgctccatcccatccataggagactcatgttgccccattgtttgcgcctccaaagaccttgttttcctcctagtataaacttgtagattttcttcttcacgtggccttctccaattttgctcatgaatgggttcactaacaggatatgggattgagccaaccacaaatttcatgcttcttgattgtgtgtcttcttcaatacctgatgagccattctccccctcttgtccatcctcatcaataattggattgtcaagatcaacaaacaaggaactcaaatctgttctttctccatagaacggaacagactctctaaaagtaacatccatactaacaaaagttcgccgctcagatggactccaacatttatatcccttttgcccagaagagtaacctataaaaatacacttgacggctcgaggatccaattttccaacggatggtctatgatctctgacaaaacaagtacacccaaacacttttggaggaacaatgaattcattcttcccaaacaccatttcatatggagtcttcatcccaagtattcgtgatggcatgcgattgatgagatatgttactgtcatgactgcctcactccatagaaactttggtacattcatcgtatacatgagtaaacgagttacctccagaatatgtcgatttttcctctcagctactccgttctgtggaggtgtgtcagcacaagaagtttgatgtactattccttctgctgagagaaaactcctaaattcatcattcacatattctcccccattatcgctcctaataactttaacacaagtgtttaattgattcctaacccaagcatagaaattcttgaaacatttcaatacttcactcttgtgtctcatgagatatatccaagtcattcgtgagtggcaatcaataaaggtgacaaagtactttgctccacttaccgaagcaataggagaagtccatacatcagagtgaaccaacacaaatggcaaaatgcttcgaagtcctctgcttatgtatgtggttcgtgtatgttttccatactcgcatgcatcacacattaatttgcttttgtccaccttactcatctcaaaggacatatgtcccaattgacaatgttttagaatcaatttagcctcctcttcacttgtgctagctaacaaagcactacatagtgctttgtccgtccctcttctatccagataccacaacccattatgcctaacaccggttccaagctttcttccagttcttctctcctcaattagacaattctctcggtcaatagtaattcgacaatccatatgatcaaccaacgagcttacggatactaggttaacaggaaaagaggg

SEQ ID NO: 28455 - DNA, 1501 bp, Oryza sativa
ttccatttgaaaaatcgcatcttaaatttcctcctcagaaaaaacttgtactaaagctttattttctaattgagagacctgtggaatatcacttatttggctttcatctaacgttaaagaagacttttataataagtggtgatttgcgccttttcacatcaccattaattacctaatcaccatcctgtaactgataaatccttgttttcctgtgcttaccatttgctaccaaatgaaaatatttagtattcgagtccccttccaaaatatttttagtcttagctcgctaataccatttaatttcctcttcccttagaaaacaggatagcttattcttcaaataaagtctagaatcaagttccacttgagttaacaaagttcatcataattttttatcaagaaaatcaagtttttctaacaaaaacttcttcccttttcttataaaggccactagtctgtttggcccaaccttagtctatttggcccaacctatttgatggttattataagtagatgaagaatttgtgtttaagagtaaagaagtatcgtcaaagatatctctattaggagtataattttgaagtactcttggagttgaccagaaactctctccggagtccaacatatgtctactccaaaacatcaatggttaactaacgtgccgtgttcatgcagaattttgctggtacatgtacgtatccctatttcgatcggatattacgtgttttccccgtagtgatagagattttcgtttgcgactctgaaatcgtctcgtactctcgtcaacaacaatggcagacgaatcgatcccgttgttcactgttggttaccctttgttggtgtagcagagccatgccgacggccaaccaggctcaccggcgatggcctatagcctgcttgacgggaagacgcccaacgatatcagcctgcagcccgagatgcactctaacaccttcctcgagacgccgcagggctaggtcttgtactgagcacctcgccggcgctggagacgacgacgatgttcctcctcgacatccagaaagaaggtcggcctatcacctctcgactactatctcacggcaaatcacaatgtttatgctacacactgaccacgacggtagcctgggaacaatggccatctccgatcaagtgcagttgttagtacaatgacggtatttaaacagttatatccatctacaatcgttcgttaagctaatgaacgtcaaagagatgtgccacgtcaccaactggctgctagcgctacggaccatgctacagtgcacaataggactaagggcttgtttggttgctaccctgaaacctgagtccaagcctgtgacttgcctgtgttgtgtttggttggtgccctgaagatattggcctgataaaacttgcctaagtgcgcacgcctaagtcaggcctaggaaattggtcgcctgatcaccccatgtactgaccaagtaaaaaaaatgggcatcactttcccccttcttgctctcaa

SEQ ID NO: 28456 - DNA, 390 bp, Oryza sativa
gtcgatcttagccgtagccgattcggactacagccgatcttactatgttctccgatcaatttccatctcgaattctactttgattccatctccatctctgatacttagattaccaaatttggtcgttaacacatgccccccaagtccggaatattggataatgttttggatttgccatacgtcaattccgagaaaactccgttctcgccgtttcccgaccgttattcaagcgctttaaatactaaccattacccccaagaaatctcacaccgtcttcttccgtttccaccgctgaggccaacactgtcctctctctcttcggcgatttctccgacgcacaaggcgatccccaagcgacttcatctccggctagatctccgcccgcggcga

SEQ ID NO: 28457 - DNA, 1501 bp, Oryza sativa
tggcatcatggttgttgaggattttccctatgatgatagaaggtgttgtcatcagcactgaggatgggcctcaactccatgcagattttgggggctctgatgccatcatctctcccatttttgggggccagatttcaattgccagccacacaaagccctagcagatggaagttggcatgccaagaatactaggtagtaattggtatcaagtctcttcgtcattgaaactgcaattcggttgtgtgatgagatccatgcaagatttgaagtgtgccaatcaaatgacatttcaaatcagtcacatgatctttctgttggagacacctgtgctgccattttatcactggataggtgtgctctgtaggattcgctgctgtcaacttgctactatgaatttggcatcctctgaaatggaagatttttggaggattttcatataatttgaactaaatcctatgagagtcatgtgaaattcctgactggtgaattctgaggtggcaatatttgaaatggatactttgtaaaattccaccaaaacatcgtaacttctacgctgtaaattacgactcggtccaatgtgctagagcttaaagcatgtcaagtctcatgcaacaagccaacaactcaaaggagactggattaaaaaaaaaaactcgaaggagactgcaaggcataggcccaatgggctcttatgaattccaatctgtaggcccatccccgaattccagatggcttctttaacagttgattaataaccagaatacagaacaaacattgccaagcacatggagcaatgcaaggtgcaaattaacaattcagatggaactgataagccgtgcaaaactgaattgagtaactaaaaataaataatttatgagtaaaacttttatatacgtgcttatagtgatttaaaagctaatgttggaaataaactacggtaaaaaaacttataatcttatggtgaaaaaaccctcaaaattaactctaaaattgagtattaaaaattaaaatttagctaagtttaaattttggctacggctataagccaacgatggagctgtctacaagtaacaggagtaggaatagcataaaacgcttcactatttacttaacccaaaaaagggcagaagaacatcaggccagattgctgatgattattactcctatatctgtactgaggaagccacatgtgcattgacagcttcagtattttactcactaaattgcagatcagcatcaggtcatattgttaaatgtgatactaatactatccgatagaaaagccacatgtacattgggtcattgacaacttgataagagaaagacctaggtaatgacacataaatcattgtaggacaaaaaaatagacatgatattcccattctaaggcacatctccgttgtccaattagtaagattcgcctattataagtacacaaaactgacgcacagcaacactgaagaaggccagcagaattatgttcagacatgaaccatttttg

SEQ ID NO: 28458 - DNA, 917 bp, Oryza sativa
gttactatctaccttttgatcttttaagcttatattttacaaattatttatttatagccttctattcaatactctattttatatgcataattcaaccatagaaacctagataatttagtattgcttatcttgcttacaatctggttaaaatattttatacttagattgggacagtacgtaagaattggataattttcgggtggctagtactgtctcgatcgatatagttatcaccaggtacttatgtcgaacgaacgggtacaacgcagtttgtagaatggggacagacctagttattatgttaattagcaatgtggtacctctgtatagtggttcttatttttaagtcctcgcgcaggaggcaactatagccgcgaaaggcaaatttaaccattaccatgtacaggtgaatggtttgtgatactcgactataaattatatggtatatttctaaaccctgaccgagatgacgtggtgtcatacgaccagttcctcttaaatacctcgggaacgccagaactcctcttgctgctgttaacattacgttcagagcatatgaggatataagttcatggaataggtgccacaattgttaataacctaatactgggccataactaaagctgatgattatcagcaagtcatggactgcgggtaaagcttacatctgctgcagtagaatatctttgaaactattcgaatagccgtactcacggaattgagtaccgggactcatatggtaccctggttagaaacctaaagtatatattttacaaactcttgctttaatatttccagattgtctattattgctttctgcaaagaacttcactccttgccaacgcataacatatttttatggtaacttgctgagtattgcgaatactcacccttgctcttattaaccctttttcaga

SEQ ID NO: 28459 - DNA, 1501 bp, Oryza sativa
gaacattaactaatcaaaactgattgaatggctgaacatatatcgagaagggaatataacatcacatagcgtacggagataaataaaaataactatgtaagcagcaatcaccaaatggcacatggaccagctgatatatcagtggagcatagaaaggaaagataagtggcacaaagaaaaaagtatattactatgaccacatctgagataggtaacgtaaggaaagataagtacaatgtaaaggcatccctttcccttttcctttccctttcctatgcattctctcaaatatccaatctaaaatcaaaaattgcaatccaagaaaaagagaaaacagagattggcagctcccagctcactcagctcttatttgcagtgtgcttctctgcttagtagcttagacagaggcatgcccattatttgcatctgagtgctgtggttgtggaactccttacctcagtgccggttggcgggcgctgctagcctacacctcatcagtacagaaaaacaaaaacaaaatcaactccccacaacattacaaattgatgcgattatattacttcattttgccttcagttattagatcacccaacatcagtttattgggaatccgtacctgcaaacattgccaaaaccactcaatacaacaggaaaacagtaggtaatgtcagtgctacaaatactatcacgtcattaacctgacaatacaactgaccattctcgatgatacatactgagcaatgaacgagagggaggaggggactggcggcggcggctagggtttgtgggagggggagtggattagtgcgcgtagttttgcaaaaaagcccctcgtttttcactttttagagcacggtcctaaatcacgatttttctctccttcgcatggaatatccgtatttctgaaggaccttcacgtaaagtaacacctcatggatactgtttgttaggaacctcgatcgaattacgcacaaagaggagggttttttcgcaaaatcgccacccctgcactgtagctatccgacgtggacacgccgagcggccgcccagcccgccactcttaatagtttctaatacttcaatactttggaagatgaatttgattaaaaagaaaaggtgagtacctattttaagtactagatgtgtaatccattttcagttccattccatcatataccattttatggctcccaacatttctgccgagcgggcttcaacccagcaggatatgcttcagatgacaaggggatatttccaaggggtgatgggcacgactgagtctgatgctagtaggagggggctcaattttcagaatttaggcttggagcagctgaacctagcagagctagtggaggacttcggggaggaggaaatttggaagacaattagagacatgccggctgaaaaagctcctggcccggacggtttcacagggcttttctatcaagcttgctgggatacaatcaagtgtgatgtcttagcagccctccagaaattcttc

SEQ ID NO: 28460 - DNA, 232 bp, Oryza sativa
gacctcctctgggcagcattgaaaatatagggctggcaaagttcaggagcaaaaactttgacagatggtagggtgaatggaaactgcatctattccatcaatcggcttctatgtacatgacagatctctttccagatgttatcccttaggtatgccttcatttaattaactccgtttaaataattgcttagccgattcataacgtaattaattttctttcctgacttgcaga

SEQ ID NO: 28461 - DNA, 1501 bp, Oryza sativa
cccatgccaccactctgtttcgacttcattagcacatcccatgccttccaatgagtttttcgccgtccatcctgagatccccaccagaattgacgagtgagtttgttcaaatcctcacacacagactctggcagtttgaagattcccatgacatacactggtatcacttggaggactgctttgatcattatttctttgccgccagaggacaggaatgtttccccccactgaataattcttttccatatcttctcttgaagactttggaatttccctctcttcatcctaccttcgggagtagggaaccccaagtacctttcttcaaattcgtctttctcaatgtgaagaatactcttaattgcttcctgtattcctggtggagaagcctcactaaacataatagaacatttcgctgggtttattagctgtccagtcccagctgcataagcactgagaacctcacttaccgcaatcgcctgttgttgttcagccttgaaaaataacaaggtatcatctgcaaagagcaaatgagatataccaggagcgcgtcgacatatctgaataggagagatggacccctgtgcaactctttctctcaacaacatagacaaaccatcagctatgaatagaaacaagaatggcgactgaggatctccttgacgaagacccctggagggtgcaaaggagctaaggagagttccgttaaatttgacagagtatctcaccgaggtaacacatgccataatccagttaacccaacggtgagcgaaacccaacttgttcaatgccatttccagataccgccaatccacacgatcgtaagctttcgataagtctagcttgtaggcacacattgctctattctgtcttctgttagtttgaatggtgtggaagcattcaaaagccagcaaggcattatctgtaattaggcgacctggcacgaatgcactttgctcacaggaaactagctcatcaagtatagtcctcaaccggttgaccaaacatttcgataccaccttgtacataacattgcataaacttataggtctgaaatcctttagctccatgggttaatcaatcttcgggataagaactatcgttgtgtcgtttaccccatcaggcatagtgcttgtctgaaagaacttgctaacagcatgtacaatatcctgtttaacagcaccccaattcctctgataaaaccgagcaggaaagccgtcagggcccggtgccttcaggggaccaatttgaactatttttcttagccctccaaactgcccggctgtgaaagaatcgagtattacgatcaccttccttcaaccaactaattctggagcgttggagccacaacatttcttccttgtataacaattcattcatatggtctgaagcttgccgaacaactgaactatcagctccattctctaacagagccgccagtctttttcttgccttttctgactccctgcctatattcttaaccttcctgttactccaagaacgc

SEQ ID NO: 28462 - DNA, 218 bp, Oryza sativa
cccttatcggagcattaccggccaagccctctcgccaataccttcgcctcgacgaggcaaatccatttcctaaccttcccctgcctttccccctctgagactagccaccaccggcacctcccataccggccggagctaagccctagccatcgccgttccggcctcctccctcactccctctcctgatcaccaccctccctggatgcgcgtcgctcagg

SEQ ID NO: 28463 - DNA, 1501 bp, Oryza sativa
ttatgctgtgagtgtggtgagccgatacatgcatgatcctagaagtggtcacatggatgttgtgtatagaattttgagatatttgaaggcaagcccaggtaaaggcatatggttcaagaagaatggacacctagatgtggagggatattgtgatgcagattggggcagttgtcttgatgataggaggtcaacatcaggctactgtgtatttattggtggcaatttggtatcttggaggagcaagaaacaatcagttgtgtctcgctcgactgctgaggcggaatacaggtcaatgtcgatgagcttgagtgaattgttatggttgaaaaatcttttggctgaattgaagctgtcgacaagcacttccatgaagttgtggtgtgacaacaaatcagccataaatattgctaacaatccagtccagcatgatcgaacgaagcatgtggaaatagatcgcttctttattaaagagagaatggatgagggaaccttaaacttaggctttgtaaactctggtgaacaagtagctgatagtttaacgaaggcattaggtgctagagagtgcacttcttcgtgtagcaagatgggcatgatagatatttatcgcccatcttgagggggagtgttgagtgtaggcgtgtgtatttcagcccaatagggcccattccaccaatgtatatgtatagtagatgagaaaggaaatgaagtgaagcttcgagaggaaaaatcacaaaactacacaccaccactagggacagctttcaccctgctcactctgcgttcaaacggtttcaggggagaacaccggagttctgaagaaaacagcattggctctccttcacctgagattaaagtcgtacaagaaaatctctaaaaaatttcgtttgtcaccagagttcgtttgtttttggaaatataaaatgaatcgtacaagaaaatctctaaaaaaacttgtacgctaacttgagattaaagtcagactcctaattgcagctcatgattttctaaaaaaaatttatcaaagcgaattcccacatcaaacttcaccctagttaaaccgtataacaataataataataagattaaaatagtattcatccgttacaacgcatgggcatattttctagtaaaagaaaaattcaagtatcacccaaggggccgagtagcacagaatagcaagtatgttagaattgaacgtaagctaaaattagcgcacttgacttttagatctgcatgtatggtggtggatgtgtgaacgtctttcgtttaatgagtaatactgtaaaaggtctccgagaatttagcgtcaagatatgcacactggacaaattcaagtcttcatatttttaaaagaacaattaaaatatcaccctagtggcagagtagcatagactacaaatatgctagaattgaacttaggctgtgtttagttcagtacgaagtttggattttggttgaaattggagatgatgtgactgaaaagttgtgtgtgtatgacagg

SEQ ID NO: 28464 - DNA, 208 bp, Oryza sativa
tagtgaccagtgattgcagttttggtttgaaattttggaccccccaacaagtgattatctcagccaaaatcttcagtttttttctcaattttttacgaatttgatcaaaatttagtcaaattcagttaaattatgtcaaaatttcagaaaattttggttcaaaatttccaaaaataccgaaattttggaaattttggaagaaccaaaa

SEQ ID NO: 28465 - DNA, 1158 bp, Oryza sativa
gtattaatttgcgtattgcatatatgaaattaagagggagtgtatgacaaacatgtatattagataaatactagttataaatcttgacctcatataattataattatagttcaactgtaaattaggattattcattgtaaaattatgtgatgggataatctgtaaccatactatgattaacctaaacaattctaacatacaaagcaagggtaattgttaacctttataatttattttgacaagtaaaatatgtacataattaaaataaagcctccatcaataaaataataatacaaatgattcacagtaattatttgaccgatccaaatccatccggcaacaaaacctctagtgtataaccgttctatctagatagatgcatgaatagccatttgctagactaaaccacatagtagccagatacgtatctcattcatactacattggctagctcctaaatagaccaccatgataacagaaagattaagaaactttagcccttagcatgttggaaaccattagcaagcgcgaataatatgagcaaccttaggttcaacctcaacaaatatattttgtttgtgcatatttgattgttgcttgaatattggtttttctcgcgtattatagactttgtgtatcggttagtcgtgaggcaatgtcagcaacttccaggaggtgaaggttgatcaagaattatatcaagaataaggactatcctgagcaaggcaagtcatcactattcctcgaacatgttgatcctaattgcgaaattgttttgtttacaagtaaaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattaccttcgggaaggtaattgagatgcggcatgtggagacatgagcgccacattgccatgatgttgatgacatgatttgtgaaaggagaaataaaattaaaacaactgttttcgactggggcggacggaggatttgggtggtatctggaaaaggctagtaccgtccccagtcaattaaggaccgagcca

SEQ ID NO: 28466 - DNA, 1501 bp, Oryza sativa
aagtctttatttgtagagaagggtatttttactcggcctctatatccaaccagaaatatgtagcccttttaaattagtaaccgaactcagagctttgggtgctactcaggtcactgcaaccactagactacatgttgtttcacgattaataaagtcatacagttatattccatgaccacatatttggcgctgctctactaaatccctctaaaacatggaccaaaaaaattcatatggtgagagttgcaacttacacttattggtaaacaaaaattccagagctctctcagcaaaaatcttttttttttgtttttgatacattatatactccctccgtccaaaaaaagacaaaccatgattttcgtgtccaacatttgaccgtccgtcttatttgaaaaaattatgaaaaaaattaaaaagataagttacgcataaagtattgatcatgttttatcatctaacaacaatgaaaatactaattataaaaaaattcatataagacggacgaaaaccatagtttgtctttttttttttacggaggtagtagactgcaatttgcaggtaggactacataactacccacgacatgacatcatgccagccgatccggaccatccgttacttaaaagtggacggccaagatgagccaaaagtcagcggcacagtcgcacagtaacggcaaggactgacgaccctgaaaaaaaaacctcgtagcctcgcaagaaattcagtcgcgtctgcatacaggtcatccatctctctcactctgcctcgccgggaagcagcagcgagcgaagtagtaggcgagagaatccgagcgaggaagaaagcccgagccgaggagcgctttaaagcgggaagaagaaagaaagcgcgcgagtaaagaaaagggaggaggaggaggaaagagagccgtcgttttcgttctcctctgcttcgcctcggccacgctgcggccacctcctttctgccacggcaaaagcctcctcgggatgctccactgatcgtcttctacttactcctctttcttccagcttggccggcgtgtggctgattattccagaatttccattagcttaatcaccggatcaagaagaatgagagaaaggggggagaggctcttttctgtgggatgacagattccgttttgtaggagcagcgcaccatttcagatttcttcctcctcctcttcttctttccgttgtgcttgctgcttttctctactaccttttccactgttgcgaagtcgggttggtgggtggttgattgattgttctttccttcctcgtgagggttcttgcttcttggcttcttggccgcttcttgagttggggctagctggttcttttgctgtctctgtcccgtcaaactgaagcgagcgagagattgaccgggtgggtgattcttcttcgaggagcttcttcttggagctcgtgagagtggagtgatcgaggtggtggtgtgagagcagtagacaggtttttcttggggagcttggagg

SEQ ID NO: 28467 - DNA, 881 bp, Oryza sativa
aaatatgaaaatatttaaactattgtatgagaaaaaaaatctaacaatgctagccgcgcaatctgcgcgggccgccatgctagtttagataaaacaacatgaaaacttgctggtgcaggcgtgcagcgtagtaacattttcttctttgaagacgtgacttggatctgctagtcaacgaagaacaagaattaatctgtagtttctgtttctatactcgactagtatctcctctgtctcaaaatataagatattttgatcgaacggaggtagtagcttcctgcagccaacacactatactcgagctatgtattttttgtcctctcttttatcaaacttgcagcaactaggagtatgatagtgttggtgataaagaaaccgtgggcatagaaatcactactctctcaccaaaattctctaattctaggtagcaataatttggtacggagaaagtaaaatgctcagcttgcgctagtgtggtggtctggtggaggccgtatagtagcaatagtagcaaattgacttggtaggtagacatgtcattatttagggtgaagcttaaaattctaataattaactagttggtagttattttctaatttatattgttggattcatagaattttaaaaaataatgtttaaaagagattctgattttagaagaagcagtacagtagttgcaagaagctctcaaacagacccatgaaactcatgttgtttgcggcgctacataaaggcataaagcccccttggcgtgaaataatttgccatggacaaggaggggctagctaactaggtgcattgcatgcttggcggcggccaccacggcttccacgatgtccgcggcggcagcggtgacaagctggactaacggatgctggtcg

SEQ ID NO: 28468 - DNA, 1501 bp, Oryza sativa
agaaaagccctgtgaaaccgtccgggccaggagctttttcagccggcatgtctctaattgtcttccaaatttcctcctccccgaagtcctccactagctctgctaggttcagctgctccaagcctaaattctgaaaattgagccccctcctactagcatcagactcagtcgtgcccatcaccccttggaaatatccccttgtcatctgaagcatatcctgctgggttgaagcccgctcggcagaaatgttgggagccataaaatggtatatgatggaatggaactgaaaatggattacacatctagtacttaaaataggtactcaccttttctttttaatcaaattcatcttccaaagtattgaagtattagaaactattaagagtggcgggctgggcggccgctcggcgtgtccacgtcggatagctacagtgcaggggtggcgattttgcgaaaaaaccctcctctttgtgcgtaattcgatcgaggttcctaacaaacagtatccatgaggtgttactttacgtgaaggtccttcagaaatacggatattccatgcgaaggagagaaaaatcgtgatttaggaccgtgctctaaaaagtgaaaaacgaggggcttttttgcaaaactacgcgcactaatccactccccctcccacaaaccctagccgccgccgccagtcccctcctccctctcgttcattgctcagtatgtatcatcgagaatggtcagttgtattgtcaggttaatgacgtgatagtatttgtagcactgacattacctactgttttcctgttgtattgagtggttttggcaatgtttgcaggtacggattcccaataaactgatgttgggtgatctaataactgaaggcaaaatgaagtaatataatcgcatcaatttgtaatgttgtggggagttgattttgtttttgtttttctgtactgatgaggtgtaggctagcagcgcccgccaaccggcactgaggtaaggagttccacaaccacagcactcagatgcaaataatgggcatgcctctgtctaagctactaagcagagaagcacactgcaaataagagctgagtgagctgggagctgccaatctctgttttctctttttcttggattgcaatttttgattttagattggatatttgagagaatgcataggaaagggaaaggaaaagggaaagggatgcctttacattgtacttatctttccttacgttacctatctcagatgtggtcatagtaatatacttttttctttgtgccacttatctttcctttctatgctccactgatatatcagctggtccatgtgccatttggtgattgctgcttacatagttatttttatttatctccgtacgctatgtgatgttatattcccttctcgatatatgttcagccattcaatcagttttgattagttaatgttcatgcatcagatttgttaatacaaaatgttctctgatctggtattcagcttggctaccag

SEQ ID NO: 28469 - DNA, 200 bp, Oryza sativa
tttgtgtgcacttgtcgctagccaaattacatccatcagcgcatcttttcgacgttgacacctccagcccagcaccccgacacaccatataagtaagtagagctaagcatgcatagtcgaccagaagtggaatattgaacggtggaacgcgtacttacccacaagttaggtgcatgccatggcaccattcatggcgtgcg

SEQ ID NO: 28470 - DNA, 1501 bp, Oryza sativa
tccaatattatggctgatagcttagatgtcaattcatcacacacaataataaataggtaaactaaagtttattctgaaatcgatcacataatactattcaacattcacctcttctgataatgactttgttctaataatttttattaatcaagtcttatactgtaagatccttaatgtcatacagaagctgtaaaaactaactttttgggggtagctaaggtgcttatggctatgaaattttgacttcttcatctgttttcatcaaattgaacagaaccgacagatccctttgagggttgagtgtggcacttttttttttcctaaagttgatccgatcttcgtgttccctagatagttggcgaaatgtgattctgatgttcacaaccaaagtcacctgaatcctcattccaagatcttaacgtttatgtgtgtgttctcccatctgcagttctcctgtggctgctgacagcagcctgcatcaagactgggcgtccgcagatggcgaagcgcgccattgagctcgccgagtccaggctactgaaggacggctggccagagtactacgatggcaagctgggacggttcatcggcaagcaggccaggaagttccagacatggtccatcgctggctacctcgtagcccgtatgatgctggaggacccgtcgacgctgatgatgatctccatggaggaagaccggccggtgaagccgaccatgcgacggtcagcatcatggaatgcctgaaatgttttgatagaatttttttttcccaaagagaggttcaatgtggaaacttataggagttttgtccaaacatgaaaatggggttcaaaatttactgtaactgtactgtcagttaggacagaagtgtatacgatagatccaagtcgtttcagagcaattttgtccaacttttcgtatctggcttcatcaatccaacagagaagaagtttttgttggtgaaacatttttgcaataattaaacagttttgtcttgacatatatactagcatatgtttctgtgatggataattctttgtaatactttgtaggactttctgttaatatactcctcacatattttcattgtggaaggaaacaccaaggacttttgtatgattgtggcgccattgacgtttacgatatcctgtgaacataagtctttcgtgcacacaccaattaacaaataccattgaaaattttagaaaaaaaaatctgtgcatttactttcaatattattacacttttagttgcagattgagaaatacaataagaaataagtggcattacggcattcagtaattcagtaaaaagaaaaaaaaacaacgacaagatcgtcggtttggaaatagggtaatatactggtggcaaacagtaaaaaaatccaaaatattttatagtctaaacaaacggaaggtttcaaaacttcttgaaatttaaaatcaaggatatatatcagatttctgataggacaggactagaggaacaggccggggagcag

SEQ ID NO: 28471 - DNA, 322 bp, Oryza sativa
ttacttctagccgctgtattatgttttcagtttggccataacataatcgaggtttcagttaatatgtaatttgtggtgtattacttgctacctacagtcccattaaattgatgttttcttaccgcctatgctcagactacaatcactggcagtccaagcagcctgcttcttgcctcttttaataagattacacatatatacatggattaattgtgtgattcttctcaaaatgcacttgaaatctgaaggtgtattctacatagtttgtgtatatggatttattcactaattcttctgcaagcagacaatcttggtttgcagc

SEQ ID NO: 28472 - DNA, 405 bp, Oryza sativa
actatagggcgaattcgagctcggtacccattacaatttacacacaccgcaagtaagcaagctacaacaaaaactgaactccctcttatctaaaacatattttgatatcggtgagaattatatatatatatatatataattacttaaatctgggaatttgatcgtatttgtgttcacatttaaagtggacatcttagatgttaattaatggagaacttgacgatcaagctaaggatggattacatagagattacgtacccctgttcagattcgttgtactaggatgtgtcccatccactacaaagtttgctatatatattttgggacggagagagtaattcggtttgtcaccaagctccgaaggcccctgcaccacactgggagaaaccaaaaaggagatcgaga

SEQ ID NO: 28473 - DNA, 308 bp, Oryza sativa
catggaaaattattattttttatttcttcaactgtgaaaggctcatccagctcggataggtcagaccgccagttcctgcagggattgaaagttaatcgtcgaagagcgttcccactgttccccgagatgctgcaggaaaaaactaaactgttcactgctggaaaatgttagcagtgaaaaaagttaaccctgaaaataaggaagtgcaccaaatgttttattatcttataattttgagtaaaaccttgggtattgtagttagggttagaagaaaagctcatgactcgttagctcgctcatctcgtagc

SEQ ID NO: 28474 - DNA, 1501 bp, Oryza sativa
aaagaatttagagtctagccaagtgtaatacatgtcccggtgctcaataaccgcgagcacggctattcgaatagatctggtttactcacactgcagtggatgtacactttacccgcactccgcgactgcccaacacatgagcctcgtcccaacacatgagacgcgtcacggcaaagcttttcgataaccttgcattggcagtacccgctccatgaacttaaatcctcatgcactctaggcatccatgtttctagcagtgagaggagttctggcgctcccggggaaagagaagtctcacacgcatattaaattatggttcaagttaagttctctctctcacacactcatggcagtcctaccaatggcaacaccgatgtagggcacgcctctcggccctacctcaacggctgtcccatcgtagcgcacctgcctcactcaggggtgaaccatctatgcagggatactgcctccgctcggctatctaatctgctaggtctatacccattcgagaagtacggttgtacgggagtcgtttcatgcttaacttcatggctcggtccttaattgactggggacggtactagccttttccagataccacccaaatcctccgtccgccccagtcgaaaacagttgttttaattttatttctcctttcacaaatcatgtcatcaacatcatggcaatgtggcgctcatgtctccacatgccgcatctcaattaccttcccgaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaatttttacttgtaaacaaaacaatttcgcaattaggatcaacatgttcgaggaatagtgatgacttgccttgctcaggatagtccttattcttgatataattcttgatcaaccttcacctcctggaagttgctgacattgcctcacgactaaccgatacacaaagtctataatacgcgagaaaaaccaatattcaagcaacaatcaaatatgcacaaacaaaatatatttgttgaggttgaacctaaggttgctcatattattcgcgcttgctaatggtttccaacatgctaagggctaaagtttcttaatctttctgttatcatggtggtctatttaggagctagccaatgtagtatgaatgagatacgtatctggctactatgtggtttagtctagcaaatggctattcatgcatctatctagatagaacggttatacactagaggttttgttgccggatggatttggatcggtcaaataattactgtgaatcatttgtattattattttattgatggaggctttattttaattatgtacatattttacttgtcaaaataaattataaaggttaacaattaccct

SEQ ID NO: 28475 - DNA, 1501 bp, Oryza sativa
ttcactgagatgtataattttgtgattcattgtatcatatggatatgagatgtctaatttgtgatgtatttgatttgtgtgtatttttttaggatttatgatgtatttgatttgtgtgtataagtaactttaagatttatgatgtggatttgggatgttactttgatttggggatttggggtttgatttggggatatgcatgccacttgattcgagagaaaataaaaagaaaaaagaaagaaaaagggaccatttgggactgccgttattctctctttactcccggttggtaataccagccgggacgaaagatccctctcttagtcccggttgttgttaccaaccaggactaaagatgtcctggttatttcaactggaactagatttatactccggttaaaaacccgggactaaaggggttatcaaccgggagtaaaaatggtttctccaccaatgagggtgcattagtgtgttggggaagtagcggtgaagtaggcaggatcgaggtgtcgagctacgacgaagggaagaaaaagaggagtaagttaggttttaggtatttgcacgaatcttgaagtgatctaacagttcaaaattcgtaggatattagagaggtgcattgcgcattaccttaaataaaaatcggttgttcccagttaggagccctaataaacgggacctttgatcatgcaccataaaggctcctatacggcggaaatgctgttgggcgatcgatcgccctggggatggggtagcgataacctcccccctctctcactccacctagtttccttttttggtatcgtattactttcctattttagtaaatttatacacctcaagtttacacatctaaagtttagagaccaaaagtttacaagtcaaaagtttatatatccgattcaaatttgaatttgaattcaaatattttttctatatagtatttctatacatctaaagtttatacacctaaagtttatagacttaaagtttataagtccaaagtttatgtacccgtttcaaatttgaatttgaattatatccgattcaaatttgaatttgaattcaaatacttttttatatatagtatttctatacatctaaagtttatacacctaaagtttataagtcaaaagtttatatatctgattcaaatttgaatttgaattatataccattcaaatttaaatttgaattcaaatattttctatatatagtatttctatacatctaaagtttatacacctaaagtttatagacccaaagtttgtaagtcaaaagtttacatacccgattcaaatttgaatttgaattcaaattttttatatatagtatttttttacataaatttttctaacttttttttttaaaaaaaaatttgtggtttattgtagtggggaagagaagaagggagagtagagggacgtacgtatagagggagcgggcccagcgatcaccagcacattagcagtcccccttatacggtcctaccacttaatca

SEQ ID NO: 28476 - DNA, 234 bp, Oryza sativa
cattaagttggcgatctcagcgaagaaatagaaaacatggcaatcggcgggtagattctcggacggccgtggacgagacgagggcggaggccatcggcagtgacggcgagctaggagcgccggtaatgccgtcaactcgtcgttgtcaacgttgttcaccttctcgccttagatgaacttagcgctagtccctgcagcaggtgttgacgatgatgttggtcggagcggaagacg

SEQ ID NO: 28477 - DNA, 481 bp, Oryza sativa
ccctgtcttggctccctctctacccggcggcacgacgacaaataggggggcagcggctcaccgacggcggcgacgacggcgcacggcgcggcacactgaggcggcagcgcggcggtcacgaatgcggcggcacgacagcacgagggcggtggcgcggcggcgcgtggagagggggaagagggagaggagggggaagatggagtgaggagaggggagaacggtggctcttataggggagagagggaataaggggaagagggaagagaagggagggggtgacgcgacggcggcgcggcggcgcggggctcgggacggcgcggggctcggcgcgcggtgagggcgacgggcgacacgacgacgacggcggagcgtcgacgggacggcgacacggcgacgggacggcgacgcggcgacgggacggcgcggcacggcacggggctcggcgcgcggcgatggcgacagggcggcgcggggctcgaga

SEQ ID NO: 28478 - DNA, 1501 bp, Oryza sativa
attcccgtaaatcatatctattgcttaaatgtagttcttttctttactttcttggtgatcatttacggtttggcaagtaatagcaatcataacaaccagcatgatgcaaaagttttaaaaagttcgaaattttcgtgattttcattgtcttgaattttcaggatgttacacgtcacgtcagcgaaaccgctctctaaaactgttgatggagtcaaattgcaactgttttaatagttgggagtcgagatatccggtattatgattcaaggatgcgaatcagatttggcaattagttagagtcaaagtggacttatttctttttttttttgcccccgggccggggttcagagtggattgggccgaaacccctgtcaaacccggcctaactaaaatcaggcagaattccgtggagccccgaacacagccgggtgcgggtgcagagcctctcgccgccgccatcgccgctcatcgaaaccctagagcccttggcgatgccggcggccagagattcaggcctcaggctaccacccacccagggtgggtgatgctcgaggtcgtcgacggcgatggcgccaatcaccgaggcgacctcccgctcctcctccggccatctcgtccgcgtctccttccgccccgagctgacactactacagatccgggcttcagtgacgggtcatctgtgacgggccaacgtaactcgtcaaagatgagtcatctctgacgggccgaaaaaatatcctcttcaatatatggctaccagggaggacccgtcacagatgtaaagtcatctgtgacggcttgcacttgtaacccgtcacagatcgtctgtgacgggtcacaaccatggctcgtcacaaatgacatgtcatttgtgacgggtgtagtattatgaaccatcacaaaagagaccactcatctctgacgggtctttaactaacacacgtcacagataacgttatctctgacgggtggtggttatgacccgtcagtgatgagtgaaaattcaaatttgtaaattttgcaaaaaaacctcggattgaaacatgtcctatataaaagttgtagctctcaatgatatccacaactttataactaacaacatttctattagagatcgtttacatccccgaacatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgttataaagtgagatatatttttaaaaatgaaattttgaattcttcaaacaacatcggatgaagatattttctatgtaaaagttataaaacacgatgagataactatttagttgataatattttcatttgaagtcatttagggtgttaaatatatgttaaatgattcagacaagcatagacaaaataataacattgggttagtagtcaatatgt

SEQ ID NO: 28479 - DNA, 203 bp, Oryza sativa
ctctgatagatctaggaggaagaggagtaaggtcggtggtgtggacgcctctagattcagcctacgcaaggtcggggacggctagatccatcaaccatgaaactagggattcgtcaaccatgaaaccggtggcaacataagtcccatgatttttctcacctttttcttatctctctccactctataccttctcctttcataga

SEQ ID NO: 28480 - DNA, 1501 bp, Oryza sativa
gttgtggcaatgtaaatctaccaccaccacctctgtcaagttctttactccctaattcaaaagctcacaattcttaatcccgatctgtctttttattctgtggcaacgcacgggcaaaacagttagtcacaatataaatcaatttgatatatattgttccataaatatgtatgtttaaatttaacctatacaagtaaggggaaaacaaatttgactataaacaatacataagtcaaatttattttttctatttattccataacccttcccataaagtattttaactactcatattgatatgtgcaaatattaagtactcctagctttgtggatactaagcaattataaatctaatagattatcttgagttatataaatctaaagaaattataactgcatttagggttgagtttgtcggtgacatggggccgggggtatcgtgactagaggcttggatagccgcgatcactcacatggcccgaccccctcgggggggtcgggcccgacagtgacatggccacccctccctctgtctccccgaggggtcgggccgctcccgtttcggccccgagggctggggcaccccgaccccctgtggtgttggcgccacgtgtgtgggttaggtgagcacagcggcgcttacctaaccgcatttatggcgggttagacgagcgcgccacgccgcattcaatgcggcgcagcgcatgcttatccggtctgtgaccagtcgcggtgtgtgaccggtcacagaccggtcagatcgcgggttaggtggcaacaggcggcctgtcacacgcctcgccccgtcccgtcggaatgatgagagcttcctggctctcgtctctagccggagctggcgtgctgactcctggagttggtatgtcagtcccggtcagatccattccaggcttcagcgcaagcgtggcaagaaaatcgctggccattgaatgaaggatgaaacgggcgtccaccgggagagctgacgagcggagcaggaggcgtgtgtactgcttgtcagatgtcatttccggctgtagattagccctcattgtaaaaagcatgtttcttttcttaggcagggagaggcccatgtggtgacccctaaccagataaaaaaaggggaggcccaggcctaagaaggggggactggagggggagagcctgaactctctctggcgctcgagctctcttgctctggagctctctgtattccttcacacacagatccaccagaacacaggagtagggtattatgcttctcagcggcccgaacctgtctacgtcacccgtgtcttgtgcgcttcttctcgttgacattcctcagatcgagggcgaagaacctcacttagcgcccccggccgaaccggcaaaggggggcctgcacggtctctcggtgaggagccccacgctccgtcatctggcgcgccaggtagggggcgcgcgtgtctttctaagccctcgtcctctttcgtgtgcgccaagcttctcccgctcaacccaa

SEQ ID NO: 28481 - DNA, 370 bp, Oryza sativa
tgtttttcgtggtcacttgattttggggatcgaccctcttctcttctggctggagcatctttttctcctgctggatctgcttgactgctttttctcctgcttctttttctcctgctcgaggttgcattatccaattgtgctagctgcagtggtgtcggctagctgcagtctgcaggacccgcagcctccatcctttgctgtcgcacttgccgccaggactctttccaacaaatctgccatgtgttggatctcctgctgctgattacaatacctaattgcagccactaattgcagcagcggcagcccagtgcagcagtgcagtagcagcgtttcaagtgcagcagcagctcagcctttcagattgcaacca

SEQ ID NO: 28482 - DNA, 1501 bp, Oryza sativa
cgtcggcgaggggggtgtagaaccagtcgctcttccagtcgtcccactttttgcggaggacgcagggaatgtagcagttcagcacctgcccccgcggctggaagtagcagccaccgactaccgtcggcggcgacaccggctgaacggtgaagaaccaccggaacagccggagagatgggcgcaccccaataaacatctcgcacaggtgtgcgaagatggccaacgtcattatcgcgttgggggtgaggtgcgccatctggagatcataaaactccaggatatccatgaaaaaaacagagaatggcgggaccagccccgccattgcgaaagagaggaagaagacggaccgccccgggtagtgcggcgccgggcgtccctcgcccagcgcgaccacctcccggccggtggcagattccggcatgaatcggcgcggcagcccggcctgcctctcgctcacgatgcgggaaggcggcagcacgctaccctcgagcggtgcggagccccgtgccatgacgccggcagaggaagggcttgagagcgagcgagtatggcaagggtagggcgcaggaaacggagagtcagagaacaagtggcgaaggcaaggggaagagtggcgagaggaaggaaacaaatcccttccttggcgtctttgtacccttgccaacgctatgcccagctcctcgcttcccgcgcccactacctcgccccctcgtttctcgcgcccacgcctccaccaaccccactcgcccgtttgcggcgcacgcggcagatgtgcggccgtggcgtttgagatggggcagatcgtgcgcgcattaaccgcgctcgccaaccgcgaaaaacgccatcatcgtgtccccaggcgaaacaaaccggctcgtcccgattcgcgcgctactcgagtaatgtagcggtcttgaagaggccgctcattattgtcgatcggtttttcccttaccgatgcgcgcgatttgcgaccgttgggtttctgcctgcctgtggggaccggccccacctgtcaccgggcctaaggagtggcatcacgcccgagcgcctccctcgaggggggcggtcgccctggcataacgccgggggctactgtcggtgacatggggccgggggtatcgtgactagaggcttggatagccgcgatcactcacgtggcccgaccccctcgggggggtcgggcccgacggtgacatggccacccctccctctgtctccccgaggggtcgggccgcttccgttttggccccgagggctggggcaccccgaccccctgtggtgttggcgccacgtgtgtgggttaggtgagcacagcggcgctcacctaaccgcatttatggcgggttagacgagcgcgccacgccgcattcaatgcggcgcagcgcatgcttatccggtctgtgaccaatcgcggtgtgtgaccggtcacagaccggtcagatcgcgggttaggtggcaacaggcggcctgtcacacgcctcgccccgtcccgtcggaa

SEQ ID NO: 28483 - DNA, 1501 bp, Oryza sativa
gaaacttatatctcttgagacgtgctattatgggtgctcctctacaatccagcatattataatatactataatatattatggtacggccgaaacttatattctgttacgagtgctccacgaccctcaaccggttaggccgttgaccagttgtacccaaacctatgctattgtcatcttgcggttataaccggtgtgtctctctatttaagagagagcctagaatcgagtctgactctaagtctatcctacatttatcccaactcctagtaggattagtatatccgacacttattctaacaaactccaccttgacaaatacacctcacctagaagtaatagaatcaccatgtcgatccaccggtccttcagacttggcttgtcttcttctgcagattcattgtgaaccgcccgacgagcctacaccagactcaccgccttcaagtgtaactcctttctctggacttcacctgcaacagtgctccaccttctcacatatcatcaaagtcgtcttgccaagcgaaattggactcctccttcaccgccacataccagactcctcaaagaccatgttcacttttatcttttgtcttaaattttgattttatctacttcatggccagaaaacacatgccatcgccaaatagacaaatcaaactcatcagaccattgaagagaaccctttcttccttatcgtcttatgaaccaagctaaaaaaccaacatccatgcttttcacatatatagactgaatgcatgatactttgagaaaattcactgctgccttgaatcacttgaagaaactaccaccatagagattgctcatcctcttcaacgacgtagttttcatatatctccatcatgccgactccacatcctagaatatcatgtattgctagacaatcccgttgacaccttcaacgatttcgacccactattgcctgtgattttccatgcactgttggacatctctgcttgagccacggccttctctggtcaatccttggtgaacgcctaaacctggtgcccaattattgttgttgttaattcacggtccgcttttcggtttaactagacatcctgagtccaaattgactctgtttctccgtcatctaccacacggcctccatatgagctcgtctactccgagttggaaaaaattcctcgatcacaccgtaaagcgacaaagaaaagataacactgttaggttttactctctggccatcgagccagatggaggtgtacggcacgactcacctaagtccggcactctacctagcagaaaaggcgcgtctacggactcgtgcacacgtcacgcgcgttgatcggatcgctcgcaatgatttccaacgaaaacgcccctgactcccatagttctatctatatacctaattaaaaaataaataaggtttccgactgttttgtcgtccgtttcggatcggggctttttattccaaaaccccagttgatatagtatatgtacgttacaagtaatcacctaaca

SEQ ID NO: 28484 - DNA, 1501 bp, Oryza sativa
gctttttattccaaaaccccagttgatatagtatatgtacgttacaagtaatcacctaacacatgtataaatctgcctacttagttaaggaagaacttcttcactccagccaccagggttcgattccaacttactctaagatgtttcgtacgtcgtcactgaatgtatccgattccgcatattagaaaaaaaaatctatcgcgcttgggtcatgtccggcaccacgcgcgcgcgttcttgcggcccgcgtaaaccacgagtcctattccacgtgaaacatccaagccgcaagattgattcaattctcgtgcacgtaacatccaaatccaaacctataggatttataaaacgctatgatcaattcaaataaaactcccaagaaatcctcattagaaaagtcgggcaagaaaaccaaaatctctctcccattcctctgccccacgctggttcttggctagaaaagttaaaggaagcatacacagagcaagaaaaagaaaaattatactagcaaagcatacatcacccgacactctgtgctgaccacgactgggatagtcccaaagtagaggggagatcgaccagggcgggacagcgctgtcgtcgtcgttgtcatccccggccaccggtgttgtcccaggctgtcggcgttgctagatccaccaagcggcaacggcaggcgggcaggggaagagggaagagtggaggcggcagccgaaggaaagggcccggtcgtcagcggggagcgctggctgccggagcttgagatgatctggagcgccggcggtggagcggagcggcgctggatcgcgattgtgatagggatgaacggttaaccggatgggtggataaatatcatctgtcatcttctattttagcccctgaacttcgtaaatattacgacaatttctttatttagttgatttctttcatataagccctaaatttcatatttattttcatactagccctcaatgatctctttcccctactaattaagggcatgttcactttgatgccaaaaaaacccaaaatttttatcaaaatttagcagcaaactaaatatagccatattttgacaactttagcaaaatttggtaagattaaagatgtcatcaaagtgaataggacccaaatcagtttttctattttctaattaataaattacatatattagacgagtccctgaatttctttttttaatatagtttcagacacccgagtcagactccgactcccgagtccaagtcccgtaacactgcatgcataccagccctgctcaagttgagagactagaaagaggttggccgccggcaagtcgggaggaagaggcagagccaaagaggtgagcacggaggcgttgccatgtgaagtcgcgagagaatacatgcgacattgcgacgtgccggggttgactggatgggcatgggcattttttctataagaaatctatttaaaaaactcgcatcaatcggacttttaactgtagctcaagattttctaa

SEQ ID NO: 28485 - DNA, 269 bp, Oryza sativa
aatccagagcggttttgtcatacatggtgtacacaaacctacaattggtatccaactccactactacacaaacctagataggtgtcggttggaaacccaactaggtgccggataacctgaaaagtggcacagatgatagaaatcaaaggtgtcagttctaaaacggacacctttaagatcccaaaaatctaaaagaaaagtggatcaattcatcggcttgaatcgtggtgcccccctcacccaattttacccaacatttaattcataga

SEQ ID NO: 28486 - DNA, 1501 bp, Oryza sativa
cgggtcccacccgggaccacgcgtggtgagcctggtccaccggctctctctctcctcccctcccgcgcgcgcgtgcttgggccgccttgggccggccggcccatttagctcggccgaaccgctccatttctctcgggccgcgccctagccgcccgaggaaagtctaatttccctccctcttttattttcttttctttttttttcaaaaaggatttaattaaatccttttcctttagaccaaaaatccaataatcttagaaattcaatatcttcccaaccataaatccgtttgactccgttcaacttccaaaattcctcaaatctcgagatctatctaatgtcacgcttagaggtcattaatagggctttattttcgctgtttgttaagttgtcccgtttcgcgtgtagtttcggagcccgaagacccgcagtgcgaggatttcgaggatcaagctcaagatctcgagcaaggcaagccacctttgaacatctttagcctatatttgaacttaattatgttgcttgaaaaatattatgcattgataggatcgcacttaatctgtttgtcccgtctgcaaggcagattggtggacctacctagtttgttgcatttgacccttcctttgttaattgctataccatgttcccttgtaaccatctagttgcgcctcgatattcgtgcactctgtgcgagtaactccttgggtaaaacttgctttactaaagacttggaaaacccgacacctgggtcggtgcttgcgaactaaatgaatttccaaaaccgcggaccggggaatgtaccgggtgtacggttttctgctctcgcacctaaggaccgtttccttggaatttcatccgaatataagacaagtacgaccacatgggtggaatgggacacccctggctgagtaactagcttatcaggggagccttgatgccgggagacatgtggattcgccggggtggtgtcggggaggacccctgggcttcctggcacagtatggtctgggacctaacctgttgttggtctgggacccctctcgtcggcatatggtaaacctgtgtccgctttggaaatgccttgtcatgaaagcttggaggtctcccgacgtggctgatccccacgggctgggtgatccgggttagtaatgtcgtgtgggtaaattgtaccccctctgcagaggttaacaaactattcgaacagccgtgcccacggtcatgggcggatgtgaggtgattcctagcgtagttttgtttgactactgctttgcgaaattgctgttgtggaatgggttcgatgtttgaaaaacctgcagctgatgggatcagctaggcccgggtggccgtttgaaagttgttggcccgggtggccgtttggaagctgttagccgggtgccaaccttgaatcaattctaaagactgatacattgcacatactccgaccggacgagacgcactgtctcatccgtgtcgtttgagaagcactcacttagttgttttc

SEQ ID NO: 28487 - DNA, 1501 bp, Oryza sativa
tgcagcttggttgcttactttgcggtgtagtaatccaagaaggcgggaaggaggcggccgaagaatccgaaggaggacgacagggagacgagagtggacgggtcgctgagcccgcgggactcggcgatctgccccaggttgttgaggaagaccaaccccagcgtgccactgaacatgtagctcaggaagtagagccagaagtcgagccgccgcagcagccggatgccgccgacctcgtcttggccgccgctctcgccggcggcggcgtcgtcctcctccttgttctccgccgcctcggccacctcgagcaccgacacggccgtctccggcacgtcggtggcggcggcgacgtcgtgcactctgttctcccgcttcgcctcccgtagcttgtccatgctctcccgcaccttgagcgccgccgggatgagcaccgggagggcgagcaggatgtagaggctgatcatgtgctcgctggtcgagagcccgatggacttggagccgatgctgccgacgacggcgcaggctccggtggcgagggtaatcgcgaacatggcgaggaacgccgggtcggtccggcggtggctggtgagctccaccacccggagcgacggcgccgccacgagggtgacgagcatcggcacgacggcattgaggaggaggtacaccttctccttggagtacctcgccgtggcgccccggggcatcttctcggccatggtggtgtagagcttggcgctcaggccgaggtagctcgtcgcgaggctcaccgcgacgcggctgtccgacgggaagttcttgatgcagaggaggtagcacaccgtgttgatccagcagatgccgttgccggcgagggaggtgagcaggaacaggtgccagtacgcgagcccgggcctctccaagaagaggaactggacgccatacccgacaagcccgaacgacgcgccgacgacggcgacgagccacaggggcaggtacagggcggcgacgccggcgaaccagccgaagagcttcccggcgtcggaggcgaaggcgaggaagttgagctgcacctgggagatgcccttcacctccttgagctgcgacgagtacaccgggaagtcggcgttcgggccgttgatggtctggagccagacgcttccgaccaagctcagccaatgagctgaggaaggagaaggcatagctagcgtggatttttcctctctagctacctacagcctctgcctccctctcaccggcgccgctgtacttatgcgagatctcggtggcccggcgataaatgcaggggacgacggcgacggcgacggcgatggctgtggctgcctccgagcaatacgctctattatgtgtggtttcttgttggccattatggctcatggcgagcagcttatatagtgcgagctccgctatggtgttctgaccaaaggagtgtacgtgacaggcacctgacctaacagcagtggtcggtcagggttggcagcgaagaggagatgcaaactttctt

SEQ ID NO: 28488 - DNA, 1501 bp, Oryza sativa
ggtgagtacgggagtactcagcaagccatgggaaataagtgtttaatgcaggcttcaaggaaggctgttgtttttgcaattgattttatttgaactcttttctgaaaacaactaagtgagtgcttctcaaacgacacggatgagacagtgcgtctcgtccggtcggagtatgtgcaatgtatcagtctttagaattgattcaaggttggcacccggctaacagcttccaaacggccacccgggccaacaactttcaaacggccacccgggcctagctgatcccatcagctgcaggtttttcaaacatcgaacccattccacaacagcaatttcgcaaagcagtagtcaaacaaaactacgctaggaatcacctcacatccgcccatgaccgtgggcacggctgttcgaatagtttgttaacctctgcagagggggtacaatttacccacacgacattactaacccggatcacccagcccgtggggatcagccacgtcgggagacctccaagctttcatgacaaggcatttccaaagcggacacaggtttaccatatgccgacgagaggggtcccagaccaacaacaggttaggtcccagaccatactgtgccaggaagcccaggggtcctccccgacaccaccccggcgaatccacatgtctcccggcatcaaggctcccctgataagctagttactcagccaggggtgtcccattccacccatgtggtcgtacttgtcttatattcggatgaaattccaaggaaacggtccttaggtgcgagagcagaaaaccgtacacccggtacattccccggtccgcggttttggaaattcatttagttcgcaagcaccgacccaggtgtcgggttttccaagtctttagtaaagcaagttttacccaaggagttactcgcacagagtgcacgaatatcgaggcgcaactagatggttacaagggaacatggtatagcaattaacaaaggaagggtcaaatgcaacaaactaggtaggtccaccaatctgccttgcagacgggacaaacagattaagtgcgatcctatcaatgcataatatttttcaagcaacataattaagttcaaatataggctaaagatgttcaaaggtggcttgccttgctcgagatcttgagcttgatcctcgaaatcctcgcactgcgggtcttcgggctccgaaactacacgcgaaacgggacaacttaacaaacagcgaaaataaagccctattaatgacctctaagcgtgacattagatagatctcgagatttgaggaattttggaagttgaacggagtcaaacggatttatggttgggaagatattgaatttctaagattattggatttttggtctaaaggaaaaggatttaattaaatcctttttgaaaaaaaaagaaaagaaaataaaagagggagggaaattagactttcctcgggcggctagggcgcggcccgagagaaatggagcggttcggccgagctaaa

SEQ ID NO: 28489 - DNA, 255 bp, Oryza sativa
tgcgaaaaacggacttgcaaccggtcttcgacaaaatatcagggagagttgcaagttggagggggaaaaacatggcagcagccgggagaaccacgcttgtaaagtctgtgctttcagcacagccaatttatctcctcactgccttgaaggtgatgaaggaatccctggagcagcttgacaagcagagacgtcgcttcctttgggctggtacgggggatatcaccggggggaaatgcaaggtcaactgggcaaaga

SEQ ID NO: 28490 - DNA, 213 bp, Oryza sativa
cgggccaacaaatttcaaaacggccacctgggcctagctgatcccatcagcagcagatttttcaaacatcgaacccctttcaacaacagcaatctcacaaggcagtagtcaaacaaaactacgctaggaatcacctcacatccgcccatgaccgtgggcacggctgttcgaacagtttgttaacctctgtagagggggtacactttacccaca

SEQ ID NO: 28491 - DNA, 1501 bp, Oryza sativa
gcaagtgaatacatgaggaaagagaaggaaatcatgtcttgcataagacatgtcttgcatgagacatggtttctacacaacatccaagacatcatatgagataagtagcattaaatttaagtatgaaatagtggtgtttgcattggaagaatagtgtctagtactagtttcttgataattcttgataatgtggagtttatagaaactatgtctagtgtcttgggttgggaatagcctaagttatttatgaaatctaccgttggaagtaagtaatttattgcataactataatattcataagtttattgtgtgagaaagtattaaatgcagaaaatctaacatatatttaaagaaatatatttagcattttttaaaggataaacatgacaattcgtcttgtatagtagcatttttagataatatatacaaaatgtgtcaaatcttttgtgctactgtcacaaaaatatgatacatatgctttttaataaatagaaatatactttattatcgtctaaaaaattttttgtcgtgataatacctcacataatgacactcgtaaatataactgtctcatacaacaaactgcaacacatccaacaatatactccacaaatttagaagggatcaaaccaaaatagaggtacacaagagagtgagacatcatggtaagaaaaacagaatgctcaacataaaaagttcatttccaaaaattgatgggatataattataggcaaatgttgctacatgatagtcaatgtttatttaatttacatgtggacatccaaaaacgtgcgatgactagaggacacctacagaatggtaatttactgaacgacaccacactcattgttttaatattttagatccaatcgaagggatttttttttcaaaaagacaagaattcccctcaggccacaaaattataagctacgctggagaaaagaaaagaatatgatgtatggtagcagtgtactttgggggaggatagattgagagttgcatgatgtgtagtttgaaaatctaccagaaaatgtatatgaaaatttagatttttctgaaaatctagaaattatttttaaaaaattcagattttttattttttattttggaaaagttgcaaaatgtaccagttgctgctgctctagggttttggagggggttaagagcatgcccagcagatactctaaccaatcctccatcccggtattggcgtatatgggtgaaaaaaatgccctccagcagatgcgctacccccacactccaaaattggcggatgcgccatagtaggagagagaagaggcaaaaatagcgtatctctctcctcacgccatttcgcacccgcccccatccagactttcgcaaccaccacccctccggtgtgccttcccctcgccgtcgtccccaaccggcgtagatgagttccccgtgcccctttttttgcttttttttcagcgatttgtggagcgagccttaccagatctgggggcgtgcgcggggcctt

SEQ ID NO: 28492 - DNA, 1501 bp, Oryza sativa
gctcgcgtgcgagaggaacctacatgatctgctggttgtcgctgccgtaaaaggccgccgcttgccgaggcctcacacgcccgccgctcgctgccgccatacgcgcctacgaaagcagcagctggacaccgtcgccgccgccgacgcacgcgcccgtagcgcccgccggtcgcagctgacgtacgcagcagaaggtcgccgtcaccgccgacgagcccgtcgcgccagccggtcgccgccatcgcacgcgctggctcggttgattagggttaatcttgaatcaacggtgcgacggcttggttgattgggtgacgggtgggatttgagcaattactaagctacccttgttaataaaaatttgtgttcctaaattaccctttgaagattaacgggggataacaattcgttaaggaggtacctggggtacctttcaagcaccgtaaaagatctcttatccagatcatcagcaactgagttttatctgtagaacttgcatacgaagattggagaattagatgagttcgatcggcctacgtatgtaaacacgcaggctgataaaaatctgcaccaaaaatctgaacctgtatatatgctcgcattgtgtccaacctttcgcatcagaagcatcaaatggtaagccgtccggtacaaactgaaaaatcttcagacgcagtacttcagagaccatgaaaaatctgccacgcacgaggattaacctggtatttactgaaaaaaaatatccttggtatgatgtgccctgcatttactgaagattttgccgccgcctcttgctggtctcttcaagacatgaggcctgttttgacaatgtgacatgacaagctacgttgcgaccttgcagcctaacacgttccttgatcagatttccgacggccaacacgtagtaaaatcgtagttttacgatctcagctaggccggcgtctgaacctcgtggcttgcagagccgcttctctctgacggatctgaatttctcggccatgaactgcacgagcgtctacaggttagcagcacacgctgcacgttactgtaccagaaacctggcatctctcttcgatccagtttctgacgaaagatacagcacccagcagctgcttccgattgacaacggctgaattgcagtttcgagcccctcctgagattaattgcagagatgttcaagaaagtttgcatctcctcttcgctgccaaccctgaccgaccactgctgttaggtcaggtgcctgtcacgtacactcctttggtcagaacaccatagcggagctcgcactatataagctgctcgccatgagccataatggccaacaagaaaccacacataatagagcgtattgctcggaggcagccacagccatcgccgtcgccgtcgccgtcgtcccctgcatttatcgccgggccaccgagatctcgcataagtacagcggcgccggtgagagggaggcagaggctgtaggtagctagagaggaaaaatccacgctagctatgc

SEQ ID NO: 28493 - DNA, 1501 bp, Oryza sativa
aaaaaaagtatctcaaggtgccggtacctcatggtaccaaatcgtttatgatcattgaaaaaaaaaacctaaagtacccaagcaattgtacaattaagcacaatccgactgttaagcagtaagcacatgtatactatcaataccaaagcaagtttacaacaaagtatttcatgcattttgcaagtctgtcatgcaaccacagcagacagcgcaatcttcgcacgtctgaatttccatcaacaaccaagtcttcctcaggctcatcggaagccccaaaagagatttgaatcggcggccattatcatgacaaagcatgctataagctcttagcaaatcatgacgagacaactccggtatctcttccagggcagcaaagatctcatcaggagaagctactgatcctgacactctgaaatgtttagcaccagatgactcacatgaaattcgcactgaatcaccgatgatggcatcatgtgttggcgccttgtcgatgatcacagctggctctgacatcgctccgccattgctgcagcttccattggaggaagtgaagtagctggagaccttgctaggaaggaaattgcgtccatggctgcaggagatcgctgacaagagtgtcttgctccttgtgtcgaagaggatcatccatgtttctttgatgcggcaatatctcccctcggattctcgctcatccaccatgaagctgatgaggtggggatcgtctatgctcacgatggggtgttctggaatggcgtgtgggaggccggcgtaggcgtgggatgaccagagctcgctggcgtcgaccatggcgtccatggtccaggccatgtcgccgctgccgtcgtctaccctgagtatccaggtcttgatgatgaaggcaccggtagaatggccgcagtaggtcgggccggggcggccgcagcagcagcgggggatgacgtcgatgaacttcagcgcggcgccgccgccggtgacgcagacgcttcgctctgcgatgacgtatttccgcgtgtggtcgtcgtagtcgtcgtcgtcgtcgttggattcatcggtgagggcctcggggggaagtggcacgaaccgcagctgcggattctggtcgaacacgtcgtcgacgtcgcagaggatgatgccgcggtacaggtcggcccagcacatccgccgctcgccgacggggacggccatgtcggtgatccacgacggcagcttctcggctctaccgtcgaagtggacgaccggcgcccgtgtgacggtccactcgccggagcggagaacgaggagctcggcctcctccagctcgtcgccctcctccatcacggcgagatccaccaccaccatgtcgtcttcgccgcggcgcaggaggccggtggtcctttcatccagatcgtggcgcggccgccaggtttcactctcttcttcatccgcgtcggtggtgacgtaggcagggagcagcgacagcgacggcggccgtggcgggtctgcggcggcggagccggcgttg

SEQ ID NO: 28494 - DNA, 1501 bp, Oryza sativa
cgtctcggcggccgtagcgatcagcgcgcgcgctcgtctcttccggggtcggtagtggccgcgggcgcgcgcggggtgccctcacgcgcacgtcgcatattgctttcacaggattcagctcccccggccgaccgggcggcacactgcccccctgtccgtggtgcagctgctgaattgagccgaaggaggtgtgaatcgtgttcgtgttttgtgtgtgaacgagcgagcgatgatgctattatagctttttcttttgctttgtgcaattgtgctagcgctagtgatcatgatcaccatctctttcatcctgcgcccccctatcacgcgtgcgcgcggtgcgggtgctaaaaggaggtttgcttaattagcttagcccctctcgatccgtttcctccaataatactcctaaaaggagtattgtttggacgtcctaagaaagaatcgctcgctgtgcacactgcactgcatagtgcaatgcttctgaacgaacctgatctcgctcgcgatatgacgttcttgacttgtcactccactacacctcgtgccggctaaaataaaccaaagaatttattaaagcgttcttcgatccgttgctagctgactaatactactactaatagtcttctgatgcactaacacttgtagtaaagcacaggcatgtactagcacagtagtagtagtagtagtagtagcgtaaagaaagcggcactttggttattagttactttctcctttctcctttccttgaccctttctactcgcatgcaaaaacatttcgcggacgtatgtgcgacgtgtggtcgtcaagtaaccccggccccgaaactaataacaaaagttaccatccgtttcgatcgatcgatcggggctcgcagcagcagcaacaacgagccaaaggattcgcccgtcgtcacgctccaactcgtggcgtgccgtcactttcccagcatgcatgccgacggttgccatctttttggacctgacgcgacagatatcgtcgatttgtcgtcatcgttgcccctctcctcctctgcattcttggttccgtcgtcactcttgtggaggagaggaaatcatgccaggattggaaggccattgtgcctgctcgcttggctcacgtgtacttagccccattcggaccggccatcgtccatgcatgcacgcaacgagagttttatggttttatcatgccaagctttcgctgatagaaagtgagcagggcatgcgtgcatgttcgcgttgaaggattagacgagacatgggggatggatatatggattgatcatgtagatgctgcgcttattatattcacggtagaccgatctggctaagcaaccacataagtactaaaccagctcaccggaaagagaccgaagttgctgaatcgatcgagagcattgctgatggaaacgcttgtaatcctccctgtcgatcagcagaggatttgaccggccgtccgggccatatcatctcaaccgaactgcctcgtgtttatcacatc

SEQ ID NO: 28495 - DNA, 1501 bp, Oryza sativa
agggggaaaaagtgtcaacgtctagctcaggaactatctgtagcggttggtggtgtcaatgtccggattgcagttgtctcggcctcaaaatgttctggaacgagacactacgctaacgtcctcggttaggaagaggagaatggtccactgtactggttcttggatcagtctgctaccacctgcactgcatctaccatctcccagcagcaaatcaagggagcagctacagtatctttttttaatttttaatctcttccatcttctccttttgaaaaaggagctacagcgagagcaatgttgcaaacattgaaaaagatgcacgaattgcaggcagtatctcttctcctttctcgctttaccgtcacttttggagcctgattttccatcaatcacgccatctagggcttccttgctgctattgcatctgtcggtgtttttcctcgctagacatttcttaccatatggttgcttatttacagtttccagtaaaagacagagttagtcggtaaacaaattttaaatttcaaaacttaattttagaattaattttgatttttttactatagattgttttttagcacttgcttttatgtcactaacaatacatataaaagttttatgcataaagtattttttgactgctagtaacaaacgttatggtttataattagtacctatgaatattttaagtagaacatgagaactgtgatgggatgatggcgctgcagtgctgcacaagttaattatgcagattaatcaaccagtttttttaaacaagattaattaaccaggtctggctgtccatctacactcttgtttgattcttaactaacattgtcaatttgtcataactcataattcactttaaacgaatgtggcttgccacactttttgtcctataaattataagcaacacttatagcaaagttagacaaagaatttaattgatgacatgtgaggtaaagtgttaagaaagtgtgacttaccacaactatgacaataaatcaaatataaaactaagaaggacgtgttagtctaaaatgtgatgcgataaggtgaagcgttgaaccaaaccccctaaagctgttgcatgcctacaaaagcctagggtggtaaaaaaaattacctggtgcaacaacgattagacggcaaagggacaatctctaaggctagattagcagttactgtatcctagaacaactgatgggatgtaaattgtcctcatgacacaaaacagaagaccactttttgcacaccactattttagtttgaatcacccaaccaaaaagcactgctgctgctgaggaacggacaagcaaacaaggtgagtgagtaccactcaaggaaaggaaggcacatccacaaaatgtaccgtcgagtaaattctggaattgacgaggtaaaacctcagcatttccactgtacaaaatttcagcacttccacgttgagttcgtcttggaagctatatttgtacgcactgaactgaacttgaagatcaaa

SEQ ID NO: 28496 - DNA, 1501 bp, Oryza sativa
taacatgtgatatatcattcataaacatgtaaattaaaattcaatttgtacaagttgaaacaaaaaaataaataaactatagctagctaacgtatatctatagttaaatttgttttttttttgcaacttgtcaaagctaaatttcaatattgcatgtttgtagagtagtctatatcacatattttatctatcttgttaatttttttcataatcatttacgtaacatgcaaacaacgggaggatgttctcttgagagttttgaatagtttctgataagcccggtaaataggctacaatattagtagtcgaactttgctatactccacatatacttggacctgcagctttgagctatggctgtgtttacttcagcgtaaagtttggattttggttgaaattggaaatgatgtgactgaaaagttgtgtgtgtatgacaggttgatatgatgaaaaagacttaagtttggatccaaactttagatttaaacacagcctagattctgataggcaggcaaatgatctgcaaagaaaatttagtagcaacagaggtacagatatggtcacctactgcccaactcgaaccaatctccattattaatttacatctgcgtatagcctttctgtacgtctttgagtgtcggaggtagagatgacattactagctacagtaggctagcacatccactaaacctgacacctaccgctgctattgtgtattaatgagagatcaaatcttctatctatgtatctattatatactaaaagtctattaaacttcctacaaacgttcctaagccgtcatatggcatcctataaacactcatgtgatgccacatgacaaacaaaacatctaactgttgattttcatttaatttggtggacccatcattatcttttatttttagccattagattaataatccttaaaaggaaaaacaaatgccatctacctccacctccctcccctacgtccgtacatacatactccaaagtcatgtacgtacagtcactatacgcacatcttccctctatctctccccttctcacatcttcctatttaaaaagctagatgtaaatattgcctaaaaattaaatggaaattatattatttaatttataataaaccaaaaatttaatatcaatattgctcacttaaacatatcaatattattttatttaaatttaaataggtggacccattatctaaaatagaaagagctccattaaaaaaatccctccgtcccacctccgtgtgggatgcgcacgtacatatgacattgaaagcacgtatatgcacctccgatccttttgttttaggtaaattttgctacaggacactgctattgcgtggttttagccgtgggacactaccaaactcacttttgggggaaaatactccataaacgtgctaatttgccaatggacaccgcgccgattaaaataatgatttccggttgaggaggagagagaaatcacgtgaaatgtcaaaaatgcccttagg

SEQ ID NO: 28497 - DNA, 1501 bp, Oryza sativa
ggcgcgtgcgggcggacggagctcggcacggtttcccccctccatctcggtggcgtgcgcgtagggaggactagggcagcagcttctcccacctgcaccgccggccagctcctccgcggctgctgcctcccgcccacccagatcccgcgccgacgatggacgcctgccgccggctacagggacctctcatccgtccttgaccgccgccggctacagggacctctcctccgtccttgaccgccgccgtgacctcgatcccaccaaatcctcctccatcgagagaagagagatgaagagtgagagagaaaagagagtatgagtatataacaggtgggtcctacatttttaataaatagaatgatgaatggactgccacgcgtatgccacgtagaccaaaaccaccgcggattgagtcgaggaggataattcatcctgtttgtatagttggagataaagaatgtccgattttatagttcaggggacaattcggttgaccgcgatagttcaggagataattcatactttttccaacttaaaaacaacgaggtagggacatcaagcgaactttttctatttcccaattcgactatattttgcaagaggtggtttctcctccggaaaaagtacacccaaggtccctcaacttgtcatcgagatacagtatcatcctcaaaccgcaaaaccagatatcccgcgtcccttaactaatcaaaaccggacacaaaaggtccctcggtggtttttatcccggttttatcccacgtgtctgttgaatcagcatgagacccacgtgggccccacatgtcagggtaatccacgtcatcaccctccctctttctcctcttctcttcttctgggtgaggcaaagcggcgggtgcagaggggccgaagccagcaggcgaggcaggagagaggagggcgcggctgcgcgacggtggccggtgcccggcggcggcggctgcagcggaaacacagcgacgcggcggccccgacggctatgtcatcaactgcgtgccgacgcacctgcagccggcgttcgaccacccgaagctgcgaggacagaagcccgaggtgaccgagcagtcggcggtgcggcggcggcggcggcggcggcggcggagcaggaggaggaggccgtgttcccacaggcatggacggacagcggcgagttgtgcactcgtgcccggagaggacggtcccggtgcggcggacgacgaggcgcgacgtgctgaggtcaagctccgccatccggttcgggatgaagcagccatgcgccgccggcatcgtccgccgcgactccaccagcgacggccacgaggtcagtcagtcaactcgccggtctgaataagttactacatgctgaaatgatcgagtaggagtatagtatacgttgtgctgcacagctggtgcagtagcaatgggcaatggcaacaatggcgatggcgagttggcaacgaactgaattaagagtgtaattaattagctgagattattcatgagc

SEQ ID NO: 28498 - DNA, 1501 bp, Oryza sativa
aaattggtttggtttgggaaaaccaaatttgaagccaactctaggagttgtgcaaatcttgataaataaatttgttacttctcacctcccgaccgagctgagacttgtctcgctctggttgtggaaagcacacacttagattgttgaaaacttgaaaacaaaactgtttgcaaaataacagccttcccttgaagcttgcattaaccacctaagttcccctggcttgctgagtacgtaagtactcacccttgctctctatataaatatagttctgccagctccaaagatgaagttgaagtgaagtgaagattagggtttcgtcctagttccctgccgttgcctgtggcgtttggtgttagtccgttggttggttctgctgctgctgctgttgttggtgtttgccttgtccgtgtcgccggttgcattctcaggctgtctgagctgcaacctaagttaaggtaaataagtcctctattaattataaggatttgcaatgattcatgtttgtcaccgtgggtaccagcgctatgtcctaggactggtactgagatcgcggtttcgtaggacgcggttcacgccgttttcctacgacacgctcctgtcaggtgccgttgtacggtggtgccagattggggtgtgacagctcactcttcctagcaagatctccagctacttcacttttgatgatccaagttattgtagcaatgctgcgacatcatcagagccacatgtggttgatcatgatactgtcatcgatgagtcggtgcgatcttcttccgagtcatctgctggtggcaaacatctgatcagagtgtcaggagtggcttcccctgatgagatctttgctgcactggaatagataccggagttgtctcgtgatgatttgctcagagcgtatagcttgctttgttctgacaatggtggccgtcgattcaaatctcttttagggctcccaatgaccctgaggaagccatggctgttgatggaaatcaaggccagtgaagctcgttctgtttggtgtgcatgcagagcagagctacaaaatgtatgaaatactagtgtttccagctgtttgattgttctgaattattgtactattgctgcttgttaagaagaggactctagtactctaatagtctactactatccccatcccaaaataaatttacttttagacgtaaatttggacatagcctcgtgtctaaattcaagggttgtcaatttcggttcgaaatttcgccccccagcaagcaattatgtcaaccgaaatttccaaatttaaccaaatttttgagaatttgttttttatgcaaattaaattattttcaaataagcatgtacatgggcacatggatatcgtacccattaaaatatttatttttggttgaataagagagaaaaacagttctaaatatatgcccgtagttctaaatacaaatagaaaagaaaattttctatttgtatttgtattttttaacccaaaactgtgggacccaactaa

SEQ ID NO: 28499 - DNA, 182 bp, Oryza sativa
acttcgtctacagcgccggcgatgccgccgccggtgacccgccatcgttgtcgctgctcccaattcactgggttcactacgggttgagtgacaggacgccgaaccggctggacgacgctagaaccggcctcctgcgcgccgccgccgccgttgcggtgacaacgaccttgtggtgtctaagc

SEQ ID NO: 28500 - DNA, 1501 bp, Oryza sativa
aaagtgaggtcctgggttacccttccaggtgcgcagatttttttccctacacacgccagcatgaatcttgaggcaaatccgacggtgaaaaatttgaaagtttttctccctattttccgtcgacagaaaactagtaaatctgttacatgtagatagacctactgagttccacaaatagaactactactccgttctgtaaggacagcacgaatcttgaggcaaatctgacagtaaaaaattctaaagtttttctccctattttctgtcaacagaaaaaaactagtaatccattacagatagaacaattgagttccatatatagaactgctattctgttctggaatgacacctgggccatcaacccgacgttgtaccaaaagttcgaagccctattttcccatgcaacggatcaagacgtcatagtgaagtctgtgttccaagggggtgtgccactaactctgcggccgggaaaacttttttaaacactcggacggacatccactcgtttcttgcatgtcaacctaaatagtcatgaaaaatctttaaaaaataataagatagattaatatgaaatatatcattctataaacatgcaagttcaaaatcatcttctataagttgtaacaaaaataataaatttatctgcaaatatatgtaaactagttacaatttaattttttattttttaagtcgaatttaaacttatatgtttgtgcagtggtatattttgcattaatctatattattattttttaatttttttttcataactatttaaatgatatataagaagcgggtgaacgtccatccgagattaaaatcatctccccgcggctgtcctcaacagcacaagcgcaactacaaatacgatcgttccgatcaaatcagtagatgaccgaagaaacagagagctgtcacaatcaaacgaactaacatccacgcaagtttacaatgccagggcaccgcaagtccgcaactagatcaatgccccaactgggagtttgtctggaagaaaaggacgcatctcaaggaacagctaccaacgaaacaaaacctgaataaaaaaagtgatagtccccactgcggtatgtgatctgtgcgaagatatatacaacggaaacagctagccatctatgcctacactgcccattcgcaaaaccattctaggaggcgatcggcttccaaccaatcattcaggagatgagcaacatttgcacacttacagcctccgtcaggactgcctaagctgcatcaccaaatcttttttcctggtgtgcttctgggaattttggaaccatcgtcatgatattgtcttcagaaacgcaccaacatcgataccgagtatccttagaagatgtatcgaggatgccagcctttaggccgaaaggttgtgtgtgtagaaaggacacagtagtactctcagtgtggaaccaaatattttcttcccctctccagtcactaaatccagtgtaaaactttgtattacttccttaagtttggt

SEQ ID NO: 28501 - DNA, 1501 bp, Oryza sativa
tggtgaaatttttttgtgtgggaagtaaacggagcctaaataaatacacatacacgcacgcttctctctgtgtagggacgaagtaataactagtgcagtgttcgaatgcatgatgcatgtttgtgtctttgttggtcatgctgttttagtgagagcagctgcgctgcattcgttcctgtaaatctgtaattttgtcacaaggaacggtgccatgaataagggagtcgtcctctcacgttcgccgtgaactgaacgcattacagatgggcctaagaggcccattacagtgggttgggcctacataggaaattagcccgtgacctggatattggttgggctttacaaattaattagcccagtagggtactaacggtccatttcagaggattcctacgaggactgggccttgctatgggctgtacatgggccaggtcggaccatgcttggtcagtggtcacctcactttctattttacatgtactatgttgcctgtataagtattcctcttaaaaaaacttgtactctgctgtatatcacgaaaactgttttttacttgtttttttccatctatttttcttggcccaagtttgacagccagaatgccagatttcgacaaacctgtgtcagattccaactggcattaatttcgcgtgtcaaaaattccttttgcctaatcagacacttgaacctgaattgagtcccaccaacacatttttgtggtgacgccgaatggttttgtaagcaagtgtgtggagcatgcatatgcatgtttctgcacgccagtatgtcactgaatcggcaggcaggcttcatgcatgtttcactgcacctatattacactcaaacagacagcaggcatgttcgatcaagcatgttaggctcaggcagagaactcacgaccttgtccgctctatccctctcaacatttcatatatatcaacgttttctatatgcttaaaatgttgttggtggtgatgttcatactcacaccacctctaccactaacatctagatttacaatctgtattattacaccacttttcaataagtcgccccatttcacaattggctcaccaaatttcaaaattatttagttgttcaataaaaaaaatcatagtactacttagactgaataagtgtttattaattgatttaataagctagtaacttaatttgttttccgttgtaatgcacgggctcttaggctattgaaatataaaaatttgcatgattcaaattttgtatcaaaatacactaattctgatgattccatcatgtcaataattccaaaataaatcacatatgctctaaatctgagtaatccaaaattagcaactgaagtgactaatttttttttatatagttactaaataacctagaaatctttatattttggaacatatggtttgctaagctacaagaactagtaaaacaacttagtaaaaaagagcaaagattatcccgctaacttgtccactcctctgaaattaagacgccagca

SEQ ID NO: 28502 - DNA, 1501 bp, Oryza sativa
gatttccctagcatctgcgtggccgccgccggtggtggtggcggcggcgcacacacttcgtttggtcgccggcgagtccctgcggccgtcgtcgaagctcttggggggctcgacggggagcgacacgtactgcagtcgggggctctcgtcgaacgggttgcagagcatgatgccacggtgcaggtcgacccagcacagccgccggtcgccgacggggacgaccatgtcggtttcccacgctgacagctcagcgccctagccgccgctgtcgtcgcggtggatgatcggtgcccgcttgaggctccactcgccggagcggaggaggaggagtttggcctcgttcggcggcatgtcgtcgtcgctccccttggtgatgagctccgccaccacgagctcgtcgtcgccacggcgcaggatgccggtggcacgtacatccatgtctggatttggctcgtcctgctctgtcgcatcgacatagttgtgaggcagcagcgtcaacgacggcggccgcgcggcgtcgccggcgttgtagacgaagtaatcaagtaatcgagcgcgtcgtcggcgttatgctcgtcgtagtattccatcttgatgagcacggagtcgccgtgggcagcggcgacaaacatggaggcatctagatctttttgctccaagtcgaagaacatccgcgacgccgccggtggcggctcgaggcagaacgagacgcggacgcacgggccgccggagaaggtgcaggcgctcgccgccgtcttggggtcgccggtgtagccggcggcggagtgcttcctcaagctcctcacgttgtgacctttgtgctcaagcatcacccaccgcgggtaactgccgccgccggcggtggccatcaacgtcgccggtgattagttgcttgcgccttgcggttggctctagttatcggagttatataaaagatcgtaacagatgaatgtatgtctgtgttttctgttaagatttaacagggtataaataaccgtcacgtttatcgttagagatcctatcgtgtcatcaaaaacactctagcccgaatttactgttaattgtgtcgattttttttttttgtgtgggttgtggaggacttttattttcttttttttatccaatccccaatgaattttattatgaaaactaacgatccaaacacctatttagagcacaaatttgctacatatctatcttgtgattttttaaaaacgattttttcacctttggcttttgccgtacagatttgattttggaccgatcaaatatgttaggttaaatacattgccgttgagtgatttatcatatattaatctattttttgattttttttaacaaaaatcataacccatttgaatgatatgcaaataacgagaggatattccctcgagattagaatccactctcctcactcattcatattgttgccgtcagtttctcaaaaaaaaaaaaaattgttgccgtcaggctataaatggccaaaaggcccgaggcccga

SEQ ID NO: 28503 - DNA, 822 bp, Oryza sativa
gtctatttttactcccctattttttgtgtattgggccgagctgccggcccatcgtgccgggccggcccaacgtgccggtggaggggcccaggcacggctcggtggtcaggccgggctagcacggctcgacctccgtcgggccgtgccgtgcttgggccgggccaaaatgccgtgccatgggttgggccatcgggcctcgggccttttggccatttatagcctgacggcaacaattttttttttttttgagaaactgacggcaacaatatgaatgagtgaggagagtggattctaatctcgagggaatatcctctcgttatttgcatatcattcaaatgggttatgatttttgttaaaaaaaatcaaaaaatagattaatatatgataaatcactcaacggcaatgtatttaacctaacatatttgatcggtccaaaatcaaatctgtacggcaaaagccaaaggtgaaaaaatcgtttttaaaaaatcacaagatagatatgtagcaaatttgtgctctaaataggtgtttggatcgttagttttcataataaaattcattggggattggataaaaaaaagaaaataaaagtcctccacaacccacacaaaaaaaaaaaatcgacacaattaacagtaaattcgggctagagtgtttttgatgacacgataggatctctaacgataaacgtgacggttatttataccctgttaaatcttaacagaaaacacagacatacattcatctgttacgatcttttatataactccgataactagagccaaccgcaaggcgcaagcaactaatcaccggcgacgttga

SEQ ID NO: 28504 - DNA, 154 bp, Oryza sativa
aggctaatatatttttatttacattccccttttctaccctctaagtaaataactgaaaatagacgtcttagcttcttttcgattctcagaaatttcgctaatttgagcaagttcagcagatcgccatgcataaccccgcagatcagagatctca

SEQ ID NO: 28505 - DNA, 1501 bp, Oryza sativa
cagatcacataccgcagtggggactatcactttttttattcaggttttgtttcgttggtagctgttccttgagatgcgtccttttcttccagacaaactcccagttggggcattgatctagttgcggacttgcggtgccctggcattgtaaacttgcgtggatgttagttcgtttgattgtgacagctctctgtttcttcggtcatctactgatttgatcggaacgatcgtatttgtagttgcgcttgtgctgttgaggacagccgcggggagatgattttaatctcggatggacgttcacccgcttcttatatatcatttaaatagttatgaaaaaaaaattaaaaaataataatatagattaatgcaaaatataccactgcacaaacatataagtttaaattcgacttaaaaaataaaaaattaaattgtaactagtttacatatatttgcagataaatttattatttttgttacaacttatagaagatgattttgaacttgcatgtttatagaatgatatatttcatattaatctatcttattattttttaaagatttttcatgactatttaggttgacatgcaagaaacgagtggatgtccgtccgagtgtttaaaaaagttttcccggccgcagagttagtggcacacccccttggaacacagacttcactatgacgtcttgatccgttgcatgggaaaatagggcttcgaacttttggtacaacgtcgggttgatggcccaggtgtcattccagaacagaatagcagttctatatatggaactcaattgttctatctgtaatggattactagtttttttctgttgacagaaaatagggagaaaaactttagaattttttactgtcagatttgcctcaagattcgtgctgtccttacagaacggagtagtagttctatttgtggaactcagtaggtctatctacatgtaacagatttactagttttctgtcgacggaaaatagggagaaaaactttcaaatttttcaccgtcggatttgcctcaagattcatgctggcgtgtgtagggaaaaaaatctgcgcacctggaagggtaacccaggacctcactttgtctcaagattcgtgctggcgtgtgtagggaaaaatccagtgtgagaataaatctgtgcacttggaggggttctaaccgaggacctcactccggcaggctgtgtgtgctagtcactagggccttgtttagaacccaaaaaatttggccaaaaatatcatatcaaatttttaacacatgcatgggacattaaatatgaaaaaaaaaaccagttgcacagtttgcatgtaaattgcgagacgaatcttttaaggctaattacgccatgatttgacaatgtgatgctagagtaaacatttgctaatgatggattaattaggcttaataaattcgtctcgcggtttacaggcggaatctgtaatttgttttgttattagtctatgtttaatacttcaaatatatgtat

SEQ ID NO: 28506 - DNA, 1501 bp, Oryza sativa
caatgcaatcgatctagagcccttcacatatttatgtgagttgaacatctgcaaagttacctccaatttacagctttgttggaatatccactgaatgacaatccttcctttcgctactaaaaggaaataatttagcgttgtcatatgttgaacctaaaatcatgcatgtaattatattctaggaaactcaaatagtcttcaattcagcataaacaagaaaaaaaatctccttaatagagttttaaaacatagcaatctatgagatcgataaaaacatagaagcacacatgtaatttttctaactaaaggcacatcactagacgagtgaggaaatgatggattaaatgttgtcttcatattaggtgtaaatggcaatcatatactacataatgatatgaaactgctaggatggctatcattggttagccatactacatcatatatcttgctcactcttctcgtttccatattcttataaaaaatgtttcaattcttaaacatgtgcaagaaacaaattgtttcaactactatttgactctattgatatttcaaattgatttttcccttcgatgtttagccattgggaccctatgtaacggattgttagtgttgcaattaatattttctgaatgttgtacgtatttcaaatgtttgatatgagttgaaaaattttaacaaatgatgaaacatccttgattttcttttgctttggatcgagcatcttgtagtagtgctctactattattgtgacaactaccattgtttgttttattatattatgtagaaattttttttcctaattgttgagtcaaataatgttttgttaaaaaaaatcaggacttaaatttgttttcaacatttgctgatggagttaaaatggtccaataaaatggattgaagtccaaaaggtgtactttgtcaaatggacccctgagtctggtacgcacaaacaaatttcgcaatatcgatcgacatcaccctttttggcttaagtttgtttatttaaccatataaacacaacatacatacccaatcaatcaccataggcttcaacttcatgtggcccgacaagttttgttccatttgtgacaggacacaggttccattttagccttgtaactttgtcacccactctatcaccatcattcatcaaactttgaatggataaactactggtctgatttgagatttgtacgtagtactaaaatactttatctgttttatattataagattttctagcattgtctacattcatatataggtgcctagattcattaacatctatatgaatgtggacaatattaaaaagttttataacctaaaacggaggtagtatatttcattcatctaaaatcatttatattttgaggtggacgaagcaattctaaatcacccccagctggatcgatcgatctgcctcttaaccgacacgggcagaatcgcatcacgggcgcgctggcaccggcaccggcacggccttgagcggcgtgaccatgttg

SEQ ID NO: 28507 - DNA, 1501 bp, Oryza sativa
gactaaagataccaaccggaactaaagatcgatctttagtcccgggtatttgaactgggactaaaaatagcgatctttagtcccggattcttactctcggttggaaaaccgagactatagagggttaccaaccgggagtaaaaagggtttttgcaccagtggatggtgattagatatgtttgcatgttgatatgtataattcattaatttgtgatatatgcatgtataagttttgacatgtaataataattgatagggcatgatgacgtggtatgtttgtatgttatgctttttaagtttagtgggttgtaggtatatagaatttatagatacgttatggtccgaaatccccgctagggatggtaattttgcccatgggtccgggtatccgcggatacccgacccaatgggcacgggtgtgggtgtgattttttacccgtgggcacgcccgcccgaaacccgtagacatcatgggcaacagccgagtttcatttttttcctgtgggtaatacatgcccgacccgatacatatgtattagctaatttcaacttatctgttaattcttataccctttcttttggtttatttgtgatactaactaatataagttgtgatgtaatttaaattattattgataactgataatttggtaaattgtcgattttatttctctttgttaaattatatatctttcgagttattattcatatgagatccatgggtacccgccgggtatatccgtgcccgtcgggcatgggtacggacacagagttttacccgctaaccctagtgggtagggtttgggcgggcgacggcgggcatgggttcgggcatggttttgctctacccgtgcccgacccgacccgctgccatccctgatccccgctacaaggacctcatctttatggactactgctgatagcctaaaaatgtccatctttgcattcaagttcaatcataactgtggacgttgacatccacatgatggttgatgtgtaccagttgattgattccgcatgagaaaacaagaaaaggattcggtcattccattttgtaggcaaaaaaagaatcatttcgccatgaccaaccattaaaactagaattatttacagcgctagattggtaccggacagacaaaatctctgaatttatttcatcatctaaaaccaattatcttatctggataagacatcacagacgagattaatttttattgttttaacaaagaaaacaaaaagaaattgcagaggagatgagaaaattgagcatgttgccatgttcatgcatcttgatgtgctgatatcttaactaattcgccatgcttaactagcaaggaatgcttagtcaggtagagagatgaccaccgttcatagctttctttttcactccagtgacctgatcactacaccagagcttcagaattagaccaccggacacataaacacgtgaactgtcagttccattcgccatcgacaaaacgcattttccacaatccaatca

SEQ ID NO: 28508 - DNA, 1501 bp, Oryza sativa
gccgacagaggaacgtcggaagtgcacaagatacagacgcggttcatcgacgaccagacggcgttgtagggaggacgcacacccggctaccgcatgtgcctgaagcacatcaccgagagccgcgaatgcttgcgaaggtggcggcagctgaagaagaaactgctcaaagctagcgccgccgagtccgagaccgccgtcgtgtcgaccaagacggtggcaggaggaggaggccggaaagatcaggtggcctccacggcgatggcttctgcatcggctagtagtagtaggccaatcctgaacggtgcgacgaagaagaagaggatggccgtgccaacctccggtgaggatgcaaccggaggatcgtcatcgggcggtgagagcagtactaactcatcgtcgccggcaccggcaccggcgctggcgccgtaggagtatagtttgttcgtctcgtcgagctacttgccaactgaagcaggtagctagtgagtacgtggtgactagcgacggcagctgaggacattggccagcagtgcttggacgtttatcttatgggttttgaactttcgattccatcgatgattactatgttttgattttctttcctgtaaactttcggtttttattctatagaaaatattttatttgatttttcggaatggattagagcatcactaacagattatctataattttctcctaaaaaattgtttttgagtttcctaaactgaaaataggaagtgaaaaaactcctccctccaacagatagcctaaattcaatccccaaaacttaaaagtgggcccttctgttaaactaccaagagaaaattccgttttttttctttcacatgcagaaagatcgctatctcccacgcgcgggaacgaaggagagaggcgggattgcgtgattgggagcgactttcacgcccgcatataaacggagcgaggaaccgggggaacggaactccaaaactcgggtaggagagtaggggatctgttggagctgatttttggactaaaatccttcaaaattagttttgggaatcatatagttagactgttggtgatgctcttactacatagtattatctattttgcagtcaaattaatatatatttttacttccaaacaacgctgacaataaaaccatatttgatttgctatcaaaaggttgtcatgtcaaacattaaactttacgttgttggtcactttactccttatgaccacatgtcgtccatatttttttataaaccttatcatacttgtggtggccacacattatgcagttaattaatagaagtttatggacaacaatttactgacaggagtagtgtccttataaaaaatcgctcacagatgtatcgtgaaataatgtcaaatgccagaacaattttagtgcatacacacaaaattaattatgaagacaacaaggaggatatggagggtaacgagaaggaaatagtgatgacaactgaacatgcttaatttaaaatgaaaaagatat

SEQ ID NO: 28509 - DNA, 592 bp, Oryza sativa
cttagaaaaagaacagatataaatatagatctgaaattgtgtagaagacacatttatcttgtttaaatgaatttgaagttcatgtagattagcccacactcaaattaattatttgatctttacgttagttcatatgttaaatttggtttttatatatacatctctctcatgtggaaattgaatcttaaatgcaggtacctgtaaacgcggggaaggaggctgagggcaagaatgtaatcaagcaggctgacaatgccttggtagagaagaggtaaggatgcctcttttttaaacttttgaaggcatgaataactatatttttagattagatgaaggaaatatataggaaataaagacacgattagtagatattatattaattggttcatggttaactttgtgtaacgtaaaaaaagatgcacagctagacaagtgtggcagacacacttcacgcatttaaccaaacatattttgattatgtttttttgtggataatacatatatatttggttatgtgagtatatctatctgtcctgttttctatgatcttgcattatacatgtatgttttgttttaatttttttgcactagc

SEQ ID NO: 28510 - DNA, 832 bp, Oryza sativa
ctagtaatttgttttctcatccttctccaattcatggcgttagtaaatgaagtttatcttccaaaaaaaatattgatcaatggttaattgggccagcttgttaacatgaaatcaagaataaaatgatatgattggccagccttaatacttaccaagaataaattgttatgatttgtgaaatgatccatttcctatgacatttctcaagaatactaatctacaatatggctgccattccatgaaagattggaagtgaggaagcacctagaaagagaaaaaccaaatcatgggacaaactcttagttccaaaaatgcatggttgtaccttcctgatatattttttttgcaggactcttaataggatttgaacaattgaaaagccatgcgtgtacaacaggaaatgtaaattcagtatgaaccccacaatagatacaaaggaagaatctgtactacagaaacacctctgaactttttgaagatacaaacgaaaatatgaattcagtacgaactcagtaatagatcataggttagctcttgcaaagtacaagtacaaagaaaaatcaaaggaacaaagatccctcttggaattcagaagatctactcctatattcagaatgaccaataataattcaaaaggtagatgtcagaatcagctttttgtacaatttataataggggtaaatttgcaattgcccctttataatatcagtaggtttcaataataaattatgaaaagaacatttttttttcaaactaaacagtagaccaccatatttttatccaaactgaacagtagaccaccatatttttatccaaactgaacagtagacca

SEQ ID NO: 28511 - DNA, 471 bp, Oryza sativa
cctcctcgttgacgtccatggctgctgctccggagacgggacgcgcgaccggaggggagggagagagagaggagcgggaagccgggaatgggcgggggattgtggcggcgggttcggatttgggggtagaatttggggaggaacagggcacgtcttggcgggaagaggcgcgcggtgtggcgggaagaggtgccctttcccgcgctcgggactctggactatggaccacgtgacgtgaccgcgatccgtgtagtaaaggagtattgaattgtactgggcctccaattgaattcctaatttaaggcccaattcaggaattcaaacagggcctaaaaggactccacattttcatgcatgggctttctgggtctcacggcccacattaaagctacggcccaaatccagtaaatttaacagagcattcatcgccgcggttgaaatttctctcgaaaccgcaagaacagtagatgt

SEQ ID NO: 28512 - DNA, 1501 bp, Oryza sativa
ttttggatggttctaatcttgcccaaagtcagcaaccatggatagagggggtggagggatttaaatacccgagctcttcaaaaactagtcgttacatacaactttgcacagtcctagagtatccgggtcccatgcccggagtctcctggacgccctaaaacctagccgttaggctcaggttagtataggcccggagtctcctggatttggcccgagtctccaggaagccctttcgggtgcccgaggttcaattttggagcctcctggaagcctcggcatgaacaggcctggagtctcctggccacctaacaacaccagaggaaaaaaccataacttcttacttcggagcccgatttcaacaaacttaggctttatggaaagcttattgaaagggctacccgaccccaccaagaacaaattctaaaaccactcataggataggctaaaacttgggtctctctcaagtagcacttgcataggttactttaagcaccgagacataaacaaacacatcaacgttgcattcctcataatagtacgagattcatatacccaattgcaaatagaaaagctataccaataggaataccttcacaccattctctttcttcacttcgagggttgtcaacatcaaagtcgtttcaccattgggacattctcatacaactcaacaagcacattagtcccagatcaattatacctttgccttgatcaatgcccttcttgattatcaacgaatcaaatattcttgatctttggctttgcatcttccatttctcaaatgattgatacagataatccatagtttcaaatggcctcgcacgatccgtcacgacaatgtcttcactcgcccttctccaccggatttggttcatcggtgccaagtcccttgcttgcccttcaccaatgcatggtccatcgtagccgagcttcccttgcgcttcaccgtcttgccatagttagccacttcatacctagatcttcaatctcttctctttggttctcatcaaccgataaactccatcttctagcttctcacaccattttcattttcatctcaatcttcaatcatggtatttatcttcttcaacatgtccatcaactcatgatgggatctcaccaagcattctcatcatcggcatttgactcttgttgattcccgatatgtgaggtatcatctttcttgtcatcaatccacaatccgatcacttgatcctcgcatatgagtcgtcaacctttttgcttgatgccggaacataactatcatcacaaactcatacaaaggttagttccaacaaccattgtcattaatcaccaaaacaccaacacaatgttaggagcacggggttggcgagagcttgggcggatcgggtgaggagaaaggagaagagaggaaggagataatgaggatgacatgtgggccttcaaggatgattttgtaatttggtgacaaggtgagggacctcttttgtactttttccttttacttacgagctgtcga

SEQ ID NO: 28513 - DNA, 1501 bp, Oryza sativa
ttatgcattcaccaacagtgtgattgtgcagtgttcctggcccttttttttctctctctctggatcgagaggtcgtccagacacagtgacacagtgtgtcatgtggctgtgtgtgactgctaaatgggcctaaacacggagacgtggagttgggccttgaagaacaaggcctctctatgtgggcctattcgattggattgttagatgggcctagtggagcccatcggcatcccatcccacacatgatgtggcgagatgcagaaatacccaaaagtggaggggccaatccggaaaaacgcctctgcccctgcctctgcctgttcgtccccacatcgccgcggcgacccgctcgacgccgacgagcggcgactggcacgaggagggagccgatcagccgaatttggagcagaagccctcatcctcgccgagggcgagcaggccagccgccgtgtaatgcagggtgagaagagggcatatcctccccgaccgtgatgcagagaatcatcgccctccgcttgccgcgcggccggatcgagtcgaatggagtccggtgctcggagcctcggatctgcctcgatcagcagctgagtcggtgagtctaattcgattgtgatctgtcatgctagtctccgttgagggcatctgttgttggattgttgccggcttcactcgatttgattcgagttcttgttgattgggaacttctctttagtttttctgttgcgagattaacggtttttctccttgggttgtgtcccataaaatctcacggccaagtgccaccagaacagaaaacaaactcaaaggaaggtatactcaatatgaaaaaaaaaatgatgcataagcattaaatttcatgccgtatgtgtcgacaaaagaacagtttatttcagtgtttctatcgagcattgcttttcgctgctacttggaaggagccaaaaaacaatatatgcatcccgatgcgattcaattgctcgcatcaaatatttggacatccatttttgtcacaaacacagatatattctcttcagttcttttttccgtcctatgtcagaggagtttctagccatcatagattgcagttgtagctgtctcgttcggtgaagcttcagttctgatatttgatcgcagctacaccccatgtactgaatctatgggaacctcttcccttcctattggatcgttagtgattttaaatcaaatgtattgcatttttccgcggatgcgagaaaattggattcttctggaattagatgccatcgatccacaattgtaacgtctaaaaaaatgtcttcttgatgttcccagttcgtataatacctgtgatgcagccatttgcgttatagatgttggactaatcttccattcttggcctgttcattttgcaggtagcatcttggtgaagactgaaagtgattcacctggaaatgcagagatatgtgccagtcagtaacactctatagatagtagacccatttttaatttcagcgcggtgctgata

SEQ ID NO: 28514 - DNA, 1501 bp, Oryza sativa
atagaagaaagctgctgctggcatccaacaaggtctaccggtatgacatcgaaacatgtaaactggagaaaatagcttcaacatttgaagacttcacgtgctgaaaatagcttcaacacccgaggaatggtgtgtaccaaacatttttgaagaaggcagtgatggatcttcacctgtttaattatgctgatagtctagttgcggttagtaaattttgagaagctacttctttgtgtaacaattagtttgcatctataaatctagttaattatactgaataggatctacgctactatttaagaattaagcgtaacggttaatttggcattccagtcataaatctcaggtttgcagaaatggaggctcattctgcaatctgcagcagcaccagcagcagctctcgtcacagcccttcttgctgttgctacacttatgagctgcaactttaaaggtgcagacagttagatatactgtgttgtcttgatacatagtaagtgatttttttctctgaagatgtactctaatttgcaatgttgttctgattacgaagatgacattctgtacacacaaaaggctggcatggaagaagttcaatgatgtgatgcgcagagctgggattcgatccttatcaactcttagttcttttcattaattaaactgcatttatgtgtgctccttttccttccttggatcagaaatatttgaccgttagggcaaggtttaatcaaacatttaaaactttgaccattaattttatattagaaataaatttataaaagctaataagcttatgatattataatagtaatttcaagacatataccatttttcttgtttttaaactaaagcatttgagaaactgttggtgataaaaaaaagtttgaccaaatcttagtagtgtcacaaaaaattgaccggagggaatacttgcactgacactatcctaatttgcctgcagaaatgtttgctacaaacaatctggccggcgctgtcggatcaactgtattcagagttatctgaatttataattgcggcttcgatatattaacttttgttttctttctttggtacatgcacagatgtgatggtttgtggttaactgcaagtattatttgcgaaattggcacttctgactgaaaacttaagccgtccttgcagactcagcagatggagaagttataagagcagaccttgcattgcctacctggagcaatgatgctcaagtaggaggtggtcgtcgtgattcctagtgcattttgaagctttcatggcttgtatataaaattggggcgcttactgcaacaaaaaggagaacccttttcatttcagggtaagtatatatggttcagaagaaggcaagttcaaccatagaaaactgtcatgctacatcaatctctctttgtcaacttgctcaaaataaatgtacaacctacaacttgtgcaaatatacaattcatcaatgtttgatgatcgaaccttccaaacaagtaacgtgcgattc

SEQ ID NO: 28515 - DNA, 556 bp, Oryza sativa
tatactctacttctaatattccttatttttacttctgaatttcagttattttctaattgtatttctatatggactctatactctacttctaatatttcttatttttaattccgaatttcagttatttcctaattgtatttctatatggactctatatctacttataatattccttatttctaattctgaatttcagttatttcctaattgtatttctatatggactctatactctacttctaatatttcttatttttaattccgaatttcagttatttactaattgtatttctatagggactctagtctcctcttctaatattccttatttttttaattccgaattcaagttattttctaatggtatttctatatggactctagtctcttcttctaatattccttatttttttaatttcgaatttaagctatttctaaattgtatttctatatggactctgtattttctttttctccgattaatatgagaatttttaggccacgagagcgaacgtgaagtctccttttttttttattcctttaattatataataga

SEQ ID NO: 28516 - DNA, 452 bp, Oryza sativa
tactacgtaagtagttagtagtagtaaaaacagactatctgaatttatacactaactccatcctatttcttaacttatataacttaatttgatgattctatcccagcacagtaagctactatagtatgaaccttcagactgcactgatgtttttctgctagagtggtgtattgcatacagtagatttttattgaaaaaaaaacttggcctgtaaaatttcttatagctaaatctgagagatcatgtagttttttgtgaagaatatgacgtacgtaacataaaacttttaaacaaagacatgtttaatacataagtgaaaattgaaatagactaattataacccaaacaggagtttttctctgcgaatgttcggttgaacatcatttcagctagaatatgttttcaacataaactttatgtactgatgaatgctatcatatatgctgcaaact

SEQ ID NO: 28517 - DNA, 213 bp, Oryza sativa
ttcgtaggatcatataataataaatagaaggatcgagagacgatgaaaattaagataatagatagaatcggcatcgtttcggcttgatagaatcgtagtatcatataatagaatagtatagaatagtaggatacgggtcaggatactgtttctttgatgcgagaaaggagcacggcaaccgctaacaaacgtgtgacactatcgtttgtcagc

SEQ ID NO: 28518 - DNA, 1501 bp, Oryza sativa
gtgtacttacatcaaattgggctgcctcatcctcccttgacaacataaataaattttattacatgatacttaaaatttaaagtttgtgtagtttgttgatggatatttaaaaacatgctacagctaaacgatactacaaaaactgataggagtaatttgctagaagacgctgcaacaattattttattatttcgcatgcaattagagagagatttttttcaaaaagacgagaatacccatcatgccacaagcttctaacctagcgctggattgaataaggaatatgatatatggtagcaatttacttgaggtgatgacagattgagaaagcactactacgaaaaggatttttgcgtgcggagaaaaaaggttttcgtgtgcgggtgggcgaaccacacgcacccaggtgtctggaaaaatcgctatttttgtgtgcgggtgcctatgtcgcccgcacgcaaaaataaaaagccaaaaaataaaataaaataaatcaaccctaaccctataaaccgttgtagccgtcgtcctcgtcagatctgccgccgtgacgcctcctccccaccgccggcccactactagaaaaataatttatcaccacgaaaaaaatgtaacatcaatgctaaaatttttgcaatagatacatgttgccataatcttaaaatcgttgctagtcgtggtaataaatagcgtgataataggttattgcaacgatttttatttagttgtaataaattttgttatagctataaaacggatgtgtcaaaaaaatatatattgcaacacttcacatcattgcaataaataactattgccaccactccatatgtggcattagttctacgcaccaaactaaatgtttcaatattaatttatcgtcctaattattttcttttgatatcttgtcatggctaggattcgaacccaagatctctccctcatgtgcgctctccatgatcaactcacctatgcatcaattttgtttaaaaatacatataattccatttgagactgcttaactgagatttgaatcaagaatttgagcatttaaaagatttcaaatgaaaaatttaagttgcagatctcatcgagagctgtaaattttatataaaatttgtcctaatccgtgtccatatgaaaagaataagttaaattatgagatgataaattttttattgtaacggatttgttgatcatggcaatagaaaatagtgaaaagtaccatgtactatgcaaattgccaaaaaaataaatttgtggcgatagaacatgtttttttttgcaatagtaatgtttttgtggcgatagctcattttctattgcaacaaaaaaactgaataaaacaatgattgtaaatcgttgtaacaaagtataattatttgccacataaaaattatcattgcgatagtacaacatattgccatgaagttatttttcgttgtaacaaattggtggcgatagctcaattatcttgtagccgtcgtcagatctgggcggggga

SEQ ID NO: 28519 - DNA, 1501 bp, Oryza sativa
accggaatcgcgacatcaaacgtcgacgtcgacagatacgatcccgagtagaccttttagggactgaatctgaataggactttgtttatcttttcttatctaagactttttctatacataagaggatttattctgtataggacttgatattatggtgggccccaccaagtttagtacacatgtattgggtatcccatatatagaacactgacacatgatttatatatactccctccatcaacaaatataagggaatatgtatttcttttagagatcaaagacaaaaataaaagattatgatgcacctcactggatgaagagtggttggggatggaagggtgttggcgctaagatgtgatgaaaattgaatgagtgatgatcgatggtacaagtagaactccaaagtcccttagagcatcttcagcaattctccaatatcctccccatcccaaaatactgccactgctgagaatttgtgtgctctaccagtcccccaataacccccccacaaatttccaataattattggcaataaccagtaatccaccctagttctcctaaaatagaggggtgaaggatatccctaaataatccacccccaatcccaattaccatgcgaggtgtccgattccatgctcatcccgagctctaccaccttgccactgcccctcacaccaacactcgaaggagctccgctacgctaccccgccatcaccgccacgatggagccgtcgtgtgcccacaacatttccccaacatcgtcatggttgcaaggcctgctctagcattggagagtcgactctgccgcgtttccaccgcagagctccgtttgctttgagtacgtgcatgcatgtgttttcctcccgcctggagtagctctgccgccaccatcctagcttcgccgattggaggagctttgtcggtcggcccaccaccaccacctcaccaccatcgtcccaatgtctactagatctggccgtgaaggagagatagaaaagagtgatagatcatatggtattgggtcactaacaaatgaggccatatgtctggtggtatattggggatggggtattgtggaagtgcaaaagcaacttccgccaataatcctgaagtaatattaaggaggctctggggatggactattaggagactactgaatatgttcttacattagttaataaatggtgagatgtaaatctcttatatttatggatgaagcgagtcaaatactagcgagtaagagtgagcgagagggagggggcaacacatttcggaagtatgagtggctgggcatgatcaagttgaaccatagagaactgccatcctgcatctgcatcaatctctctcagactttctcaagttactcaaaacaaatgactacttgcaacttttgcaaatatacaattcagtgtttgacgatcgaaccttgcagaacaagtagcaacaggctacataacaagaccgaaattcgttctcagatctttgtgtgcactaatggagt

SEQ ID NO: 28520 - DNA, 182 bp, Oryza sativa
ttgtgcttaaagtacattgataataaagtaagtcaaaaaaaaaataattccaaaaatttttgaataagacgagtggtcaaacagtacaagcaaaaactcaaaatcccttatattatgggacagagggagtaggtagtaagcattaaatcttctcctgttaacaacaagtattgtgagagtga

SEQ ID NO: 28521 - DNA, 167 bp, Oryza sativa
tgggccccacgtgtttagtgaatagtaatccccttcttaatctttattagttgagtctattacatgtgggtccgggtggttaaaaatcaaattatagaagttttatggtctcgagttcatgacatgtgggccccacttgttattagctcttcctatttccctttaga

SEQ ID NO: 28522 - DNA, 378 bp, Oryza sativa
gcttgcttgccatgctaagtccgccctttatattaagatcttattgcatcaaaaatatattgggccttctgtttgatatattctgtctgttttgatatcttaatatagagtggtatcggagtagatttagctttatattactttattcttcattgccgatctaatgccaataacatcggcttaatgattgacgatatgtcatcggcttctagccgatcggctattgtttatggatttaacctcggtttccttgtctttctttcttgttgattgcaggatcaaatcaactggcatgcctttgaacccaagagcaagatttaggacctgcactggagttaagcagatctcccaggccagtgtgtgttttttcgcatcaac

SEQ ID NO: 28523 - DNA, 1501 bp, Oryza sativa
atccagctagctgctctgtctgtcttaccttgctgttgaccggtgttgaccgcggtatgcaactacagttttggagggcgtccgtatactcggtatttggaaggtgtgattagccaattatttcctatatcttatctactggtataaaagtacggatccaccatttgaagtgaaactcgatggctagatttctctagtttgttatattacacatggcggcttagaagcgtttgcaggagtgctagtcagcttagaagtgtgatagaatatttaatggacttttagtatataataatagaagatttccacgtgagagaagtttatatgaaatccaaatttaacataaaatgaataagaaaataaagttctccattcgtttcatattataagttattttggatttgttgtaagtcaaatatctcttcaagtttgatcaagtaatatagcaatatctacaacaccagattagtctcattaaatccatcattgattacatttttatagtaaatttattttgtgttgaaattattgccatatattattttattaacttggtcaaatattaagagctttgatttaaaacaaacccaaagtgacttaccatatgaaacggaggaagtaattaatttgagtgtaggctaatctacatgaacttcaaattaatttcaacaagatgaatgaaaaaaaaatcagatctatatttgattttcagcggtaatacagatctatatcatcaactaatagttagtcaactactttatcttaggattcataaatatttacaaaagaggtaaaccaaaagcaaagcataacaaaattaaaaaaaaagaagaagaagaatctaggagatctttttcacaaacaagagaagaaaaaaaaaggattaaccaatgaacttgcagcagtgcagttagccttgggactcactggatctgggctgggctccttgttcagatcaaagtccctcaccttcctctttccctgcgttgtgatgtctctcccggttagcaaaagcaaacacaatagcatatagagaggagtagatgtatgattcatccaaaaaggcttatcaggagcgtgaggatcttggattacctggttcgaggactccatcttcatcctctcccggtgtgaaatggtaactaccaagagacgacctgaggaaatgagacaagaaggagattgatatgggagtacaatgtgggggtttagggggggtttatatggggaaatttacatggaggtggtgatgaggcgctgaacaacgtttagttccagctgtttggtgatgagaacgatcgagtgaacggcataaacaggaaggtttccaatgtttcctttgtagccttttctgcctctcgttgcaaatctcaacaaattagaatcaattttgtttctcaatttattagaaatatattgaagtatcccacacaaatattaaaataaaggaatgttaccgaataaaagaaatattcaaggttttgtttaacttggcagcttt

SEQ ID NO: 28524 - DNA, 767 bp, Oryza sativa
ttcaatgagtacgagtgtggctagggcacgatcggttggtgtgtactacgtaaaactccctctatttctaaatatttgacaccgttgactttttagcaaatgtttgactgttcgtcttattcaaaaggcaaaatttgctacaggacatccaaaaaacgtataattagctgggagacactgcaagaacgcgaatatgctatagggcatcacaaaatattggtaattagctgctggacacccacgggattattttattatatccggagaaattggagagagaaaaactgtgtaagtacggttctacccttcgaatttttttctttttgtttttctctatccttccctgctccttcttccttgttcttttctctctcattctctctctctctgctcttttctccaagcaagcccgagggagagggagagcatcagctacggtgcggcgaggcgcgggcctggtgcggcactgcgctgtcgcgcgcaggcctaccacgacatgcacatacacgctgcctccatgcccagctcaagcataagtagcagcaggccagcggcagcagtagcacggtgggtcagtgggtgtcgctttcagctcctccatgttctcacttgacatggccacacccacctcttccctaccacgcccgcaccacgcggtcgacctcgcttaggcgcccatcctcgtcgccgcgacgcccgcgggacttaccctcatccaccaagtaggcgccagggacatggtatgaaggagaatgcgtcggctcatc

SEQ ID NO: 28525 - DNA, 573 bp, Oryza sativa
cattttagtggtccagacaacacacacgagacgaggagtcgacgggggccaaaggtaaggtcttgtcgtcatttctgtggccaagtgtttttccagttgttcgatttgcctaagattcctgcacgagattaattatgcatgcccctgcatcagttcatcacatgtccactggtccatttcttaatcaccagtaaaataattcaccgagccatatgcatgcgatcttgttttttaatttgtttttgtggcatatggtcgtgtttgcacaagccgcgtgttctacgcttaatcacaaccgtagaaacgacctatgatgaagtactcttctaggttttctctcgtttggtgtcatgtgctaatgcatgctagtcaaagtggctcgttcgatcgtggatttaatcttgtttcctctcggtcgtggggcccctgactgtttggtctctccgacaggcagatctggtgccgagacagtgatagattttggaccatgttttgacgcagcacttgccgatgtcaagaaccccctttaaggggcttttacctactgatcgatacgtgtgctttctgttcagg

SEQ ID NO: 28526 - DNA, 1501 bp, Oryza sativa
gtgtttagttcgtactgaagtttgaaaatttggttgaaattagaacgatgtgattaaaaagttgtgtgtatgaaatgcttgctgtgatgaaaaagttaaaagtttgaaaaataaaactttggaactaaacagggccttagcatataatctattttatttaaaaaaatactcctaatggcagcacatagcgcttgtctcattctgaaacaagaaacgctggacataatcaaactagttgtctgaactccaaaaatactcctaccaaacactagtctccactacattaccactagtactcactcccaaacaaagacacaatcccaaggtcacaaaaaaaacccgagaaaaatccacgcaaaaatcctggaggattcaacaacagcagcagcagccattcttttatctttttaaaatataaaatatgtttatagctgacctatagcttgctatcgtaactgctcttatcccatccatgagcggctgctgcgtggccagctttctgctaaagattgcgggtgctatttttaaaaggggaaagattacgtaaccccagtgatgattacggtaattattgtcgcctgcctgctactagtactccactgtactaccaatccatccatccaaacccttttttttcacgtagccccccggcgaatccgcgaattgcagctcgccgtgtcgccggccgaccggggctttttcctttcctccgggtcacgtgcggcctcgtcaaccggtcaaaccccgccattatcacgcagccacatacgcgccggagggaagcgagcgagagaggtgtgaagtgtgaggtggtcaggtcgtcttcttccttcgctgctgctataaaacctcgcggcggcttgcgcgattacgaggttttccattgctgtgtgtgagtgaggtgagtgagtgagtgacggattgttgggagagatggagctggggttgagcttgggggaggctatggcggatgctgggagggagctggttcttgggcttgggatggggaggagggaggaggcggcggaggcggggaggagggatcatgaggtgaggagggagctggagttcgggtcgatgtcgagcaggtgcggtggttcttcgccggagccgacggtgcggctcacgcttctgcccatggtgcccggccttggcctcccatggccgccgccgccgccgccgtcgtccgagagcagtgagtgcggcgatggtggatgggtttttttggtggtggtgttgagatgggttggttgatgcgatctgtgtggttgggtggcagggcatttggaggcgtcgacgcggggattcgacgtgaaccgcccgccgtcgtccggcggcggcggcggcggcggcggcgcggaggaggagcaggacgacgtggccggggcggcactctcgtcgtcccccaacaacagcgccggatccttcccgatggatgacttctccgggcacggcctcggcggcaacgacgcggcccctggcggtggcggcggcgaccgct

SEQ ID NO: 28527 - DNA, 407 bp, Oryza sativa
ccagagcgatcgatcgcccatcagcatttccacgtaaaacctatattactagtcgttctcaaattttatggccactattacagatgtcggttcacttaaaaccgatacatatgagatcctcgaacgtaaaactgacacctataatacctcattagtaccagttttataataaaaccaacactaataaaataagtactaatttattaaaaaactggcacttatacatgagtcatctgcactggttctctaaaaatcgacgcttataagtgagtcatatgtatcagttttcttaagaaaaaggtgcctatatataagctgagctagctgggtgagcgtaggaggtctccgacgaaaatatctatataccaacctctatttttctattcaatcggttcctctccacttct

SEQ ID NO: 28528 - DNA, 1501 bp, Oryza sativa
aagtttctttttagtcattccagtgatcaaattaattataaattttgaattgcttagactgttgtaaccgcagcggcgtcctggttaaactggggccgtgtttagttcaccccacctaccccaaacttccaactttccatcacatcatatcacatccaaaacttttctacacacataaacttttaacttttttttccaaacttttaacttttttcagaaactaaacatagcatgggtcaaatttttccatgtgaatatgagatgttcggttgaggcgtgatgagaaaacaacaccatgtagtcatgtacgcatctaacattacatcgtttatcttgacaccttgtagctgcctaatctatgtttactaagtaggaatttgtggaatttgatcacatacagtgccttcagcagagcatgggagacaggtggtaatcggcgcccttgagagcaaggcacacgtcgagatcgatgagattagcgcaaccgttagtgttcaccgaagcttaattgcaacaaagacctcctaatcaaaagctaaaggtttccaagtaaatgcagagatcaggagagccttttatcatccctcgtagaattgaacaaaatctacgcactgttcgaccgataccgattcatcatcatttctgaaccacgcacatcaatgacttgtggataaccccagaaaaataaacgaagtaattaaggggctcttcatattaatatcattttcaaccataccgttattttataaaattattaaaaaaataactacgtttagtttgttgctaaattttggtaaatacataagaaatcctactaaaattttagtaatattgccaacttgccaaaattttggtatgtttattttggctacaatctaaacggcccctaaatactctctccatcccaaaataattatcatatatgtttatacaccaagaccaagaataatttaaatcgcataaatcaagatactatgtatacattctcctacaatgcatgcatcgattaaaataccatgctaattacaccctagcatgtacatatttttccatgctaaattaattgtatttcgatgaaatttgtgtccatgcggttatatgatgatcaatttgagaatttttggattctattatatgatgattaatttggaaatgagtgagtatattttatggttaaaacttaaacatagtcccttgtctttaaaagagcatagtttttttatctagttaaagacatatattaagcggcatattaaaagactaacttgccctttattaataggggcaattgcaatttacaactgcttttaatcattatttcaaaactgccactaaaaaattacaaaaataccactggaactgtcattcgagtggcatccttgcaaaattgaaaaaacaagtggcaaatttgcaaatgcctcttattaatatggtgaaaagaaaaactatgagtgagtattattaagttcaatggctaaaaacgagaagaaaaaaaaataag

SEQ ID NO: 28529 - DNA, 980 bp, Oryza sativa
agttgtggcaaggtgaggcaaattgtggtagtgaaccaaacaacccctactctccggtcaagtaatgccgtcttcaacattttatgactatggactgttgactattgtgatcatcagccacaaaaactgaatcttttttttttcagaaattctgaaccattagcaactgtacagactgaatgtgtcttgcggcgggcggatgttgattaattgttgagtatagtaatccaggtatgttcctcaccgtcttacaatattaatatcatgatcacttaactctgtaatggtgacaaggacgtccagaattaaaaacaatacaatactgcttgattagccaaaaccattaaaaatgagagatttagggatgacgtaggtgatctattagattaaagaagctgataagatgccaatgcattcacactcttatcaatacccataaacgatcatggatgtcattagtaaacactgtaaaacatgatggcatgggtctaaattactacggattataacagagcctgatcgcatatgattactaaaacaaatagcatacgaagatatgtcatcttacattcaccggccggtcggttgcatcagcatcaggaagtccaaatgctagtcattctgtttcagcctaccaaccatgtacttctattaatttaagatacaagtgtttgattgactgacttgaacactgataaattaatggatgctagctgcgtgaatcaggcattctgcccaagctaagctaagtcctgtgacagacatgcgtattgcactattgcgcgttcgccattcatgagagcatatctgcctctgacctatcaggtaagttactggtatagtaagcatcttgttcatcaacatcttgtttagctttaggtgtccatgcagttgataattcatcaaactgatcaaataacttgtactgttgtcagtgtgctgtgtgctccatatttgggtagtttgttgcaatcggttta

SEQ ID NO: 28530 - DNA, 170 bp, Oryza sativa
aaagtttcaatctttttaaaagttgaaatacaatcaacacctcatgaaatattttgctaccacgtataaaacaacggttctgaatatattgaaacatgaatgatgtagctatcaaaaatcattcgatagccatttagccttcccgttacaaatttgcctattcacataaa

SEQ ID NO: 28531 - DNA, 1501 bp, Oryza sativa
gcatgtgtcacttgtacaagagacctatagaagtgtaaaattgtatgatcaacaaatcaggcagaactagttcgacatgtttactatggaaaaggaaatgtatctgcacatttcattcaaatgttccagaataaatgcattagccactcatgccaaataccctatgagcatatgatctgaattctttgcaacttactgctatactcacagaagattttggttgtggtgtgcttggatgttcaaggtgggctccaactccggcgtcgacggtgatgatgacatgatccaaggcagcagcctcaacagaggtagaatcaacgacgactacaggctcaccgtccactgcatgcaggcacgctagcaatcagattaatttctatcaaagttaagatgaaagtcttatagtagaaactaacgatggcatgaagggctgccgctgccaacgccgaaatgcgactccatggcgtcgcgcgcgccggactccatcacggtggcgggcgggcaacggctgatggcgaggtcggcgactcgcgggcgggcggcggcggcaaatcgcgggtgaggtcggcggtgactcacgaaacgacggcgtgcggcgcactcggcgggccagcgacggcgtcgagccggctgggcgccactgcgttcgcggccaggcgagggagcggcgactagggcggcggcggcggcgttgccagacgaaacgaccagacgaagcgatggtcgttaattgtaaaattgggtggggtgatttgcaaaaaaaacatgattagtctggctaatggcgggtggtaaagtgtaaaattagcccacctctgtccctagccatcggatgagcatcctgtggtcttaattgagagtttccaagtttgcacaggaacctagttttcaccttatacgttgccttctaggtgatcctcggaaaaagataactaactcgtcactgccggtgttaaactgttaaatgtgttactgtattttcataactctactccaagattcaggtagtagtagtacaatcattatccattcatatgggcagtatcatattctagaggttaattacaagtgcacccatcaaccatgtaagtacacgtaactaattaagtgggattaacttttgattggccattcacgtcgaagttcttcgtgattaagtcacaaaaacgcgggagagaaaaaaaaaagggcgcgaaccagtcacccgtatcgtcagcagcagcagcacaacgcgcaagagaaaaagcaaagcaaaagccaacggggagaggattctaactcaagtggacgtccaccaatttattttatgtcaactagatggttacgaaaaattttcaaaaaatttgataagatagattaatatataatatattactccacaaatatacaaattcaaattcaacttctacagcaacttctatagattactgtagaagttaaattttacgattgatatatattacatattgatctatcttatttatatatttttaatatcttt

SEQ ID NO: 28532 - DNA, 1501 bp, Oryza sativa
ggagcaaaaaaattgatgaatgggaaagggattgtgttatcttgggattccaaatagtaacttatattgcgggacaaattatagaaacaaaatttcttaggccatccacagtcggtgtccctgggtcgtccccccgctcatgccgtccgccgtccgtccgcgcggcgtgtctctagagggaggtgcgaccctcacgcggggaacgcgcccctctagctccccagctcactttttccagagacactccctcgaggctacgcgttgtggcgacccggtgccccatctcctaccttctctcctggcgtttccctttcttgcccctcaccggcggcatggcaacgagagagagagaagagagaggcgacgacgacgaggatccgcgacggtgacgaccagatccggccaccgccgcggcagccggcggccaccaaccggcgacgggctcggcttccgcgacggagaggatgacgatgacccggcgacgactgcacccgccacctcgacggccgcgtccgcccaccagatctgcccgcctcggtgccggatccgccgccgccggcgctggaaccacttctgcgacgacggtgggacacggctggtggaggcggagggaagaggaaggcggctgctagagagggcgaggagggaggcgcggcggcggctggggagggcgaggagggaagcggtggcggcgagcggcgggggagagaggagggaggtggcggcggcaggctgggaggcgggggcggcgaatggtcgacgaggagggcgagaagaagaagaaagaagacgtgagaagagagggtggaagaaaagagaaggaaaaaagaagaatgggctgggagggttatttggggatttttcatctggggttactttgggccaagatacccattgtgggctgtagtatcttcatcgggttgcttcagattttgaggagcccatccagagatacctcctattgcgagctgagtttcctacaagtctcctcagttagtgaggacactctagaagtgtcttacattgtggatgcccttatattatacgaacggaggtaggggtactagtagaggagtatgaataggacaatttctcctaatcagcacgctcttcaggacaaaaaggaaaagacgcaaccgtacactgccaagatgccaagcaactccgttgatctgatcaaaatcagattggatcagaatacaaacggcacaaaacaaaattcgaacgaaccaacaccagcttctcgcagatctggatcctctgcatttgcagtctcgcagatactcgcaagcaccctcgtaaaaacctcaccctcccgtactcacacctcatgtgatcccaggtctgcagttctgcacagccgaacacaagatccaaaaccccccgcacgctttccaaagcaaagcactctctcgacatcgccccactccaggtcaacagtctccactctcactggctcgcagtcgcacacactcccacgcctccgcgctcccgaccaccg

SEQ ID NO: 28533 - DNA, 1501 bp, Oryza sativa
atcaagagatagtgttgaaatattattcctcactggaagttggctatgctgatatcccgacaggaagttgagttagctaaacacattgattactttgcttgaacctgcagagacattagacatagttgttcttattcatatgttgtactcttttcatggaattaagaaaccacaagtccttagttcttgatcatgggaataattgatattttgtattactaacaagtagtacatcccccgtttcaaattacttgttttaggtttgtcctaagtcagacattcgtatattttattatcaatttctaaaaattcatatagtttgaacgatgttcaaattggtggtcaaagatagacatgtttgacttaggacaaaactagaatgatgctgtgcatttgaaatactatgatcccaaaatatttttattggagaatgcctgtatgcatcagcactccaacatactatgcacagatcattaaacaagttagcattatccaccctattcatgcttgttttccttatttagagcaccatgtaaagctctcccagagtcatggactcatggtccttcagatatctttatccatctttatgagaacaattctttacaacatgacccttcaagcaagaaaagctcacataaagggaatttaaatatatttctcaattggtcaaggattaaagcatgaagtgcacgactgcatgttgtaaagggtacaagttagcatatttttcttgaaatggtgtggccctaagtctatagatggaaatggtgttgctgacatgctgtagtgttctcatgtgtgactgaggagcatagcgtaataaaaagagacgagatttggtggaataaatattatgaggaataaactttttctttaatgataaattcgcttaaatcattttgattgtgctggaagcctggaatgctatttctttacccggcatacatcttatatgtacatctgatatattatagcaagatatccttgtagaatcatcaattgcatttgccactctttgtaggttaatatcataatgtttgtagttacatgttgcccacaatgcatatgaatagagtgaaatgtatacctctatactactaaaaaagacaatagtggttgtggtggttctgccacatgcccaccaccactacttttgcacgttctacaaattagtccctgatattttctgttattatgcaatagtctaatatttgtttgaatcaaatgaataacatatattcaaataagcatggccattttacccatagcaaacgtggacatattttgctagtactatattactagtaattcagtttatgcacctagagtgagatttaaatgtgcactccacatcatcaggttacttctctttcagtacacaggacagcttgaggggaaaattaagtagatttagaacctttttttatgtgtttttcacattagttagttaattctgccaaccgtctagcagttctatacattttttcccctattattt

SEQ ID NO: 28534 - DNA, 1501 bp, Oryza sativa
tgtagacagtgagcagtgtatatgtgtgtcaggcatgctgctcatgcggggaaacgcatgctgcgagcttctcattttctcagttctcactgactctgaatcaactgctaccctgcagttttatgcacctcaacaccttgcatttctgcattggcatcaaatctcgatctcatcaagttcttaactatgtttacatgaaaatgatatcacacccatgcattgcacggatttaattgctgcaggtgttcttctctgaaaacttatatcaacagccatgcatgcagatcttggagatgaaattcagaaactgtacgtgcatgcatattgtgatttgtgaagcactgcatcgtggtactatgctagtactgtacgtagcaataatgctagtattcactgggttcagggtggtagtaaacgtgagcactgtcactctgacagtcagaacaaggggaggaccggaggacatgaacgtaactgccgacgcatttaagcagggacacggctatagctagcctcattacttcgctcacgcagcagctgtgaattgatcgacgatgccatttacacggcgaaaaactactaccacaagttgcaccacttcaaggcgccagatcgttttctctctgggatttatgttccatgtgtgttcttctgcagactgcagtttactagtgcgctgcatactgacattgcattttcagaaaaatcttcagatatgtaattgcagcagtactactaatcatatgttgtcttgatcgagtacaatgatgaacattggtacgtcaaatgtcgatgcctatgatggtttcagaaggatgcatgctagcttagcgcctccacttgaggtagaatccaaggttcatgtcgttgatgagatcaatttggtgtacagtatgcagacttggagcaatcgatgactctgttcgtgaaactgacgagcacatgcgttgacattgatcgatgctttggtaatctctggaagacagaaagatcaacgcaatgatcatcactagttgtccttgtcgaccccaaatttctgcctagctagataactcaaaccaattaatgttcctaaatcttaattcaacaacatcaccatcaaattgcagcagatattgtgtcctgtaatttcctgcgtgataagaactggaaaaaataagactggatcactctgggaatacgttaattgaagattataactgaccggctgacgagaatgatgctagcttgtagattcatgcctaactagctagacaactagacaagccacatgtttttgtcgtttttaggatgaaatacatactactattatacagtggttttcgaggttaatgcttgtgttaacattgtaaacacgcacacgtcaactgagcatcagagaaggggagtcaactgggctccctgtcgtcctcgcgcgggcaaccgggggtgaaccctagcaccgccgccacacccctcctctctctggcctcgccgccgtcggagcacgtcgccggaaaac

SEQ ID NO: 28535 - DNA, 1501 bp, Oryza sativa
gaacatctcatattcacatggaaaaatttgacccatgctatgtttagtttctgaaaaaagttaaaagtttggaaaaaaaagttaaaagtttatgtgtgtagaaaagttttggatgtgatatgatgtgatggaaagttggaagtttggggtaggtggggtgaactaaacacggccccagtttaaccaggacgccgctgcggttacaacagtctaagcaattcaaaatttataattaatttgatcactggaatgactaaaaagaaacttttcttctttgatttaagtatgctaaacaatgtagaaattatgagtattacacttgtacgttgcagctttgaaacccggcccactggccacaggagagctctcactgctgtcccaataattatgcagcatagtagctagcagcttggccagtgacagtgaatagtgtgtccgctgcggccaggccaaagtgccaaaacaacgtcgtcaagtggcacgcactgatgatcaggaaaccatcaatccttcagaaaaaaaaaggctcactcagtcacgagcagcagcgagcgagagaagggccccttgatcatctccatcttgtccctcgggggaggcagtctaattgggaagttgcatcgtgtctccttgcccctctctgagatgttcccctgctactgctatatagctagctccatcgatcgcaagctgcagcaacggccacttgctgttgcctccctcttggccaccattgctgatccgctgctgctactctgctagttactcactgtgacaggttggattttggacaggtcagggtggctgtttccctgtctgatatctgcctttttgctgtttgtgtttgggaggagagagtctctggataacgagaaattaattaacgtgagtggcttgatgtgatgccctaaagtttctctcattgctgatttatgtgcactagtcgatgtgataattaaagtactagggtatgtttggtttggtatcatgataaaatgtcgatgatgctaaaatctagacaagttttttcgttgtgcaaatttggacaacttgtgtgtgttgttggcacattttgatgacgaaccaaatattagcaaaagtaataactaaaatgtcaacaatttgatagggaatattttggcttagagccaaaatggccttattctgtccatttttaaatggaaattttgagaaataccacgcgagatgtatgagttggaaaacaccaccacatgggacccataggtcgttgacacatgtgatgatatttttcaactttgaaatctttgcgatggtactcttacatattgtatttttgaatatatggcgtcattgattttaggaaatgtcgatcattagtcttggtgaaaaattcaatactaatataaaaatataaagttatgcttaaaatacgtttatgataaaacaagttgaaaaaaaaagatacttacctagtttttcttaataaaatgaatatttttagaaggaaaataaaacgaat

SEQ ID NO: 28536 - DNA, 1501 bp, Oryza sativa
tacaaattgggcttagtttttgtgccaaccggtgaatgtatggcactaatcaaaatgtttgtcatataaccatgttccaaatggattattggactaagattatttatgccacgcttctaataaaatgattaatttgaaccactttttctaagctatttgttatgtttataatcctccgttccaaaatataagggattcgggttggatgtggcacattcaatctataattttctgaatttccaaaagaatcaatcgtttctagctaagttgctccatccaaataatcctcctctcctctcctattttgcctaggcatccaaccaaccaaacaggtccatatctagtatttgtgacagggacaattacgaagatggccaaaaaccccacatatttgtgactcgagtgtaatgctatcaccagctcccccctctgcactccacacatgactgagtctgaaggtatgaacatacaatgtcctcctccctctcatacgctgtaccagtacaccacaggtcataaaagtcccatttgcagcagccatcagagcagctcgtgcccaatggtaattggtaagctagcccctcaataaatggcaattcagctcgcgcggcccatcccaaggagctgcgccaactgccctcctctccctcttcaaaaacaccagcgctctactgcactgatggctcgatcagtagctacctctcttggcgtgtcttcttcttcttcttcctcttccccactgtccatggtggactccatcttggcatctctgaatcagtttgattttgataggagttcttgttttggagtgcatggcatgtccaggctgaagttaggttaaggggattgttgtctggttcaaggtctccacattgtgcaaaatgttcattcatggaggcacaggatgcttggtgatctcggaccaggcttcaatccctttaaccagcatctgcacaatatgtctctcatccgagtgtggtgcactggtatgttatatgtttatcacctccagttcttgttcttgtgtattaagtattaacccggaaattttcatttgcttttagctgtaactggagtagctcttgctttgttttatcagcatatgaacaagcaaagtttaacaaagatctaggtttgctcatcaagaatccaaggttttggttctatctagaaggaaaccctggatagctaaggaccagttactctatatagtgtatatgtgtttttgtagacagtgagcagtgtatatgtgtgtcaggcatgctgctcatgcggggaaacgcatgctgcgagcttctcattttctcagttctcactgactctgaatcaactgctaccctgcagttttatgcacctcaacaccttgcatttctgcattggcatcaaatctcgatctcatcaagttcttaactatgtttacatgaaaatgatatcacacccatgcattgcacggatttaattgctgcaggtgttcttctctgaaaacttatatcaacagcca

SEQ ID NO: 28537 - DNA, 418 bp, Oryza sativa
aacttcagcccttttccatcacatcaacctgtcatacacacacaacttttcagtcacgtcatctccaatttcaaccaaaatccaaactttgtgttgaactaaacacagcctcacataaactcctaactctttttccaaactaccaactttccccaaacttctccccaatttcataaactaaacacgacatagaagatggatcccacaacaaaggttttatgcacatgttgaaccaggctccccaaaacaaacttttggaaacatggtatacaaaactctactcctacacaattccactgacacataattccactgacaccacacagttccacaataatactcactttgatattaaccattattgttgccctaagactgtctccaacagtctacccataatggtacctaaacccaaata

SEQ ID NO: 28538 - DNA, 618 bp, Oryza sativa
aatgtaagaaaataaaaaaaatcaattacacagtttgtatgtaaattgtgagaggaatcttttgagtctaattatgccatgattggacaatgtgatgctacagtaaacatttcctaatgacggattaattaggcttaataaatttatctcgcaatttacaagcggaatctataatttgttttgttattagtctacgtttaatacttcaaatgtgtatctgtatacttcaaagtttttacacctaaagaactaaacacaccctaaaatggcaaagtgacggcgcgctctccgtattggcatttttaacaaaaacgcgtttttgggatggtgttctagcaaaatcgcttttcaaacctgtccaaatgtctattttctcagtttgcatgtggaagagcaatgtgctgttcgctttgggccagcaaaaagagaggtagaaataaatccaggaagaggaaattgggacgcacaccaacacgaaagaacggagaatcaactccgactcggattcatttctataccgcatcttcccttacaatacctcgacagactaaccatcgccagcgtcaacaacgtcttgactaccaccaccgtctcaactctctctcagactgtccgcca

SEQ ID NO: 28539 - DNA, 1501 bp, Oryza sativa
cggacggcgctgacggagcgcgccggccgccgcggggcgccgccgccctgcaggctctgggccctggagaagacgtccgacgactgcgcgaggatgaggtacaccagcgcctgcaccagcacgaacacccacatcttcaccagcgcctcgtgcgagctcgccgccgcctccattgccggacacactcttcttctcgagctccggtgacacaaacgtacgcaacaagtgcgagagcagatcaatcaacttatcaaccgaatcttcgatcttcttctgctgctgctgctgctgatgcttgtgtgattgatttgtgtgggggaggatcggattgaagctttatatatatagacgtcgatcgacgacgtacggtcgccgggtttgaccgtggccggaggccggaggcgagcgttcagagtgtgcagagatgcttccaaggcgatggcgagttgaagtgttcgacgtgcgcacgagttcgcattggtgcgcgtcgtcgtcacgcgttcggtgaaaaagtatatcgagtttggcgcggccgtcacgggtgaactcgctacgtgagccggtggtggttgtttcgcgggtcaatggtcctccctgtcactgggattagaatgcaggggaaaaatactactccatccgtaatatttgacgccgttgattttttaaacatgtttgatcgttcattttattaatttttttattaattctttttctatcctttgattcattgttaaatatatttttatgtatacatatatttttacatatttaaagagaaatttgaataagacgaacggtcaaacatatttaaaaaagttaactacgtcgaatatttagagacggaggaagtacctttttggcatatatgtttattttttaaatttgtttgactgttcgtataaaaaataaacaaatgtataagacatgctgaagggtacttttggtgtagtagatctaatgttactcttttcactttacttataactaagtgaataaatatttttgttaaactctgagagaaaaagtcaacaatatcgtagtttacaaaatcgtctgtaattgtccaagcaactttatatagtgcacaattgttttcacatatctatgaatgtaccccctcaatatatactcaaagagatgaaaaccacgattaaatcttgacatcactaaaatcctattgaaaaaggcgttgtggagactagataattaatagtcttttaagtggcctgctactttcttcgattggccagccactatctccaaacgttgacaacatgctaaagaaatggaaaccatagtcaaatcctagcatcattaaaatcctattgaaaaggtattgtcaagctcggacaactgatagcgattttcagtgacctgccactgtatccaaacttcattagcaatcggcagtagaaacgcaatggcaaagcctggtttgcctcctaatcaatatgggagctggcttggacatatgtgcaatatctgtagatatagatggcca

SEQ ID NO: 28540 - DNA, 489 bp, Oryza sativa
tgtgatgaacaattgggcattggagattattggttttgtatttggaatttattcacaaggtaattttggagatgattggatttacaggtgaatttacaggatactgctgtgattttatgtggtccggtcagaccgggcaggggttgccggtcagaccggcggtgatcgagcggtcggaccggccagcccgcggtctgaccggctgacactgtgtcggtttcggtttcgggttgtttatttggatatctgagtttatttcatgattatgacttctagatggataatatacttatgtaatactattgtttgctgctaatgagtcaagttagagatagcttggtctcggaatatggtttctttgtttgttccatgtgtaggtgactcgatgtctcggaagagtatttgcggtgatggaccgggagtcggcttggggataagacgacgtccgttgtggtcagagatcatgcgggatacttaggctagagttga

SEQ ID NO: 28541 - DNA, 1501 bp, Oryza sativa
ccagtggtccacccgtttatagtatgtcatctaaatagttataaaagatattaaaaatatataaataagatagatcaatatgtaatatatatcaatcgtaaaatttaacttctacagtaatctatagaagttgctgtagaagttgaatttgaatttgtatatttgtggagtaatatattatatattaatctatcttatcaaattttttgaaaatttttcgtaaccatctagttgacataaaataaattggtggacgtccacttgagttagaatcctctccccgttggcttttgctttgctttttctcttgcgcgttgtgctgctgctgctgacgatacgggtgactggttcgcgcccttttttttttctctcccgcgtttttgtgacttaatcacgaagaacttcgacgtgaatggccaatcaaaagttaatcccacttaattagttacgtgtacttacatggttgatgggtgcacttgtaattaacctctagaatatgatactgcccatatgaatggataatgattgtactactactacctgaatcttggagtagagttatgaaaatacagtaacacatttaacagtttaacaccggcagtgacgagttagttatctttttccgaggatcacctagaaggcaacgtataaggtgaaaactaggttcctgtgcaaacttggaaactctcaattaagaccacaggatgctcatccgatggctagggacagaggtgggctaattttacactttaccacccgccattagccagactaatcatgttttttttgcaaatcaccccacccaattttacaattaacgaccatcgcttcgtctggtcgtttcgtctggcaacgccgccgccgccgccctagtcgccgctccctcgcctggccgcgaacgcagtggcgcccagccggctcgacgccgtcgctggcccgccgagtgcgccgcacgccgtcgtttcgtgagtcaccgccgacctcacccgcgatttgccgccgccgcccgcccgcgagtcgccgacctcgccatcagccgttgcccgcccgccaccgtgatggagtccggcgcgcgcgacgccatggagtcgcatttcggcgttggcagcggcagcccttcatgccatcgttagtttctactataagactttcatcttaactttgatagaaattaatctgattgctagcgtgcctgcatgcagtggacggtgagcctgtagtcgtcgttgattctacctctgttgaggctgctgccttggatcatgtcatcatcaccgtcgacgccggagttggagcccaccttgaacatccaagcacaccacaaccaaaatcttctgtgagtatagcagtaagttgcaaagaattcagatcatatgctcatagggtatttggcatgagtggctaatgcatttattctggaacatttgaatgaaatgtgcagatacatttccttttccatagtaaacatgtcgaactagttctgcctgatttgttgatcata

SEQ ID NO: 28542 - DNA, 192 bp, Oryza sativa
aaacgagcgaactgctcgtcctttcgttggggaaacagcagcaaccgtgtgtcgcagtactcctacggcacagtcttttccggctgaatctccttgtcagccgagtcaatagatggtgcttcttttgacatcccattccatggccttggaacccgtcgtaaacatgtgacataacccttcacccatcctagc

SEQ ID NO: 28543 - DNA, 543 bp, Oryza sativa
tctatgcattaatgtgattccccttttgtgtactagttgaactaggcatggctaagcatttcctaaaccaacatctagtcatttcgatacccaagttatcaatggcataagggaaacaacatatagctgagtaataagacccatcccacatgatattgtaaaataatgcaatatttaatagaaatacgggacatttgtaaattaggtacaatatgatcaattgtaatgcatgacttgtcttgctctcgcactgatgagaccacagcaacgtcttcaaggaaccgcggattgacgaaacggccgaaatctatgcgacaaacaaagcacacaagcaaaacatgctataagactattgaaacagagaacaaaaccatttttaatggattctacacatttttcttgatttactgagacttgaatggacttaatcggagctcggatgaattaattatgatttttagaagattatctgtgtttattactataaaagaaaaaccttaatgaatttattgcgcaataattcatcccagggctgacgtcagc

SEQ ID NO: 28544 - DNA, 335 bp, Oryza sativa
atcaaaacatatggaaccgacaagtaataattaaggatttttaaaatctctacaacaataaggagggcaggcagcaggcgggctgtagatgagtatagtggcgaagccactaacgatttgatgagacttataaaaagtaaaaaaggaatacaaacaataattatattctaattttaaaatccaaatgacaataaagagaggtggtagtggacggccgtagagtagtaaattggtgatgtttaaagatacttctaaaaattatgaaaacgaaacccaccaagacaataaactctaaaaactataaggcctaatttataaagttctaaagaggatga

SEQ ID NO: 28545 - DNA, 167 bp, Oryza sativa
tctcgccggccgccgccgtcggtggccgcttgggccgccgcatcatctaaccggccggccggtttgaagccgagccgggccgaccgggcgcctcgccgctcccccccccttttgtgacactgcccagtggggcccgcctgccagccgccccctctccctcccttagt

SEQ ID NO: 28546 - DNA, 646 bp, Oryza sativa
acgaacacagagtttctaagagagggattggaagaaacaagggatttagtccccacagggtttgagtgaaattggggggattcactcaatccctccctggtttgcttccccttaggatttaatccctagcaaccgaacaaggcctgagggattagaatccatcttccgctttcagcgtgcggttctccaaattgttttatttgcgtactgcagagcttctgagtcagccgtgtcggggagggattatttcaactctaaaagttcattcattacaatgtttatatcctcagtcaaattgctgcagtcgtatgcgtaatgataacatatgcaaatctgacgacgcgaaatctaaaatgcgtgcggtttgaaaggcttgctcgaggtttatccttttgaatatggggagagcaaagtcatcgtctctcactcggtccaaaaccatgtcggacttctgagttctgacttctgtactgcttttatatgcgggctgcggtgagtccccccggctgtaattgtactttgttgtcgttgtttgttcttctcttctcggctgctccggtgctcccgttcccaaatatcattcgcgtattttgcttataaccatagaccatcggttaagagttactaataacttctcatttgcgga

SEQ ID NO: 28547 - DNA, 295 bp, Oryza sativa
agtgacttatttaagcaatttgcaagatgagtgactaaactataccaacctcgcaagttgagataccaccgatgcattttactctaacaaaaaatacggtgaatttactctttataatcgaaaataccttaaatggcacagctactatgtggcattgtgtatttttgctcgaggtagcattgtattattgacatgtagctttgggaggcccgcgcgacgagctattagctcagtggtagagcgcgcccctgataattgcgtcgttgtgcctgggctgtgagggctctcaactata

SEQ ID NO: 28548 - DNA, 1501 bp, Oryza sativa
gttcgcgtgaaccgccgccgtgcgctcggtccaccgaaaccctagcccgctgacgcaataaatcctcttttccttttcaaaaaataattcattattgcgtcataattcaattaaaatcagtttaagtgttttaatccgatttaatctttaaaaattcataactaattcatcttagatccgatttagttggttcaagtctctaaatttttctaaaattgagatctacatgttaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgagctttatttattggttcaactagatattagatataattgcttagccctgattagaaacattagcacactattgggataacttatgactcactattatttaatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcaaggggtattgtcacaactcttttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctgtcgtgattagtcccacacttctcaccatagtaaatgatgctataattggtaataatttgattagctcctggtttggaatggtacattcctggtttggagatagaactgtgcagccgggatggttgttcagaatggttgggcctatacaacagggtatgttgtgtagcgttggattaatattgtttaatacttaactgttttattaaattctgaaatgtttgctaaatgctgcttttgcaaatgaaaccctactatgccatcctttgttatcctgtgcatttgcatatttgctgcgtggcttgctgagtatgtcatatactcaccttgcaatcattcatca

SEQ ID NO: 28549 - DNA, 1501 bp, Oryza sativa
atgttttctctttttcctccccttttttctgatgccttgttgcatctttggtggcatcaacaacaaggcaatggcggcatcaccaatcccccccttcttcgttgccgacttagcggaagagctcgtgtcggcgggaacctatcttgcctacctcctatgcctcatcgcctccccttagggcggaagaggcaaggagagacaatggctcaatgaggaggtttgccagcttttccagctcatgctcgccagcttctatcaacttcttagggaggaggagacagcgttagcgaagcttgagctcaagctctcctagaagacggtggcggcgacgacgatgttagatctaggcatagagccttgggcagtacctagatagaggtggcggattgataatggcgaagaggagatgttgacagtagctgatgttgtgccgccaaggagccaagctagcctgttgctactactccgcccatcgctatcctcgagctctatgaccggataggagagagagagcactcgactaccaccttccgggagctcaagcactaccttgttgccagctacttctactgttgcaatagggacgagagtaaggagggtgtgtgtagtagaaaagaagatgtttggttactgacatgtgggtcccacgttgttcgaagttaggtcaacatgccatgtaggcgccatgtaagacaaaaccactgttcaaatatgtcaatgttatggataaatcatacctaataattcttgtgttaagctcagtgaagcctaccacatactaagttttataagcaatcaagcctcatatacattagatgttttggataagaaaagagaaacatagtcccgcttcggcacgataaggaccactcggattatatctacacttacaaccttatcttttcgcttgtgcatatgcttataagccaaaatttgaatttttaaccttaaatttggagttcactttggggggttttttaaatcgtggtttattttctagcctttacttttagatcgctaagaacacgtatataacagtttttattaacaaattatttttgtttgcaaacacaccgtttagcttattccctaaataagttaaacgatgaccccgttagttctctagttctacttaaataaggggacatccgagggtataaatacaagaccatcgagagaggcgaagacaagccaagacggatctagccaatccaagacaaaccaaaatataccaaaggcaagccttaaaaaagccaatatggagccacataggccgacaaaagggatctagctagagctatctccaatctcatcgagttcatattcgaggaaccagactacgctaaccgtcgatcacatgtgagagctccacgtcattaggttgatagataatagattagatcatctcaaatattgtactcatgtgatattgatatatataaaggcagcactggttcagtcaacaggagtagggttagatatgtcaattaaggggcttgaa

SEQ ID NO: 28550 - DNA, 186 bp, Oryza sativa
aagtcctccatgttttcccaagtggcatcctcggctgcagaatcagaccagcggatcagcacttgaagaacagcatcggtagccctcttgaccaccctgctatcaagaatctgagaaggaacttgcagagcagagttagctttaggcaactgaagtgatgaaagctctttataacccttagccgcc

SEQ ID NO: 28551 - DNA, 211 bp, Oryza sativa
agtagtggtaccttctattttaaaaaataataattgataacctggatatgatttaaatcctaatgagtaacatcataaatatgtccgtatgattggtcatatcaataggccatgcatatcgatgtaaagttagcacgccacatgcatacactaagtgatagcactttccacgccctctaatcaacgcgtattcctccgcttgtgtcaaagc

SEQ ID NO: 28552 - DNA, 548 bp, Oryza sativa
ccgatgtgcacgatttgcgatcgctggctttctgcccgcttgtagagaccggccccacctgtcaccagacctaaggagtggcgttacgcccgagcgcttccctcgaggggggcgatcgccctggcataacgctgggggctactgtcggtgacaagggaccgggagtatcgtgactaaaggcttgggcggccgcgctcacccacgtgccttgaccccctgggggggtcgggcccgagggtgatgtggccacccctccctctgtctccccgaggggtcgggccactcccgtttcggccccgagggttggggcgccccgaccccctgtggtgttggcaccacgtgtgtgagttaggtgagcacagcagggctcacctaaccgcgtttattgcgggttggacgagcgcgccacgccgcatttaatgcagtgcagcgcgctcacttatccggtccgtgaccggtcgcagtatgtgaccggtcacagaccggtcagatcgcgggttaggtggcaacaggcggcctgtcacgcgcctcgccccgtcccatcggaa

SEQ ID NO: 28553 - DNA, 1501 bp, Oryza sativa
gatgtagattggagtgcaggaaaccggccagatccatgcatgcctccagttaagaggatcgtgacaggtgactacgagtctacgagtgctgagttgttctggtctctttactctgcatagcacccaaaaaaacagctactagctggtttccgattaccagtttactttttttagaaaaacaaaggagaaacaaatttaaaggcaaaacattttcctttgcagcaatcaaaggcacatgtacatagttcatacaaattcaattttctgagttgccacaaaacaaccacgcgagcacaggacaactctgaccttctaacatcaaaggatcagggaaacacttttaattagttatatgaacatccgttcatttgttgtatgttaactaaattatttttatttttttaaaaaaattgacaagataaattcacatgtgaataatgtgatatgccactctataaacataaacatgtaagttcaaattcgacttctatcaattacaacaaaaataacaaatcaaactctaattagtacacatatatttacagttaaatttgatatttttattataacttatagaagttgaatttaaatttatatgtttgtgaagtgatatatgtcgacggggatatccgtagaccggatatagagggtattggtgtacgctggtacgaggatctacgtaatacgacatcaagcaggcagaaaacaaagattatactggttcaggccccttgataggtaatagccctaatccagttgatatggaattatatgatggaaaccacatattacaaagggaaaagcggaactcgatgataccgacgaggtcgtaatcgaacaggttcgattagatctcccggcgacttggctcctgtgggcttcaactccgtaggctgtcgtggatgtgttggctatgagattcgatgccttagatcctcccgggggtcccttttataccgcaggtcaactggtctccaagtaggactcggagacatcggacccggcacgatacaatgacgacccagttctgtccgagtaggactccttccatctgtgaactccatgatgaatttccttaacgtacgccgaaaacgtccgtatacgcgcaagtataccatatcgatatgtgacgtatatcgaaggtagagggtataccttacccgtaaccctgacagtagcccccgacttctgcttaaatgaactcatgtaactgatcgtgacttctgatgtcgaggttgttgtcgttctaggtgtgaggaccaagagataaggagtaatcgacaacgccaagtgaagctcaacggtcatgagtgaatttaaattgaagtctgaaaaactgccgtgcgtaacggacccataaatttccggcggccatctctttcctttccttggaattcgcaccgtcggaagtgcgactatttaagtgagttttggggatccattttgaagtccgcctgttgtgaaaaaactctccagcctccaagcgttcctcgtcttctct

SEQ ID NO: 28554 - DNA, 246 bp, Oryza sativa
gttggggcccgcgtccgcaggtggtacgcgcactgggaggtgcacgcgccacgctggagctcgcgcagcgtcaggccttcgtggagcgcgtgttccacgtcgccgaggaggacaacgagcgcttgtcaagaagctccgcgcccccattgaccggtaaaaaaaaaaaaaaaccgaaccaacaaccacccgatcgagtgaaaatggccatggatggcacggctcgagtccggccagtgattgactaga

SEQ ID NO: 28555 - DNA, 1501 bp, Oryza sativa
tgactttcggccaaacaaataacttccgaacggagcagatcacctttgatgtcgctgaattcgatacaacatacaatgccatcattgggagaactgcactcgcgaagttcatggccgcatctcactacgcgtatcaagtgctcaagatgccgggaccgaagggaacaatcactattcaagggaatgctaagctggcagtgcaatgcgacaagcggagcctcgacatggtcgagcacatgcccagctaggggtgaaaacggtacgaaaacagacggaaacaacctttatcgttttcgttttcatatttttttcggaatcggaatcgaaatcggaaaccccggaaacgaaaacggaaacgaatattatcgaaaacgaaaacggagcgaaaacgaatcggcgcggatacggtaacgaaaatttatcggaatacagaaacccctcaaactgagcttcacagcaaaatatattcttctataacttcatataatttgcataacaaatattctaaaaaaattacagcaaaacactatggtacaaggtataaactattagtgctttcactccatcatcagtacatactacatagtcatcaatcatcacataacagcaacacatatcagtccatcaatattcagtacttagagcgtacacagtaacaaagagtgatagaggtggagccgtggaggttgaggaacacctgctgctgctgggctaatggctgctgaaaggcgaggcatcgtgcatcggtggtggtgaggctgtcggcggtgtggccagtggccggcgtcatcggtgtcgtccgcgtcggcggcgtcggcatcgtcgcctcgtcggtggtggtggtggctgcgaaaatggtgggggcgaggacggagcgagagagaggaagggcggcgagacggcgggggcgaggtcgcgaggagcccactagccgaggacggcagccaggcggccggcggtggcgtgctcgaccccctggaggctggatgcgccgcctctctcgatctgtctctctcctctctagcctctgtagggttagccagttagggacctagggacttgggttgggcgggaacttgaggaggaattatggactatttggatgggcttttttttacttcggaaattccgacaaactttccggaatttttccgaccgattccgagttccgacggaaactgctattatcatattcgattccgtttccgagaaatttcgaccggctgattccgttttcgaaaacaggtccggaatccggaaaaaatctgaaccgttttcacccctacgcccagcccacctaccacagctgagtcacccaagaaagtgagaaagacaaacaagacgccgaaactggactccgcaatcaagatcgttccactctctagtgccaaccccgacaagaccgtcaagatcggggcatcactaggcgagaaataggaactcgtgctcatcaccttcctccgtgacaatgttgacgtgttcgcttggcagccgtctgaca

SEQ ID NO: 28556 - DNA, 1501 bp, Oryza sativa
acttgttgtggcagcagcggcagcaacatcggacgcctccttggcgacgtcctccttcagcgacgccgccgcctgataatccacgagcagcccgatgatatcagtcagagggagagcctacgctttatgaagtcacaatgcgatctcggaagaaaagtgcaaaagggctgctgagtacacttacattgatggcagcttcgcgttcagctgcccccttctcacaaagggggacggggactttgctcgccgttgtcgcgccgctgatcatcaattggccgacacggcgctccatggtttcgctgttcaaacctgcagattgagaaccagaattcgataagtcaggaggaacacgcacataaggaagtcaatttaaatacaagaaaaataccccgagaagaaacccgggtcgcgtcctccggcccaaaatagtcaaaggatgggtgggctcgagcccggagcggctggatccgcctaccaatgaagtcggcagcgacttcataccctgacaaacctcgtattcggaggtcatcgatggcatcgatgaagggctgaagagaaggggttaaggcgggttttgcggtccaagacgaaatcttgtctggttgttcctcaggaacaacgaagactggatccgaattttctatctgaagatagaaccacctcgcccgccatttgctacgagaggaagggcactggaaagggatatagcacgacttcaggccatcccggagtcggaaaccgacgcatccggataccctgtttgattccatctaacgcaactcgtagtagaaacgaaagaggtcaagaaacagctctaccccaatgtaggtctcacaaagatgcgaaaaaatactgagaaggccatggaattggggttcaaatggagcaaagaaaggccgtagaaattcaagaccaagagaagaaattcagaaggcggaggaagaaaaccacagagaatatagtcctcgatcgcaaccatgcgacccaggacaggctggggttcaatacctcctgcttctctctccatggtcccgcgaccgggaagggcgccatcctcctgtagtttcttcagcgacgcgctggtggaggtagacttgtcgaggtccattgcgggagcagagaagacgaggaacgcttggaggctggagagttttttcacaacaggcggacttcaaaatggatccccaaaactcacttaaatagtcgcacttccgacggtgcgaattccaaggaaaggaaagagatggccgccggaaatttatgggtccgttacgcacggcagtttttcagacttcaatttaaattcactcatgaccgttgagcttcacttggcgttgtcgattactccttatctcttggtcctcacacctagaacgacaacaacctcgacatcagaagtcacgatcagttacatgagttcatttaagcagaagtcgggggctactgtcagggttacgggtaaggtataccctctaccttcgatatacgtcacatatcgata

SEQ ID NO: 28557 - DNA, 310 bp, Oryza sativa
ggtatgtacctacatactttttcttctttttttttcgtgaatattgtgtacaaatttaagtacatacatgttttttctttctctgcctttttctcttgggccatcggcaggagaagtggaggatatacgtaccatatatatgggctaacggggaagaagagtgtcacgcccagaaattcacgaaccagaatttctaagctgaatgtgcattaaacccctgtccaggactagccagggtacacaaacgacaattgttgacatacagatccacgtcttacaaaaatataaaaaagattactaatgcagcgga

SEQ ID NO: 28558 - DNA, 245 bp, Oryza sativa
acagggtttgcaatttcggtggttgccgaaaattttgtgatttccgggtttttgatcgaaattatttgaatgtttaacatattttgactgaatttgaacaaattttgaccaaatttacaaatatttgataaaaaaccaaaaatttcggagagatttgtgtttgccagtgggagccgaaattaccgaaattttcacaccatggtttacaatcaatgtcctatgtctttgtttaagcattctagcac

SEQ ID NO: 28559 - DNA, 1501 bp, Oryza sativa
aataaccgtagatccgtttcaggtggttcaagttgctaaatttttctaaaataaagatctacatattaaaattatccataagttgaattaaatttatttaattctttttaaatgggctttaattagatttaatcttgtaaaattcataataaattcatttgaagtcagaatgaggccgttcaagtctcataattcatctaaaattatgatctacatgtttgtttattttttatatactgtttatttggtttttattagtctttttcttcgttttgcgtgttagcttgtcgtttccgtcgttgcgaaggttcgtgagtgcgtcggaagtgatcaagaagattaattgaagaccgattattgcaaggcaagtcacacagatcctaaacacaatcctttgagcatgttgatcctatatttaaattctctatttgtttcaactgtgcatttattttcgaatgtcatcgggtggtgtgaacctattcctttgttatggccaatttgcattgaatgccctattccttgataccttggggtaataaaattgattagcttgaaccttatgtattggtttggttcagctaaatgttatgtatatatataattgcttagcaatgcttagaaacattagctcactaatgggatgaatcatatatactacattattatttaaggttatatttaatggtagctcacgatggttaatcgtgttatgataattaattggtaattaaaatatgattaatggtgggttgtgagcacatggttttgaaggtcgtgctcatggcaattaaggaccggttcgcgagctacggttgtgaaacatttatcgtgccaaccacaagccagcatgggcaacggctttatcctttgtatagcgtgattcattatagtgcgccagactgagaagtggcgagaagtccacgggggtcgctggggagttcatgccttgtttataaaggggtgactatgatccgggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacacctctcacaataattattgatgattaactggtaataatttgcttagctcctggtttggagttagatctgttcagccgggtatggttgttcaggatggttgggcctgtacagcatgggtgtgctgttcagtgttgattaaaatttctgattaattactctactgttttactactcttaactctttgctaaatgctgctttcgcaaatgagcctatattatgccatcctttggtatccttgtgcacttgcatacttgctgtgtggcttgttgagtatgtcatatgctcattcttgcaataatcaatcaacctcag

SEQ ID NO: 28560 - DNA, 1501 bp, Oryza sativa
ttatagatttaatgaaaataatttggtgtcttattatattgtttataaacttaattaaatttagagtaaaatgattttgatcaaattcaaaacgaattataatctaagatggagtagtttatggttctcgtaggacaagaatcatcaacatctatctattatatactaaaagttcattaaacttcctacaaactcttctaagccgccacatagcactcctaaaaacactcctaagtcgctatgtggcgctttaaaaaattttaaaatccgataggcccattatttctagccattagatctattataaaaaatataattaaatttatctcaaaaactcgcatagtacgtgcacgtataggtattcccaaaaacaacaagtacgtccatactttgatacgtacactgggcccacatcattcctttttttttcttttttctttctcacttattagatggaaaaccaaactacctatatttataatcgtctcactttccagaaaacactggtggagaaatgctttctagtcccggttcataaccccctgtagtcccggttttccaaccgggactacgaatccgggactaaagatcgctatctttagtcccggttcaaataaccgggactaaaaatcaatctacctcatatactacggaattgggccgaccgaccaaagatggtttctccaccagtgaaaagacaaaacttaattatctacctcatatactacggagaaaaacgataaatcaaaaaatatatcaatatattaatagtaaaatcggaaagaaatactaatcaacaaaaatcataaacaccggcacttattgttgtcaatagcctttcaactatgattttgttaaaaataatactatacaaaaataagtagggggcaaaaattataactattttcatcacctcctcctttttgtccctccatgtccttcaatgcagcgtctagtgtttactatgccatcgtaaatattacaggcatatacatatggttgagttaaggtggcgtcagtaaaagatcactataggcaatgtatctaaagtgacattcttactaatgcaatcctttgtgggtgtgctcatagtgaactaagtgttaaaatggtgccataggctggtctttagggtcacggctacgtcgatgtggaaccaatgtttcagggcattatataagaaagctttggtagatacagtcgatgatgtggaaataagtgatgaacatcgagttaagtagtgtagattattttttagtgtattaataatatataatttattttagtggtactaatacagtttcatttattaaaaatgcacatagcttttaaaacaataacaatagaggagtttatatatgaccacgacaaaatgatttttatttaaatatgagatgtattcttattcttatcatatttagtagtatattaaaatataccatctattttacggtaaatatatttcttttttattgtaagaaaatttacattcccttacagt

SEQ ID NO: 28561 - DNA, 213 bp, Oryza sativa
ccaccacggaaggggaaggatggaagtaatttcgtctcattacccactgaagaagcgaaaatgatttcgaaaatgcacaaaaaagctaaaatggcaaagtggcggtgagtacgagcgcttcatattagcattttagggaaacacgtttttgggatggcaatctagcgaaaccctgttttgaactgggctaaatgtccattttctccttgcaga

SEQ ID NO: 28562 - DNA, 1424 bp, Oryza sativa
cttagtggtgtattagtcccaggttgcttaggagtgggctaggatgcttggagaccctcgaaaacaaagcggcaagaagacttggagccgagttagactagtttaccttttcgctttgagtttaagaaaaaccgtactattaagaggggttccaagtgtggttctaagataacacaagtgctcttagtggtgtccaagtgttgaaatatttttaggagctatttttgaaaatggctctacccgggacagagagtcccacccggaggttctgtccggaacttcctggcgccaaggtgaggttgaaaaattttctaagtgttgcccggaagttcctagcacccaggcccggaacctcctagcaaccctccagttcaaatatgtgagtaacggctagatgacgtcacctagccgttatatatagccaactcgactccagctcattctttggccattccactttagttcttgtgttccctagcttgttctagcctctcccaatgtgattttgcttcccccacccaaatcttgtgtatttcttgagtgagagagtgattttgagggtggtggtgaggattggagaaggttttgaaggctaggatgacttgagcacttggggtatctcgttgggctgtcatttggagcttgttactcttggagggtgacctcctagacggttaggtgtcgcccgcgagtttccaacaaggttgtggattgacccgggcaagtttgtgagggcgttattccacctccgaaaggaaacggaatacacggggagtgaattccgagctgaggtttaggaggtcgtcttggtagagcaagcctcacttgtggtgttcttttggtgttcaagttggggatcttagtggtcacttgaaaccaaagagaagtacctaggggtgttggcttgaagaccggagacctcttcctaggccttttcttggtgaggcaaggggttaatcaagacccggctctttgaagctcctcaacggagacgtaggattctcagtggagaatctgaacttcgggaaacaaatcgtttgtctcctctcactctctttatctttgtgattgtgatgcttatctccttatttgcctagttgtgctatcatgtctcccattgtatgatcacttgtgatatcttgtgtattttcatgtgtattactcttgtttgagacatgttgtacctctctatggtttagacttccttgtgatttaatttacttattgtgaggtgctcgaaagagtaactcacaactccccggaagttcctaggaagaaccccggaagttccgggcaactttctttgctcagcataaaaagctgccaggaagttccgggccttttgccaggaagttccgggccctgattttaaccgctgcaatttgaagtaaattataggaacgcctattcaccccccctctagg

SEQ ID NO: 28563 - DNA, 808 bp, Oryza sativa
ttttcggcaaatcaattcgaacaaattttctcctcgaaatggtaattaaggtaattatccataaaattttgtatttttcggacaactctctacacaaattattgaactgtcaaatcaaataattttcaactaaaattgtaaaattttcaaactcaaatataagaactttcatgttcataattacctggggagagttgaaagtttagtttagattaacccatcagagaaggccggcctgcattccggacgcatgcatgttacgaggaataagtccactttccggctgtaatttttatctcgaatttaatttgcatccctaaaccgcaatacccccaacttacaaaaacagttcaaattaagtcctctaatagtatggaaggttagttttactgatatggcaatttgacctagtccactcatgttgactagactcttacgtacgtgacaaaaatgaaagtggcccaacctatcattctaactctcctactcctaccttctctcttccccctgctctctctgtggtctcctctctccctcctcccctctctctcccctgcactcagtctctcctccatcaaggcatcacggtggtgatgacgaggtgaatggcggaggtggcgccatgtggtggtgtagcggtgtagattggaaagacaatggttccgacatgagtccagaccagcggtgtcgaggctgaaactccttggttgacgccggtgttggtactgccgtcaggatggtttgaagttgtattggcagatccttaagcaccaagccctccctacctggcgcgtcactgtcgacgagt

SEQ ID NO: 28564 - DNA, 1501 bp, Oryza sativa
ggtacaaacaggggaagaaaccaagatcggcttcttaatgtgtagtaaacaaatttccagtcttgctggaagttgacatggttaattagagaaaggaaacaaattagagttagttttagtaaatcccaatgattccttcagggcttgtactgcatgaagccaagaatctgatagctttcaccacattagatttaacccagatatccaataaggagaaagagcatgcaaaatcactgttctttacttcttgttttctacagcagcaataattttgccatgaaatcgcatagctgtcatggcgattctcttctcaccaaccaaatttagaacagaaacccagctgtgttttccccccttttaattttaactcttctgtgaattcaccgcatgatacacgccaagaaagtgttttaaatcgctagctaaaaaacatttagcgatcggtcttctcaaacagctaatagccgattgaatggggctgtagcggctaaattctacatgaggcgagaaatagctagagacaccctcctcgaacagctatatctgaagatagcggtagctatagccggagatttaagacctcgcaagaaacagggatggtgtcacatggcataggcaagaagagtctttcttcttcctcctactcgccgccgtcttcgtcgtcgtcgccgcctcggtcttcatagctcggctgcaatgtctgatcgtcgtgcgtgtgcgtaggattcagctgagtttggttcttagtggattcgtttgaaattggtgcagggtaaggtttgccaagacggctccgcggcggcgtctccggctaatctccggtcactctggccttccccgtggcgccgccgccgcctcgcgccgtgagtgaggtgtgtggtgctgtggggcatgcgatctcctccgccgtcttcctcctcgtctcgccgtcgctgctccggagagtctctcccgtagacaacggctaaaaggtctcagaaacttactgaaatttggaacgaattcgtctgaacagaagaaaattcgaagggatttgcgagttttgagtaggtcaagatgaccaggatgaggtgcatcccgggtctgctcgccggcaggaggaagaaacgagtggtaaatgtttgatcgaattttgcctttctgtttttgtgagattttggttttgagtttgtaatggttggtgagtgttcgacaggttgctgatgccaagaaggctagtggggattgtcccaaggtgaagccggtggagttcatcgactcgccggcctccgaatgcggcgacagaaaggtcgcgccgtgcgatgtcaaggtcgtcgtcgacgacacggttgtcaccgccttggcggcgaccaaaggaggcggcggcggcgacgatcatggcggcgacatggcgttggcgaagaggggcagcatgtcgtctgacttcgagttcgagttccacgcacacgagaagcccgacggacatggcgtccccgccggcgcctcgccggacgcggtgatc

SEQ ID NO: 28565 - DNA, 607 bp, Oryza sativa
aatatcccaaagtctagagttgtaaaatcacctaatgttacctaattaaactgcgaagcatctacctaaaattaaactagtggtgccatgagtagagtgtccactagttgaggttttgtttattctagggtgaacaaggtaataataacaataacaataataataaggtcataacaaaggtaaataggcatggctagataaaacagtgatattgcgggaatttaaataaagcgataatgcaataatttaaatcaacataattttacaaactgggattcaatatgttcaaagatgatgtgacttgtcttgctcgctttcccaaacgtcggcttcaacttccacgaagagcggatcttccgaagctgcaacgtctacacgaccaacggaaaagaaaaggcttttactctaataaactccatataacaagcagaaacaaagcacaaaaatgggttcttgacttcttaagaaaaaattagagacttgaacggtccaattccgagttcaaatggccaagttatggccatttgaagtttatatgctctttaattgaatatttgcgaatttcttcatttaaattttaatttaaaatcggatttattgcgtcagc

SEQ ID NO: 28566 - DNA, 159 bp, Oryza sativa
caccatccccaccaacttacacaccgtgcacggcctaggaggatagctagagaaaggcaggtccctcgcaccgaccaccgacaaggtgaggaagccccagatctaagaagagcgacggggaatggccaccaaacctgggtcgaaagctgctccgcaata

SEQ ID NO: 28567 - DNA, 747 bp, Oryza sativa
aactaattctactcgggcggctgtaagtattcccaatatatactccttgtatcgatcatacttaaatcaagtgattgggatagatcggacgccatgccgagacagtataaatcacttaaatcgaaatatatattaataatgggactacatatgttcatagcatagccgatcatatagatctagcatgtatcggctaatactccgataccactctatactaagatattaaagcaagtagaatatatcaaataaaggcctaatatacttaaatgcaataagatcttaaaataaagggcagatttaacatgtcaataaagcatatagagtaaatatagttaaatcagataagatcggctgaaactctgatgctaccctaatcagcaactagaaggcaggctagaggttgattttttaagcacgacttaatagatcaaactcaactgatacagcattaagtatgaaaagaagaacaatatctagacaatcaagctgctggaagtttcatagagtggtagatatcttatataatctacgtcaacatcgaaatctaacctaatcggctgtcctctaccgacagatgttagccgattgtagattagatagtggtattgccagagattatgtaagatatatgatagttcgacgaattacataaacgagatcagagtatcacaaagatggaagcactaatcccgagaacacaagtcgtcataacaagttttaccttttgttgaagatcgaaaccga

SEQ ID NO: 28568 - DNA, 1501 bp, Oryza sativa
gagtactcagcaagccaggggaaataagtgtttaatgcaggcttcaaggaaaggttgttgttttcgtaattgattttgtttgaactcttttctagaatgactaggtgagtgcttctcaaacgactcggatgagacagtgcgtctcgtccggccggagtatgtgcaatgcatcaatctttagatttgaaccaagattggcttccggccaacagcttttcaacggccacccgggccaacaacttttcaaacggccacccgggcctagctgatcccgtcagctgctgatttttcaaacaccgaattcccttttcacaacagcatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatctgtccttaagtgcgagagcgggaaaccgtacacccggtacgttccccggtccgcggttttggaaattcatttagttcgcaagcaccgacctaggtgtcgggttttccaagtcttttgtaaaactccagttttacccaagttgtttctcagattttaagtttgaaggcgaccgtcgatactcgcacagagtgcacgaatatcgaggtgtaactaggtggttacaaggggacatggtataacaattaacaaaggaaggatcaaatgcaacaaattaggtaggtctaccaatctgccttgcagacgggacaacagattaagtgtgatcgtatcaatgcataatatttcgcaagcaatataattaaatttcaaatataggctcaagatgttcaaagggggcttgccttgctcgcgatccggagcttgatcctcgaaatcctcgcactgcgggtcttcgggctccgaaactacacgcgaaacgggacaactcaacaaacggcgaaaataaagccctattaaagacctctaagcgtgccactagatagatctcgagatttgggaaattttagaagttgaacggggtcaaacggaattacggttgggaatatattgaatttctaagattattggatttttggtctaaaggaaaaaggatttaattaaatcctttttggaaaaggaaaagaaaagaaaggagggagggaatatatacttttctcgggtggctagggtgcggcccaagagatt

SEQ ID NO: 28569 - DNA, 1501 bp, Oryza sativa
ccgatacctcttctcagggtgaaaacctttgttcttaccatcattagttggagctggcctaattgatattcccttctaaaggcatcgaaataggagaattggcccatgggagcagaggtgaaaaccttcgatctaattttcactgattagatctagcaacgatgatgcgagccgtgtcccttcttggaggtgttgtcatcaatactaaagccccaaggacctctttcaactgttgtcctcttgtggttggtcgcctaatggtggtgatggcgggtctacgtttcttttttcttgaccagtcttagcattgacaagtattgtgacgttatgtttttttctggtcttggttgtgtgcaatcctagttgatgtagatgttggaatttacactttcccttatctaaacaacaatgccttgggttgagtggcttattaacaatgggtagcatagtttaatcacatattggcttaagaaatcttttgttaggaaccttggacagccctctgaaaagcattcttattacatacttataaggtaaattaatctcaatgcatgttaccttgttcaaaggaaataaattaacaatagtttggccatcaaaagttccggatctatgcatcaacaaacgggatcgaggtaacactgaatgctattttgaaaggttttaacaaggcagggacaatgttgtccccgtggtcccaggttgttccatgtttccggtgactactttttgttagtttactcatcatctgtatgttaatgcataaatgcggcagccaacagattcggaaagagtttttgccatccttgacaattgcccaaatggccaattggcatgcttcgtgagcatgccatcgatcatgattcctaggatttgtttgacttgtacatgataccataacggtaggttatctatgcgttccaccagcaagtttcccacaaaacatggcattaaatgtgcattatatccaaaacagaataatgaagtcttgttaacttaagaaatgacaggtgttgctattattcacaatgagtgctggaatcgctctaaaagtggattgctaaatttctacttatttgaaaatggcttcttgtcacttgtgccattttgcatttggaaaatgcatatttcaccgttggatgtacatcaggaaagcagaatagtaatagtagatatatatgttatttgctgtgatgttgccgcatttaatttctaatgcctatgtttttcaagttactgatagaaagcatttgttatctgattgtggtttatttggtgaaagtttattctattatttattccagttggtgaaccaatactttcctgttttgtacactttatgcatcctcatctttgtttttccccctcaaaaatcttcatctttattttttgtctttcatgtttgagttttacatcctaaagtctttactatattccagcattcctgtttcttaattgttgattaacatgctgagttgtggggttttcaggaaagaaaagg

SEQ ID NO: 28570 - DNA, 257 bp, Oryza sativa
atgtggttcgttcacccttcaaagttcagagtagtagacagtgcgcattagcatcggattgatttgtcaattgtcatagcaaagaagccacggatgttaggcaatgtcctcatatcaaataattagaagaggtcaagctgtgaacccaagtcgtctagcccaccaccctgtggagctagccggaaaacccctgggcatttctcatcaattgtcatagccacagcttgactcatgcatgagtgtttcccgagtaagga

SEQ ID NO: 28571 - DNA, 792 bp, Oryza sativa
tctccggtcgacgacgagcttctacatcccccagcctccccctgacggtcccagcaaccatgaactcgggggctccagatccggacaccctgaactcacaggtcgcggatccaaccatcccgagtttgggtgcttcagatcctgcggacctagcttcaccgataccagatccgttcgtgaggtaagcggtccgccgtccacaccacaccacgttgtcaaggtcaacctgccgtggggagagcaagcttcagctgtccccttcccccattcttcggtagtcacccgtcccctcatttattttactcagtttagtgctaagcagaagtcacccttttctttccttgcattcacatctgagcttgcagtcaaccaattccggcgtctcctgtggttcctgtggctaaatccttgtccaaggatgcatctagctttaaccccatcaaaaatcatgagctattggatcattagttagatgctctttgtgtactagtattttgtttggatagtgggcatgcatgttgtttcgctttgttttcttgttctatttaagttgatgcatcactaaatctgtttttattttccttgttagacctcttaccagaagtttcttttggttgtgttcttgcatactctacaaatcccccaatttctatactagctgaacaaattagacgctagttctttctacaaatggtgagcttcctctgccagttgatctatttccgtttctttcagataatatttaactactgacatgcatatggatgactatcaaggatggttgaaaagcta

SEQ ID NO: 28572 - DNA, 794 bp, Oryza sativa
acacaattattggtgtactaacattgcttaggtatcgaactgaaactgaactcagatgaaaaattcatggtaaaaatgagagcggagagtataagtgtacagatggaagcataaacaagttaatcttgataatactgatctaagatggctgtgaagaatgaaatctacaacctcagattgaggtagtggaacagattaacacaattgtgttttgaggattcttgtagatccacctcttttttaacctttaaccatcataatcatgtctaaagtcagcttcttgactgtgcaattccttggggctatacatttgtctatatattctgtgatatgtttggggaagtatgtttatgtgtgtgtacatgggtgttgactgtgatattatgtggcacactgggattcctatatggagataggagtactatcttatcgattttggagccaaccaatatcatcttgtctaaatgcttttcaagtttatgatgttgcataattgtatctcttctagcatcctcactgttgactactatcaaaatcaagctcatgctaaagtcagcttatgtccatctgaagaacttatcttcaagatatcagaaaatcaattccagtggttgtgcacaaactaaattgcaccctattttttctcctgaaagacttccaaaattgatatgaggagagcgtaaggccattaaaaaccatgcacattctgaaccaaaagaaactaaatgttatatcacatcctcgtgaaaagaaagcatgcgtattgctaaattcataatcccccgttctgcaga

SEQ ID NO: 28573 - DNA, 182 bp, Oryza sativa
attcctgcagcccgtcctggcaccggcgttgtcttcgtctttggctcgatttgacctggatctggcgtggtggaggcggaaaggaggcggcgaccgtgggtggtgggcgaaggaggcagcgacccggaggcggtaggcgaaggagccatgacggggtggcggagagacggcggcggcgacca

SEQ ID NO: 28574 - DNA, 244 bp, Oryza sativa
cccttcccccaacgatgccgcccttcgcgcttccaccttccacctctccctacaccgcgcgtggatggtgtgagggcgtggtggatagagcgggcgctaactggcacgctcctcgattttgcactcttccgggcctgcctctaggctgtaggagctgccttcaccactaggtcacgtaggagctgcctttaccactgggtcgcgctccttagccttcgcttcccctgcacatgcactcgctagg

SEQ ID NO: 28575 - DNA, 1501 bp, Oryza sativa
ctacagaagagccagcacagggggccctaggcgtcgacggcgcccagagctcgacgcagggctaggatagagctaggaatcgtagccccacacttatagcaaagaattgcttgtatgaatgaagaaaacacaaaccttgcttgcatgtcgcgatcttttaaacctttagctcgaagagagcccccaccatgggttccgaaccatcttgggaagcctgtgatcacttagcaaacgaggtcaggttcccacgagcctgtgtccccacgctacacattatgtttgctctttcctttcggtggcctccttccaatatctctcccttctacacggacgactactttcgcacgagtgtgagagccgaaaaactctagagccagcgatccctgtctacagttgagccgggccgagcgccgtagccagccggcggggccaaagctagccgctacggaagagccagcacagggggtccctcgcttcgacggcacccggagctcaacttaaggctggaatacggctagaaaacttagcccccatacttggcgaggaaacgttcatgtagatgagagagaggttgggctcttaccaccgaggaagcaaacgaatgcgcaacacgcgagcgtcgcagggccatgagaaaagaatgggggaaaagaaatataagacttcaagctatattatgctgatgaattgaaaaattgaaaatacttgaaggttgaaaggatgattagttgagccgggccgggcaccatagccagccggcgggaccaaagctagccgctacggaagaaccagcatagagggtcccgggcttcgacggcacccggagctcaactgcaagagtcctcccaagagtagaccgaggcaggcagcaggttcatgagccaaccccgcgcttggcccctgagggtcatggggaagaagctcgccatgacctggtcatcacccccgccgcctctatgatcatcgtgcagatctggagggactcggaggggttgacgccgccgtcgtacttctcggtgaggctgtgtcgaaactttaggggccatcggacattccgaagactcgccacaaaggcctggccgctagccttttccagtgaggaagtgggaggcctagccccctgcctggggtggcgcggctctcccgaggaggctgcgccttccccagcatcggcggtgcgacgctcgtcgcgccggcactcgaaagaacctcaaaaatcacgaacacaccccctacctggtgcgccaaatgtcggagaatgaactcctccaccagggaaccgtgaggcccctttttgtgagttcggccgggggcagcgggtgagattcgaggattcggtgagcgaagctgtgtgatcttgagggggttcaatcccccaaagacgatgagacaaaaggggtttatataggttcgggccgctaagaagcgtaataccctactcctgtgtttgggattatggtcgagtgtagaacacaagtgcctggggctgcgagactcaagc

SEQ ID NO: 28576 - DNA, 1002 bp, Oryza sativa
cggctgtgcttagatccaaagtttggatccaaacttcagtcattttccatcacatcaacctgtcatacacacacaacttttcagtcacattatcttcaattttaaccaaaatccaaactttgcgttgaactaaacacagcctacagagtactacatcaacaatggccttgtttggatcctccgaactattaaatagccctccggaatcttgctatttaggagtattaaacatagattaccgacaaaaccgattccataacccctaggctattttgcgagacgaatctaatgatatatattaatctatgattagtggctgattactgtagcatccctgtagcaaatcattgattaatatacctcgttagattcatctcgcaaaatagcctaggggttatagaatgggttttgtcagtaatttacgtttaatacttctaaatagcaagatttcggagggctatttaatagccctccggatccaaacagagccaatgataaaactaaacagttctgtgtcgtttgaattgtacagacaaattcaacaccagatgaccctcgtaggtcgtagccatggtccaggaccccctctctcaagtggagtgtctgtcggcctaccacctccactcatgaatcatgagcggccatcatcattgccccctcggtatgtttggtataatctggtaaatgaccgtcttctcttttaggtctctttgatttggagaaaaaacataaaaattttgaaggatttcaatcatataggaaaaattcctatgaatatctttgaatcaaatgattgaatcttttccattcctttgaaattattatggaatagacaatcttatagacagtgtttagcaaatgacaaagggaaatgattttccacccatctttaaattctaaccattcattatccctctaccatttaatcctaacccttcattcatttcccaatcccaatcccaccccccatttcccattatccaaatacacccatagagattt

SEQ ID NO: 28577 - DNA, 159 bp, Oryza sativa
tgtagttcttatgttctatgtcggcatgtggatttgcttgtgattcgtttcgaacttatcgatgtgtttatgtttcgtcgtgtaatgtcagacttcggcatgtcgtgtctttagggtctcgtgatgtaacgtcggactaaggcgcctaacgtctttagg

SEQ ID NO: 28578 - DNA, 1295 bp, Oryza sativa
ttctctaccagagctaagttagattgttgggcccatgtggtaacctcttgaggtataaaaggaggtccaggcctagtggtggaggaggggggacttccgagcgaactggcgcttgagtctcgcagccccaggcacttgtgttctacactcgaccataatcccaaacacaggagtagggtattatgcttcttagcggcccgaacctatataaaccccttttgtctcatcgtctttgggggattgaatcccctcaagatcacacagcttcgctcaccgaatcctcgaatctcacccgctgcccccggccgaactcacaaaggggggcctcacggttccctggtggaggagttcattctccgacagattgctacactaccaatttataggtagtgttaaattttaggtaagttttggcactaccaatattttggtagagatttctattgatttggcaagttttagcatccatccaaacatcacacaagtactatttagattaaaaagtttagtagggcaagatttggcactaccaaaaacagccattgatgctcgttgggggggggggggaattgtagcaaccgaactgatctgagtattgcacagtggagtagtaggcaaaaggccattttggattgaagccaaaatgtaaccttacctatttattggtagcttcaatagtgatagtgtatgtttggattgaagtcaaatcattaataatgtctattaacaatttggcactaatctagaactttcttctctatatcatcaatatttggctttacattggtagcaattcaaatatgtaccatacatctctaccctactaaaaaattactagtaccaaaacatgccaaaaatttggcactatcaaagatttggtaggtaaaggttggtttgctttgtagcctaaatagaccttaccaaattttgtcaataccaaattttggcaagttttggcatgactaattttggtaaggtaaagttgtgtttgattgaagccaaaatagcctaagttcactattgaaatagcctattttcttaggcatgccaaaatttggcttcaaaccaaatagacactaaacactattgaaattgccaaatattgataagcctaatttaggcctcaatcaaaaccagccctaaataaccaaacagccccaaagttctgtcatggcaaagatcatgaaaagcatgtgactcttcctcaagcatttgctataagcataccaattttgttgtttaagagttccgtttcgacgtttgccctctcctcttttggtgtttacatccgcaga

SEQ ID NO: 28579 - DNA, 227 bp, Oryza sativa
ttattgtgcgagaaacccacaggagacaattttagtgttcactatcttagtaccttcgctatagttgtagatctaccttatatttgtaaagttctgtgcataatattgtagttgtcatgaaatatgatgaacaagtttatattttattatatcttggtatgcaatagtcaaataatgttatcattcctgaaccatattaaattatggactatttctgtttggtaaat

SEQ ID NO: 28580 - DNA, 1501 bp, Oryza sativa
ataagcaaggtggtactaaactccacatgcatgccatcccatgaggtgggcttttgtgattttccaaagaattaatcttcgaatgggtcttagcccatctattaattccaacagttttcaccatagttgacagtaacatttttccatggacatgctcccctaccaccatcactgttgaggcagcattgccaatcaaatctgatttcgcattgaaatcaacattagccattgatattaatttatttacactaatcagtgtggttttatggtgtattgttaattgcacatcagttcacaagctagaagtcattaaggaaacactctacactatttaaaatttatgtgaaaaattcttcatagtgtgtgaatattctctacttcacagtggtgtacattgcaaccaaggagtttctatattgggccgacatcagtttattaatcatcatacatagttttcacaagtatcttcatattttagtactttctagctagcgttgggttggaatccattaggaacccacctctcgaactcaaataatagcaggtatcagtacacaaagtaattgagggttggaagaaccaaagtactttatgtacagtagtggagttggtgttagaagatggaaggagtacaaggccaaaagtttgttcaattcctttgaaaaagcagttgttgttgcctttgttctcttccttgtgcttgcttgggccagccatagtgagttaatacaacaactcaacttgtattgacctgttgctagccaccggtcctagcaatcccctttgctttaaattcaggttgttcccaagccaataagttgaaacctcctagatctaatgactgaacatgaagtgtcatggcataaaaagttaccttcacatttaacaaatcactttcatcattccggccgggtgatttgcttccaggcatggtttcattcatgatattatcataaaaatggttcttatagtccatgtctccactctgcttcgtgctaggaagtaggaacatgatagaagtgttgggatattgatttgtctttgcagttacaacccattttttatagcgcaatatccgtgagcatattttcagcaaagcatcacaattgcatttaggatatgggcatagtgttgacttcatttctcctgtgatgtccctttgcttgtattactcccttccttccatttggacagcacctgaacaacggccccaaaaattcagtggatggtaactgcgaagcaaaatcaagatccaaacacttttgcatttcctgctcaaagctagcatcaattgcaatactcctattttcgtccactcatttcaaatctatatccttgaaattttagccgattccttctatgcccctgaattttcttcactcctttatatacctctgaattttgatttggatccctttcgtacccttgccatcaattgaccattagttgaccgtttaataggtatagaaaagttagttttacccttcaatatgtgagaaat

SEQ ID NO: 28581 - DNA, 1501 bp, Oryza sativa
cgcggcgagttgatgatggtcgacgacgccgccgccgccatcaatcatccgagcgacgagatctgtagtggcagcgacggcgaggccgtggtgaccgtggccgaggccgacgacgagcggcggtgcaaggaggcggtggtgaggatgtaccaggtggcgttctggtgcgtgcagcagcggccggaggcgcggccgccgatgggcgcggtggtgaagatgctggagggcgagatggacgtcgcgcctccggtgaacccgttcctgcatctcatggcggctccggcgccggtgccgaatccatgggcgacgacgacggcgagcagcggaaacgccgtctcagaaaacgtcgttgtttctcacggaagtgacggaatcgtctcgctttgactactgaaatcttttgtctgtgcgtgtgggtcgccacgacctcgtttctttgcattctacaagtagattgtttatcactacatcataatacttcctccatctcaaaatatttgacgccgttaacttttttaaaaatgtttaaccgttcgtcttattaaaaaaaaatatttgacgccgttaacttttttaaaaatgtttgaccgttcgtcttattaaaaaaattaagtaattattaattctttgatttattgttaaatattcttttatgtatacatatagttttacacattgcacaaaagttttttttaataagacgaacggtcaaacatgtttaaaaaggtcaacggcgttaaatatttagggatggagggagtactcattagatttggaccaacaaatcttacaaaactttcaaccagtgaatactacgttttcaacaaaaaaaaaagaacaaacatgttaaaaatagtaattctagagacaaaagcagttgtaaaatcaatttttttataatataactgagtgcagatacactgtaactatttgtaagtgttctatagtatatataagcgttttgtaaatgagtgtaattgtaagttgggtctacataaatataaatctttgtgcagatcttacagacaaaaaataaagaggctgctatataatggaatcccgttttcgaacggaatgatcccgagtaggtaacaggtgtgatacctatcaagtatcagacgattctacacaacatgatgatcccgagtaggtatcaggtgtgatacctataaggtatcagacgattctacacacatttcaggtgacacttgcaagtatcatgtgatatttatcaggtatcatgcgatttctaccacgtatcgcgtgatactcgcgaggtatcatgtgaaacctgtcaggtatcagacgatttcaaccacgtatcgtatgatactcacgaggtatcatgcgatacctgtcatgtattagacgatttctaacacgtatcgcgtgatactcgcgaggtatcatatgatacttgtcaggtataagacaatttctaccatgtatcgcgtgatacttacgaagtatcggatgatacctaccaggtatcaggtgattc

SEQ ID NO: 28582 - DNA, 358 bp, Oryza sativa
tttgttttttgtttttgggcatatagggatacttttatagaattgaaatattttctgtgtactatatcattttctgaattatgatctgtactatgtgatatattcaggaatgcctgttctcatagatgtttctgttgtaagaacatttgtagttgacttactactttgatggtacagcatacatttattagatagtgttgactcagttttattctctcgctaaatgactgaaaatttgtgattgctcatgtggtggaattcgatcagagtctatccgaaaacatgcatccagaatattggttttcccagatgcttttgctcaacttttgttaacatttacgcttcttcactctccagg

SEQ ID NO: 28583 - DNA, 1501 bp, Oryza sativa
tttcaatttttgacaacccccatttagggaactccctaaaaatattttctccccacattttttttctccaacccaatatctaaatcccaccctctgtatttaactttgtcatatgttattgattgcctacaaatatctttatctttaatagctatatttttaatggattaatatatgtggtgacgattgggaggcaggggggcaggaggcgagaggaatgtgttggctgccagaattctaaaaacaaaaaataatgaacttagcaatgataagttccaatttttttatagaaaataaatccaaatgataacgaagaggatgagcatgacgagcagaggggtggcatatggccagctagcaaaccagcagggcacatggtggctaagcagactttgaaaaccactctctccattttaaaataaacaaacatcgtactagtatgtaacgcatcttagacttcttagttcaacgaatctaaatatatagtacaactaaatttgtaagatgtatcacataatattcaaggttagtttattttaggatggagagagtatgaatgaatccatcaataataacgttcaatttttaaatgtgcagacatagagttaaggcgacaacaaacgaatggcagggattgtgacttgggatagggaccctttggagtttggagcacttttttttatttggtgctctttggagatgttgtgacagtgtcgaccgtacatttttcaaactagttaaactaatttaaattttatgtctaataaagtagtgaagaggtaaatatatgtgatatatctatccaagtataacagaaaatttcagcgaactatggttttgtttgatcctccggactattaaatagtctttcagaatcttactatctaggagtattaaacgtagattactgacaaaacccattctataacccctagactattttacgagacgaatctaacgaagcatattaatccaggatttgctacagtgatgctacagtaatcatccgctaagctatgtcgcaatcacctcactagtcacagagttgggataagcttgcctctctctcaagaaaaagttaatcgccggctaaatttattaagatttgcaaggccgtgtggagcaaggcacaaggccgtcactcttcacatgctttcatcaaaacaccaagattacatcacctgcttcatggcgtcgcctgccgttacggtgtgcacccttgtcatcggtttccatgatcatctcatatattctctcatctactggctgcttgatttcgattatattgagttgcttcctcttgtttgatttttgcattgatcgatcggtggtccctgcagtgattgccacgatcatcttcgttgtggcgttcgcggcgttgctggtcaaggtgtaccggggcgccgagagctgcggcgccgcggtggccgccgagatgaaggcgacggcgcactacgccgtggtgcccgacgccgcgatgcggagcgcgacggtggagagg

SEQ ID NO: 28584 - DNA, 1501 bp, Oryza sativa
cctccatggcggccgagcacgcgcgcagaggcgtttcgtcgaacaggtcgcgcgcgtagaaactgcacgagagaggaaaaccaagaatcaagaacccaacaacccgcagctcaactcccagcacaagaatcgagatcgtagcacaagaaacgacgctcgagaagaaattgattggtcagggaagaacatccagagaaggaggatcgatgcaagaagagttggaagccgtacctcgaaaccgctcgggcaggcgtttcgtcgaacaggtggagcgcgtgggaactgcacaagaccaaaagaatcaagaagccatgaatccacagcacaactccaagcaagatttgagatcgtaacacagcaaagcacactcgaggagagattgatccgtgaagaacattctaggggaggggatcgatgcatggagagatggaagggaggagggagctgtgtgtacctcgaaatgtcgaattcgcgattcgcctcgcgcgctccggggaaaggttcactgctccctcgatggaaacatgggcggttcaggttggataaatgtgtctgccggaatgaaatactctgtccggttaaataatatggactccgtttcacaacgcaagtcattctagcattttccgcattcaaatttattttaatgaatctagacagataataaatctagatagatatatatatctagattcattaatatcaatataaatatacgaaatgctaaaatgacttacatggtaaaacggaggaagtccttggagtaatgtggttatagaatctagtctactccataagtcccaaaaagatcccttatagaacaacgaatctgagctaccatttatccagatttgttagttttttttggacggagggagtatgtaattcctccatttcatattactaaatcattttgactttggtcaaaatcaaactactctaaatttaattaagtttataaataaatatagtagtatttattacaccaaataagtttcattgaatctataatcgaatatattttcatgatataattgttttcggttgaaaatgttagtatttttttttacaaatttgaccaaacttgaaacatatttactttgatcaaagttaaaaatgacttgtaatctgaagtagagcgagtagtcaataaataaattttgatcataatagttagggttaattggatccatgccactgcaactttaccaaattaaaaacatgccattactattcgttgtataggctacatgccactggaaatttctaaaattgaaaccatgccactcttgtcacgttttccgtctcctctctcatgtcgtttcttttcctccagtttaatcgtttcccctcatgtttcctctcctctcctctcctcttcttctcctctcctctcttccgaccaacctcccaccaccacaccgctcctcctcctcctgctgttgctgcaaccgtgctgccctcgagaaactaagtctttgatcaccgctggtaaacaaca

SEQ ID NO: 28585 - DNA, 1501 bp, Oryza sativa
cctgacggtgcccgaaatcgattgggcgatctgcagcgggttcatccgcaagtgcaccgtcgtcccgggaacgaaagggtagaacggcgagaaggagaagccgatgtactcgtcgcgcgacaccacgaactcgaatgtgccctcccgtgggtagtaggtcacctcgaacggcgtcacgccctgcatcgccagccacacctcggacaccaccttgttgtcttcgaccccgggcctcgggtggtggccgccgcgcgcgcggggcgcgcgccgcaccccgacaagcagctcgccgtcgccgtcgccgtcgccgccgccgcggcgcatgaagaccacggtgtccctggtggcgaggcgcttggctttgacgaaccctctccagccgtcgttgtcgttgacgccgaggtcgccgagcatgtagcggcagcgcttcttgtcccagatgtgcacgaactcgaagcgcttgcctcgcaggtccctcacgtcgaagagccgggcggtctggtaggcggcgatgtcgagcggcggaaggacgtgctcggcgccggcggggaggacgagggcgttgctggtgacgtcggccggcgacagctgcttctcgaagaagcggaaccccggctcgccgtgggcggggacctggcgccgcgcggtcgtgtcgtcgtggctgcctggaaggagggagatggtggcgtacgcctcgccgctctcggcgtcgacgtcgaggacgaggtcggcaacggtgcagggcacggggtggatggggtccgggaggcgggagagcagcagcgcgggatcctcggcgcactgttcgatgtggccatgggggatgtagtagaccagtgtgccgacgccggggaggacgccggagtacgggacggcgcaggcgtgccagacatcccggtcgatgactaccggcggcgggacggcggcggcggcggcggcgtcaggcggctgcgccattgttcgatctcctccacgggaggtagtggaagtggtggaaatgtgttgaattcgaaattcgaattgacgccagcagatggggtttatatatacacgccacgccgccacctccacttcgttaacccttctcctttcgtcttgctaattacagtgattaatccgttattacatgtttctttcttgtcggctacgttttaaatgaccagttagttacaggcttacagctagccagcgtccacttgcacggttttttactgttatttcttttcgttttttctttttttttgcttgggttacctctctgcaaggaaaaatatcagtaaaaaaaatcgtctacattgttctggacggaggaggccagggttcaaaattttagaaatatcgaaccccgatatgatatttatttcggcagaaaattttaatgtttttaattttttcatgaattttaacaatatttgttcaaatgtgactaaatttcgttcaaaatatcggaccgaaattttgaacatatcgtcatatcagcgtcccgatacaaatacccact

SEQ ID NO: 28586 - DNA, 1501 bp, Oryza sativa
aggtggagtttgtgtgggccgtcgaggacggcgcgccgcccatcgtcgggccacggggcaaggtcaccgccattgccaccggacagctgtggcgaaatctcgaggtaatccattcttgacagcttcctgacatccatgccaatgaattttcattttgtttgtttgattgttttttgtccctcatcagcacagcatcatcatcgatttcgttcttgcatgcccagtgttactgttttgttcatgcaagattgatcactaccgcgtgattgattattactcaataattgcattgatatggattctactctgctcgttgtgcacatcttcagattgtatgggatggaaactcggagatggacatgagtgccaacttttggcaagttcgacctgttgaggaagttgatatttctccttctactcctcctccgaagaggctcaagaattgtgagattgatgataccgcctctacttctgtttccgtcgacaatggagatgagcaagttccaacgatgaggcaacggctagaggcgctgattcctgataacatctgaggccaagtacacctgcttgtgactaactcaagtaaaaattagttctgtcacttgcgagttgtgactttgtgagattgggtccgtcatgaatcagctttggtctgcatttagtttgaaggttattccgaatagtttcaaaattcggggaacaagtttgcagtgttaaatgtccattctaaatctgacggaattggaaaatggtgtacctgaaatctgatatctgaagaacacgaacagttcagatcgagatgacataacgacaattttatctgttagttacgactaatatctcaaggctgcttcctgcactgaacttaaaattcatagaatgcagtcaaatcctgtcaggtttttggacgccgacaattctgatgatcatagatcagctaatggttcaattcacgttgctagtgaaaacaaccaaattgcgtaaagccttggctaatgctgtagtttagcagatggtttgggacttgggacagtcactgctcaaggactaggttcagagttgagacttgagaccaataatctatgttccgttgttacaaaaaaccgttgcaaggacggcaatctgaaacttgttgccggttgagattgagtggagctgtttgacaatacgtttaactgggcatcagcttcagacacagacgcagttacaagcctctgtctgaatggatgctactggtggttccgactgacattttacattggtgaaattattgtttgatccattgtgcattactgctggaaaatgacttatctttgctaaaaatccagtgaaatagaacaaatcaactcaaacctgaactttctgaaaattcagactcgatatctgaattctgaactgtttttagataaaaaaacaaatttaactatggttatacgttaactagttgttgtttaatttgttttttcttgcgagatgtacaaattgaatttaaacttgtata

SEQ ID NO: 28587 - DNA, 1501 bp, Oryza sativa
aaacagcttcagcaaaacaagaagtctgtttcctcgtcatccaccttccgactctttggcaaaaaaatgacacctggcgtgccaccaagaagagacaccagtggtctttctggacaggtgagctcaacattgcagtaacaaaagtttgcattctcctattgatgatcatggaatttgtaggtatcattattcagccattatcttccccatgatgaggacgatggacaagttccaacgatgaggcaacggctagagacgctgtttcctgataacatctgaggccaaggacacctacctaactaaagatttgctctgtcacttgtgactttgcgagactgggtccgtcatgaatcatctatgccagctttggtctgaatttagtttgaaggttattctgaatagtttcaaaattcggggaacaagtttgcagtgttaaatgtccattctaaatctgacggaattggaaaatggtgtatctgcaatctgatatctgaagaacgcgaacagttcagatcgagatgacataaccgacaatttcatctattagttacaacttacaactaatatctgaaggctgctgcctgcactgaacttaaaatttttacagaatgcagccaaagacctgtcaggttttcggacgacgacaattctgataatcacaaatcaactaatggttgaattcctgttgctagtccaaacgaccaaattgcataaaagccttggctaattctgtagtttagcaaatggtttgggagcagtccctgctcaaggaacttggtgttttgccaggttcagagttgagaccaatatcctctgttccttggaccagtttttcagacatttttacaaaaaccgttgcaaggacgcaatctggaacttgtcgttgccggttgagattgagtggagatgttaaataactgatgacggcatcagcttcaggcacaaacgcagttacaagcctctttgtctgaatgaatgatactggtgtttccgactgacatttttacattggtgaaatggttgatccattgcgctggaaaatgacttatctttgctaaaaaaaacccagtgaaatagaacaaatcaactcaaacatgaacattctgaaaattcagacttgatatctgaattctgaactcaatccaactcatctcggtgtcgacctatataatgccccacgcaacccccagtccgatcgcacatacttttcagcccaccagcccgcacgctggtttctcattatgggcccatcagcccacatgtttgtttctttcttcattatttttggcccaccagtcctttctttttctttttcgcgggtttcggcccactatgtgtacgtgcttcctttccttttttttattttccgaaattttcaactcaaatttgattcaaattgtaaaactttcaaaacagactttgagaacttccaactccaatttcaaaacttttaactcagatcttaaatactttcaactcaaattttaaaaactttcatctc

SEQ ID NO: 28588 - DNA, 1501 bp, Oryza sativa
tcgagagcggaagacctagacctagatagttacaaggaagcgggctgatggggcattgcaaaagctcagcgatggccgttgcctcgggttcattcatgtgtatgggtacgaaggtactcttgctgaaattgatctgtagccctgagaatgcagcaaattcctcaagaatgctcttaattatttcagcctgctcaagcgatccttttaaaatgagtagggtgtcatcagcgtattgcagcgtgggaggaggagagtgagaatccagtgggtggagtaactgctcggagtggaaggcttgctgtatcatttgctgtaggacgtcagcgactagaatgaagagatatggggagagagagggtcaccctgacggactcctctcctatacttaaatgactcgcctgttgatccattgatcaagacgtgtgcttgtccagtttccaaaatctgtttgatccaattgatccatgtgtcgtcgaatcctctgcggtgtaggaccaagtataagcaatcccagttaactgtgtcaaaagctttttggaagtcaagctttagaataatcgttggttttttccttttgatcgcacattgaacaatgtcagaagctagtataaaattctccgtgattgatcttcctttgatgaatgcagactgcattggatcaattaactcaggaatttccccttgaacccggtttgctagcactttgctgataagctttggcagactgtgtagcaaggatattggcctgaaatctgttatgccgagaggggtttcttttttcggaattaaagtgatgtaagagatgttaacccctgaaagatcggctgcattggcatggaaggaattgaacagcgcgatcaggtcaggcttaagagtagagatgaagcatttgtagaactcatttgtgtagccatcaggacccgggcttttatttggaggcgagtgcaggatggcgcttgagatttcttcccaggaaaaagaggtggagagagctgacaagttgcgcattgaggggtagaggggcgacagaggaatggagtgggaagtgagttcagtgctgaagatgttccggaagtgtgcggtcgcaatttgcaatttttttggagtgtcgtagtgttctatcccatcctccaacaggagtttgattttattttttctgtggctaattgtggctgcaacatggaagaaatgactattctcatcgcctagcgtgcaccaagtgattttggatcggcgtttccattttagcgcccaaaaccagtttaactctttgaagtgctcgtggcagtgtttacgaagtgagaattccaggtctgtaagaggccgccactcttcacagcgatcaaagaaatcaatgacatatttgttagtgtggaggagagattttaaaccagctttgcgtcgtttccaggctctgattttggctctcagccttctgagtttaaagttcaaaatggagaccggagagataggtctagcggccttaagcaggtcgttttac

SEQ ID NO: 28589 - DNA, 1501 bp, Oryza sativa
tacgtttaatatttataattagtgtcaaacatccgatgtgatagggacttaaaagattagtcccatctaaacacggtctcacccaccctttcatgttcatgtctgctatggcagaattaatggatcaataagtttgagtatgaggtgacttactggtgcaagggatgtcacattggggtgccgcagagggcgcaagctaggtggacggcgcgagcttgtggccatggcatcaaaggcggcatggtcatcggaggcctcaacattagcaagaagcgattgcccgtcatctggcttgccgatgctaacctccattgtctaggtgtgatctgcggcatatattgagaatattgagttgcggacaccaatcaattcaatctaaaagcttaattaaattgacgagcgaatacttatattccaacactccccccacactatattggaaaacttcccctcgctcaaggcttccttagtcaatggtcccttatatctcaaacgtcgaatataatatacatgagttatacgattttatttaattgtgctacctaggacttgaacttaaaacatctaactctcataccttattgaattacatgagaaaaaatggacaattcacaatatacgaacacaaacaaattttaactatagttttgctaggaaaattggaaaaaaccaatttagagcaaatccacaaaataatttgtctagttatgaacgacctggtgaaggcttatcagatagctccgcatgagcaatgaatgagcttaagcccaggtgcacggagattcaaatgtacacggaactaattcaaattggtgtagcatactcgccaaggtagagtttgtattaaatatgtttacattgtcagttagtgattggatttgtagctaaactcttattttagactattttaaacaagagatgcaccatctgagatgattgcatggctagacaagagaacgactgggaggcctaaggctcgttgattccttatatattataattatcaagttcgggttgtagattttggctaaatcttgttaacaaattgtctcagtattgtcaagtttgaatcttcaatagcgttatgccgtctactaatgccgctatcgtgacagttttataactgtaaatgtaaaagaatcaggtatttgccttggcaaataaagcctttctatgcgaaagaactatttttgaggccaagatatatcgttttgcatgaggtgatacacaacaagtacaaaataagagatcaatcaaatgataagcattactttttcgacgtagctagagttcggagaagcgtaccaacgggagattgaaaggcttcactcttctcctcgaaaaaggagaaaaataaaggcttcactcttctatggatttaattaacagatcgagattgaagggggcatgcatcatgacaaggagtacttaagaacttatagagctctgccacttgttttttgttcaacttggtacgatgtgctcttgctgcgatagtgta

SEQ ID NO: 28590 - DNA, 1501 bp, Oryza sativa
ctagcgaatcaaaatcaaatcaatcgagttcgttgctcagagagatgcagtgcacgcatgtgtgtgtgcgtgtgtgtttctttgattgtacatgagaattaagaacaagttaaggagagaggtcgatccatcgatttcccctgcatgcaaggattgattttctgtgatccgtgtgttaagtaatcctagtaattaatcatgtttcatttttgtatctatgttaatttaatccatgcttgacatgacactcatatatatgtaggagctgctttatttagtttaatctagtgcattttcatacttgatgcacagctatgccaatcggaaggataggatagcgagaagcagaaccgaatggccattgaagttttcagttcctaattaacctgaagttttgtttggctgaatttgggggcggaaattggaaattgatagtttcatacaccaccatttgtccatttcatattccagcttcaaatgggcactgaacttgtccagatttctaatttgctatgtttagcttttgaattggacagtgcatgcttgatatagatttgaattattgaacctgaacaaggttttaatctgcctacatccaattgaaacatataagctgatttcaagattccaatatttgaacctgaacaaggcttgcatttgccttcaatcaatttgaaaaacagtacctaagggtctgtttggtgagcttaagattctgagaagcagctggctggtaaccagcagccagcttatgagaatatgaaaaaggtgggtttcccagtttctgtcttctatttattttctggattccacaactacagcttcaatctgaaccaaaagctggactgtttaggggagtttctgattctggtagaagctgcattagcttaaaaactcccccaaacatcttctgaaatcagcttttgctattcaataatcgattgacaaccaacttctctaccaagatcaaaaataggagcagtagtagtaacagacaaaacttggcgttgttgcgttggcgcgacacgtcatccgctctgctgcacgtcagaatccggtgcgcatccggcgaaccacgccgtctcgcggcgcgttctgctgctgccggcgaacggactggagcgcctggtcgaccatcgcggcgagcgacaccggcgacacggccgtgccgccggcaagcgcccgctggtaggcctcgtcgcgctcgacgtcctcgccgtccagcgccatgcgcaccagccggcggacgtcccgcggcgtcacctcgagctggtcgtcgtcgtcgagctccgcgccgtcggagcgcgccgcgaagcccgacagcagcagcgcgccgtcgctcggcccgccctcccgcgccatggcgcaccctccgccgccgtagacgccgtactcgtcgtcgtcctcgtcgctgatgagtacgccgtcgtcgtcgtcctctgtttccccgcacacgtcgctgagatccatgtcgctcccgatctcgtcgtcgtcgccggcg

SEQ ID NO: 28591 - DNA, 1501 bp, Oryza sativa
actaagataattcaggtctgcttgaccaaaagtcttatttatgtataaatgagctgaatacaatgaaatagattgcattggatggttgatggcatcagtcatgatttcatgacataagaattggttatgccacgcttagttgtgccggtacaggtaactaatatagtggaattgtgaagtgtcaagaagaaacagcgtgcttaagttttattatttttcatatcaatacctatattaagatgcatgcatataataagggcaggggggatatatatctaagatcaattgcaatacctttttcccatcataatagaaatggcaggtcaaatttttagcagcagaaaggctcctgagattttggcagaaatcactagaggcttgttcgacatgaagtaccagcaatgaattcactagtaatggcatgttattgaacacaattgtgccgctcaaagccaccacaaggaaaaaatggtaacactcggggtagaaatagtagtcttgtacttccaggggaaccaagtatcaatgatgctcaaaaccttcagtgtctgagaggagatgtgtcactatccacaatgatgcattcatctaaggagagattttccaacgatgggcagcctttctcgagttgcttgaagaaaccttgcttcatagcaacactaacgaagttgattgctgtgaggaagcggcaagcaaacgcagaatagtggtttagctccagtttaccagacaacacaacaatgtccagaactcgggcatatgcttctgcaaagcgtggctaatccatctgctcatatcttccgagttccgaggccgaggcaccttcgattctggtcaatctgtagaacttgaagcagaaggtgcgtatcgacgcggcggggtcgcgtagcttcagcactttgtcaaggaaactgttgaacgacaactccatcttttgatcatacttgataaagccggtttcgttccgcccaaactcatggatgtggatgttgatgcagggcacggtgcgtcagaggttgcgccaccgcgacagcacgcacgtccgcacggcctggcgcgtggtcaggaaggtcatgatgtggaggacgatgtcgtcggggagcgcgctgaaccagtccttgccatcggcgtgcgccggagccatggccgtgagcccgtgagcacacgcgcacgcccagaggcgtttcgtcgaacaggtggcgtgcgtggaaactgcacagtagaggaaaaacaaaatcaaagaatcaagaagccatgaatccgcggctcaaccgtgagcaaagatttgagaccgcggcgctcgagcagagattgaagattgaatccgtgaagaacatcgatagaagaaagatgcgagaagagatggagttgaaggtgatgggaggtgtacctcgaaatcgcgaatggtgttggcgtctcaagcgctcgattgactgcttgtttttgttgggacgctgggtgtatttgcggttttactttagtccctctgatggaagatgga

SEQ ID NO: 28592 - DNA, 1501 bp, Oryza sativa
ctgaacttcttggtgatccaaactctgaagctgatcgatcaagcttgcatgcaaactaacaatgcgtgtagcatatgcagctgtaatctggggctgaatttatagcactcaaggggctatcgtgttgggacagcaaccaaagaactgttcaacacgcgctgcagtaaccaggtcaagtcagaaaaaagaacgcgggagatatgataattaacctgacagcgacaggcatatcgtatctcattagattaaaaaatgcagaagaaaacctgaacaaaagaactaggactctgcttacttccctcaagaagaaaaaacagagagggtctcctgtctgaattattcattgccgccgttgatatgaagtattcatcgacgcaatcactcagtttcgacccttccattcatcaaattttgcagaaaactcccttactttctctttttcagaacgcggtcctatacttgaattttttttcaccttcacataagatatatcaggatctagagggcctttacataagaatacataagacagtgaacttacatttagagacttaagaaagattatcaagttaagcgaggactttttgtaaaattgccagctcgtgcaccaggtgatgtggccatcaccggaagcgaacatgccagtaagaaaagcctcggagcgctctggtgcgagcagatcgccttcatctttaattactccgattgactcctgaacaaaataaaaagaagaagagaaaagtcaaatcttctaatcttcatcacaaataaaatctcatgttctcccaaatcccaatgttaaggcgtaataaggctccaggttagggtgactgcggcctaagggagcaatttctactgggcaagaggatgttgggtatccaagcaagcgacggcggaggcgccattgccgccgtatgcggttctccctgagccatcgctgccgcccccaccgcctccgctcggtacttccaaacttcggtcgcggcggataaggcagagctcgccggagaaagttggaggcaccaccgtcgccgtgtcgccggagagccgagcgcgtcaccgtgccgattcgattttgagtttacctaagggtttttgtgaaaaatgacgtactaaattattacacctccgtcttaaaataaatgcaaccatgagtttccatgttcaattttgaccgtcgtcttatttaaatttttttatgattaatatttttattgttataagattataaaatatgaataatattttatgcgtgacttatgttttttagttttttttaaaaaaataaataagatgaacgatcaaaagttggacacgaaaatttatgattacgcttattttgggagtattaccttattccacaccgtctgatcaagtataggtggtggagattaaagaaaggcaatattgcaacacgcccccccttacaatgtttcctttcccaattcggactcgtaatccgaatccgaatgagatttaaaacattcggcgccggcggcgg

SEQ ID NO: 28593 - DNA, 1501 bp, Oryza sativa
cagtaaaaagccgggtatttgacctgttttctaaaaaaaaagattcatgatcttagcacaagaaatacaaattgatcagcggaatgattcaagaaacgtttggtgaaaagaggggagccatacctccaatggtgctcgcgtcttctctcgagtgcactacgggacgagtggtttgtttgcttcctttaacctggactgagcggcgacggtggacaccaccggcgacgagaggatccggtggtcctcgcattggtagtgtgccaccattggaatggagaagaagattggggatttttatgaaaaacaatttgaacttttttagtttctgatttttaaaataaacattttcaagcgaaatttttatatataataattatttaccgtgaaattaaataagtactccctccgttttaggttataatacgtataatatttacattatcaaactagttttattaaattaataattaaatatatttttatgataaatttatcttgagtcaaaaatattactattttttctatataattggtcaaacttaaaacattttgactttgtattttgggacgttgagcttaacagagtccgcctaggacgctatcagccagagcgtccttcttcctagttttctaaatatatgtttttatttactatttcctccgtttgtcctaggcggactatgttaagctcagcgtcccaaaatcataaattaaaattatctagaaataatgtggtccgggggcttcaaaatcaaaccgagcttgtatacttattgagtacagttcctcatcatatccaagtccccgaaagatctcatttctcatatctttgaatgtggtagtgtcatatgctggaagtgttatttttagaggaatactatattctgcacccatagctccatattggattcttctacccacatacacaagaacaataatcatgttttcatctgctatacctgcaaataggaagcacatatgcaattcaatcaattcaatgagtatgaagatctatatagtaggggttgtttggttggttgccacatattgctacgccacacttttatgcacaattttttaggtatgtgtttgtttcgctatcgcaattgtgtcataacacactttcttagccttagacccacatgtcatactcttaaagttggagctaagcatgtcatactctcaaagttggagctaagcatgccacacttgtagccaactatttttaagccacacttttttttaaaccatttttaaaccacacttatgccaccatgcctcaactagcctaaacttagttatggcaaggttagacatcaagcaaacattcccttaatgtattaatcgaggcctctgccatgtaagtactactccatattacgtaataactttcctagcaaactggtccaatgtaaataatctatatctgcctgttatattaataataatccattattttcagattaaactggtccaatgtaaataatatatatctgcatca

SEQ ID NO: 28594 - DNA, 1501 bp, Oryza sativa
gacgacgccgacggtgtcgtcgaccacgacatggacacaatggaggacgtgatctgccgagcgccgctccgcgagctgatggcggatgatcgcgacgacgatggcgcctcggtggcggagcgggcgttccgggagatgttggccgggatcgagcaccagacgctgctcccggaggtcgagccggaggtgtcgaaggccgcggcgcgcgtccgggcggtgtgcgagggtcgcccggaggaggagatcgccgggctcgagctccgcctgcacgtcctgctcgtggtgcacgtgttcggaggcgccggcgacgacgacgagatcgggagcgacatggatctcagcgacgtgtgcggggaaacagaggacgacgacgacggcgtactcatcagcgacgaggacgacgacgagtacggcgtctacggcggcggagggtgcgccatggcgcgggagggcgggccgagcgacggcgcgctgctgctgtcgggcttcgcggcgcgctccgacggcgcggagctcgacgacgacgaccagctcgaggtgacgccgcgggacgtccgccggctggtgcgcatggcgctggacggcgaggacgtcgagcgcgacgaggcctaccagcgggcgcttgccggcggcacggccgtgtcgccggtgtcgctcgccgcgatggtcgaccaggcgctccagtccgttcgccggcagcagcagaacgcgccgcgagacggcgtggttcgccggatgcgcaccggattctgacgtgcagcagagcggatgacgtgtcgcgccaacgcaacaacgccaagttttgtctgttactactactgctcctatttttgatcttggtagagaagttggttgtcaatcgattattgaatagcaaaagctgatttcagaagatgtttgggggagtttttaagctaatgcagcttctaccagaatcagaaactcccctaaacagtccagcttttggttcagattgaagctgtagttgtggaatccagaaaataaatagaagacagaaactgggaaacccacctttttcatattctcataagctggctgctggttaccagccagctgcttctcagaatcttaagctcaccaaacagacccttaggtactgtttttcaaattgattgaaggcaaatgcaagccttgttcaggttcaaatattggaatcttgaaatcagcttatatgtttcaattggatgtaggcagattaaaaccttgttcaggttcaataattcaaatctatatcaagcatgcactgtccaattcaaaagctaaacatagcaaattagaaatctggacaagttcagtgcccatttgaagctggaatatgaaatggacaaatggtggtgtatgaaactatcaatttccaatttccgcccccaaattcagccaaacaaaacttcaggttaattaggaactgaaaacttcaatggccattcggttctgcttctcgctatcctatccttccgattggcatagctgtgcatcaagt

SEQ ID NO: 28595 - DNA, 168 bp, Oryza sativa
atctaaaaccgatatatcacatcagtaaaaagctcgtgacattggcattaaaacgttgctcttttccagccagaggtgagaggcccagagaacatctgaagccaccacctactattgacctactttcccttctcacttgcgacttcactgacttgccacttcgccagc

SEQ ID NO: 28596 - DNA, 1501 bp, Oryza sativa
aaatatatttatttgacatctactctactgtacaatatcaattttatttattagcacatttttaagttgaccataatctaatcatttgatattaatatattttattaaataatgagttatataccattggaaagcttatgaatttagatgaatttaggttcaagtttcactcgaatcggagctaaaatgaataagttatactaatttaaagattcaaatttgagttaatccgagaaattgtaaaaatgcactgttcataaatgatttatttttaatcggaaacattatccaaaacccagtgtggttgacatgtgggaccggcatggttgacttagggtcaaacttgcttgtttaattaccattgggtcccgcctgtcataggaacaaaatatataattgtgttttcttagattttaactatagggaccccacctgccattgagtgggataatcaccgttagggataggattactgtgcgctaatcacatgtgggtcccacacggtttctctctctcctcatcttcttcttcctctcgcccgttaccgagcgatgcagaggcgcggctcggcgcagtcggcgtggccggcccgagccgggacggcggcgggcggctcggcgacggccggggtgaggcgcggaggagctccggcaatctcccgccaatggcagccggcgcgcgaggagacgggggcgcgcggcgccatcaggcgacgccatgcccgagctcggctacaaggggcttcggtgctagggacatcctccggccgaattgaagggtgcgggagcatctacggggtatggggattcgatttcacgaactatatggagaggggagctcccgggatagcctacccacggagagctcgccggcgacgaaacggcggccggggcggcacggccatgggcgctaatcgccgattttggagccggcgctagcaattagatgtatggaggacgctacaggcgcgagggtgtaccgcgagacggcgagatggcgaaacgcggcgaagtggagctcgacgcggtgcaggacaggggcagacggcggcgacgtaaggtgctcgacggcgtttctggatgtccagcggctacccggcttcccccatggcgacggcggcagcacggctcttcctccactccgtccaacctccagctccggccggggagcctcacaatggtgatctctagcggtggtgagagggtgatcgcaaggtgttcgatgaaatgcatacgagaagaaggctgagaggtatggggattttgttgagggcttcgcttaggatgcaagcaaactatggggataagatcaccagcacatgcctaggcgagctagagtactaatggtgatcggataagagcaatgaggtggatgacgcggctgagattcatctccttctccattaaggttctgtggcttaatcatcacacatataacctatagactgcaggtctgggcgctagctggaggagagggctccgttttatccattgggcgtgga

SEQ ID NO: 28597 - DNA, 186 bp, Oryza sativa
aaccaaatattccaccaggtggtgagaaggcttccagagatcactcttttttgttctttggatttgatgcagttgatatcattccaccacagtcaaatgtcatcacgcaatgacaaggagggaagaccaccccaagcactaaccagggaacaaacatttccgaaaaaaatgcacgaacggaaaaga

SEQ ID NO: 28598 - DNA, 1501 bp, Oryza sativa
ttttgtctcccccttagttcatttaggttgatgatttgctttgtgcatcaaaggtgtagtggctggatatacttattcatttatttaaaatgggaaataaatataataatatactctccccatcttaaaatataatacttcttgttcaaatacctatccatggattactatattttagaacaaagatggtactaaaatagcaagtatgttttacaaccatgacctttccacaatgccatgcactttccaatcttcatcctgtatttatgttggtttttgcaatgtgttttttaaccctgaaacagcagaagagatttctactgtaatttatgcaatgtgtcattaatggtttttctttttttcaaaactgttgtgaaggagagaaagtgaagtgcttactgactcaagtcttcctacacctatagttgtgacttgtgagataactagaaaattaaggcctcttttgggacatggaaattctatgggattttcactagaaatcactttaacgcaagcaatagttaataaaaagctttagaaatttctatcatatgttatcggtgaatgcttgggtctgcaaaataccatcaatggacatgagttttacattactatactatcaaacttcttcctttttgccatcgtcgttagagacatgttaacctttctccgttttggagttataaaaagtccaagttacccctattgtaacaggggccataaaagaccgcaatggtgcccctagtggtaagatggatattttacagtgtaaaagagaagacatgttcttaacgacgatagcaaaaatgaaaaaaaaacggaacgatggcatattatagtgcctgatattatgtaagaaggaagttgtcgatggcgtttttagaacgaagtctttgttgacagtatattgtctaatttctctaaatttttttgtgtgtcaaagaagattttggtacatgtggaatcacaaacttttgagaattcctctagctagaaactgaactatatcagttaatgaaacacatgttcttgatatgggctctaaaccgaaggtggagtcttccggcattatcggtaaaaaagaagtaaaaaataatctcaatgtcaacgccctgccagttatttgaagcattctgcaatgtcttcttgcaattaaatggcgatatttagccactatgagttattcacataaccacttgctatggacagctaggctgttcagatgctgcaacccgtgcatctaagcttgcatccctaatgagattaagatatcttgaaagatcgttgtgtagataccacagaaatatactagtataatctaggctcaagtggctcagaaacagaggcttcctgcactcttcaacggatccaaacagaggatgcaaagcacccggctaagctatatatactgatatacagcatccacgcacagtactaccttgcaagttccaaccattgttataggcaatctgatcagagcaagagagcacacgtttagaaa

SEQ ID NO: 28599 - DNA, 1501 bp, Oryza sativa
catcaaatagatttgaacatgttaccacatcagtgattgttggaattgcaggtgctattcttgaaaaagcctctaaactgactgtgttgtctacttcaacctgcaagggaaaggagatgaaattcaatatgtagaaagattcttaaaagcccttaatacgaggaagtaacctgggaaaattttattaatgcaacgctaacaaattatataaggcgtgaacaaaagaaaactatttaagaaagtaaagaaaggaaaattgtaaccttaacagtgagctcgcttgaagaagagggaacttcccaagctagcatcatatcaaaatttaggcgacgaaagcttttgtcagaaagataccctgcaacttgtgaggcatgtgcaagtgccctcaaacaacaatattccaaaaaatttcttgcataatttcttggctgctttatggaatcagatgcttgcatatcaaagtcatactgcagctcatccgtggaagtaccaagtaccctgaaatgtaattaacacaaaaggcaaatgttcagcacctaatgaaagcaaaactggtattacataagtttgtgcatgaaaagggaattgattttacatgacatagcgatttggaaaaactaatattacacaactatgccaattggcttaacagaacagtagcaaatgcaaacaacatcatattggttccatgaagcataggatgctcatcaacatgtttccaatcaagctaataaaagaattgcaggtcattctgaaaggacataaactatattagctcacacaagttattcatttaccaacatcccttaaagaaaacccaccttagggacatattaaacagctatggttttgattctatattaaaattccctcggaacaagtacaatggacgcaacgaactacattgcacacagcagttgacgtttggactttggacatcataaaccaaacccatttcagatccaacacgaactcataggccctagagcacatcctgagcactacatactctaataatcgatcttcaaacatatgcaaagtaatattggttgctgataaagccaccgaacagccacttaattgcagaatttcgaagaattgtcacatccaacgcagtaacctagtagtatatcagaaagaaaatgcttccccagagcatttcccatccctagaaacccaacccaagaaatcccaattttcagtagaatctaggcaattgcgtgtgtagggaggccattaccgggagcagcgagagacgacggcgttggccttgggggagaggccggagatggagggctgcttgccggaggaggaggaggaggagctgtcggggtcatcggcgtcgtccaccggcgaagccccgcggcgggggagggcccagctgaaggagccctcccgcacgaggccctcgaacccctccatcagcagatcccgcgtccggttcatcatcgccatcctcacctcacctcacctcaccttacctcaacaggggtcggttgaa

SEQ ID NO: 28600 - DNA, 1501 bp, Oryza sativa
gtatgatcccaaagtttccaacctaaatttggtaagccagctcttggatgaaccgatcaccgttggtttacgttcatccgtacaccgatatactctatccatccaaaataaatcatcttttttatatgaatctggacatatatatttttaagtatgtctagattcacacacacatatatatatatatacagagagagagaggcgcaacgcagaagaacaacaacacacctgcgcgcatgtggtatacgtgcacagatgaacttgttgtgttaatatatatatatatatatatatatatatatatatatatatatatatatatacatacatatacatatatacatatacatacatatacatatacatacatatacatatacatacatatacatatatatatacatatatatacatatacatatatatatacatatatatacatatatacatatatatatacatatacatatatatatatatatatatatatacatatatatacatatatatatatatatactaggagagcaaagctttcccattttaaaaaaagagagtacaagttcagtttttccatcacaccttttctccctctagtttcagtttcagtttcagtttcagtttcatatataaaaataaaatatgcttagggtatgtccagattcacactaaaaaaagtttgttttgggattgaggaagaatcgactaggatgtgctacggtgaattaatctacaagctagtgtgaaccatgtatacctttcttcatcagctaccggaacaattggattacacatctgttagaccaatggaactgaagtagcgtgcaaccggccggtcataatgtgcaggacgggactatacatgtcacatatatgccacagaggcatgcacaaaagctgcaggaacttgtagcgaatagcgatacatatatgctcgggtgccatccattatatgcgacgcgagcatccaatcggggcagcatagtaggtaggccaccaaaacggaccgatccggtttacgcgctcggcgccaatcttgtaaccgcaccaacacatcatatcggccgcatttgggacactgttactccccctgttgtcacgacgtgtcgagtcgagactcgagagaggcagccgcttcacgcgggcgcgcgccggtgaaacgaaacgaagaatttgtccattcttccctcctgggataatggcccggccgcctgatctgtgcggcgctggcgggggcagataaggcaggtcgcgcaacgcaacggcacagcagagcagcgccttcatgtgaaaggggccagaattaaacggtcctggcagtaggaatagtaggagtggtagctagcgacagaggcaggcaggcaggccagtggctataaagactctcccccctggagggctttggactcccaacactatcatcaggcatcagcagcagcagcagcaacaacatttggccgctctgaagattggtgacggagaatgcccggcggctccctcc

SEQ ID NO: 28601 - DNA, 1501 bp, Oryza sativa
catagaaaaaaaataaaaaggttgtatataaaataaactagtttaaaaaagatgggcaaaacctttgatgtcaatcagattcatgtcgaggtcatgctgaagttgaagttatcatcgagaatccatggcatgcttcctatacattaatatgatctgccattttactgcagtctcagatgaaccatgatatggtttcctgtttctgtcatgtcatttttcttgttgtaaatggcctcatgtgtgggttcataccataccacaaagtgctcaccttgattcttttcctagctgtttaccttttgtagtagatttcctgatgatacttcaacggagcaaaaccacttttcttaattgttgcaaaatcacttctcttaattgtttagacccatttccaatctatgcaattgattataattctcatgtttgaacctgctcttggatgcaaataatacttagtacacagctgtactcatttggaacgtcaagattttaattgtgtggcatgttttgtatccctatctcagagagttgccgtagctgtacattgtgggattcgatctgcatgtgttcggttgcattgccataccatgtttcatccatgcatgattccatgtcaaatgacattcatgcgcttagccgcaaaaattagctagacagcttatcttattaggcgatgccaaatgtcagtgctatttgttgatttatgaaagaaaaatagttaagtttgttatgcatgagaacctctgaaacaagctttacgtaggaaactttgatgaaacggcactgcacggaatatgtcgtatccgcgcatgtgagttcaatggaactcaaagtctacaattgtgtgtgttggacgcatacgcgggtgtgtgcgtgtggtgttgtgtgaacttagaataagttcgtgtgcgtacttagttgtaccttcataaaaaagtaaaatgtaaaatactgttgttttgatacatggtatatgcgattagagcaagtttaatgaaagcgccggctactgtctccaaaacaaccaaattggcctagttagtatagctagtgccaaaagcggaccactatataatcggctctctacgcatttttcactgatagcttttcttttttctaacctcagctttcacggtataacctgttggagcatgcgtgcatgcatttttatctctcatcttcttttcctgcctttttttttttgccctttggggagacaaatctttccgtttcacttcccccttgggccatttgataaagtcatccttccatccaatatccatatatgatttgattcccatggtcatggtgggctgctggctgctgctatgctagtgatcgatgggtgagttgcaggtgagctcagcgcacagcgccgtggactcgctcctggggcggctgatccggatcctggaggacgaggcgaggctgctcggcggcgtccgcggcgacgtgcagttcatcaaggacgagatggagagcatcaacggcttcctcctcc

SEQ ID NO: 28602 - DNA, 1501 bp, Oryza sativa
aaaaaatcgggcgaaaaaaaagagtccgatcaaaaaaggagaaaaagcgggagaaaaaaaatgaccgatcaaaaaaacggagcgaaaaaaaaaaccaaaagaccgggcgaaaaaaccgaggaaaaaaaccgggcttaaaaaagagtccgatccaaaaaaaaagggagaaaaaaaagaaaaaaaaatgtccgatccaacaaaccggaccgaaaaaaaattgtccgatccaaaaaaatacggggcaaaaaaaagaactaaacgaatcgtttaaaaaaagagcaaaaaaaatttaaaaaagtgtccgatttcaaagaaaaagaaattatatgtgatacggtgaaataaacgaccggacgaaaaaaataaaaaaaagggcgaaaaaaacaaatatgtacaataaaaaaggaaaaaaaatcaaaacgaatccgactccgtcgactcggtaataaaagggtgaaaaaaaataaaaaaagtctgattccaaataaaaagaaattatatgtgacgcagtaaataaaatggaatcctatttatatctagaaaggtccgacactataagaaagtggcgaaaaaaaccgttcgtaaaaaaatgcactacaaaaaaaaataaaaagggcggaaaaatgtctaatttctattcgtcgttttagtagtccgtttatatctcttctttatctctaatctaatctaatctaactattttaaaagagaagtttctaccgtatattaaaaaagaaataaatgcctgagaaaataaatacggtttaaaaaacgcgtgaggaaaaaatgtcagaaaaaagcgcaaaagaaaacgcgctagaaaaaagttccgtagtccgtaaaaaagcacacgagaaaaaaatatttccatcgtctatagaaaagaaaaaaaaagcatacatggaaaaaactattagaaagaagcgctaaatagatagacacttggtcggataggatccattgactttttttctatctcggggtacacgacttttgtttcgtcatctattctcctgtattggagaccctgcatatcttcgtaggcaattatcatactatttttgtgaagtatagctactattcttgataatatattatatgaaataatattagaaaataaacatattttaattgttatacagataagagtggacagtgactctattttgtgtagacttgatcatacgaggcaatgcaggacttgattggttgcaagaatgagattaaaagaatattttagattatatgcatgttgtcatatgaataatccaattattttaagtaaagcaagcatcgtaaggttgccatcatcgaggttgggctattacatttaagatgttccaattttctgattgtcatcgacatggttatgcatgaaaaacgtatattatcattacgttttttcacccgttgcaacgcacgggcatgtttgctagtttctattacatagcaaacatgcacacatacacaaacatgatgtgtagaaaacacacaagatatt

SEQ ID NO: 28603 - DNA, 1501 bp, Oryza sativa
ttgacgcattttagtcttgatcaatcatcacatcaacaacttatctccttagaaaaaaaattccgatcctgtcaaagcccacacaccatcactcaagacatgataaaaacccgattccccgatccaaagcaagatttctaccatcgagtggcctacaaatactactatactcgcctatatagcacatactaataatctcgacaagcaagctagccatgccactgaagaaaaagaagcaatcataatctctcctttcttttgttgcaggaaagcaactgagaccaaggattccaggaagatgcccgtgaattacagctcggggtttagcgcagaaaagccgcaccaaaactcgcggcaacaaaaggaggggcaaataagatatacgacgagacgccaccatgacatctggtctgaccgaagcagcagattgcacacagaacgtccaaagttgcaagtaactgtcgatgcacacctagcgacaagttgatgtactacgttccgagcgtaagatgtgggagcagctcacgtccttttcccacattccacatgagcctcatttaaaattcatttggaagatgaggtaaattttgaggtatataaaatctgtactcatttaggtctcgtttggaagatgagaaagttttacactattaagtgtgtgcttcatataggctcccatcggatggcccaataagccaaattttgaattttcaaacttaattttgagatattttcaacgtagttttttttagcattggcttttaagttacaaagagcacatatataaaagttttacttacaaatttatttttattccctaataagccgttttggcttattagaaaaaaaaaagccaaccgatggagcctataaaccctaaccgaattttaaattttagaagttaattttaaattaatataagtgtttttagtgttttttattgtttttgtttggtattggatttaaaccactaacagagctatatcaaattttgtctctatttttttttgcttcgctgacatgttttaaccgaaaaataaataaaagaacagaactatataaaaaactaattctaaaattttgcgtttcaaacgggcttaaaactttgaaatacagaaagtggtaattcccaagaagattactgctgctatgtgggaatagaaaaaaaaatgtgctgctcaaaataaaatctcactatcttccctaaaaaaaaaatctcactcatctaaaaatatctcaggtacccctcaattctaaaaatgactttgatttttggctcagtaaagctctgattctaaaattatgtttggttgtcagccacattttaccacagtttatcatgtctaagattagataagtttgatcataattgtggcaaaattcacttttaataaatcaagtcccacacgttaatgaatcaagaaagtgtgacaagattatcttagacttgttaatgtgggactcagaatttaattatctcaacttaaacaagtactaacaa

SEQ ID NO: 28604 - DNA, 980 bp, Oryza sativa
gggcagtaggacaatatactgtactagtacatgtagtataacaattgcgttcttttggacagatcgtaagtaactagtgcactagtacgaccatgtgggattctgaaacacgagatgtgtcacttgcaaagtaactcttctggaatgtgaagtatgtcctttgtctctcgtttgtcctaatgctcaatgtttaaacgaatcttttttcccttaagaagtactaatgcaatctggaattttcttcagttaacttggatgtacttgcttcagtaatcactcctactagtaccaaaggaaatttctttgcttttcgatatcttttgatatctccattgacagctcatacttcaaaacttatagggatacactgacaacaaaaaggagaaaacaaaccagggttcgtcagttcgtgggctgctaaaaataagtgcgaatcacatggcaagcaacgtacaacgcaataataaaaatagattcttcagatcagttcattagtttcaactcccacctgcatgcactgttctgaattctgcatccatcactgccaattgtatattcaggattcttctcccgttacctcgccatgttcagttcaattagcactagtaaccctcaccttctgctaattgtttgcagctaaaatgcaccaaaaataaactttcaggcagagctcattttctgtacaagaacgcagcaacatgttcagacaaaagctgctgctaataacagggcagatttgaaccagggaaaccggagatactcaaaaagacaatttgtatcatatttccggaggcaatttacacaatcatgtgtctgttacattttcatagttatgtcgcctgacaaataaacaaaatcaagcttttgacagccctattccacctttgtacctgactgcaatgaatgtaatagaatgaaaatatacatgtatgcaaccttggaaccatatggaagaactactttccctgctccatttcagt

SEQ ID NO: 28605 - DNA, 1501 bp, Oryza sativa
tcaaggtgggtggatacactaagtaatacaaataaccatacctctgtaccctcataattgaactccaagtttgtaacaccagaaaggctccagagacactggcggagatcattagcatcaaaaccataactgaatatgaatgtattaaatttaactgatactgatgcggtcgttagtaattccatgtcctttagcataggtgtggaatcctcaatagacaaggtcagagaagtaacacttggaatagaaatagatgccttgttagccatggagaattcagtgccgtcgatggtcaaaaccttcagtgactgggacaagatctcctcatccgcaatgatgcaatcatgtaagaagagttcttccaatgctggacagccggtgtcaagttgcttgaagaaaccttggtgtaaagaaacacaggagaacccaatttttctcaggtagcatgaagtgaacactgagtgatcgagctccaatggaaaggcgaacacgacaacctcgataaccctggcctgcttctgcaaagcatggctaatccacctgttggcatctacattggaatccttgtattcattgtacccgtcccatattatgtagctgagccagaatgtgtctatcatagcggtgggatcgcggagctccaacatttggttaacgaacctcttgaatgccacctcgtcattgtagtcctcatcgtccccttggtaagcaatgaaatcaaactcatcgaagtcggcattgatgcagggcatggtgcgccagagattgcgccaccgccgggacagcacgcacgtctgcacagcctggcgcgtgttcaggaaggacatgatgtggtggaggattttgtcggggaggccactgatccggtccattcgggcagcgcgcacatgggccttgacccgcctgagcttgtgcctcccaggacgcctatccatggtggccgataccgaagaggcgtttcgtcgaacaggaggtgcacgtggaaactgcacaagagcggaagaccaaaagaagccatgaattcatacgaatcaacagcgcaagtaagcaagaactgagatcgcagtgcaagcaacgattcgcgagcagaatctaccggtgaagaactcccagtcagtggcgcagctaggaattttttcttgggtagtgctagttcacacgttcatgtcacatgctaaaattttcttgtaccataaagccgatatacaaatacaaatttagtgaaaatgcgataaaaataatgtcttacagcatctgtaggaacttgtcgtggttcttcttcaggtacaggagcttcatcaccaatgaatacattcgaagaactagaagattctggaatctccattgtttttgcttcatggttcccaaataatgacgcaatatctccgctcctcttcatgttttaccaatcctacaaacaatagcacacattcactaatcagtaacaacttataaattgcatattcagttattcttattcacaaattcactgatctctaat

SEQ ID NO: 28606 - DNA, 1501 bp, Oryza sativa
aaatcgaatcctacgcgatacgtgtgcagagatttcagaagaagaagaaaaaaagaaaaccacggaattaaacattcagaaaaattttcagaaaagagcacccccaaaccgcatgcaattgcaaagtaagcgatcgatcgaatccgatccatctccagcgcacctgagatgccaatgtcgtagccgaagatgaggccaccggaggccgccatgaggcaggtaaccacgaccgggaacgtgaggccgccgccgctgccgccaccgccgccgtagtccgccatgccgccgctattgaggagggagccgccgggcattctccgtcaccaatcttcagagcggccaaatgttgttgctgctgctgctgctgatgcctgatgatagtgttgggagtccaaagccctccaggggggagagtctttatagccactggcctgcctgcctgcctctgtcgctagctaccactcctactattcctactgccaggaccgtttaattctggcccctttcacatgaaggcgctgctctgctgtgccgttgcgttgcgcgacctgccttatctgcccccgccagcgccgcacagatcaggcggccgggccattatcccaggagggaagaatggacaaattcttcgtttcgtttcaccggcgcgcgcccgcgtgaagcggctgcctctctcgagtctcgactcgacacgtcgtgacaacagggggagtaacagtgtcccaaatgcggccgatatgatgtgttggtgcggttacaagattggcgccgagcgcgtaaaccggatcggtccgttttggtggcctacctactatgctgccccgattggatgctcgcgtcgcatataatggatggcacccgagcatatatgtatcgctattcgctacaagttcctgcagcttttgtgcatgcctctgtggcatatatgtgacatgtatagtcccgtcctgcacattatgaccggccggttgcacgctacttcagttccattggtctaacagatgtgtaatccaattgttccggtagctgatgaagaaaggtatacatggttcacactagcttgtagattaattcaccgtagcacatcctagtcgattcttcctcaatcccaaaacaaactttttttagtgtgaatctggacataccctaagcatattttatttttatatatgaaactgaaactgaaactgaaactgaaactagagggagaaaaggtgtgatggaaaaactgaacttgtactctctttttttaaaatgggaaagctttgctctcctagtatatatatatatatatgtatatatatgtatatatatatatatatatatatatgtatatgtatatatatatgtatatatgtatatatatgtatatatatatgtatatgtatatatatgtatatatatatgtatatgtatgtatatgtatatgtatgtatatgtatatgtatgtatatgtatatatgtatatgtatgtatatatatatatatatatatatatata

SEQ ID NO: 28607 - DNA, 1501 bp, Oryza sativa
aactgcacaagagcggaagaacaagaagccatgaatccacagcacaaatcaaatcaaaagctgagatgtcagtgaaaggatcgagtcccgaatgcctagcaggaatgtgcccgtgaagaactcccagagaggaaagatgcagcaaggatgggggaaggaaggaaggagggagccgtacctccagctccaatggcggccgcgtctcgagcgcaccacgtcttttccattttaatagaaaaaacctgactactctgttagatgggctgataatcgccaatgggctgggccctgttgtctattctggcccaagatgtacaactgtcttcttgtttcttttgtgttttgcaaagccacaattaccgtccactctaattgttccacaaaattcaaaaaaaatattttgttcttatattattatgtttaagaaacaatgataatttttttcttatattaccatcaagaagataatggcattaccacgcatagtttctcttttgttagacatggtgcatattatggaacagaacatgagagattatgcatgataggtgaaacgaaatgttttccataccagtaaaaaaaagtgcaataatttctgaaatggccagtttatttgagctacctttgatggccatatgaaatattacagggtgtctcttgatttcaggctacagaaatattcagaagtttcaatcacctttttattctttggatgacaatcaaatggttgctatcatcactcgtctattacttatttataaacaaagtcccttctcttttaaatagaaactaaaaaaatgaatctaaatatgaaattcataaaattacatgcaaaaaaactttgataaagtaaataaactaaaacggtatataacaaagaagttgaagataaaatgaactgaaaattacacatcatatagcattgcaaatttaggactaacaatgtaagatttatgatgcctgaaaatttacaaaattttaggcattcgaaaatctagcaaatacctagattaaaatctcaagtggcagcatcaactgatttgttgtcttgaaataacgtttgattatttgctttattcaaaattaatgtaaatatgctaaaatataattcatatttaaaagtctctttaatggtaaacttttcacaacaacataaataaatttatgtattattttaaatataacgaatggaaatatcatgtaaaaagtcaacagcgttatctattaaaggattactccataaatactttacctaaaggatgatttttttctctcaaaggttttaccaaaaatgtggcaacacaaattgttggatttcgtcgccatgaagattcgttgatcgtgattgttgcacattcttggcgaagccaattaagtgagcagtttgtgtggtggggtgctgtgatatgtacttgctcacgtcgtgatgggaaaaaagtttaatctacataagaatgtttttgtaaaatgaaaacgaaactgaagagactcgacaaaaata

SEQ ID NO: 28608 - DNA, 428 bp, Oryza sativa
tcatagataatttgagtgatagcaagaagaataagcagcttcgataagaatacgttgagcataatattagcctgagattgacaggactccatgacacacggatatcgggatatgaaatgatggttattcttgtttttggccgacttgtagccctttatttttctatctaatgggatgactgtaagtcttttgcgtgtttcaaaactaaacaatgctagaacacctttgtatgggtagcaaatgtgacagtggagagaaaaaagttgcacaccttaatgtcagtatcaaaacactgcaaattcattgttgtccaaagatattcctcagtgacgatatttgatccataatctattgcaccccaactccatgttcatgagtggtaaccaaaatatacgactgaagtaccaagaatcctagtagaactgaca

SEQ ID NO: 28609 - DNA, 237 bp, Oryza sativa
caaaccgggtagtaagcaataaatacactcttactacctggtattaagcattgtggggctagtacataactacaaccgggtcatacccctactgccggaagcaaggaaatagaatatgcatgtacacagtgttttctgacagcaaaagcattgcttctcccaaccgttgcatgcatgctctgtccttgctacgatttttattaccccatggaccccaccttactgccaactcacaga

SEQ ID NO: 28610 - DNA, 1501 bp, Oryza sativa
atatatggttttccttgtttgcccctatttattgcagagtctatccttaatatagaaagtagccaagtttgttataacaaaaagattcatatgaaaaaggtattgtccttggaaaaaaagtatattttactctctcaaaatattcttaaccccaaaactatttttggctcattttacacccaaaccattcaaaacaattcattttactccatagttgtattttccatttttttctctttctatataaatcatagtttgcactgaaatttggtacgatcataggtgcattataactcgcatcacaacattttataaatttattatcactgtttatataggttgaaagaaccaaagactaattcaaacaatgatattttttaaaaagcaatcagtcatgaaaaattgaaatacttttgagctttgataatatggtgtcatctacggctctcaaaatttcagcttatatatgactagtataaagaggaaaagtaagagaaagagaaatgttattaagagtaaagtgaattgtgttttcaactgtttagggggtaattagttgaaagggttaaataatttaattgaatagattgaggaagtaaaatggagttttctttcttagagcctattggttgtccatgagccgattataaataaacgacttattaatgacttaaataataatttatgagttaaacttttctataggtaggagtacttagcaacttaaaaatccaaagtaaaaataatctacgttgaaaataccataaaatatattacttttaaaatttaaattttggtagaggctaacccttgtccttatgcaatagtttttggatgttggtacaaacattaggtgtcataatataaattatgacttacttactttacaatgccaaaaacgataccttttgtgcctgtgtaacacgctagacacatcttaagctcccacatactttctcagttctcatgaacaacgaccacgccatcgatcctatgcaataattaattcatacctccaagaaagtaattaacttataaactatacgtgattcatcgtttgcacgtgtgcgaaaacgaccatttaatttgccggcaaagaagcttctattccatgggcttgtttggaagattagcccatggctaattttgagagctaatgtttagtcatgaattggtaggctaaacattagcccagagtggtatgtttggatccatgggctaattcaagactaaaaggtggagagagagtaaaaagagaggagagagaaggagagagagggctgcctttttatggtccccatgcaaaattagccccattagcaccccttggaggggctaatgtttggagggaggctaattcactttaaccaaaaattagcccacatgtttggatacttgagggccaattcatggctaaaaggtgggggctaatgtttagcccatggaaccaaacagggcccatgactcttaccactcaaaattaaaggaacacgtttttttt

SEQ ID NO: 28611 - DNA, 1501 bp, Oryza sativa
cagcctcttccccaacgacgtcgccattgccatcaccgaccaccgcaaggtgaagcccaagcccaagcccaagaccaccatggaggtgcactacaagatggatggcaatggcgacatcgagggcggtgctcctgccatgacgccatcgccatgcatgccgatggcgacggcagcttagaggatttcttttcttttctttttgacctgccaagccaacgcgtccacatgcacatgcatggttttagcggtttgaatttgataagatgaatatttgaaatacaaagtgcctatgaaaatttatattgttaatattttttgagtaagttgaactttatgtatctactagaagatggtatgtgctttactgttaaatactccatccgtttcaaaatatttgacgccgttaactttttctcacatgtttgaccgttcgtcttattcagaaaaaattatgaaatatgtaaaactatatgtgtacatgaaagtatatttaacaataaatcaaatgatatgaaaataataaataattacttaatttttttaataagacgaatggtcaaacatatactaaaaagttaacggtgtcaaacattttaaaacggagggagtatatggattagatgactatatattaaatgttatagaaatgataggtaaaatttagtttaatatatcgtgaaaataatgtaagtaatgatgatttagcatgtttttatgttgaactttaaaagataataaatcataaatataatattatagttttaggtgtttaatgggtaggaactttagagtaggtataagtttggttacatactttgagcctgtgacgccctagaataatcggggaaaaaaaaagatggagcaggcagcagcagctagctagctgtagctggcggcccattttgctggtggccttgggcccatttgcaataagcataaataaagcggaaaaagttcacttcagttccttcatctgtcatcaagcttcaaaccgttcctaaaccggaatactaaatataatacatccattatctttcaaaaccgagtcacactaaaggtgtgtttagttctaaagttttttttttccaaactttcaacttttcatcacatcaaaccttacttttcagtcacatcgtctccaacttcaaccaaattccaatctaaacacagcctaggtagtaaggcaatgttgcttccggttttaacagacgtagcactcttaaagcaaaaattaaaaaaaacataaaaaaccacgtgggatccgcatgtcagtgaagctttagacggttgacttaagtgaacgagctcctgctcgcgcatcggcctggcgcgcctctcctgctctgttggaccgccgcgcccagagcgctcgaccagtcggcgggcgatggtcgccgaggtgggcgaggaggcgggcaccgcggcggaatcgcatcgggagcggaacgccatcgccagccgcatccgccgcgccgacgccaccgcagcgcgtcgcccctac

SEQ ID NO: 28612 - DNA, 1501 bp, Oryza sativa
ctgttgatggatacgtcacttaccactgacagaataattagccgcaaatgtgagcacccatgtcaattttagaacttgaacccgactaggttggtttcagcaaaataaactaaccagttaaattatactcacttcaccttttgggtttgacttttgaccgcatatagcagaaaggcaaaagccttaatttaaaattacaattttcgttattatagaaaaatatattgaaaagtacaaccacagagtttataacttatttctatatatatagagagtaataataacatagttaaaatgtatacttgcatgtttaggcatggcggataataaaaataaaaaataaagcccaaaaccctatcgaaaagatcaaggcaaaatttactacagaatacttaaaaaacgtgtaattagttgtgggacaccgcaaatatgtgaattggctataggacatcccaaaagagtgataattagctactaaacaccggagacattattttatcatttctggtggaaacggagagaggaacaatggaaaaaggaccagatttccctatgtgagccaaggatgtcagcatctccactattttcatgtcctcttactcctgatgaggcacaccacacgcaatacggcgccgctgacaccgtccttctccatcacgccggcaggctcgtacgcaaacgtgggtagggcatcgatggcgtgataattagctactagacaccggagacattattttatcatttccggtggaaacggagagaggaacaatggaaaaaggaccagatttccctatgtgagccaaggatgtcagcatctccactattttcatgtcctcttactcctgatgaggcacaccacacgcaatgcggcgccgctgacaccgtccttctccatcacgctggcaggctcgtacgcaaacgtgggtagggcatcaatggcgtcgcggacactcacatcgtgcccactatgccacgtcacgctctccgcgcgcaccctcgccgccctcgccgccgcctgcgcacagcgatgcagccgcaaccggcgaggacggcgacgccaatgcaaggcggtaggtgctgcatcgacgagaagtggtgctattccatcggctccttgccgtggccgccagagccagtgcccgaggcagcggctgttgctcggcttgctcctctcgccttgcttgcgcctgggctagcatctgatgcacctgcaccgccacagccccagacggcggcttcttgatggcatgcgactctaacacaagcaaacgacacgggggtatgttggtacttccagcgctctttctctctctgtttccactagaataataaaataatgcatcaagtgtctagtagctaattaccactattttataatatcctacagccaattcacatctttattgagtcccacagctaattacacgttttctgagggtcccgtagcaaatattgccaaagatgaaaaccacatttccatcagcgcgcgaaatcccaatcc

SEQ ID NO: 28613 - DNA, 1501 bp, Oryza sativa
ttcaacttcgaggaagggggattaggagtttattagaggaagttgatgtgcttgctatagagattgagaatcgtgtttgggaaaggggattgggagattaagagaaaagttgatgaccttgggtgtgttcggatgctacttttcctaacctctctcactcgttttccgcgcacacgtttttcaaactgctaaacggtgtgtttttttaaatagtttttatataaaagttgcttaaaaaatcaaattaatctattttttttaaaaaaaataaatacttaattaatcgcgtgctaatgtaccgccccgtttttcgtgtgcactgtacaccgttcccatcccctggtagcgaacacaccccttgtttggttatagagatgagaatcaagcggagtttaggtgggagattcttcttttttcttttctaaacataatatagatataggtgtccatatgcgcgcagacccaccggccaccgctatccatgcacacacttacaacctatccctattagcacttttaaagattgaccaatatgtcttgagattgatgaagttattacaggtgcttcgctgtggaaggatttatcacctactactgaaagaattagaaaaaaaatagagctacaccgagaaaaaagatggaaaaatatgattcctcttcaaaaaatttaacaccaagcgtgagataaagaatttcatttcatgtggaataaagaaattcttggactacgtggtactccctccgtccaagttttcgtgcttaattttaatcgccgtcttatttaaaaaaattaaaaaacataagttacatattaagtactatttatgttttatcatataataacaataaaaatactataaaaatttcaaataagacggacgatcaaagttggacgcgaaaatttatggttgcgtttaaaatgggacggatggagttctaggaaacaaagtcaatcagtcaatctggaccgtccacggcagaagaagttggaagccgtgcgtatacgttctctttctaaagaagtcaatcagtcaatctggaccgtccacgtgtacgttttctcctcttttcctcgcaagagaaaaaaaacagaaacaaataaacaaacgaaataaagggtaaaagtcaaaagtagaaagtgctcttcgcctcttcctcctctcgcgccgccggccaatcgccggcaacctcagcccacatcaccggagagaccccgtcggctcgccgtcgccgctccccttgccggcctcctccttcccaccgccccgcatccatttcttcctccagcgaggtcagttcccccgcaaaaccgcccttctccctcgtctccggcgcctcccgctgccggatccgccgccgccgcctcctccccgggcctctctctgatcccgtattcaccggtgaccacctttactccaccggacagagcatgcagaggtggacagattgaagtaggaaaagaaaatgatcactcctcccgtcgccggtgacaccttcgccg

SEQ ID NO: 28614 - DNA, 1501 bp, Oryza sativa
tattaattagacaataattaaaccttggatactctgactgtaatgtattgtttcttgccagaggtggtggaaacagggctaatcaccattccaggaacgatttctgagctaaatacactttcgaatccaggacaacgcatatcaggacaaacattagaaccttcaatctggcattaattggagaatgagttatgacataataaatacaaaatctttattatggcaaaaaaaataaaaataaaaattgatggataggaaactgcagtgtttatgaagaaacttacaaaccaagtactgaagtgcgtctgtgaatcattgtacgattcaggctcaacctgtatgaggtacaatacaactaaatgttaaaactaaaagacatggagcaaatgattaatcaaagtaacttgtttagtgacacatcttcgattgacagtgagaagctcatgaacctgttgagcatcaaccagctaagctaatgtaggcttgaaattacaattccaaatcaagcagataagtttaacttacattccatccagctataactttattcacggcagatgcttcatccgtattgtaaatccaaatgaaacctccggtttgttgtccatgctctagattaaagccataaatgtccatggtggcctctaatccgtaatacttgatagcgtcgtctgaaggaatcgatccatatgctgcaaactgccaaagtacgtatttggtcatgaaaatcatgatcatgagtacaagtgcatcttttagatctagggaaaaaaaacatactccccaaaaaaactcaaattttagcttcctatggtggagttaagaaaggagacaaagaaccaaaatgccccaaattaataggaaagttatattagtaggtacggtgatgggatattgaaagaaatttatcgatttattcatcgatgataggtaagaagatatgagttgcattattttggaacaaatttctaactatgttttatatttggacggaaggagtatatgacactcacataatatactgggtcagcttgagttgatatatgatccgatgaagagaaattcacatgaagtagaggggccatcaatgttcgccaattcttttggacctggttaattgtttgggaaaaggggaacaaatcaatatagactagctattacttctatgtttcagttgaataaaatcgaatttgaattataacaatatatatagctcaagagaagtacctcttcttccattgtaggagagcaacctccaactattgaactactaagaaacaacacacagagtagtgcagattgagtaaaaacgttctccatgttagaagtggggaagggaagaggtatcgtgttttgtgtgtcttttgctagcctgtttcatccgctttatatagatgagtcagaaagatcttcaacttattaaatccgaaatctgaacgaaatcttcaaattcaatgagaaaacaaaaccaaatctttaattcaatgaacattaatgaaga

SEQ ID NO: 28615 - DNA, 618 bp, Oryza sativa
gattgtctccatacatattttgccaccgattcttttaaaacctcgcacatgggttcgagtgggtgtatattatcctcgtgagtttaattcgaatagcagtggcttgaaaacaccacaaataaataaaatgacacattggcacgttttccctacctaacctttttacctttttccaaccatcgtgtgtatcacaaatttcaacatgtccttgttgcggggagtacagacatgtaggaattgctctgttagctgagccatcctttttggtgatccacttctgttatctaatgcttgcttaccttgctggcaatgaccttttttatgctttgtagttagtgctttttaattagagggagcatcagcaggtagagttatgaaatcttctgcatagtttaatggccaagttgggcatcacggttcaatggccttgtcatctctagatcacatccgctagcatttctctttcattgtgtgtggtagcaacaaacacatctttggcccatttaattctgctaatagagactgtttctgtctcaactggtgaagaaaaaggattcagatgcattattgttgattaaaaattgaaaacatctaacgttcttgccttttcaattcagg

SEQ ID NO: 28616 - DNA, 495 bp, Oryza sativa
cattatttaagagtaaaaggtataagaactggtcgtctagtgcatctgccgtctgatatagctagaagcaggagactatgcaagttcacttgaaagttagaattcaaaaaatttggaatacctgacagcataagtgaatttacatgattctacaatgattatagctattctctgaacacacatacagctggtatgcaaaacttatgctacctaagcattagttcctttacggtgctcacatctagccatctagatctaggcattgatatgcacacttgagtaaagctccattttacatgcttatacttacatgatttatgtacaggaatataaggataccacccatacaagatcctcatctgaggaatggtgcatggatggattattgccatatgaggaatggtgcgtggatggattattgccaagttgtacacagatgtgtcgatttttatgatcggcaatataatttatagggtgttctatatcaaggagaga

SEQ ID NO: 28617 - DNA, 500 bp, Oryza sativa
tttacactaagattttggtccctcatggtacctcctcaaggaccatagaattactctaaaattatcatttttgtttcttcatatatagatctaatttagacttgcatgtttttatagtgtctgatatatattattatagtctatcttatcaaattttgtgatcaagtgtttatttgaaaaaaaaaatgaagtcattttgatggttcttagttcaaatccttcaagaatatctaagtagctatagtccctatagatcgagtgtttatttgaaaaaaaaaggacaataatgcttcagaaggtaaactgtttgaaaaatataaaagtacatgaagtcattttttgaaaagatagagatttgacatggggtcgaaatttgttaaaagaaattagttataagacgaactggacatgacttttttttagaaaaaaaatatatatggagaaaacctggccaaccaagttatatatattgtcaaacataggttcaatattttgcatca

SEQ ID NO: 28618 - DNA, 571 bp, Oryza sativa
aaaggtgcttcttgcatgttaaatgtgcccatgttcaatatttcatattagtatttcctgtgcaaacagagtctgttcaattctacagtgtaactacagatatctattgcattccattccttaaaatattagtatttcatgggcctttttcatttatgctcatactttccacgggattcatgtagactattaatgtatatatgtagaagcatatcgtttgacttgagaggtgatgtcatggcatttgtcttgcataatactttcataacagacagtttccatgtactatattgtaatgaaaaacatgggcaatattgcattggagactgaaaagtgaaaaattgacctgtgtttgtgaagtttgagagggcaaagattaaccttattaccaacatgtggctccgctacattgaaaatatatattttaattcttccatttggtttaatattattgatctttttgatgtagatgtcatttcagatgtgtttgcctactcattatgaattttttctttatctgttgaatggttaataaattacaactcattttcctttcttgtttatacaaagg

SEQ ID NO: 28619 - DNA, 153 bp, Oryza sativa
ttggcagtatgcagaattaatttatttaatcacctctattgacttgaaaagtaaaatctgcggggctaaagagtaaacagaaagcagcaggatgtccaaaaatacacacgtcatcgattatcacaacactagaaacaagatcccgcccgagaa

SEQ ID NO: 28620 - DNA, 1501 bp, Oryza sativa
ccggcgtaattcgggtaagcgacagcggagtctttgtgaggggcggcacgcacgaaggggtcgcaattgtagcaccagtaggaggaggacgccggcgcagcaccggcagcggaaggggaggaggagaaggaagaggaaggggaagaagccatcggaaaccactttttgttctctctcagatctgcttggaaaccactgcaagaagggatttttgtttggtttgttgtttaccggcggtggtcaaggacttaggttcctgagggcggcgcggttgcagcagcaggaggaggaggaggagcggtgttgtggtgggaggttggtcggaggagaggagaggataggagaggaaacatgaggggaaacgaataaactgggggaggggggacaaagacggcgtgagagaggagacagaaaatgtgacgggagtggcatggttctaattttagaaatttcgagtggcattgtagctgatatgacaaatagtagtggcgtttttttttaaatttagcaaagttgcagtggcatgatccaattaaccctaattattatgatcaaaattaacttaattactactcgctctgtttcagattacaagtcatttttgactttgatcaaagtccatctgtttcaagtttggtcaagtttgtataaaaaaatactaacatttttaacccaagataaatatattatgaatatattcgattatagattcagtgtaacttatttggtgttacaaatattactatatttatttataaacttgattaaatttggagtagtttgattttaaccaaagtaaaactgacttataacatgcaacacaaaatgacttataatatgaaatggacgaagtacgactagattctacaaccacattagtattattttaccggacagagtatttcattgcagcagacacatttatccaacctgaaccgtccatgtttccatcgagggagcagtaaaaaaaccattccccggagcgctcgaggcgaatcgcgaattcgacatttcgaggtacatacagctccctcctcccttccatctctccatgcatcgatcccctcccctagaatgttcttcacggatcaatctctcctcgagcgtgctttgctgtgttacgatctcaaatcttgcttggagttgtgctgtggattcatggcttattgattctttggtcttgtgcagtttccacgcgcgccacctgttcgacgaaacgcctgcctgcgcggtttcgaggtacggcttccaactcttcttgcatcgatccttcttctctatatgttcttccctgaccaatcaatgtcttctcgagcgtcgtttcttgtgcttggagttgagctgcgggttgttcggttcctgattcttggtcttcctctctcgtgcaggttccacgcgcgccacctgttcgacgaaacgcctctgcgcgcgtgctcggccgccatggagggttcacctagcaagagcaggggggtcacgggcccagcgcacactgacgacg

SEQ ID NO: 28621 - DNA, 291 bp, Oryza sativa
tcccaaaatcaaaagatcaaaccccaaagtttcccgaaacaaatccaagtgaaaaaggcatgtgcatatgaaaaggggttcagagggctcttaggttttccagttggcttgtcctacggtcaaggtcggctctgataccaacttgtcacgcccagaaattcacgaaccagaatttctaagctgaatgtgcattaaacccctgtccaggaccagccagggtacacaaacgacaattgttgacatacagatccacgtcttacaaaaatagaaaagattacaaatgcagcggaa

SEQ ID NO: 28622 - DNA, 1501 bp, Oryza sativa
ttggtttgttgtttaccagcggtgatcaaagacttagtttctcgagggcagcacggttgcagcaacagcaggaggaggaggagcggtgtggtggtgggaggttggtcggaagagaggagaggagaagaagaggagaggagaggagaggaaacatgaggggaaacgattaaactggaggaaaagaaacgacatgagagaggagacggaaaacgtgacaagagtggcatggtttcaattttagaaatttccagtggcatgtagcctatacaacgaatagtaatggcatgtttttaatttggtaaagttgcagtggcatggatccaattaaccctaactattatgatcaaaatttatttattgactactcgctctacttcagattacaagtcatttttaactttgatcaaagtaaatatgtttcaagtttggtcaaatttgtaaaaaaaaatactaacattttcaaccgaaaacaattatatcatgaaaatatattcgattatagattcaatgaaacttatttggtgtaataaatactactatatttatttataaacttaattaaatttagagtagtttgattttgaccaaagtcaaaatgatttagtaatatgaaatggaggaattacatactccctccgtccaaaaaaaactaacaaatctggataaatggtagctcagattcgttgttctataagggatctttttgggacttatggagtagactagattctataaccacattactccaaggacttcctccgttttaccatgtaagtcattttagcatttcgtatatttatattgatattaatgaatctagatatatatatctatctagatttattatctgtctagattcattaaaataaatttgaatgcggaaaatgctagaatgacttgcgttgtgaaacggagtccatattatttaaccggacagagtatttcattccggcagacacatttatccaacctgaaccgcccatgtttccatcgagggagcagtgaacctttccccggagcgcgcgaggcgaatcgcgaattcgacatttcgaggtacacacagctccctcctcccttccatctctccatgcatcgatcccctcccctagaatgttcttcacggatcaatctctcctcgagtgtgctttgctgtgttacgatctcaaatcttgcttggagttgtgctgtggattcatggcttcttgattcttttggtcttgtgcagttcccacgcgctccacctgttcgacgaaacgcctgcccgagcggtttcgaggtacggcttccaactcttcttgcatcgatcctccttctctggatgttcttccctgaccaatcaatttcttctcgagcgtcgtttcttgtgctacgatctcgattcttgtgctgggagttgagctgcgggttgttgggttcttgattcttggttttcctctctcgtgcagtttctacgcgcgcgacctgttcgacgaaacgcctctgcgcgcgtgctcggccgcca

SEQ ID NO: 28623 - DNA, 1501 bp, Oryza sativa
attgcatcttacataagttggttcatccaattgcctaattcatcagttaacctagatttcttagtctgaggctttcactgtctcatgtcacactgtcgtagctgtacttttatattatgggcatcatatattcatgttgattaacacttaagcacataattattacgatgggtcgtttattgattattgtattattgttccttgcattgctaactcgatgttgtatcgattgcgtacacacgtaacatccgataaatttaatccgttaccgaactgattccgcaccattttcgacatccgaaacaatctgctccgtatccgcatccgtacactatccgcacccgcttaaaatatatggtttaggatatggtatgaccattatcgtccgaatccgctccgttttcacccctaaatgaaacaacgcccaatttttgagaaacaaatcgggcgcccgatttgtaattgctttgaagtttttgatagctggcccttttatttccggtaatctaattgtgggtctcattttgttgagagtaaaactaaaaattccaatttggctcccttaaattataggtcaatctaattcatatccctcaaccataaaaccggatataacgaatacctcaactattaaaaccggtacaaaatgattcataagatagtattgatagtggtattggtgacgtggtacgttgacatggttaaaaatgctatgtcatcaaggaatattatgtggtgcccacatgtcagtggcctgaaacatgtgtgtcatccacactctcactctttcttcctccctctatccatcctcccatggggcctctctccctcctattcttgacagcaatgaagtccatgatcgccctcttgccgtgttcgattgcaggagcaggtttcgactgcacgttcggttgcaggagcagattttgattacacgtttaattgctagagtagatttctactgtgtgttcaattcctcttctgtgatagtgtgctcgattatcttaaacttcgacaaggacacgtgggtggcgcatcgcaagatggctgacgccagcgtaggacctacaggacgtcgagaagaatgcggattggagaggatagatgagagaagaggggagtcacttacaaacaggtccactctattttcttaattatctgataattagattgctgcatggatgccatgtcagcgaaaatcgtccttaaaacctgcatggttttacggttaagggataaggatcaaagggtaaactttttcacaagtacaaaaggtccacacttctgttgggccgaaaagcctctggcccaataaaccgagaagagcactcggcgagtcaccttcctgtttaatcgccacatggccgttggcatcggcgagaaaaagcttcaagcttctcatcgccgaggccgagcacggcagccagcaacggcggtggaggctggcttaccgagcaagttacctcccgtctatttaagacgggccccttgctctctctga

SEQ ID NO: 28624 - DNA, 286 bp, Oryza sativa
atagccttcagtagcgacgagtgtgcgacatcttttgcagcggtaagtagtgcctggatcagtggtttctaggtcaccataagttaccccatctgtgtactggtttgtttctgcagggtttggattagccactggacttgtctccagctcagtttgtactgctggtttaatatcagtttccgcgactttgtcctggcttatttccgcaggcttttgatcctccatggatcctggcatctcatcaacctctggttctgactttttctgttcaactcccaattctagc

SEQ ID NO: 28625 - DNA, 1501 bp, Oryza sativa
gcagatgaaaacatgattattgttcttgtgtatgtgggtagaagaatccaatatggagctatgggtgcagaatatagtattcctctaaaaataacacttccagcatatgacactaccacattcaaagatatgagaaatgagatctttcggggacttggatatgatgaggaactgtactcaataagtatacaagctcggtttgattttgaagcccccggaccacattatttctagataattttaatttatgattttgggacgctgagcttaacatagtccgcctaggacaaacggaggaaatagtaaataaaaacatatatttagaaaactaggaagaaggacgctctggctgatagcgtcctaggcggactctgttaagctcaacgtcccaaaatacaaagtcaaaatgttttaagtttgaccaattatatagaaaaaatagtaatatttttgactcaagataaatttatcataaaaatatatttaattattaatttaataaaactagtttgataatgtaaatattatacgtattataacctaaaacggagggagtacttatttaatttcacggtaaataattattatatataaaaatttcgcttgaaaatgtttattttaaaaatcagaaactaaaaaagttcaaattgtttttcataaaaatccccaatcttcttctccattccaatggtggcacactaccaatgcgaggaccaccggatcctctcgtcgccggtggtgtccaccgtcgccgctcagtccaggttaaaggaagcaaacaaaccactcgtcccgtagtgcactcgagagaagacgcgagcaccattggaggtatggctcccctcttttcaccaaacgtttcttgaatcattccgctgatcaatttgtatttcttgtgctaagatcatgaatctttttttttagaaaacaggtcaaatacccggctttttactgaaagccaacgtaggctaagatcatgaatcttgcttggagttgagctaggattcatggtttactgatttttggtctctgccacgtgcaacagcagcataggcgggtgaaattagaaatgtgtagatcaccatcaccacaaggagggtgtcttaaagtagtatataattaagtatacgtatatatttccaagacattgatttcaatgcacacgaaatccaaccattttcaacaaatcatgtgtgtttagaagcaatttaaaattcaacatgtgtcaaaggactgtctaatctccgcttgacagaaaaagaaaaccctaatatgttgcaaattttgggtcgtttgattgctttaagattcgagcaaatctcccaaccctaatttccatcacctctttttctttcctcttttttattccatccccgccgccgcacaagccccccattctcaacttctcctcgtgactatgctcctgtgctgccgccgacccacaacgctgccgcccggcctcatcggcttgacgaaaagcggcgacggcaccagcgaggtc

SEQ ID NO: 28626 - DNA, 1501 bp, Oryza sativa
tgcaatatcccatcccacacaagttaagaatttagagtctagccaagtgtaatacatgtcccggtgctcaataaccgtgagcacggctattcgaatagatttattttactcacactccgcgactgcccaacacatgagccttgtctcaacacatgagacgcgtcatggcaaagcttttcgataacctcacattggcagtacccgctccatgaactttacatcctcatgcactctaggcgtacacggtttctagtagtgagaggagttctggcgcacccgggaagggaagactcacacatgcattaagttataattaagtttagattctcacatggcagtcctaccgatggcgacaccacgtagacacccgccccgcggtcctaccaacggctgccccaccgtagagccccttcctcacacatcaagaaaccactatgcatggatactgcctccgcttagctatctactccgctaggtctatacccatacgagaagtgcggttgtacgggggttgtttcatgcttaacttcatggctcggtccttaattgaccagggacggcactagccttttccggacaccacccaaatcttccagccgccccagtcgaaaacagttgttttcactttattttcctttcataaatcatgtcatcaatatcatggcaatgtggcgctcatgtctccacatgccgcatctcaattaccttcccaaaggtaattgcccaagcatatagcatttgataaatatgagtatgcatgattctagaatagcatttctaagcaattgtaataattgactagggactcatatgtaatcatggttacaaagatttaagggtgatcaataaataaggcatggcataatcacaaataggatgttcatcattgcatgcaatcttatttgtaaacaaaaattaatttcgcaattgggatcaacgtgatcaaagaatagtgatgacttgcctgctcaggatagtccttattcttgatataatcttgatcaaccttctcctcctagaggttgcagacgttgcctcacgactaaccgatacacaaggtctataatatgcgagaaaaaccaatattcaagcatcaatcaaatatgcacaaataaaatatatttgttgaggtcgaacctagggttgcttatactattcgtgtttgctaatggattccaatcgtgctaggggctaaggcttcttaatctttctatcgtcagcgtggtctatttaggagttaaccaacttagtataaatgagatacacatctagctattgtgtggtttagtctagctaatggctatggaaggattatggctacacatgcatctatttaaataaaatggttatatactagaggttctgttgtcgtatggatttagggtcaatcaaataattacagtgaatcatttgtattattattttgttgatggaggcttcactttaattatgaacatattttacttgtcacaataaattataaaaggttaataattatcca

SEQ ID NO: 28627 - DNA, 1501 bp, Oryza sativa
tgaattggatttaatcttactatttctttagctaattgtgacatcaagctatcaatcatggttcgaatatttaatatctgaattgtaatttataatagaaattaatatttgactttactatcttgtgcataaatattggtagggttattaataaataacatattctcgtaaattatatctattgcttaaatttagatcttttctttactttctttgtgatcatttacggtttggcaaccaatagcaatcataacaaccagcatggtgcaaaagttttaaaaagttcaaaattttagtgatttttattgtcaggaattttcaggatattacactctctccacactcttcaagctaagctctctcatactctctcaagctttagtttagtattctcaagctagtggagtaggaagagttcgggtatggctccagcagctctcatttcttcttttgtaagacttgtactttatttagaatattcttctttatacatttctagtattgtaatactttccaagtatatgaatgctaactttactttatatccgaattatattgtttatattgctagcttatctgggagatgcaatggaacatgtatagtgtttgcttatgcaattactctatgtgatgacgatgatattagattagtatctggtagtttaggcgtagtgtctagattacaggatatcattatttggggttatatgctgcagatgagaggtgggccgctgatggtgacatctcagtacgggtactcctccgcgcgtgtatatagtcctaagttaatttcatggggagggtactcctccgtatttagtcccggttgtatggtcatgaagggcagtcataaggaactcgatagtcaggggtggcttcttgaagcaccaggagggcattggaaagagggtattagctagttaatcttatagctaggatgtatatataatatgtatactagaagtatatgaatagattcttttctattttctttccacttaactcagataatttattatgagaataagtagtcttatgcttgtgtgtcactctaccctttgcttatattaacccactctacaagtaatatataaattattagtacggttctctctgctataatcatcccacgggattaaacaaatacgatacccttggaatactctcgggtgaaatgctacactggtatatccgtgcgcttgcggataaactctgtaaccgtaatataccaggagtatttcgggcaccattgctgtgaattatatttctacttatgtcgttaaaaaataccaacaaccggctcgaattgagccgaactcactaagcaccatcactcccaaatcaaattgaaaaccccaaatcatccacaaatcatcaccaaaatcgattgacatcacataatgaacatactcaacaacaaaatcatccacaaatccaccaaaacatctaaagaaaatctacaggagacgtgggagggagaggggctggccctcgggcttca

SEQ ID NO: 28628 - DNA, 612 bp, Oryza sativa
gtcaaccttgggtaataaatcgactagctcatgttacgacctatgaaagctatcatatgtaagtgggcccggcctgggggaaggcgggacgttacagtcacacattcccagaattttgatcctaatttacaaatgttttatcgtttgcaaataaaattgcatgtcttgctaattacatgggatctgggtattacctatctgtttgcttgtgccatatttacttgatatctgtcctttgtcaaccttgggtaataaatcgactagctcatgttacttatgtgacctagctaaaactatatgcttagccatgcttaattaccactagctcagttgatgggataattacagtattagaccctttttagtatcagaatgagctgcgtgctcgagacatctggccatgcttcatggtcgtaattatccaactaaaatgcgactacatggtgggctgtgggtgcatggttttgctagtcgtgcccatggcaattaaggaccggttcgtgggaaaccctggaagaatttatcgtgcttaccacaagccagcgtgggcaacggctgggcttgtagtgtagctttcctctagcttacgcatctaggcaagggtgggcgtga

SEQ ID NO: 28629 - DNA, 271 bp, Oryza sativa
cattgcattttattgtttctttttaaaaaatatctcttataagaatattaaaaactaactccaaggtgattctcagttactggcaaagccaacaaaaagaatgtattcatttccggcaaaaaaaaaattccatcaaagagtgattagatttgacatgcaatgatgacactcccaatcttgatatgtagaattaccagctaactttgtttattgtcggttaaattatcccatgactgctgtttcaaaatgaacccaaactctggcctatagc

SEQ ID NO: 28630 - DNA, 250 bp, Oryza sativa
catcactatcgcatgatttttttagacattcatttttctattttatacatattccatcaaatgttcaaggtgcagtttatgtagcaagtgttgattaaaggcctactactgaataaatatagttgtacacttgcatgacactgggctatccattagtgagctttgaataagcgcaataattgtgaagtatattttctagtcattttcatgttggtatgatgagaaccataatggttgcaactcttgcaga

SEQ ID NO: 28631 - DNA, 1501 bp, Oryza sativa
cacaaactgctcacttaattggcttcgccaagaatgtgcaacaatcacgatcaacgaatcttcatggcgacgaaatccaacaatttgtgttgccacatttttggtaaaacctttgagagaaaaaaatcatcctttaggtaaagtatttatggagtaatcctttaatagataacgctgttgactttttacatgatatttccattcgttatatttaaaataatacataaatttatttatgttgttgtgaaaagtttaccattaaagagacttttaaatatgaattatattttagcatatttacattaattttgaataaagcaaataatcaaacgttatttcaagacaacaaatcagttgatgctgccacttgagattttaatctaggtatttgctagattttcgaatgcctaaaattttgtaaattttcaggcatcataaatcttacattgttagtcctaaatttgcaatgctatatgatgtgtaattttcagttcattttatcttcaacttctttgttatataccgttttagtttatttactttatcaaagtttttttgcatgtaattttatgaatttcatatttagattcatttttttagtttctatttaaaagagaagggactttgtttataaataagtaatagacgagtgatgatagcaaccatttgattgtcatccaaagaataaaaaggtgattgaaacttctgaatatttctgtagcctgaaatcaagagacaccctgtaatatttcatatggccatcaaaggtagctcaaataaactggccatttcagaaattattgcacttttttttactggtatggaaaacatttcgtttcacctatcatgcataatctctcatgttctgttccataatatgcaccatgtctaacaaaagagaaactatgcgtggtaatgccattatcttcttgatggtaatataagaaaaaaattatcattgtttcttaaacataataatataagaacaaaatattttttttgaattttgtggaacaattagagtggacggtaattgtggctttgcaaaacacaaaagaaacaagaagacagttgtacatcttgggccagaatagacaacagggcccagcccattggcgattatcagcccatctaacagagtagtcaggttttttctattaaaatggaaaagacgtggtgcgctcgagacgcggccgccattggagctggaggtacggctccctccttccttccttcccccatccttgctgcatctttcctctctgggagttcttcacgggcacattcctgctaggcattcgggactcgatcctttcactgacatctcagcttttgatttgatttgtgctgtggattcatggcttcttgttcttccgctcttgtgcagttccccacgcgcaccacctgttcgacgaaacgcctctgcgtgcttggccgccatggaggggcgttcttgcagttgcacgcaggaaggtcaagaccccggcgcacgctgccggga

SEQ ID NO: 28632 - DNA, 1501 bp, Oryza sativa
ggcgcgcagccggagtcggtggaggcggtggagagaggtggtgcgcgtggcggcggtgcttcggagacggggaggggaaatggagcggatgccggggtgcggtggggcgctgcgatgctataggtggcagcggcgcagtgcgggggcgacggaagcggcgacggcgcgcggctggagggtcgccggcgtgcggcggcgcacgggaacggcgtggggagctcgagagagcacgcgggagggggcgatgagttggggaaacggatgaggggaggccggggtgcatttttataggccccggagagggagatcgtggccgaggtgggcggcaaccgccggcggagggagctccggcgacgtgggcgagtgaggctcgaacggcgccgatttttggggaaaataggggagaacgtggaggaaggggaggacgtggggtggaccacgtccacacgcgcgcgggagcggggagacgcgcggaggaggcggcgtcgtggggcggctcgggcgtccatggcggcggttggagccggaggaaggggatgggcctgacgggtggggccgtgggtcccacctatcagccaaaggaagagaggggaagccgggtgggggttttctggactttgggggagaggggagccgagctggccgagcggcccaaagaggagaggggagggaggcggcccggccggaggggaaaggaggaaggaggggaatgggccgaaagcggcccaaagggagaagagggaattttatttgcttttctttttaattaattgattacatgatctttgtgctattaaaattattttttgagctccgaaaattcatgcgaaaatttcggagaatatttagggcacaaagagtattgcaaaatattctcggccaatgatttttaaaggaaaaattttaaattctcccattatttcacttgattgaattgacttaacttttatttaatttctaaaaaatatattatttaatgatttttaatcccgaaagaaaatcggggcgttacagatgccgctgtggatgaggaggtggcaccgacgtaccctagaatcactaccacgtgctcatgtggcaaatctgcaccgtggtcgtcgatgcagaccaagctcagccacaaccgcgtggctgccgttgtcgatgccgtgccgagctcggccatgtcagccacaactgcgccgccgccatcgtcaacgccgcgaagctcggccgcgtccatagaagagggagcgagagaagcgaggaagagggagagcgagataagaaacgagtggctgagaatgaggagcgcccgatatttttatttttatcgggcactcaggtaggaactttttcccataaacctgttttgggctgaaagcccatatgtgttttgcaggaaaaatagtactctattttctgggggaaaaagtacaccgaaggtccctcaacttgtcatcgagttacaaaatcgtcccgcaaaaccagttatccagcgtccctcatctatcaaaaccgg

SEQ ID NO: 28633 - DNA, 632 bp, Oryza sativa
gtaattttagtgtatttacaatgtaagtaccaaaattatatatctaagtcctaaattatacatgtgtaattactgtgtaaatagagtaattacattagttgatgacaaacacgtgtcatgcaaagcaaaaaggagtcgcgaacttaggagcaagttgttcgatcagcttatcagatgtactttgcacgaatcatgaagaagattagatggcagatcgtcaaactgactgtatttgactgtatttagtccagaaatatgtcgacataattttagcaaagcagttaaaaagaaatgtttttaatcgaagaaaagaatcgtgatagagatgtgcatagcgtagcagttctggaattgttgtcctacggctaaagattagggaataaacaaaactactattagaaaagatacccacctccccctttttttttctcatggaatatattttagtgcttacactatattttgtcttattgcaaactcagttttgtacacagccacaggtctaagttgaaccattgtaacgtagtagatgaatttcgtctgaatcgccgcgatgttcttttcgttgaaaatgacttagttctttggatttttgttggaacaagcacaaggatgcaaaccggatggaatga

SEQ ID NO: 28634 - DNA, 1501 bp, Oryza sativa
caaattgttttcaattgtcaactgcacaagactggagtgattatgtggctacataaatgcaatgacatattatagataaaatttcacaaaacttgccaaagaaaaacttgagagcatgaacattatgtgacaagtattctggttgcactacaggtacaatatagcttcaacataatggatagtaaaagaccacaaggaaagaagaaagatattatgactgccaaaaaccaaattaaacattgccatacttgtttggtcccaagtaaagtctatagagcatgtgtgaattatttatcaggcttttttccatgcaagttgggtactccttctgtcccattataagtgcagccataagtttccgtacccaaatttgaccattcgtcttatttgataaaattatgaaaaaattttaaaaattaagtcatgcataaagtactattcatattttatcatctaataacaataaaaatactaatcataaaaatatttcaaataagacaaatggtcaaaattgggcactgaaacccacaactgcgcttataatgggacggagggagtagctaactagctaagccagtcgacacacaataggcaaatgtatcaggaggtagcagcaggagtaagacactgaaaaattgctgaagcattttttccattcatttgttgactttgaatgtctcataattttgaaatatatgtgtagtattcctctcaggaaagaaatatatatgcagtaatgtcaattgaagttaaaccattactcagattttggacatgatgcattttcagtttccaacccaaatattgcagccacacaaaacacatgtcaatcatcaaacagcaaatactccagttccattctgaaatcgaactgccaactaagatgctttaggtcaagtgatcaacatgttgttttatatagaaacgaaacagagtacatgaactatattagatgagtggttgatataacatcagttatcctattgatatgtcatgatttcacgacataagatttagttagcaacagttagttttgcaggggacaggtaaacaatgtcatgtaattgtgaagtatcaagaagagacacttcaccttttcgcattgacacctaagtcaagatgcataagacaaggtggaatatgtaagatcagtaagcatacctttttcccctgataactgaaaatcaaatctttaacgtgagaaaagctccagagatagtggcggagatcattagcatcgaaatcgctggtttccacacaataaagtaccactgatgcgctcactagtgatgccacgtccttcagtacaggcttgccgccaatagtattgcgcaggcccaaagtagtaactgtcggagtagaaatagatatcctgtactcatagcagaatttagtagtatcgaaggtcaaaaccttcagtgtgttggaggagatctcgtcatccgcaacgatgcaaccatctaagtcgaaacgttccaatgctggacagcccatctggagt

SEQ ID NO: 28635 - DNA, 1501 bp, Oryza sativa
ttggtcttgagctgcaaattaaatacacctgtcacttgaaattccactcaaaacagtttccagaaattgatgtgttactgatataagtccatcattaaacctcagcaaaggtagcaaattaaatcatttcttgtgcaattgatctttgatattttctagcaaatgcttgccttggcaactggttaaagcatccaacatttccagctagttcatcactactactactacattgaattaattgcttagggcatgacttaatccttcgtacatacaaaatttgcagccattgtggggaaactgtagtaattgttcaatagtttagagtggcaattaatttatgcagttgatgaaacgaacataatcttattttgggtggttgtactgattttttttttttgaatctatgcggttgttctctggagttcatctgtaaatggcagaagtgtgatctaaatactgtgtcttactatattagaagtctgcagagcccttaacaggatatattattactagtctttattttaccagtttttggctaaaccacttgctgcggacagttcagattttggcaaatagcaaactggcctagcatcatcatttgctaggcattctgaaaatcagattgtttgtttcttcgtatatgtaatatatgatcaatttcagatagccctgtattcaacttagccattaattcttccccgagcccttgctgtaactctgtaattttagatggttgactccaacaaaactggaggatcccctgcagggacttcgaagcaaacattatctgctgaagagatggatgatcagcttgaacaatttaccagcttgatgcaacagaagttcctgtccggtgaagactttgggcatatggactactctcggatcgataatgacgagatgctggacgaccattggtcaaaagaagccaactacgatgctggggagaagtatttcgaagaggattagttcaaactaggctgttgttttagcatcagttaattaactgtttttgttcatgttcagcacttagtctatcatgttcatgtacatatattatctgtgcagttgttacatctctaatccaaataacttcagtaactttgtttatgagaactacggcttgcgttggaacatcagtcagaaagtagggtcctgtcctgtcttgtggagatgtttacaaattgcacaatatttttaggcactacctccaggatgattgtgtatgcagggaaagtaacaggtgtgttctctaggggattacttcttcagtccggaccggtcaattttaaaaaaaatatggttttcaagtcgatggtgcatagaatatagcagaacggtttattttggacaaataaaatattaagtcctggaccattcggaccgggtcgatttactaatttgtccatgcatgtccacaagcattctcataaatcatcatgatatatattctttaactgctagagtattttcattatgagatgagattttaaagcagccg

SEQ ID NO: 28636 - DNA, 165 bp, Oryza sativa
gaaattagggaatgaggatttgggaataatttctgcggattttgggattcttggcgctaatggaggcagacggagcgacgtcgctccgtcatttttttagtgctggctagattatcgcaggcggacgatataatatagccgcctgtgcaaatttattttcgtagg

SEQ ID NO: 28637 - DNA, 1501 bp, Oryza sativa
gatttgagtactgattagctaacctcaagcagcttggttcttgccctcccatatcaagtcccgatgcttaataaaaacagagtgcatggtttcctgccgtttaacattcattgtttatttatcttcaatttacgagctggtgttgagagcctgaactaatggactaattttgtgagtcaactcttccatgatatgtcctccgttttagtatttaggattcgactggaccatttatgcaaacacacaacactgacacctatgtccccagttggccagtcacttggttaatggttacataaatccatgcacacccttgcttgtagctaagtattatttcattttacttttaaattcaagattgccaatcttttgtgtaattgctaatagcagtactgtattttgacatagcagagataattaaagcaattttcatcgttttgttttatcatgtctcaatattttatgcatgtatggtaaatggtaatgtgccttcatccctgtatcctactacatatgttgtaccattagcaagttaaagaaacacgcacaccaaaaaaaaaaaactgactcggtccctatatatgggcaagtggtactcaaatgaagtagtatatcagtcccaacttctttcaggacggtaatgatagcgtttcattttactggggagctgattcttatcagtgacatgacactgttgaatctttaaagggtgtggaatctggatcgcttcctctctacattcctttaaggtacacactaccaatcgtgcaataggatctgcaagtattgttataattaggtatctgctccttattaccatgttaaacctcagtaacttgatcaggtttcttcttcacaaccacccctggagaactagcttccttagatgaggtgaaaaagccaatccagccaactggtcgtacaagtgagatccatctggtgcagcctggaaggttgatggcttgatacagaggtaaactagcattaattcttatagttaatcttttcagcagtactccgttattctgtcatctaccctatagttcaccaacacagtgttacattcatcattcctcattgatcggtcaggatcgtctcccacagatccgatgccccaggtcgctcccacctccctcacggcctcaccccatcaatcatgcgtcacaaaatgtgctctagcgagagatcattagactagaatagttcatttcggtcatggaactgtacttcaccttctatgttacagtggtactttgattatcaattccatttggtactcatgccgatccagatttggtgcttatcattttcatttggtactcatgcttcaataattcttgctttgatgaattgttgctgatccacatctttcatgattaatgtaacatagtctgtagtagcagtttaaaactgaatcagtagcagtttaaaattggaaccaagcgcattctccatgggatgccttaaatgactgattagtgcatgaagtaggcttaaattg

SEQ ID NO: 28638 - DNA, 1501 bp, Oryza sativa
atcctagctacactatcactactgtgcatggaagtattgtcacatcgacggccaattaaaggttgcatggctaaactttagtactcattccaaaatataagtcataatcacccataatacaaagactaagaaaatatttaatcactttcttggttggaacaccttgatacatgtaagcaatatgattggaaggtttgatgatataagatttaaaacaaaataattttataggactaaaggatgatagttaatgtatgcatgcatgcacaccttatattatgagaaatgagagaaaagtggttgtgtcttatattttgggttggagggagtgaatttaagagcaaaataacagcacaaaacataacactacaagtatttgtggccatatgcatgtgtgtttattagtacttggcaagcaaatttttaagggctccttcgacacgcatggttatcaaatacggaaataagaaaaacatgtgattaataattaagatgtcatgccactctatccgtactaaaatgtacgtagctgtttctgttttgcattttgtagctatttcatgttaaatacaattttgagaccgagggagcataaaactatatgaatttctcaaaaagagtactactccattaatttaattggtttataactcgaacatagcgttagtgataaggttttaaaccccctaaatatgtacttttgtggtaatcttattgccagccatgtagttttgcgatacttagcattaaacatgtagttttaatttattgttaaatccgtagttttataatacaccatcttaaatatataatccttccatattttaatgtatgacgccgttgactttttaatcaacgtttgaccactcgtcttattcaaaatttttatgtaaatataaaaatacttatgtcatgcttaaagaacatttgatgataaatcaagtcacaataaaataaattataattacataaattttttgaataaaacaaaaggtcaaacgtttgtcaaaaagtcaacggcgtcgtacattaaaatattaaaatatggaggtggtatattttgcgataattcattaatttgactgaaatttcgtgaaatttactcaaacaaaattatcacatcctacctaggcccatcccatctggcccggcccactccacctccctcacggcctcacctcgatacatgcgcgaataccaccactccccgaccttagccctagccgccgccgccgcgcgctcccctccccatcccctcgccgcgccgcgccgccggcgaacccccctagcgctaggccagccgtcgccgcgcgccccgcaccctctcctccgccgccgggcctgccgccaccaccgccgcgaggcctcggttggtatccatctatctatactatctatatcttcttggatggcagtttttttttatcgagatgtgttgctaatggtgctgcgttagcacgcccactcgcgcgcccgcaggtggtggtcgaggacgccatgc

SEQ ID NO: 28639 - DNA, 1501 bp, Oryza sativa
tgtcaccgaggtttagccccgccactgtcatcctcgcttgccgcccgattctcccagcggcgcactccaatgcggtggcgagacgaagagatgaggaggggagggggcggctggcagctagggttcgccacgagctgcctgcgcgtgggcgacgtggagcgtctttttagggggttgcgtcaattggctgtcctagagaacctttttctttcatggccatccagtgcaagtgtgcaaccgcattcagacgaagagtaggaactgtgagatggatatatcaggttgaatgctccatcaagctataccatcgatgatcctattcgttgttaatttttcttccagttatcttctgttctgcattcatgatctgggcaatgatcgagtagctgtagtagcgtattggcctccggcgccgaaggagccaacatcagatgcgagattaattctctccatggacgaaagtaccctttctaattgattttcagacggttaagcaccttctaatcttagcctctcgtcttctttgaaatccatgctttttttttagtgggagagcatagaagcacatctcaagggaagcttgtccagggagtcagttattagatcgtgctatatctctggacaaatggcagatgcctttgcaagcccatcatgggcattcactgccaagctacatgcctcaattaaatcaggaataatgtacatttgtgaatccaaagatttgaatacaggaatgacggtgttaacatccaaattcaacacatatatcatattcaaaatagaaaaacattactaaaatttggaaataactgttattccttcacggagccggtctgacaccgtaggtgtttggtcggtctgaccggcggctcatggttattacatagatacacgtcacgaagcgaaataaaaggcataggcttccttcgtattagtgtcggcgcaagcagaatttgcaatgaggatccttttcgcctcggaatccccgaggccggccttgaccatgagcagccagacgaaggtgatgagctcccctccacaggccagctccgccgcgtgcatcggcccccgggacttgccggcggtgtagatgaggagcctcgtccacatgtccaccatctccctcaacgtttcgtcgcatggatccaccatctcctccagtgctcgccctctcaccaccttcatcagctgcgcagcctcagccagcgtagcctcggagctgacgttgagcggcagcatggaagggtggttcaccaagaggtacatcatgtagttggacagcttccggcacacctccatcatatcatttgcttctcctccctgacctgcttcttcttcttcttcttctgctgcagcagcagcattcatcaggtactcctctgtgaatgagtgaatcacgacaatggcagcaccaaagtccgcggtgaaatgaactcttatggtttcgaggaatgggccaagctttggccatgcccgggacgcgacatcggagaattcgtcg

SEQ ID NO: 28640 - DNA, 1501 bp, Oryza sativa
gacgttttgggattttatagattcatatatggatccatatatatgtttatagatgtgtataaattcatatgtatgctagtatatttagataaaaaacgtcttatatcgtggaacggaacgaaacggagggaattgtagataggatatattataggtataactaattaattacactgggcaaaaactgtcacaaacaaccggggtatttactattttcttgttgtacatacatgcatcgagctttaatattgtgaatcgatttgttgctgtttgcaaaaaaaaatggaattttagcacggagcatatgattattcttggtgctatggttttatagtttcataaaatcatgctgttaataaattgttatttgattgaccatatttgtgggttctaaattaattctgaaatatatgaagaattatttgatctattgtataaaaagtttgatagccattaagttaagcattttttttttgtttttgttttgacacaatagtagcaagtaaaattaataaacagtgcggttatatgaaactgtaggactataatatatccagtgttatatgccacgtgccaaaacttctggatttatgcaatttagatcataatatatacctagaattttaaagaatttactctgacttctttttctttacgtttctgggttgtagtacgtcgaaaatgtaatcttctttttaaaacttgtactaaatgattactggaatatccaacacaggtgctcttaaatttataataatgaaggattttatgaaactttatcatcagcgggaaatccagctgcttgtgctcctcagcttcacactccaaatgttcctctttttcaccggcagtcttcggaggcgcaacaccaatgtgttcctcagggtttctatctggacagcttatttgggagcagacttcacagcagtttatgctcttggttacctctcacgacacgatgatattcagaggcaaatgtcagggggaacccagccactagctttcttttgggcatcattcctcctcatccatcttggtgggcaggacagcatcaccgcattttcaatggcagacaacaacttgtggctgaggcatctcttgaacttggtggtgcaagtagtcctagctgcatatgttttctggaaatcgccagcaaggcacagtgcagagcttctagtttcaggtgtccttgtgttcattgccggagttaccaagtatggagaaaggacactgtctctcaagtatggaaggtttaaaagtctcgagagctcaactggagatcactacaagaaacggtttccggaattaaacgattcggatcatggctattctaaggtagttttggatgctctatgttcaatgctaaatgtccacaatgtctttgcagcgcgtaacccatttgttaatggtccagaatctaattccccagttgttattgctcgagacacggtacagggaaccaaaaaaatgctcaaggtggtggagcttgagcttgcaatca

SEQ ID NO: 28641 - DNA, 160 bp, Oryza sativa
aatccacaaatcatcacaatttatagtcatgaatttccattcacatgttttcaactgtatcaattcccatctccaaataaactaaccagataggatcgtcaattcatcatcgctcccggtcatcgtcgctgtcgctgagagacgaataccaaacactagt

SEQ ID NO: 28642 - DNA, 1501 bp, Oryza sativa
ccaaccaacaagatcatgcaaccagaaagtgatggctctggtgagaagatcggcgaggttagtcggcgttggaaagaaaaaattgttttggatgagcaagctgctggacactaagttcctagaggtagatgagaagacgatggagtttgtggtggaggggatcaatcgcatccgcgacgaattctccgatgtcgcgtcccgggcatggccaaagcttggcccattcctcgaaaccataagagttcatttcaccgcggactttggtgctgccattgtcgtgattcactcattcacagaggagtacctgatgaatgctgctgctgcagcagaagaagaagaagaagaagcaggtcagggaggagaagcaaatgatatgatggaggtgtgccggaagctgtccaactacatgatgtacctcttggtgaaccacccttccatgctgccgctcaacgtcagctccgaggctacgctggctgaggctgcgcagctgatgaaggtggtgagagggcgagcactggaggagatggtggatccatgcgacgaaacgttgagggagatggtggacatgtggacgaggctcctcatctacaccgccggcaagtcccgggggccgatgcacgcggcggagctggcctgtggaggggagctcatcaccttcgtctggctgctcatggtcaaggccggcctcggggattccgaggcgaaaaggatcctcattgcaaattctgcttgcgccgacactaatacgaaggaagcctatgccttttatttcgcttcgtgacgtgtatctatgtaataaccatgagccgccggtcagaccgaccaaacacctacggtgtcagaccggctccgtgaaggaataacagttatttccaaattttagtaatgtttttctattttgaatatgatatatgtgttgaatttggatgttaacaccgtcattcctgtattcaaatctttggattcacaaatgtacattattcctgatttaattgaggcatgtagcttggcagtgaatgcccatgatgggcttgcaaaggcatctgccatttgtccagagatatagcacgatctaataactgactccctggacaagcttcccttgagatgtgcttctatgctctcccactaaaaaaaaagcatggatttcaaagaagacgagaggctaagattagaaggtgcttaaccgtctgaaaatcaattagaaagggtactttcgtccatggagagaattaatctcgcatctgatgttggctccttcggcgccggaggccaatacgctactacagctactcgatcattgcccagatcatgaatgcagaacagaagataactggaagaaaaattaacaacgaataggatcatcgatggtatagcttgatggagcattcaacctgatatatccatctcacagttcctactcttcgtctgaatgcggttgcacacttgcactggatggccatgaaagaaaaaggttctctaggacagccaattgacgcaa

SEQ ID NO: 28643 - DNA, 243 bp, Oryza sativa
tccatagcgttttattagcccatgtggaaagatcattttgcttttgtgcttggactcaccttgccactcggctttatggtggagctgtgcatccaacgattcgattgtgttgatcccatctagattcgcgcggtcatggtaactgagggcaacggaaaccttatggtttgtcgatatgcgaggacatataggcagctggtggcctaaggggaattgaaccagtggcaatgccttgggtaagga

SEQ ID NO: 28644 - DNA, 417 bp, Oryza sativa
ttgtgatagtttgataaaaatatattaagttttgtaaaaattactctattaaaaaaaggaaatgtgtgctatgctccctatcttgctagtccagggaccaaataaaacacatatacttgaacaactatcagtccattgcagcaacacttaataaacagccaccaggttaattcaagtagcatatgacagtataaataatagaatcaaacgtagataagttcacatatcaccgaactcgcgtacactggttcagtacacatgtctcgcacaacttttatggtagtctatggctcataaaccgacttgctaatacaccaacacaaattaatcaagcttgaaccttaaccggcatcgcatgccgatcccgtcttttgacgttgcagtaattttccgttcattagcctctgcatacttacc

SEQ ID NO: 28645 - DNA, 357 bp, Oryza sativa
cgtggctctacagcctggcccagcccccgctcctcgcaccgcgcaaggcgcggacacaattggggggcctcggggtggcgcgtcaggcccctcggggtgctatgtcagcctctcggggtgccacgtcaggcccctcaggcccttgccctgcctggacccaaggcccttgcccagctgccatgtggcgaggggggaccaggctaggcggtcattaatgggcggtgccccaaccgtccctcgaagcatttagtgcggtcagggcggacgtgtggagccacgccactggcccgcctcaaatcgggcgtaaccggtctgtgaccggcctgtcaccggtcacatccgattgacgcgcggcca

SEQ ID NO: 28646 - DNA, 212 bp, Oryza sativa
tctgaaccagatgcaaattttactcaacattgatggttgatgcatatgtgcccttgcaacacttaggaggctaggattgatatgtagccttacaatatacctaggattaatttgactctggtttcctttatgatattacactgtgattcaaatggcttgtatgtgttgaatggagtcaatggacaactgaattggaaccaaaatttttcagg

SEQ ID NO: 28647 - DNA, 482 bp, Oryza sativa
gagcttggctagcttgagctagagcactcactctcactgatcacttgctcacacacacacacacacacacacactcactcacctctccaaccaacacggcaacacaccaacacaacacgagtatttatacatgaattgccattgccattgccatggccttcttcttgatccccattgtgaaaataaagccaagtgctcctaagctagctagctcatgagacttgtttctatgtgcatgtaagatgcatctctctatctctcttttcatgagaggaataaggtggttggaggcatgtaacatatgtgttgagtatagtacaaataagtggaggagagaagaagggcaacagagagaggggctatttttgccagaaaaggaggaatcgttttcatcccaagtacttccaatggtttcatgcccccatttggatctcctctctatatctacagcctttctggttaagctagccctcttgtctcca

SEQ ID NO: 28648 - DNA, 472 bp, Oryza sativa
ctgcaccccgttgtccacaggttgtagaatcatgcataaatcgttttgctcatatgattcaaaactaaaccacatgctgacatctagcaacaagcattcaggaatattgcctggcatgcacacgctcacttcctctgctacttcattctaatcaatcagaaaaattggcacgattgcttgctcacatatcttacaaagttggtagagggaactacacaaaaaggcaacaaaaaaagaacctttgtcatatgaatgtcccatttggggcttcaagatcagacaaatcagcttacattagccatgaagatcctaggtccacacatataaatttatttcactcctatcttcagaaatggtcctaacacccgcttcatccttgtctacataaactgtgtaaaaccacataaaccagagcatatgcaattcatgttgagttaacagctcaaatcacaaaacaaatcaatggagacca

SEQ ID NO: 28649 - DNA, 1501 bp, Oryza sativa
actctattggactttggtgggatacctctttggaatttcatcagatgattcattctcagataaatggattcagtaatgcctgtttcatggaaatttttttggtggccgcatggttgctttggaagcaaagaaatgatatcatctttaatagctttcgaacatctgtcccgtgttggaagctgaatttaagagaagagttaagcctacatttatctaggcttaagttagctgatagacctattttgcaatcatggattgatgatctgtaatgtcaatttggtccagttttctcttttataaatgaaattcaaccgtgggggcttcccccccccccactgttctctggtaaaaaaaaaaagaaatgagaactattggatgctttaatgagtcagttcagtatatgtgaatttcacatgagttttgtcagaattatatttgagcatacattgtggttttcgggcataaaggggacctatgcactgagtactgttttagtctcttaaaaaaaatggaacgtccagcttatactgttttcgaaactatgcacatccatcagtttcagagcggcaatctgctgaaccatccatttcctctgaaccagcagctactgctgaacaatcatctggaaataaaaatagttatagtatagcatacattcccacatcatctgctagacattttatacttacatccatatttaatcttttctaatgtgtccatcgcaacgcgcggggtttcacctagttcgctttatagtttcaccctcacgcctagcagctcgttgggcccatgaggcatcccatctattcgagtccctacaaatcttacacctaacaggctaatcgcaatagagaaaagcaaccacatcctcacacataatatcactgtgtgtcagatgatcctgttccacagcatcccaccattatgttgtgtggttggttgaatgtcctttcttacaacatgtaacatgcgcaaccggctccccagcgcgaatgcgaatgatgatggaagtgtatttttccctcgaaggatatcctatcgttttatacatggtatttaaaattttatcaaaaaaattttaaaaaatttatcaagatagatcaatatatatatgaaatatcttttcgtaaacatgcaagttaaaatttgacttatacaattaaaaaattgattgtgaattactcgttcttttcatagtcagatttattattttcgtttctacttgtataagttgaatttgaatatgcatatctataaagtgacatatcacatattgatctatcatataaatcttttttaaattttttgatgattttttaagtgacatgcaaaaacaaggggatatacccttgagaatgtgtttagttccacgctaaaattggaagtttgaagaaattggaatgatgtgatggaaaagttagaagtttacgtgtgtagaagttcgatgtaatggaaaagttgaaagtttgaagggcctttatcccagttcggatggagctga

SEQ ID NO: 28650 - DNA, 243 bp, Oryza sativa
attagagttttttctcgttttacgtgcgagcgtgtagctctcgtcgtttcggaagatcgctttcatgaggatcagagttcggaaggttgttgtgaagaagcaaggcaagtcactgtaacatcccggcctagggcttaataggattaatagaatacttatatcaacaagttgcaacttcttttccggaagccaatctccaaagaacttcagggttaagcgtgcttggcctggagcaatttggga

SEQ ID NO: 28651 - DNA, 1501 bp, Oryza sativa
aatttcattattcttttctttcctactgtaaattaatacattattttttaaaaaaaaattatcccaataggttctatgaagatcatactatttataagatttttttctcttttttatcaattcaaatttaaatttggatgaaactcattcaaatctcaaatggtttctacttttgagcctcgtcgaaacgtcgaaatttcgtgaaattcgactggttttcgtcggaattatgaacctgggcagagccgttccatctattctccatggagacgttttcagaacttttcccgtccttaattcaacatttatctgtgatgtgatgtacgccacgtggtccaatcagacccaatacaatccgccggcttgagaaggagggatgatgatatgtttagttgaccgaaagctaaacaatgcaaaaaaaaattctaaaactatattttataagttaaaattgaccgcagctcaaacaaacgagtccaacaaattaaataatccacgagttcattatcatcatgtaatgaatcatcatgaatccaaaaatctataaagtttatcctcactatactaatgttatttttctcttctattgtaaagccatatcaacttagttgttcttagtgttaaatgattcatcaaagatgcaaattaattctcttctaaaaaaacatatcatgcatcctaaccgtttataacattcaaatatttttttaaataagcaaataaattttataactcacatatactatttatcatgtagtttttttttaataacgcgtgtgatttctatctagtaacaataattcgctcattcgctgtgccctcgagaaaatataataataattcaatgtgcgacggtgacgacatgagtgataggactatttcatccccctcatttctctgaccaaataaaaacatgattcactccatccatctaaccaaacatcctatcacaaaatttagagaataatccaatccatctcagctcgatctcacaccaaacacgtactaagataagaagtgggtagatgctggcagaacaagttgacaaaagaagaggacaagatcgatttaggccatgttcagttctcaaaacaaaatttttcacgctgtcacattgaaatgtttggacacatgtaaagtattaaatgtaaaaaaaaataactacacagattgcatgtaaattacgggacgaaccttttaagcctaattacagcataatttgacaatattgtgctacagtaaacatttgctaatgacaaattaattaggcttaataaattcgcctcgcaattttctggcggaatctgtcatttgtttcgttattagactacgtttaataattcaaatgtgtgtccgtgtatccaaaacccaaaaattttccccaactggacgaggcctttacaccccataattctcgagtggcagagtgaagaacaagctagacaggatcgatcgatggccggcggcagcgagtttgatatccaggaagccgcggcgtcgg

SEQ ID NO: 28652 - DNA, 608 bp, Oryza sativa
cttaaaaagcacatatgatatctttcctatccagatgagaccattatattgggcaggatcaaactaagaaccgacactaatctggcttcctgcagtggtaacatagttgtaccattcttcagttgttcatgccattcgatttcgtttgtttccttgttttggagatatctgtaattgagtaagcagacagaggaatttgtggggtggataacagacaatcagaaatggtagggcaagtgtggattagtggatccaacaatggtgatgaccatcaagggaattgtctgggttcataatatttacgaaaatttttcttcaaaacaattttcaaaatcatgccgtcaataagtgtaatgataatgctatggaaagaaatcacatcaaaactgtatgatcgaatacaagagctaaacctatcagagtagggtgaatgctttgaatgccaaaaaccaaataactttcagctaaaatataagttatcctcaaccttgatgaagtggcaatgtagctcaatctgacaatcagattaactccggactaaccgtagtacaatcgccagtctgactgttgtcttgctaccggttggaccactgccttaccacggaagt

SEQ ID NO: 28653 - DNA, 1501 bp, Oryza sativa
tagggctgagaggaatcaggagaatgtgacaaccatttgcataggttcctagtacgagttggcaaagtaaaagccctagttatcattccagaacatacatgggcatcgtctgatcctctgcggtgcatggtaaaggaggaagtcgatgcaggctcatatccaacgtgggtatcgagtcaagcactgaagacgagggatacaagcgggccaacccgcgagtttatttatatgtcaaattaatgataattcatgagtattcgcgtcatggtccggtttaccgcatcaagatatgcaaatgggtcgatccataaactcatttataagttaaattaataggtaacccgctgatcaaacccgcgggttacatactaagtttacctataagcaggttcgcggacaagctcacttacacctctactgaagagacttgttagtacatgtttctgcctttctgctacttgaaacatgatcatatctgctaaattaaaattcgaatttaaattggaacaatgcatatcaattttcctccctgtgtgatggatctggattatataatgttgtaatcgctatgattgtatatgatatagttttatgcctataaatgaaaataagagatttgtaaatacattatttgtacatcaaaatgttgttgagttcacgtagctcaatcattttcccacttgcctgggaccacaaaatcaatatagtgctatcatatcgatggtataaaatgaagcaggatagcgtgtgagaaaaaaaagtatattatctccgttctaaaataattgtatttgtagtacttagaaattgtcccaaaataattatctctacagagtattaattatcccatcaatcacttctcattcaaattcgttatattctactgttaatcactctcatactttcaccaatggctctgttatggcaaaggactgaaccacagaatcgccaatggcccacatgactgtccccattcaatgtatccacatctctaaattcaacaattaatataacttaacaacaacacttgtgttttaaatcgctaacggtgttgtcaattatccaaaagtatgttttttctagaaactttctacatcactaatatgattttttctaaaaactttctatattagtgttacttagataaccatttctaagaatttttaggtctatatatatacttaattcatgagcaatttgctgtgtctatactctctgcacagttatcaagttagaatatactcatgacttcatagagttcaacggatcattttcatacatgcttgtgaccacaatgctaagatgccactgtaatattaattgatggtattaattgtttttaatagcatcaatcaatatacccaagtggtgaagccaccggtgtattcacttgttgctgtaaaatcaaagatgtttttgattgttattctgtgatgaacaattgccattggagattattggttttgatatttggaatttatttacgaagtggttttgaaga

SEQ ID NO: 28654 - DNA, 1501 bp, Oryza sativa
tatacaaagggtcctatcacagtctctttccgaggtaccttggtggtattgaggcgtatgataacatgtcgtggggctgtgtcttgtgggtaaagttgtacacttctaatcagagtaaaattattcgaatagtcatgcccgcggttatgggcagtcaaccagattcactattattagtctcacctgaatatttggacttgttgaatggtttagttcaggtggtttgcttgggcctgtttcaacgtggtttagcattggatagtgatgtttaatattgattaatttatatctagtgttttactatattcaacttgtgattttaaaatgccagctttatgaaaatatcctataccctcctttggtactatcttgcatcatgccttctattggtatggattgttgagtacggtgggtagtactcagtcttactttatttttcccccaaccctcaaaagcaaagtattattcagatggagattattgggaagagtaggcttgttgcggacgtcaaggatgcctgtggatttgtagacgctatgttttctcaagagatcgatgattagttaactcgattatttatttccgatgcatatataagacttatttatatttttgtaagacgtggacctgtgtatcaatattatcgtcaatgtaccctggttggtcctggacagatattttaatacacattctgcttgaaattcgtgttaacgaatttttaggcgttacagacatcacatttcatttcattatatgcaggcattgacagtcagatattatgatttaagaaccatcaacagtcgccatgatggcagcgcaccggttttgccgtggttggaggggtcgttaacgtgaatgaccttggcggcggcggcaacgaagttggcgaggaagaacggtgccagggaagtcgtggccgagggtggagcgtgaggagtcatatgcctacggacgctggcctgttgacggtgaagttgagagctccgaagcagaattcggcccctacagcgaagcggagtgtctggacagattcgaggacaccggggcccacctggacaagttggccggagttgttggcgaaaaatttgaaggagttgaaggagaaaagtttggcggtggggaaagtggcggtttcgcgaacgtggccccgtgaaatgcatgccatctcctcgaagaaaagacgattgagtgccccctaactagcatgccaattttcgatttctaggatcgagaatatgaggtgcgctagatcaaggagagatggtgacatagacgattatcctggtttaggcccttagcatggggtaataccctacgtctggtgatgtagattggatctatgtcaactaaaaagacaagagtgttaccgcttagggttagtgccagcgcccttatagagctagggcaaccgacgacatgcttcgtacagtatccctcataatccgggtacctaccatctgcttactagggacgagatagacttccttatctcttatccctt

SEQ ID NO: 28655 - DNA, 1501 bp, Oryza sativa
taaaacactgaaaaagaggcacacaactcctaataaaggctgtcataccactcacacatgatatcgaccgccgactaacccacaagcaacaaacctaagcacggaaactagcaagcaaacaaaactaagaagacgataaagctaagggcggcgactctgaagcttggagcggcgcttgcgatcgaagaacatgtctgacttctaaggtagacaagggataggaatcaatgcatgctcaaatccaaatttaaaccaagcaacaaatggcccaaacaactagccaagcatgatgatttttatgcatagaacatttttcatgaacccggataaagacactaatgcgactgactaaactatagcttaatgcataaactagatgcatgaaaaatgatgcgcgtaacattgccccatcgaatatagacacgacctaatgcatatcacccgataaattccccactgactgtcaaataaactccaaataaaatttttctaaaaccctagaccgagctaattttaaggatccgatccgaatgaacgaccaagatttttcccacaaaccaaagaggcaaaaccccaaaatttttcccgaaacaaatccaagtgcaaaaagcatatgcagatgaaaaggtttcagagggctcttagggtttccatttggcttgtcctacggtcaaggtcggctctgataccaacttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagagaaaagcgagctaagcctgaagacttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcataccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgaactaatcagttcattaagctaaactaggggtgagactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgtataaccccctctaaccgatcgcaccacaccttagggttcgcccccgtccccagcaggcaacgggcagcccccctttcgtgccgcgg

SEQ ID NO: 28656 - DNA, 1501 bp, Oryza sativa
tcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtctcacccctagtttagcttaatgaactgattagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaagttggtatcagagccgaccttgaccgtaggacaagccaaatggaaaccctaagagccctctgaaaccttttcatctgcatatgctttttgcacttggatttgtttcgggaaaaattttggggttttgcctctttggtttgtgggaaaaatcttggtcgttcattcggatcggatccttaaaattagctcggtctagggttttagaaaaattttatttggagtttatttgacagtcagtggggaatttatcgggtgatatgcattaggtcgtgtctatattcgatggggcaatgttacgcgcatcatttttcatgcatctagtttatgcattaagctatagtttagtcagtcgcattagtgtctttatccgggttcatgaaaaatgttctatgcataaaaatcatcatgcttggctagttgtttgggccatttgttgcttggtttaaatttggatttgagcatgcattgattcctatcccttgtctaccttagaagtcagacatgttcttcgatcgcaagcgccgctccaagcttcagagtcgccgcccttagctttatcgtcttcttagttttgtttgcttgctagtttccgtgcttaggtttgttgcttgtgggttagtcggcggtcgatatcatgtgtgagtggtatgacagcctttattaggagttgtgtgcctctttttcagtgttttaatcaagattaagataattgcacttaatcttataagaaagattagtttccgagccgtctgttttcttcctttctcttatttctacctatcctcctccaga

SEQ ID NO: 28657 - DNA, 1501 bp, Oryza sativa
ggagagcaaactactggccattgtaccaaatggtatttcctaatcctttggtcttcttgccaaagaaaccttcttcttataaaatcaattttttctttcactcctttggaaattctgtaaaaagacaacatgtatagaggtgtactgctcaaacaagagtttatcaaagttactcttcctcctatatattgcaaattcccctgccaacatcctacccttttttccattttctcctcagtctgtttccagtctttattcatgattcattttttattaatcggtatacccaaatactttataggcaaattacctatattggaagtgaagatcttactgtactcctctttgtttttttgcttctcccaaacaaataacctcacttttattaaaattgattttcagtcctgaaagttgttcaaaaatgcaaagtatttttttcaagtttctagcataatctaatatatatatttaatgcttcatatatatgcccaaagattcgatattatgtttttggaaaaagtttttaggaactaaacaaggccttaggagtatgactgtactgcacgtggtacgaggtccttcctggcctgcaaacagtacacaatttatgaaacacaccgttgatagcgaaaatgagaagaaatatgaaacacaccgttgatagcgaaaacgagaagtaaactttttcttgtgcccaactgaaggacagtagtagtattcattagaaaatcggcgcgcctattggcgtgcctattggcgcgctggataatttatcatgtgattttttcccctcgggcacatgtatactttttagagtaattactttaatactaataaaatctatgtaaatatcatatattaaaaaatatcattcaatatgtacttggttttggttttatgtttgtataattcctacggagaattatagcatgacagtatacacaaacaaacggtgaatttagtctcacgtttgtaattttaaaattttgtatataagctgttagaattagtaaaattaaaataacatattttttatttcttgctatcgattgttttaccttttgttaataaattgtttaaccttttctataatataggatattaacatggttaagttacatgtttccagttttaaccaatcacacttagcactaagggcatgaataatggtacgatcaccgtgtaggagagaatgccacatagtatattttttgatgtggaggtgagtgagaggagagaggatacgtgcgtctattaattggtagacatatatgctagacacagtattttagatagatagcttaatactatatatgcactccatatacaaaatatagagccaaattactaagtataatgtaggtaatatgttatatgaattcttttgtatatcgtgtaaatatgatgtgtgactattatagggcaaccactctctgaactattttccacactggtggagaaatgctttttagtcccggttcgtaacccccttgtagtcccg

SEQ ID NO: 28658 - DNA, 1188 bp, Oryza sativa
accgggactaaagatgctcccatcttaagtcccggttgggaacaccaaccgggactaaagattgatttttagtcccggttatttgaaccgggactaaagatagcgatctttagtcccggattcgtagtcccggttggaaaacgggactacaagggggttacgaaccgggactaaaaagcatttctccaccagtgtggaaaatagttcagagagtggttgccctataatagtcacacatcatatttacacgatatacaaaagaattcatataacatattacctacattatacttagtaatttggctctatattttgtatatggagtgcatatatagtattaagctatctatctaaaatactgtgtctagcatatatgtctaccaattaatagacgcacgtatcctctctcctctcactcacctccacatcaaaaaatatactatgtggcattctctcctacacggtgatcgtaccattattcatgcccttagtgctaagtgtgattggttaaaactggaaacatgtaacttaaccatgttaatatcctatattatagaaaaggttaaacaatttattaacaaaaggtaaaacaatcgatagcaagaaataaaaaatatgttattttaattttactaattctaacagcttatatacaaaattttaaaattacaaacgtgagactaaattcaccgtttgtttgtgtatactgtcatgctataattctccgtaggaattatacaaacataaaaccaaaaccaagtacatattgaatgatattttttaatatatgatatttacatagattttattagtattaaagtaattactctaaaaagtatacatgtgcccgaggggaaaaaatcacatgataaattatccagcgcgccaataggcacgccaataggcgcgccgattttctaatgaatactactactgtccttcagttgggcacaagaaaaagtttacttctcgttttcgctatcaacggtgtgtttcatatttcttctcattttcgctatcaacggtgtgtttcataaattgtgtactgtttgcaggccaggaaggacctcgtaccacgtgcagtacagtcatactcctaaggccttgtttagttcctaaaaactttttccaaaaacataatatcgaatctttgggcatatatatgaagcattaaatatatatattaga

SEQ ID NO: 28659 - DNA, 951 bp, Oryza sativa
cctgcattatgtcattataacctgtgtcttctgcagctttgagacactgtcaagatcatcataattgagagactcaaggtcaagcatatcttcaccgccatcctcatccatacccactgcctcagcattttcttcttcctgaaaattttgacgataaatgaacaagctctcaagagtatcgcttattaaatctagttgcatggcagaaatagaaataaactcacaggataggcttcattgtctgacagttcatcaagatctgctaagaaagaatcagcaaggcttgcctgcgaagtggcaccaatcagaaaaaaaaaaggcgaacaagtgaccacggaagaaaagaacttgcaaaccttaaacagaatatggatttagcacaagctactatcaagcagttagaatgtactcaccatgataactcctgctccaacttattgaggaggatcagtacacctgattcatagtggttatgtagtcagtggcactgtgcaaataaaaagaaagatgtagtaagcggtattactaccaaactattattgtagaatgaacattggccactataaatattagtgtaagcaaagttttgtgacacattttctaatttacaacacggcactccaaacagtaaagcttttttgggcagagaaatacgaagtacataattaaacacttaattaaccctttgttcttcggtttatcgatttggtctgcaatgcggtttcgccaaaattcagcccttcggcaatcctaaaattatgcacatctagcaaggggaggcaccgaggcaggcatgagatgtccaaccgaggattttaaaaaaaaaatagttaagaaactataccgctatacttcgcataaaataaatccgctaaaaactgattggtttcgagaatccgtaccataaacgaggcccgattagatttatcacagcaaaataatccaaacaga

SEQ ID NO: 28660 - DNA, 262 bp, Oryza sativa
ataaggaggggtctgtgtgcgggggcgtgatcttttttccagtttatacaatcaataacatactcggcggaatcatccccggacaggagtagggtattactttttgaataagaaggcctgaacctgtataaaattccttgtcttcaaacccatccactttcctagcttgatagccaccccctttttattattgccgaaatcttgtttcgacagttggcgcgccaggtaggggcagcatcaagtttttgctgactaagtacga

SEQ ID NO: 28661 - DNA, 1501 bp, Oryza sativa
  unsure (1)..(1501): unsure at all n locations
gataattgacaagtttggccttcatggcagaagcgcatggcttaatatgctgttctgtaataggcataaatgggtgcccacttatgtgaaaaataacttttgtgctggtatgttttgcacacaaaatagtgaaagcattggtagtttatttcatggatacatcaattctaccacaacgttggacgagtttctggaccaatataataaaacaattgtgggcattgattgtaaggaaactgatgctaactggaaatcctcacatgaggttgtaccatgtgtcacccattatggcattgagaagaaattccagaaggtttatacaaataaaatgtttgaagaatttcaagagcagctaaaaggtaagatgtactgttatccaactcttctgaaacaggaaggttcggtttacatattcaaggtgacgcaagatgttaaaattagggagcaacaatgtagcttggatttcacagtgtggtgggacagagatgattgtgatggaagatgtaaatgcacatgccgtcatttcgaattccggggaatattgtgtagccacatcattaccgtacttgctctactgaaggtcaaaaaagtaccctccaaatatgtattgcagcgatggagaaaggatatgattcggagacacggtaccattactaactggtcctataatgagatggtcgactcaccggttgcacgaaggtttgatttgttatgcaaatccttctatgaagtggcagagaaggcagtggtatcaaatgaactgctcatgttggtgctggatagtgttgaagaattaaaacggaaggttgatgcacatacagcgcaaaattcatgaaattcaggtctctaatccttcacagagcagaccatgaggtgtgatgatcatgaagctccctttctcctgacacgaacaaccgacattttcagcgtccccatgtaagatatctttcttctagctgaaacatttcgaggggtaatgaaactactgatttcaatctgtaatctcggtgattgatatgtgtgaaattattgatgtgaagttacgttctgaaaatgcgttcccttataaacccacctttaaagcatgattattgttttctacatacttatcatggcttagcagtcaactatccagctggttgcaaaagaactactaccagtagtaccaaatggtttggttaatacacgcaaaatacactttggcatctatncttagtttttgctctgaagcatgagttgtttgctacattttggagccatttccagctcattttggggctatttttagcatgggttgtttacagttttaacctcaccaaatttagcttgttcttggattagattctcatatatcagcgagaattcttcactttggacttgcaaatccctcagtttgccggctttggaattccaaagggaaagtcacgatgagatccctcttctacgtgactttcctggccattttgtccataaacgtccattcctctgcatgcttgcgcct

SEQ ID NO: 28662 - DNA, 474 bp, Oryza sativa
cgccctgggggagggcgatttttgcctccccctataaagcccagtcccccctctctgaaatttcattatattcactaaaaatccaaaaaaaacgaaagagagagaggggagggcagcagaaggggagcggcgaagccctgctggttcgctcacttcatcacaggtttgctcccatacatcttttacatttgtactaatatgttatgtttgagtatatatgttgcgttttagttttagttccatatattttagcatatctgtagcacacagcacatatgtgtagatccagagtatagaatataatagtatgaattgagacatagacagtagtgttaattgtaagatgtaatttagtttgatctggagaatgtaacctacttttagaattttggagaacaatattgtagagaatgtaacttagggcgtagtacagaaatgcgaggttaacgcagttattgttttcatcaggcacaa

SEQ ID NO: 28663 - DNA, 358 bp, Oryza sativa
gaagcccctagctaagtatatatattgttgtttgttacaatagatttgccagggtgttgtaggtcacattggttggcattgatttagtacaagcaagcatatatatatgccatgtttgctggtgccctgcaatgtggctaagttttacttgcacattgtttggtgccttaggcaagttatctatgtttccgccatgcatgttatatacccttttcatgatgtcatggatttggttggtcaacctttttttatcacttatgtatttcctgatgtgtagttcatgtattaacagtggtgtcaatgttgaatgtgtgtgctgccaattaatcatggaaaatatttttataaaacacacaga

SEQ ID NO: 28664 - DNA, 858 bp, Oryza sativa
atttgtctataaatttagtcaaacttgaaacagtttgactttgaccaaagtcaaaacaacttataacctaaaatgaaggaagtatgtatttccaattcaaaccttcatatttttaatgcaacattttttaagatcatggattttcttaaatttggtctctatatccatgaaccatatacacattcaaatcttatacgagttatttagactctaaaccccgcatagaagaaacaaagaagaaaacaagaaaaaaaaagctacttgaagacttagcttcaaccatcaaagatgacttactccttttgtcacagcatgagagggaggatggggagaattgaaactacctagtgcgccgcgaatccgctatgtcgcaccaccatcatttcccgcaaactttcaaactcccggccgttcctagagcatcacacagagccgttcagcacgacatgcacctgcctttactgccatgagcttgccagagatgctccaccaccatccacacctacccgcactcatatattggcgccaacgctcgcttggcagctactgctgagagcctctgttgttcttgtcttcatctgcattaggcgagtcgatgatcatcacattgtcaatcatccatgtcacctacaaccacctttctgcaatcctggcttggccatagtcagattcgggtgctggagctcgcctagtgtcgccgtccctaggacaccgccgggaagagcctccaccatcgccgactttatctgccatcaccgaaccaatcattcaccacagtcaccatgcatatgaactggcccaccatcatgggggagggctagcccccaccgctatcaaccctcatttttcgatgataga

SEQ ID NO: 28665 - DNA, 527 bp, Oryza sativa
catgtgttttgcccatgagagaaattgggaaaaaaaataaaaggtgatttgtgattcttttgttgtttctgatatgcaagaacaaagggctggtttggttttgtggcataacttgagcttaccaatttttgtcaatcctaaattttggcaagttttagcatgactaatcttgacaaggaaaagttgtgtttggattgaagtcaaaatagcctaagttaactattgaaatggcctatttttctaggctaagcaaaaatttaacttcaaaccaaatagaaaacactattgaaattgccaaatattagtaaaggctaattcaggccacaaaccaaaccagcccaaagtgtagaaggtggattttggtgacttgaagttgtttccacaggccgctattcagcatgggcctccactcccggatacctgggctgaggcccgtagtggcgaaaaccaaatgggccatggtccatgaattttctgtgggctgggcctccaggcccattagaaggtgtaacagcttcgttccacca

SEQ ID NO: 28666 - DNA, 402 bp, Oryza sativa
tatttctttttatgccacatgtagccaagcctcctcttgctctatacaggttcaaagtacgctaaacacaacacatacgcatatatgctctgacttttcaagctgaagtgttttatatgctagctacgcgttccacttgtcaatctcttttttctactctgaaactgcgcagagatgatcactccaacattttgactgtgtacttgaccatatcaaagtgctagcttagtatattaattccttttgtttggccatcaagttagtaattaattccaagttgatcatgcagcaacaaaaactatctgtcattaattctgaagaattattaatcctttaatttcaagcttgttcagttctgattgattggtttggttgcaggtgagggagggcagccgtgcacga

SEQ ID NO: 28667 - DNA, 215 bp, Oryza sativa
ttttttatagatagtacaaatctatgtaggattttacttatatatgtagttttctatatacagcctgttgagtcatctttattgtgttgaaccatttttattgtacttcgtcttagaataccggcccacacatctcggttgatacaattaatgatccaagttaccaaaagacatatatatgcaacaaaatacaaccattatgaaatatgaacaga

SEQ ID NO: 28668 - DNA, 1501 bp, Oryza sativa
tgaaaatatgacaacttcaaaacaacatttcaaatactaaatgatttcaactaaaaaagttatcaacaacaaagttgtataacccataaaatctgtaactattattttgatcattttctatataacatttttttgaatagtttgaatttgaatttgaaaatatgacgacttcaaacaacatttttaaatactaaatggtttcaaatttacatatctatgttatagtttataaaaccagatgagagatatgtgaattttgtgaacaatgttactatcactttgtcggatgaagaaatgaccaaaataaaagttataggtcttgatgagttatacaactttgttgttgatgacttgcagttgaaatcatttagtatttccaaatgttgtttgaagttgtcatatttttaaattcaaattcaaattgttaaaaaaatgttatatagaaaaatgacaaaaataaaagttatatatcttgataagctatacaactttgttgttgacaatttttccatttgaagtcatttactacccaaaaattatttgaatttcttatattttaaaatttaaattttatatagttcaatcaaactcggatggagaaatgaccaaaataaaattggtagatttcaatgagttctacaactttttcatatgagttaattcggtatcataaaattcaatttgaaattcattttcacctagaagtctgatttgcctcctcttccctctcaaccttatcttctcttctcactcagtcctctctctctctctcaaccttatcttctcttctcactcaatcctgtctctctctctccctctcttcatttgggcgaagagtgggcggtgagccagcgacgcgggcggcgcctcagtgacttcaggcggtggcgccactgccatattctcctcaccgcagccgccgctgccaacgaggaggcgaccagctccatcccccccccccccccgatgtcgatgacaacaaggaggaggcggcatcagcggttgagtgcggctgttctggccatatattttatatttggcttgtcctgaagatcctaccgtaatagatgggttccattggttttctgaaagttcccagctatacttttttcgtaattttctcatttcttacttctactgaaatgagaaaatttaattctagcagcatacatgacggttaagctgatttctctcccatatttgctacaggacatccaaaaaacgtgtaattagagataccgtaaaaatgcgtatttgctgtaggacatcgcaaaaaaatggttattagctcctggacacccgctgcattaatttattatttttggaggaataggagagagaaacggttgtataagtacggttctacccttattcttctctctctcattctttctctctttctctctctgctatttcttcaagtgagcccgagggagagggagagcgctggtgatggcatgggccggtgtagcgccttgactgtggcggcgctgcgcggtca

SEQ ID NO: 28669 - DNA, 1501 bp, Oryza sativa
aacggtgtcgaaacaagatttcggcaatactaaaaggagtggctatcaagctagaaaagtggatgggtttagagacaagaaattttatacaggttcagaccttcttaataagaagtaataccctactcctgtacaacgattgatccgtcgagtgtattattgatcgtatgatctgggagcaaaatcgtgccccttgaggcacccggacccctccttatataagggaaggggtccgtattacaaaataaagcccatatctctaacggaattggtagttacagattggatacaatcgtaaacgactaggatcccgggtatttccttgtcatacaagtttagaatttaacccgagtccctttaaagatattctatctatacatggcatcccatacccagtcggatacacatgccgtgtgggtctggggtatccataatctccacagtagcccctgagacctttacagtcgacgaaataatcttctctcgcaatccaaaacgacaatccgagtgcttcagcttcctcagtcttggtctcccgagtagtaaaatcaaagactgtgaagggctgaaaaatagaaaaaatcaggtgattagttaattaggtgtagccccgactatgtgattagttaaataaaaactaaacatatgtcaaagtgcatccaaacatccatccgagtggttttccaaccaaatctcccaagggattatatggctaagcatatgcggcatctgataaacctcccaccgactgctttaatgtgccaaagaagtataaagaaaacccgagtgagaaacactctaaaggtctataaatcaacacacatgataaaaatccgagtaaaatctctctaaaagatccatcaaatgtggtataaagcatgacgaatgacgagtctcaatagcctaagccatgactcacgccattaccaaagcaagcatataacatgccgagagaatgaacatttaaaatcagtcatctcaagaagacccgaatagctttgcagtctaaaaaggcctacaaaattagtataacacttttctgttgggcatctttttatttgcattgtagtaattccaaagaattatctaactgcgccaaaaaggattttaacagcatcgggctattctgtcgtgagcaagtgttgccaaagcaaaaacaaatgcctaagtccctaaggatcacaaccagccacgctgataataaaattgggctgaaagtactgtttaggcccaggcccattagtacctcctgataccctagcgaaacatacgctaaagcaaagcgccgtttcgtcttccccgccgaaacctccgccactttccccattccctgctacagtgcaaaaccacaccggcgatagctagggttcgcaaatccatcccaatccacctcgccggaacttcacatctcccacaaaaatcttccgcgcaaccactgcatcaacctcccctccattcctagccatttccaaatcaaatcgcatcatccaactcgcactca

SEQ ID NO: 28670 - DNA, 1501 bp, Oryza sativa
gatattaagtctatatatcctccctcaacttcgaattaaattttatgatactaaatgaactcatgtgaaaaagttatcaaaaacaaagttatagaatttattgagatctaccaattttatttaggtcatttcttcatccgagtttgattgaactatataaattttgaattttaaaatataagaaattcaaataatttttcgggtagtaaatatattttaaatggaaaaattgtcaataacaaatttgtataactcatcaggatcaacaacttttgtttgggtcatttttctatatgactttgtttaaatagtttgaatttggatttcaaaatatgacaccttcaaacaacattttcaaatactaaatgatttcaactcaaaaagtcatcaacaacaaagttgtataacttatcaagatctataacttttattctagtcattttttgatccgacaaagcgatagtaacattgtttacaaaatttacatatctcgtatatggtttcataagttataaaagagatatgcaaattttatgaacaatgttactatcacttggtcggatgaagaaatgaccaaaataaaagttttagctcttgatgagttctacaacttttatattcataactttttcagttgaaattatttactgcttcaaaatattatttgaagttgctattttttgaaaatcaaaattttacttgataaaacaaagtcacaagaaaatatggccaaaataatagcagtaagaacacaataactcaatagaacatgtttttagaacacaataatagcctcgtaatgtcttactcttgattgaatcgtctccctcgaccacaaaatcggatataacaaaattattaacactaaaattgaaaatgttgatatgttctattaaaaaaaataacgagttatatttcttcgttgatttgtgaaggtcaatttgaggggcttttatgttccgattaatattcgttaccaaattcgtttcgatttgtattcgctccgtatctgtattcgataatattcgattccgttttcgtatccgggtttccgattccgatttcgattctgagaaaaaaatatgaaaacgaatatgataaagctagtttctgatgggatcgatctcctgtccacccgtccctggacacgctctgggaaggcaaaagttggtacacgctccgtccctaaatactataagggataatgataagtattagtggtgattcgggaaacaaaccaacactgatttgattgatcttggcagtgatggttcgtggaaaaaactagcactgttgaggtgtcacaccccaatctggcaccgccgtacaacagcacctgataggagtgtgtcgtaggaaaaacggcgcgaaccgcttcctacaaaaccgtgatcacagtaccagtcccaggacatagcgctggtacccacggtgacaaacatgaatcattgtaatccttaaaataaatagaggacttatttatcttaacttaggttgcagc

SEQ ID NO: 28671 - DNA, 189 bp, Oryza sativa
ttacaaattcatcttcattcaataaagtggccgacaggatgagtaaagctatgagtaaagagacttacatttacgagatgagtagcctgattaagcgtttttgcaagcagagatacttcctcgtcttctttctgcttatttattacaatcccttgtggctgcatttcatcgtcccatcatttaaatagg

SEQ ID NO: 28672 - DNA, 1501 bp, Oryza sativa
ttgttgagaggatcacggccaaagacaagagtagcaccgatgatgccggcacagagttccatcgcacttctcgacggaaaactcgacgcaacccctacctggcgcgccaactgtcgaaacatgatttcggcaataataaaacggggtagcgcacgagacctaaaagtggatggatgtggagacaaaggatttagacaggttcaggccctctcaatgagaggtaataccctactcctgtttggggatttgaatccgccggatgtgtattgatctgacgattaggttgtctcatgccccctagagggcctcctgcccaccttatataggatggggggcaggattacaagatagaaaccttaaccaatacggtatcggtttcctaaatctattttacaatattatcaaaccaggactttaggctgttccgtaatatataaggaaacataatacccaagtcatgatctgttacatattccatacatataagttatcccctataactagtcggataaccatgccgtgtgggtatggggtacccataatctccacactgtttatcatttatcaacggagcctagcttccatattcaacaggttgattgcttgcatgcatggtacattctttgaagcctcaacttagccaatggaaggtattgggaagattcaggagacattgcgccgtatggtagtttcatggctaaagaacaaagtttctgacgatccatcggcctgctttctgtcataaattcaactatattatggacaggaagtatggaagggcttaccaaaggcatgcaaatatgaaaaaggaagcggcagcgggtggttgcgggtatacattcctagtctttacaatagctatttcctagtttagctttagaccgagttctggtctagtttaactttacactacagaattagcacttttcttgtttaggaattagcctgaccagttttgtactagcagagtcaatcaatcaacaaaatttaaaggcttagcaagacaagtatcctagccaatcaataaagtttgttagagggtgcaaggttctatcgttctctagattcgttttgaccatctgcagccaaatatattaaacaactatatagcatccctgccttaccatgttcgattcagttatcaattttgagtgtgctttagtcagagaaattaagcacatccaagtctcttgcagaagaacattacgttcacaacttcacacattcaagcttcatttcacggatgataaattacctttctcaactatttaaattgatgggatgaatcgacaaatgggatactaatactctggactttcactggataaataatttagtttgcttttaggaaaatttgtagcactgcactggtcagtgctagctaaactatgatcttaagaactttacaatttttctaccgattcataagtgtgcaccacacagcaccagaattacatttgtctaaaaacaactatactattacccgcccccaaaaaaaaac

SEQ ID NO: 28673 - DNA, 1501 bp, Oryza sativa
ccctactcctgtgtttttgtggatttgtgtatgaatgagctacaaagtgtgagccaaactctcccttgttctaggctctcaatctcgccagaatcaaccctctactctgtgggcaaggtcctccttttatacttcaaggggataccacacgcacccttccctttccaaactggactttccttctctttacgaacggagattgatatggttgccgtccgaatcacacttcgatgggacagcccacacctacctccactcccggcggagacgggcgcaacgtgggatcgtggctgctcgttgctgacgcgaccagtgtcagaccggtcattcttgtccaccacgcgtcagattaacaacgtgcatgtttgcccttcttcgtgtaacaccttgcctgtaatggttaggatgaagcctggtattcatctaaccagggctaacgtgccatctctaagaggtaacacgctagctccggctggagacgtgtgcctagaggcactcgtcttgacgggacggggcgaggcgtgcgtcagaccgccagtcgccacctaaccgttgatctgaccggtctgtgactggtcacagaccggataaaagagcgcgctgtattgcgctgcatgcagcgtgacacgcttgaccagaccgcaataaatgctgttaggtgagcacagctgtgctcacttatcccatatatgtggcgcagacttccttaaggggtcggggtgcctcggccctcggggtcggggcaagcgcaacccgaccccccctcggggggaatcaggaggagggcggacacctcaccctcgggcccgacgtccccgaaggtgccaggccacgtgggcgattgtgtctgcctcaagcctctggccatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacatcacttgagcagcgcgcgaatctgggtgagcagatttgtctcgctcggagatacggtaacgccgcttcggttggcgagcgtaattaacgcgcgcacgatacaatccgtttcgattgccacaaccgcatatccacttcatgcgccgtaagcgggcgaatgggattagtggaagcgtgggcacaggaaacgagggagcgggatagcgagatacgagggagcgaggtagtgggcgcgagaaacgaggagccaggcccagcgatggcaagggtataaaagcatcgagaaaaggatttgctcccttcctttcgccattgttcctcttgcctttgccgcctgagctctaactctttctctgctacgccctactttcgccacacgcgctcgttcccaatcatctcttcctccaccgcca

SEQ ID NO: 28674 - DNA, 195 bp, Oryza sativa
tttcacgtgcgggccccacatgtcagccgccgcggggttcggtttggctccagaggtagtacgctttagccggggcgaccgacggccggatgcgcgcgcaggggccgatcggacggccgggaggcgcccgtgggatcctatcgcgtccacgaataatataaggctacgagtcaacacagcgaacaagaagtgata

SEQ ID NO: 28675 - DNA, 1501 bp, Oryza sativa
acacatttattgggtcatttgatttgatatcaagcttttggttatatatttcctctgcttgatttgttttctgtgagtaaatgtatgttgcatgcgagtttttttttttttggaatttttgttctagccgtgtttgtatatggagtatgcttggctataagtacttgtatgtggcatttgtttataaaagtttcattttggttggttaattttacttgtgttcatatttcagaatggttgtattttgttgcatatgtctgttggtaacttggatcattgtcattgtatggtaaattgaatgtggatgttctaaaagcaagtgcaataaatatgacttggcacggtaaagatggtccgatactccgataggctatagggaggaatacacgcaagcacaatcttatatagagcggtgagaaaagaaaaaggggaatatatactgtagaggactttagatttgtagttggttgtagtttgaaaaaagaggagagatataatattttgtgggtttttattgtctagattttagaagataagatagtagtgggcttggttagggtgaataatgactattgtacaagctagctgctatactgcctataggtgatatggaatttggctatagctaccggttagcttattattattgttgttgttgtatgattgacactagatcgagaaaaggtgcgacaaattaaaccattgcagtgagtgtgacagattttcctgaacagtatgggaattgaacttatcgctgtaaacaaattctcgtaaaattcatacaggccagtgtgaaaattctcatttctgatttcttgttcagatcatggttttaccattttcttcctccatgtcgatgccaaaacaatgatagaagccttcttttcccaataaaatctgactggtacaccataaacagttaatgcgtaataatacagcacattttcgatttttttttcccaatacactatatagaactattatgttacacaagaaaccatatgttaccatatatcgattttttttaaaagagaaaatagctctctatatagtgtatatgtggcgacgggccgggcgtctcataaatcagaggtcatcatgtactcaaagttcacataggctgaactcgcatgcttcagaagataaacagtgtttgaaaaatatataagcaccagctagctggagtcccttttttttaaaaaaaaagatagagattttacatggggtcgaaatttaataaaggattagttatatgacggactgtactacataactttttttaaggttttatatggagaaaacctggccaaccaagttataatatttgtcaaacagaggtccagtattttgcatcatgcagattgcagaatggctttcagctgcaagaaggtaagctaaccaactcattgaaaccaattaacctggcagctgatacacgtactcttgctttggccaacaaccaaatgtcaagttgtcaactaatgaattaatctatttgatc

SEQ ID NO: 28676 - DNA, 490 bp, Oryza sativa
atacttataattctaaatttaaatttattttttaataaaataaatatattttaaaagtaaattttctagttgattattgtgatttttaatcatagtttatcttaaaatatttatttttaaatacctaagaacatatataaaaaaattatcgttaaattattttttattgctaacacataatcaacaataggtcttgctattgcactacgtgtctacaggtctcatcttttcgtttatgtttatgtttagtagctaaaatttaaatttttaacattaaataaacattaaatttgaagctaattttgagtttttttatcgaaatttatttttcagtctttgtttttagattgctaagaacacatatataaaaattttattcataaattatttttcgtttacaaatatatcgtttggcttattccacgaataagctaacgatgggaccgtactaggggtgaaaacagtacggaatttttccggattccggtca

SEQ ID NO: 28677 - DNA, 251 bp, Oryza sativa
aacattgttgtattgatgtaaaatagtacagacgtattctctaattgagcataaatgcggtgaacagaaaaataaccaagagaaccgttgtccattttttatctactcctcccttcctggatgtttggagctaatacctagctaaattaaatgccttttcaggaacctcacttcttggtggcggttgaatctgaaatttccaaactcggaaggctagtaggcaatggccgtggcactagaggcagggagga

SEQ ID NO: 28678 - DNA, 1501 bp, Oryza sativa
atagacttcttatcagaaatcgataatgagattatttaccggccagaaacaatttttcacacttttttctgataacaatttttatttacagtcttccatgaaataatatgcttattccgacattttaattcttacaattagttaattgaacaagtagttgtagcctgatgatgctgatcagtcccgttcgtttctccaacaaaagttgatgaagatgaaaataaagattttcgtggcacacttttcaaactgttaaatgatgtgttttgtgcgaaaattttctatatgaaaattgttctacaatatcagattaatccatctttcaattttgtaataattaaaactcaattaatcatatgttattaccacctcattttgcatgaaatatgtaatatgtagaccttgaccggatggactgtttagctttgggatgatttgccatgccgactgtcggagtatataatactccccccatttcgaaatatttgacaacgttaactttttagcacatgtttgaccgttcgtcttattcaaaaacttttgtgaaatatgtaaaactatatacacatataagtatatttaacaatgaatcaaatgatatgaaaagaattaataattacttaatttttttaaataagacgaacggttaagcatatttaaaaaaagtcaatggtgccaaatatttaaaaacggagggagtacgagttaaacaacaagaagagctattacacttgcagttgatatttgtttcgtaagcagcagcacagttttagttgacggactctatcgatctgtaatcttctgcatcagatttgagttaatctgccatcctgtaagtcaaagataatatctgaaatctagtctagtaaatatataaagtaaatgatcgggttgagcacatgcaccttccactgaatttcctcttcatcctttcgtttatttttttgaaccttaggatttggccttcgggattgctagtctttaaatacaaaagttgatttattttaggggtataaaagaagggctatggtgtgtacttgtgttattgcttttaaattagagtactccctagtgctaatggcactaagccaatggtttactctaggattagttgaacacttgaacgtactagcaggcatgcatgctcatgtcagacgtgacgacttgcaaaatgtcgtgtatcagtaccaagtctaaggccaaagtttttttccaaactttcaacttttcatcacatcaaaattttcatacacacaacttttctatcatattatatcaattttaaccaaactttcaaactttagtaaactaaacacagcctaaatgaacttcactagcaactcatcaaaagattagattatatatacacacaaacacaagattaattaaggagaggtgagttagtatagaggtggaaattctctacttgatcgaacaagaagagcacccaacgctcgcaatctcctcaggatgccgccgccgccgccgacgccgccgccat

SEQ ID NO: 28679 - DNA, 498 bp, Oryza sativa
agaatcaatccaacatcgtgtgcgctagctggtgcgagaaagctaaacttgctcaatctgtctgcctcttttcccttttcattttccctattaatgcaacaaattgcttaattatttacgactaatgtttttaataagtttgatcatttatatagtttattaaaaacatacgtatgaatgttatttattttattgtgactcgttttatcaattaaaaatattttaaccattacttatactactaacttataacttgtagtatttgttgcacatctaccctaaacttttaaatgagaagaatcatcaaacggtatatccaaaaaccagcaacatcgtctataaaagagaataaagggagtaatttaaaaattattataataaaattccacgcacgttgctaaacacgtgactaatttaatccggcagcatgacgccgacctcacgcggcaacttaattattttctcccctctcccttttttcttctcttctctgcaagt

SEQ ID NO: 28680 - DNA, 191 bp, Oryza sativa
ggagcagccgccgccggggtgcttgtcggtggtgaagcggccggcgacggggtagtacacgtggagcgcgtcggcgagggcggcggcgagatgtttgacgaggtggagagtggcgggcggtggccggaagaggaggcccttctggatgtagtcggcggcgaggagggacacgtcccaggtggtgagcggga

SEQ ID NO: 28681 - DNA, 548 bp, Oryza sativa
ggttattccgcaatcgacactcgcatcaaatgctcctttagcagccttcaatttcctatctggcaaatttcagagtgcttcatcatattaagggactgtcactggtatctttgtcattggattgtcattgacattaagcaaattgtctacttcactaacaattgcagagatttatgacatttcatgtgtttggtcgttaaaatttcgcaaagcatattacatgtggcacgtggtttcttgcagataatgcaacatgcacatcaagcacatgggatgtatgaccctgatttcagcccaacaaacaaataacaagtagcaggaaaaaaggaatgcaaaaaagaaagacaactttgttaaatatcacactttcagatcctacatccttagatggctggtgccttccaaactatacaaaaatcagactcaaaacattccaatgcgagttgcttaaattccacaatctgtaattagttcgaacgttgcgagttgcaacaacattaggacaagcagagagaacaaatccatgagcatgttcatgatcaaagatt

SEQ ID NO: 28682 - DNA, 1501 bp, Oryza sativa
aaacaagcataactcactcatcttaactcggaattgaatgaaacttgaacctaaattcatctaaaatcaagatctatctggtgataacattttctcaatatgctttgtactgtttgaattttggtgaatttatttgaattctaattgagttcaaatccgatctttcgcacgtaaatttagattccgagggaattgttgagtcgattgaggagcagggatagcaagactgcgatcaaggcaagtcatcactaatctttgagcatgttgaacctattgcgaaaattatgttgatttaaataaaattacatgctatacatatgtgaatatgaatgccctacttgttaaatatgccatgccttgatattgattatctgtatgaccattgtaaaccctgctaacgtgtgtacttagtcgatattgaacaaatgcttagtcatgctaattagaatcatgcattctcatatttatcaagtgctatatgcttgggcaactaccttaaggaaggtagttgagatgcggcatgtggaggcatgggcaccacattgccatgacaaggataacatgaattgtgaaaagagaaacaaaactaaacactgttttcgaccggggcggctggggtacttgggtggtgtccagaaaaggctagtgccgtccctggtcagttaaggaccgagccgtaaagttaagcatgaaacgaccctcgtacaaccgtacttctcgtatgggtatagacctagcggagtacgtagccgagcgaaggcagtatccctgcatagtggttattcttggtgtgtgggagtcagggcctacgatgggacagccattggtggggccgcgaggggcgagtgcctatagtggtgccgccatcggtaggactgccatgtgtaaatttaatttaactaaaacttaatgcatgtgtgagtcttcccttcccgggagcgccagaactcctctcactgctagaaactcatgacacctagagtgcatgaggatgcaagttcatggagtgcatgaggatgcaagttcatggagcgggtactgccaacgtgaggttattgaaaggttttgccttggcaagtctcattcgttgggacgtaggctcatgtgttgggcaagtcgcggagtacgggtaaagtgtacatccactgcagtgtgagtaaaaccaatctattcgaatagccgtgctcgcggatattgagcatcaggacatgtattacacttggctagactctaaattcttaaattgaatgagatgggatatgcatgatgattttatactggtggatcatcttctcgagagacgagaaggagtaaaccccagaaaaccattacagccagtaacgggaagccatctttgggaagacaatggatggtgaaaagaaccgttgctgtgtaataaatactggaattaaaactggactagtctatgctagataataagcttgtgaaaagaattgtgaaactagctttatgcaaataaaccaacggccatactttgaat

SEQ ID NO: 28683 - DNA, 1501 bp, Oryza sativa
tcacggttacattgttgaattatcaagtgcgcatacaaagattgtttagcgcgaattattacatcataggcccgcgggcagtcttagatcataggactaaacggtccacaatacaaacaataacagaaataggtaaggcagcagattataggcagcggctatgccattgccacaggcaacgaccataactaagacctacagagcgccgtcatcctccgcatcctcctgaagataagcatagggatcctcctcgacttcattgccatccactgattaaattttgtaatagcaagagtgagtaccaaccgtactcagcaagccatcataacaacagtgcatatgatagtgtcggtgatatgggaccgggagtatcatggccagaggcttgaggcagacacaatcgcccacgtggcctggcaccttcggggacgtcgggcccgagggtgaggtgtccgccctcctcctgattccccccgagggggggtcgggttgcgcttgccccgaccccgagggccgaggcaccccgaccccttaaggaagtctgcgccacatatatgggataagtgagcacagctgtgctcacctaacagcatttattgcggtctggtcaagcgtgtcacgctgcatgcagcgcaatacagcgcgctcttttatccggtctgtgaccagtcacagaccggtcagatcaacggttaggtggcgactggcggtctgacgcacgcctcgccccgtcccgtcaagacgagtgcctctaggcacacgtctccagccggagctagcgtgttacctcttagagatggcacgttagccctggttagatgaataccaggcttcatcctaaccattacaggcaaggtgttacacgaagaagggcaaacatgcacgttgttaatctgacgcgtggtggacaagaatgaccggtctgacactggtcgcgtcagcaacgagcagccacgatcccacgttgcgcccgtctccgccgggagtggaggtaggtgtgggctgtcccatcgaagtgtgattcggacggcaaccatatcaatctccgttcgtaaagagaaggaaagtccagtttggaaagggaagggtgcgtgtggtatccccttgaagtataaaaggaggaccttgcccacagagtagagggttgattctggcgagattgagagcctagaacaagggagagtttggctcacactttgtagctcattcatacacaaatccacaaaaacacaggagtagggtattacgcttggcagcggcccgaacctgtatacatcgccgtgtctcgcgttcccttgctagcagacaatctttccacatacagagagagcttgagatctcaccctaagcccccggccgaaccggcaaaggggggcctgcgcggtctcccggtgaggagccacgagctccgtcatctggcgcgccaggtagggggctcagcgtgtgttttctgagctctcagactcttccgtgggcgccaagtttcccttgttcagcctaa

SEQ ID NO: 28684 - DNA, 1501 bp, Oryza sativa
gcccattgtaaaggccgccgacacacgcgcacaacaatcgccgtacgcagtggcgcaatcggagaccgcaccaccagcctgttgtgtccactccgagaaggtgaaggcagaagcatcttcgccagggactcctcgcaccctcgcccccatgtcagtaagggcaaggcgaagcgtacggcacacggtcttggcagattcagtggctttcgacatatcctgcgtgaaccgctgcgcctccgttgaagcggtttcctctgccttgctgacctcttggcaaagagcctccatcttcggctcggtgagattatagtagtcggtcagggggcggaatgagcttgctccttcttaacctcggccttgagacgctcgatctcggcctttgcctcgctccctttctcaagctcagcttggagccgcttgttttcagccttcgcctccttgagggtgttggcgaggctctccatttcaaggctcttgcgacccagttcgtcgtccttagctcgaaaacggcctttaaaaccgtcaagacgagcccgcacggttcgttcggtcgaacaatgagccgcaagaatctatttcgacaaagagaaagagggcgaagatgaatggcatacccgaaacaacagctaaaaggaaagaaatatgaatagcatacccgaacagctaaactcttgatggcggaacagccctcgtcgaactcgttcagctcgaagaataggctcgggctcccagccagagaaacgagattacttacccccttgacgaaggggataaggtccgcccgagtctcgaagtcaccgggggcgaagtgtggcgccgcaagggaatactctgaagccgatgtttcggcaaccgtctttttccacttctggacggcgagcggcgaggccaccggtttgcgcacagggcttccgaagagcctggccgcaaccttcacgacccggtcagcagatgctgaagtcccaagggcaacactccctcccaccccgccaacaccgaccgcagcaccaggagcggtcgaaaacccaggctctgaccagcaggcgaagtaggggtctcgtccgaagactcgtcgtcgtcgctgaaaacgcgagcgacatcgacgagccccatttttttagaggtctttttaaccaaacccctcttcgccaccttgcccgccacaaacgaaaccagcgccttcgccccctccaaatcctttcggcggaggggggagctgttcgactccacccagttttgacatggtcgaggcttggagttggggtgtacccacgcgtctcggtgcggttgtcggcgggctcgtccgcaacctccgtctcgtcctcttccccttcctcttcgccgtcatggtcatcgacagtgtcctcatcatcggcgtcgaagttggtagtggcaggggcccttcgctccggggagccagtttaacttgcctgcgtgtccgcttcatggaagtcccttcatcaccgttggccttatacggcttcgcccggggaggaagatt

SEQ ID NO: 28685 - DNA, 1501 bp, Oryza sativa
atcctaacttcagctggtaaaaaaaaatacccgtccatccttaagattagattttttaactttacaagtgtttaacttgtaattattacaagtgattgagtagtactactttgctaaaaaaatctaatgtgttcagagtttgtctttttagcaaaatagtacgtgtaaaaaagttcaggatacccagactgatacgaattggattggaacggaaaaacgagccatcccagatggtactgttgacacgaaaaaatataggtatggaagatctgcttagctctagtgcaggtctaaatcttggtgagatacgggcgtgatagtcagtttgaccctgcaactgacaaaacatacaaattgaagatcaatgagctgatcggttgacaagccgatggagtgattccagccgatgccgatactagccgatagcgatagagttttgagatgtcggctatatgtccaatgtagataatgatacttgagtaaataatgatataatgcaatcggctgatgataatacagtataacagtcatataatccaatagaaaccaatcggctaataatgatatgataggataagtactgatccaaaggataaagcatacatcggctagaggtccgatgtcataaaatccataagattagattgaacagtgaaatctttattgcaatcggctaaatccaaattgtatgtaatccttgtaagccgatacaacgtccagatacctcatcggctaaagccccgatgaaacccttattggcagtcaacaagcatgctagatattacgattctaagcatgacttaatagatcaaatttagttgatgcaacactaaatatgaaaagaaacataatatctggacaatcaagcctatggctgattttaagggtggtagatgtctaagttaatctaatctagcaacacaatttagccgatgccggcagaaaccctaaaacgagaagcagccaatagagctaaattgatatgctaagactagattaacagagacatctgataaataggtaggcaaatatatcatccaaactagagcaattcaagaggtcgaatgtactgatgcagccttgaacgatgccgacgtagacgagacaattgcctaggccggtggaacgttggacttatcccttcgctagagatcgaactgaactaatgcagccccgtgtcaggtgccaaattccactggaggataagtaaaaacctcggtaaagagggtggcgatgcgcttagagtagtattattgatcgtggagataatttacaatgacctgggtgtacatatttatacccatggggagtgttcgcggtatgtcatgagtcccttcgaccagacctaccgaaaccatgcaaccagcgaggattcaggcccaggacgctaagatcatttgggcgaagtcccatggcgaagactatgaagtagaaatcgcgaaggccgaagaatcgcgctggtatccggcaagaccaaatgcatcattgggcgaagggtgta

SEQ ID NO: 28686 - DNA, 523 bp, Oryza sativa
cagtttaattagtcgttttggcctctgaaaaggcaagcagctaagcttctcatcgtttactgtatggagataaaccgtaaaagaaaagtaactaaaaataatttatgagtacaccttttacatatgtgtttcttagtaatttaaaagtcaatactgaaaatgaactaagatgaaaaaactttaaaatgaactctaataccatgttttaaaatttaatttttggctgtgggagatgcatgcactgaacgaccgttccataattaatttacgcacataaccgaacacatcatcttgcaaacccattacttacattattccgtttatttttgttttttattgtcacaatcttgtctctggattgtgatttttcaggagttggattcttaaaatctgattgtgaattcagattttgaaacatgcgaaatgtgcaatttatataatacttctagtgatagttttagatcaacatcatcaccccacaaaagcagcttcattgctaacttttggtttttattagaaacca

SEQ ID NO: 28687 - DNA, 240 bp, Oryza sativa
tatgatggatagaatccttataaaattgatatgtgattgtagaattaaatagtgtggttttgtgaaacttaatcatgatacgtgaagttctatgccatatgccaaaatctatgaagttttgtgtaatttggaccataatacgtgtggtttgtaaaatttactctaaactaccattttgaaatgattattgggtgaatttcagttgaattgttgaactaaaatttctttgttttgcttagg

SEQ ID NO: 28688 - DNA, 661 bp, Oryza sativa
atgttaagttactataataacttttagtatgtttgtatattttgtgtgacatatattacatgaaaagtgcaaaaaaatttaagtgttttatattatcactatagctaatgtgggaaacgtgcattgcgattactagtttcttctaatgtcgatccacgagggccatatcaggcaggtcaagcttgtccagcgtggttatgtgatgagtccaactagaacttgtcatcacctaagaatgatgttgcttacaactcatagcaagcaagtccttcacctaatatcgagtcaaaaaaaatagcctaagagctctctcgagtcgggctcaccttataggcacactggacgggcctaacctaggtgatatgacccgctgcgaatctacgtcaaaagaaatgggacaaattaacttcttttttgaacgactcgcacgagacggtgcgaagttctattgatagagcaggaaaaaattacaagattacaaccctggaggatcataaccagcaaaaagaaaaaaaataccaccgcccacacaccgacagcgccaacacacacacacacccgggagaaggctagcaccgaaccggccgccgctaagcgtgaccgaccgccgctagaccaacaaaggaacatagacgagatcgccccctagaggatgccaaaa

SEQ ID NO: 28689 - DNA, 308 bp, Oryza sativa
gctcatccaactagaactgaacgagaactgaactttttagaccggttcgagaacacaaaccagtcatcaattatggcaaaattgcatgaccattctaattatcatcttagttttgagatttcaccttataacctattttattgcaagaactcacccacccaacgttatccagtcgaaattgtttcctttgcgcatatgagaagttaatttgtcggcccactttaacgctcggtcgctccgccttcgggggcgacgcgggcagcgaaacaggccgcgccgctcccgaccccctcctcccctcccccacc

SEQ ID NO: 28690 - DNA, 240 bp, Oryza sativa
ttagttctccaattttttttccctaaaacataacatcgaatctttgaacacatgcatggagcattaaatataaattacaaaaactaattgcacagttaggggggaaatcacgagacgaatcttttgagcctaattagtccataattagccatatgtgctacagtaatccacatgtgctaatgacagattaattaggctcaaaagatttgtctcgcggtttccaaacgagttatgaaatta

SEQ ID NO: 28691 - DNA, 665 bp, Oryza sativa
gacgacgatcgccacgccggcggcctatgctcccctcccgtttgctcttgcctcccttggctggcctcttggttggtgcttctttactcatcctgtttcatcctctccatggattctctgatatttgagcttctcctgctctgttgcctgaaatgccatgaacagaaagtttctcagttcatatgcatgcatgattttttcttctgtttgatttgagtaatttgtaattagctaactgttgtttgagcacaggtgtttgtagcttggtcacaggaacactagttacatggtgttctagcctggttgttgcctcactgtggcagtggaatggagacaagcacaccagctacaagcttcttgcaaagagcatctttggttagtactcatcaccattttttttgtcacgacaaaattgtacttttgatcttactgtactgtgtcacaagaagatttctgagtagcagcctagcaggaaaagagttgccaaacgatagtaaatgggattacagattcttcaccataaatatttacttttgatgatctacttgtaacagtaatatacttagcagtgcagaaattgttgcaaatttacctcaagtgatggtaaaaatctgtgcttttgtctgaaggtccctggggttactggtatgtgtcgttcttccagc

SEQ ID NO: 28692 - DNA, 1501 bp, Oryza sativa
ttatgtggatgatatcatctttggttgttcaactcacgctttggttgtggagtttgttgagactatgcgcagggaatttgagatgagcatgatgggtgagttatcgtactttttgggattgcaaattaagcaaacacctcaaggtacatttgtgcatcaaatgaagtacacaaaggatcttttgagacggttcaaaatggagaattgcaagccaatttcaacacaaattggttatacagctgtgttggatcctgatgaagatggtgaagctgttgatcaaaaggagtatagaagtatgattgaatttttgttgtatctaactgcttctaggtcagacatacaatttgctgtgtgtttgtgtgcgcgctttcaagcttctcctcgtgcttcacatcgtcaagcggtcaagcgaataatgaggtatttgaatcatacacttgagtttggaatttggtattctacatcatcttcaaatatgcttaagtggatattccgatgctgattttgggggttgtagaattgataggaaaagtactagtggaacatgttattttcttggtacatcattgattgcatggttttctaggaaacaatctactgctgaatctaaatatgttgctactgctagatgttgttcacagattctttggcttttatatactttaaaatattatggtcttacttttgagaaagtacctctcttttgtgataatactagtgctattaacattgctaagaatcctgttcaacactcacgcacaaagcacattgatattcgttttcactttttgagggatcatgttgagaagggagatgttgaattgcagtttttggacataaagttgcaacttgctaatattttcactaaacctttggattcataatcattttgcttttcttcatgttgaattgggaataattcatccttttggcatgttttgagggggagtttatacctgatgattttatcaagcaaaaatatggcaatgagaaaattgaaaaagagagctttgtttatacatatggtattttcttgtgcatgctagcaatactttgaaggtttatttgtttttagcatagcttgtatgtattctagtcttttcatgagatttagattttgcttttaacggagatgatgcatgacatttaaattctacacttgaattaagcaaatatgcaatgttgatgctagcatatggtttgttttataaatgctctacatatatgctttattgaattgttattcctcaaatagctttaattgctcactgtgaaaagagaacaaaaatatgaaaaaaatgaataccgaatccttggaaacagtcttgacgacaaggacgtattcgatgtgagcaaaataatgggtgccaaatccctagaaacagtcttgacgacagagacgtacccggaataaaagagaaaaaaatatgagcaaaaaggctcaagaaaaaaaaaagttaaaaattctcttggttgttttgtgctaaaggtaattttagaa

SEQ ID NO: 28693 - DNA, 1501 bp, Oryza sativa
tatttgttctacacctaattattctacattgttaaagtataaactaaataaaaacaaagtaatgtagcatttcatctagctagattattaattgtttaacttgtcaaaactaagtaaatcaacgggctaggttaattccacctatatataaacagaactatactatacgagaagtgaattaagcaactgttgcacgtgcaatactaacaacagcaaaattgttctggctttccctacaacaaaatacggagtatattgtttactagctgttagtgcgtgggctagagtaaattagttagtctgccggggtcagtgagctttaatcgatggtgtcattggctaaaaacacagaggattatgttgtatttgtaagataccatcggtgtcacctgataccgatagatatactgtacatccgccctcagacctgtagttgactatggcttcccttaattacttttctcgcttcccttaattacttaacaacgggagaatgctacagagagaacatgtagcataaacagaaagatcgtgctgtatttgagagcactgtgactccatgcttgtctgactagaatcttcagacgaatccattcatgcgaaatttgatcgagttgtgttgttcctcctgttgttgtttggaccatattcgagagactaatatatatccaaggaatgtttgaaatttgaacgtcatcgagcacgcgtctacgccatcaagctttggggtgccgctgcgttcgcccccctcgggtcgcagtgccgctgcctgtggtccacacctccactggttgttgcagtgctgagaggcgccctcctcagcatttctacatcaccagtggacttcttgccgctacatcgacatggagctgtagctgtgttgtcctctcggaccgtagcttcgccgctttcgtcgtcttcatcgccgttcgcgcatcgacaacctcgtcgtccgcactggtcatcgtcggccgctcagggtcttcttcatcgacttcgagcatcgccgccgcatctccaagctgccactgtcgccactctaggccggtggtccagctacctctacatggctaccgacatcgccgtccaggccattggtcccgctacatcaccttctacttcgtccaacatgattcatcgccagcgtcgccgtatcttcctcgactacacttcgctcttctccagcaactgtgtgctgctccggcaattctccctctacgctgttctcgcgccgcgaccgtctcggaggccttccctgctagtctcctccgacattagcgtatgattcatggtggtctcctgtctcgccgcacggtattggcaacactgttgcgtgcgttcgtcccgagttgtccccgggtctggcaaaccctgtgtgacgtctcgtccttcacggttcgactacatcggctcttcggcgtcatcttcctcaacgactaccgtgattgtgtcaccgtcttcgtctccagtgcgtcctcacgcaccttagtccacgacgccc

SEQ ID NO: 28694 - DNA, 1501 bp, Oryza sativa
cttagcatggtcggcggcatcatttggtacccagattggggggttaccgttgctgtcgagcactgtgacatcctgggctttacattgcagtaaaagagcgacgatcttcggatggcacttccggattgcataatgaagggcagtttcaccgtttctgtctcgcatgttaatgagtttccgcagctcctttgactgcaaaacaaattccacaaactttatgtgacctttttgtacagctatgtggagacatgtggtgccatcgttttcaactagaaatggagcatctggacaatgtttaagaatctccatagcaacaccaacatggccctggtatgcggcactaccaagaagagggataccacttgtgctgattatatatcctaaagagaaatcatgttccaacaatacttttagcacgtcaatcttgttctcaagcacaccaaattgcattggattaacccgtgcgctgttctcttctcttgccaatttaggacgagtctcaataatctttttggcgatatctgagaaaaaaatgtgaaggcatggataatattaatggttaacaagcacatatagctagatcgatacatatagctagatcgatgagggtctcaccagtattgttatttctaaaggcagcatgcagagcattgtatccggaggttccaccgtgagcagaatcaggaacctccaacagtttatcgaacacatcggtgaaattcctcatcaccgcgatgaacatgggcgattcatcgtgtttgttaacagctttcgtcaaggcaggctctttttctatcagctcgaatgcaagcttcctgtgtcccctgcggatggtgtggtgcagcgcgttgcatccttgcttgtcttgcctcaccatcgcctccctcgtatcaagatcgtcatggcggcggcagtagtaactgagaagaaaagaagctaaagcgacattgccgctttttacggtggcgagcaacggcgtctcgccatccgcgtttacagtgcagaggagggacgggttcagcatcaagatatccttgcagaattcctcgtggccatgggccgatgctatgtggaggcaggtgttcccctgcactgtccttccaagcagaaggcttgggtcatgcagagccggcttcacacccgatgtggctgctttcagcagacctctgtccatcactggcgaatctgcggttgctttgctgtctggaatctgcatgcaagtaataaatgaatatgatgctttcctgttaacgacaaaatttggtaggcccatgagagaattatcacatcgtcaacagtcggattactgctatattcggttaaggaaattaatctattaaaggaagcttatgcagaagtagttcaagaggatgcgacatgacaaattatctattaattaggaataatttgttcattaccttttatctttagaaaagtgtgttcagtgtcctataaggattttatattttccttttattttttaggaaagtttttttcttgt

SEQ ID NO: 28695 - DNA, 1501 bp, Oryza sativa
aatctaaaaacaattcatcgacttacaagatagatcaagctcatatgacttttgaaccaacctttggatcgagaatgcaattatcatgcataccattcaatattgtcaaaaggaaaaattaggacggtaaggaactcaaggtatgatttaggccatgtttgatttagcttaggattattataatctaaattattaggagtatataagctaaaacaaataagtagattattatgatagattattataatctataagccagattagtataatctaatatactaatctataagccaaattagtataatataatagattagtataatctataagccagattaatataatatgaaaattatggttggattttttttccgttcgtacaagtttaaaattttcatattttttctccataattctaatgaatttttaaggcgttttatgttaggaaacaattcacctacacaattagttggcttgtagtccaaaatatcaacaatagtttgcagctaatttctttcttttttgtatgtttgtttgtttttgttcaaaacaatatttatttgaaataagagtaaaaatatattagtatgtgtagtgtgcctataaattttgaaatgtttttaataaagtttatgggcgattgtgatcaacttagctacttcaggtagagcactaggtcatatgcccactaggcaaggacacaatgtgcaacgtgcaaagactggaaagagatctttagaggcttttttagaacaaaagatagacctgatggtctattatcatagcaaaatattttttattaaaaatagttcaaaatagtgggttataaattagtttatatagatcataaattgctaatttaatggtacaaaataaaaggtgcacctaactaagaattataattgttaatataatgggtaaaataatatgattttataaattttcttttttaaacattgtggagctaatttagttacgtatatatgataatatatacaatctatgtttataaagtcaacttaaaattattttcactaataataattgtgatctcatctattcagggagaaaagagggaaggagaccgaagcggatgtattttttaatgataaatgtaatttatgttttttatctttttatgtttttaaattatactacctcaatgctaggaaaatacaacaagaggtgaactcactctttgctcaacttaacccaaattttagtgagagttttatactacctaaatgctctacctttatattgctatggtttatatctgaaggcatcatcactacgccaagaaggataggttaccttgagaacgttctcaagggttacaatatcattttccaataagaagttagagtaattttacttaaggctgtgcaggagctgaagggctgtgcgcgaacccgagaaaactttttgcattctcatttatgttagccttgattacttggatgtggtttcttatgttcacactaagctaggagggatgttc

SEQ ID NO: 28696 - DNA, 1501 bp, Oryza sativa
gtgttgctgcaggagaattgtgtgataatatagtatatatgagttctaaaattttcttttttccctactatatgattttttcatgtgtttatttttttacctttatcagttatccataggttataaataattgggttgtatggtatgccttttggggggggagagatgtaatttatacccttgataaatcatccaaagcctaaaaacaatttagataatgcgaagaggtgcaatttacacccttgatgaatcatccaatgtgacggagcgtggggctcctcaccgggagaccgcacgggcccccctttgccggttcggccgggggctcagggtgagatcccaagctctctgtgtatgtggaaagatcgcgacctattgaaagagcatgaagcacaagcgatgtatacaggttcgggccgctgagaagcgtaacaccctactcctgtgttttggtggatctgtgtatcaaggagctacaaagtgtgagccaacctctcccttttcttctagctactgaatctggaaaaagtcatcccccttccctatgggcaaggtcctccttttatacttcaaggggataccacatgcacccctctctttccaaactggacttttcttctcttcataaatggacggagatttgcacgggtgtcctccgaacatccttctgacgggacgggacacacctacctccacttctgccggaggcaggcgcgtcgtgggaacgtggctgtgtgctgacgacatgagcagtgtcagaccgatcacaaatcggtcattcttgtccaccacgcgtcagcttagcaacgggcatgtttgcccttcttcacacaacatcttgcctgtaatggttaggataaagcctggcatatatcgaccggggctaacgtgccatctttgggatgtaacacgctaactccagctggggacgagtgcctagaagctctcgtcttgacgggatggggcgaagcgtgcgtcagaccgcctgtcgccacctaacccgcgatttgaccggtctgtgactggtcacagaccggataaacgagtggagtgcactgtatttcgtgcggcgtgacacgtttagccgagccgcaataaatgcggttaggtgagccctgctgtgctcacctaacccatgcacgcggagtagaacccgcgaggggtcggggcgcctcggccctcgggggcgaggcaggagtggtccgacccccccctcggggagaccaagaggtgggcgcacacatcaccctcgggcccgacgtcccccgagggtgccaggccacgtgggcgattgtgtctgcctcaagcctctagtcatgatactcccggtcccatgtcaccgacagtagcccccggcgttatgccagggcgatcgcccttctcaagggaagcggtcgggcgtgacgccactcctaaagcctggtgacaggtgggaccggtctccatggttgggcagaaacccaacggtctcaaaccatgcgcatcggtaatggtaacttgg

SEQ ID NO: 28697 - DNA, 1501 bp, Oryza sativa
agcctcgtgttccagggcgtctggttcgtcgtcatgggcgtcatgctctggaccccggcgctcatccccaagggctgcttcctcaacctcgaggaaggccacgacgtcgtccggtgccgcaccgatgaggcgctccaccgcgccaagtcgctcgtcaacctccagttcagctggtacctcaccgccaccgtggtgttcgtcgtcgtgttctacctccacctgacgaagctgtacccggaggagccgaggtacttgccgctggtcaagggcggcggcggcggcggcgacggtgacagcgacggcggcaggttcagcatcggagacgacgaggacgacctcgaggccgcgaaaggtggcttcggacacgtggcgggtggcgggaacgccgttgaaatcgagcggtaatttactccgcgattccgtgtcagaggaagaaacaaatgtcaggatggctatgtgattagattgaaaaacgagggcctatgtgtaaataatagtatttctttttaaaaaatatttttagtagtactatagggaattagtgatttgtgtgtgagtgaacaagctgatcgacccataaatttgggtaaatctcatgcttggatcgcttcaatttgtttagtcaagagtgtctgatatcacaagggttaaattgatccatggatgtcgcatttggttggttatgtctgtactctagccatatgagtggagattttgcacacaacggaaaaccttttcatcctctgaatctcttctgttccgtgcaaagacgatgaaccaatatgccttcagagttcagagacgtgccaagccaatcaagactgcatttcaggtcattttctgaatgggaccgcgactgctgtgttgcagtcaattcagatagcttgaccagcttgccttcttccaaacatttttgtaaaaaaagatggattggttcgaaatacttaattaattatcaggtgattacgggagatcgatcgcctgctaagcgtaagcaaatgaatggaccaagccaacagcaggattggcatgtactaaacagggcgtatcatctgctaatgtcagccatatcttagggggggggggggggggggcgaagatgtcagacaattctgataatctgcagaggagaagaacatacttgtctctcgttttgatgttgacggtaattaaatttggtacgacaggacggcagcaaaaggcttgcacgttggtttttgctgggatctagtagagctgttgtgctcaaagaagtttctgcgtgtctttgtttcaactcatatgatggattatggctagtagctcattcactttcaggaaattctcatggaaatgaaacccgatttcaagcattaccctttctaaacatttaaagccctgtttttcgccaggccggtgggaggacgctagccaaatttattatgattcgaaggagaacgttcactaaaaaaaaattcagccagcaaggatttgtttctgcatgcgggcagtatgaaaatcc

SEQ ID NO: 28698 - DNA, 1501 bp, Oryza sativa
cgcgctgctggtctacgccgcggtgactatccacatggacagggccagggcgcccatgcgcgacgccgtgtcgcagctggtcgccgccgcggcgttcgcgcagcagctgctcatcttccacctccactccgcggaccacatgggcgtggaggggcagttccactggctgctgcagacggtgatcgccgtcacgctcgccaccacggtgctcgggatcccctgccccaggagcttcgccgtcagcctcgtccggtcggcgagcctcgtgttccagggcgtctggttcgtcgtcatgggcgtcatgctctggaccccggcgctcatccccaagggctgcttcctcaacctcgaggaaggccacgacgtcgtccggtgccgcaccgatgaggcgctccaccgcgccaagtcgctcgtcaacctccagttcagctggtacctcaccgccaccgtggtgttcgtcgtcgtgttctacctccacctgacgaagctgtacccggaggagccgaggtacttgccgctggtcaagggcggcggcggcggcggcgacggtgacagcgacggcggcaggttcagcatcggagacgacgaggacgacctcgaggccgcgaaaggtggcttcggacacgtggcgggtggcgggaacgccgttgaaatcgagcggtaatttactccgcgattccgtgtcagaggaagaaacaaatgtcaggatggctatgtgattagattgaaaaacgagggcctatgtgtaaataatagtatttctttttaaaaaatatttttagtagtactatagggaattagtgatttgtgtgtgagtgaacaagctgatcgacccataaatttgggtaaatctcatgcttggatcgcttcaatttgtttagtcaagagtgtctgatatcacaagggttaaattgatccatggatgtcgcatttggttggttatgtctgtactctagccatatgagtggagattttgcacacaacggaaaaccttttcatcctctgaatctcttctgttccgtgcaaagacgatgaaccaatatgccttcagagttcagagacgtgccaagccaatcaagactgcatttcaggtcattttctgaatgggaccgcgactgctgtgttgcagtcaattcagatagcttgaccagcttgccttcttccaaacatttttgtaaaaaaagatggattggttcgaaatacttaattaattatcaggtgattacgggagatcgatcgcctgctaagcgtaagcaaatgaatggaccaagccaacagcaggattggcatgtactaaacagggcgtatcatctgctaatgtcagccatatcttagggggggggggggggggggcgaagatgtcagacaattctgataatctgcagaggagaagaacatacttgtctctcgttttgatgttgacggtaattaaatttggtacgacaggacggcagcaaaaggcttgcacgttggtttttgctgggatctagtagagctgttg

SEQ ID NO: 28699 - DNA, 267 bp, Oryza sativa
tgagtggtggggagaggataagatggaagagaagatatgataggggacttagtttattttatggaggtataatttttgcaggcggaccacataagctaccttgtgcaaaaattcaaaaatcatattttttttcaggcggaccacttaagaggtccgcatataaaaataaaggtattttcgtaggcggacctcttaagtggtccgcctggaaaaattaatttccgcaggcggatgatgaaaattcacctcggtttatattttcgtagg

SEQ ID NO: 28700 - DNA, 1501 bp, Oryza sativa
ttagtatttttcatcattgtacattgatcatctgcaatgatattagtaaatgtttattttacaggggataaaagaataaggaaaagaaaaggagataaacaggagcaagacactgaagctaggaagtacaaaaaggtaaaaaacaataacgagctggaaaattttatatatatatgtatatatatatatatatatatatatatatatatttatatttatatttattgtactggatgtgttgtaccaatgaccaaaaagttatattatgctggatgcgtagacataccaagatcctactacaacccttctggaaaatcaatgttcctatggagaattggagaattgtagcaacatcagtgaagacagaaaaaatacttgcactagaaccagtgcaaaagcttcacattttttttgtatttatttatttttatttccataagatattgttttaccaataaatcagcaaatccattttatctatagccacaaatgcactgaattttagtatggaactaattaaaaacaataaccaatcagaaatatatataaaaatatcaacactatctattgaaatttgaaaattttgtgcgatggttgtaagaaactgtaatacaaatggaatggatgtactgtacaaaagatgtacgctaggaattattagagaatggcaatagaatagctctattgccccattgtatgtatgatcaataattgtagctcctattaatctttgtcgtcataaatattgaagtgtttgtattagctaacactttttttactattcatgtgtaattttctgattatatatagctgttgaaatgaatgattaagttttgtattgattcaaccaatatctttaattattcatatttaattttatgcttatattcatttctgactttggctattttttgtgcttatataatcagaagtgttaatatgccatcaaagagaaagcaagatccaataaaaatagcagaatatgataaatcagattgcaagaaaagaagatatatcagactacaaattctaagagagaaaaagcgaaaaagagaagaagaaaaaaatatggtgcataataacaataaaaaatgtaataaagatgaagaagaaacatcaaaaaatagtaatataagagatataatatatacagaaaagcaaaaaaatattaaaaataaaagaaaaatacaatataatttagattatctagaaaaaattgcaaaaaagaaatgtttagagatagaccatatatcttcatatttatcaacttcacatggcatggtgtcctttaccccagaatacattaaatatctaaaagaatcatatgaaaacaaatcatttataggtatgccagagtataaatgtaaacattgcaatgctatattttgttttgaagaaagaaataaaagagagacaaagaaaagaaaaggtgaaattatatattcaaattgctgtaaaaataacaaaataaaaataccaccattccagaacccaccagaaa

SEQ ID NO: 28701 - DNA, 1501 bp, Oryza sativa
agaaatattatttatttatttattaaaaaattttatgtacaacgatttttatataagatgtatattttagcagttcgagaatatgtagtaataagaaatgaggaagttatcgttttgagtcgaggaaaagaagtcaacattagaaaaacactggttcagtaaagagccactaatgggaattttcgggcctgttaactttgatgccattttcaaccttatcaaattttggtaaagttgtcaaaaaagtgactatataagaaatcctgccagtcactataccaaaattttgacaatttgataaggtttttttcggcatcaaagttcgtatgcatgcattgagctggcttatcaccaaacttatcttctcgttgtactttttttttgagagagcatcttcccatagtacttacacgcatgcgtttgaccaaattaattaacgggctagcacttggtttagtatacgaccataaccgttcttatgtcaaatttatccaattggtccttttattaacctattgaactcgtttcacaccgaaacttgccatgttacatttgcggatgtttctctgttcttttttctttttcataagacaaacaggagctctgctagctgctactagtatattcactaaagggagaaaacagagcagaatttatgaggcttggctaagtagctcgatcttttttctaaccattattaactaaaaattttaaaacaaaccctatgaaaatcttacttttaaaaataaatcttttggccattgccatccgcgatttattttctcccttcactgccattaccatacgccactgttgaaagtgccaaaacgttgtcctaccatgtcagttaaaatggcaagctaaaaaggttcagagctgaaaataagttttcaaatagtttattttcaaaaatatattaaaaataaaaaaaatcaaagtacatcgggtggaaagaagtatagttgaccaaaacgccctaggcccgacggctcggccaatggcatgggtttgggcctggcccaagcagtcaggcccttgttggcccgaccagacctttgggtcgtgcttgggcctctgcctcggcgcgatgggctggctcgacacggctcaaagagatgagggattcaaaatatacttattttgagccatatgagagttggcccaaagagatcagggagacaaaatagactttttccaaggaggagcatggtgggctttcgtgccttctagtcgttcatgggctgttggtgcaacacttggacgggcatggcccgtcctggtgtgtaggtcaggtcgtgccgacttgactgaactcagcctcggcctggttgtgctcgggccgagtcgggcgacccatttggctatccacacgtttacggtagtaagtctattatatatgatccactttgtaaatcatacatgtaaaatatcttttaaataatatgtcagggttacgggttaggcataccctttacccttcgatatacgttacatatcgata

SEQ ID NO: 28702 - DNA, 1501 bp, Oryza sativa
tcaacatagtgcacattccaagtggccaagataagactagcagataaattagtgcgcctacaccctgaaataaagtgacaaaatggtacgtgagtttttgaagctactggttacattttcatacaagactactaaacaaccttttcacctgaagcaaattgcgtgagataagattaagatcattgccaatgactcgtgacacttgctggcagtcagaaccaagcctacttgtcaaatcaccaacagtttcttcatcaaaaaaagcaatgtcctagcataatttaaaatacagttaaaagcttcatacttgggtcaaccaaagtaaaacaacagaaaactttatgtacattaatgaaatttctttcagcagtaatattttttattccttttgttttacctgagaaagaatagaatcaaacagcatttctctcattcgtttgacctacggaaaattttcagatgatgaaggttagagactggtcaaacaaaggggcaatcgtgaggaataaacttggaaagttacattaagaaatctaacatggttttaccaatatcatgtttgcaacaccaaaacagcagcttcgcacaccactgcaaaattggataccagctagtaagcaaccacaattgatttttcacaaaaaaaaaaaaaaacatgcagaagacaaacaattttggtttcaatgcagattacggagtatcttgctaaatgcctatagtgcatttgacaggacactggtaaatgtagaaatttgtatttatgctaccctatagtgccatgagctaccaaatcgattcatcagcataatagaagattttcaatattcagacccattgaagctcaaagcatttccattcctgccctagatttggactaccaacacattatatgatattacattgtcaaccacaccatccatggaagtgatcttatggacctaaacgtctaacgaccttttcagttttcaccacaacaacaatgtgatcaggtacagttgtattgtggacagaaatacagaatgcatgcttgaaaatgcaggattaccaacttctttggtttttccgatgaatgcagcatcacctacttgttggcttctctaatgatcgcgttcacgacttaagcacagttttaacaaagcaaagaagcaataactgacctaaacactccggaaatcaaacacagaacaaccagaagcttagcgttccggtagaacacagcccctccgttctgcgccgagaagatggacgctgcgaggagatggggtatcgcgatctccgcgagctgcaaccacaaccacacgtcaccgcgttttagacccatcaacgagaactctgcagcagcagaggtcaaacccagaaatcgccattaccgcagcgccgacgagggacgcgaatccgacgaagacaacccatcggtcggaggcgacgagcgcccacatccgcctgagcgcggaggcggccgtggcgccgctggcctcggcgcggccgcccccggcctcct

SEQ ID NO: 28703 - DNA, 1501 bp, Oryza sativa
gctcgccaccacggtgctcgggatcccctgccccaggagcttcgccgtcagcctcgtccggtcggcgagcctcgtgttccagggcgtctggttcgtcgtcatgggcgtcatgctctggaccccggcgctcatccccaagggctgcttcctcaacctcgaggaaggccacgacgtcgtccggtgccgcaccgatgaggcgctccaccgcgccaagtcgctcgtcaacctccagttcagctggtacctcaccgccaccgtggtgttcgtcgtcgtgttctacctccacctgacgaagctgtacccggaggagccgaggtacttgccgctggtcaagggcggcggcggcggcggcgacggtgacagcgacggcggcaggttcagcatcggagacgacgaggacgacctcgaggccgcgaaaggtggcttcggacacgtggcgggtggcgggaacgccgttgaaatcgagcggtaatttactccgcgattccgtgtcagaggaagaaacaaatgtcaggatggctatgtgattagattgaaaaacgagggcctatgtgtaaataatagtatttctttttaaaaaatatttttagtagtactatagggaattagtgatttgtgtgtgagtgaacaagctgatcgacccataaatttgggtaaatctcatgcttggatcgcttcaatttgtttagtcaagagtgtctgatatcacaagggttaaattgatccatggatgtcgcatttggttggttatgtctgtactctagccatatgagtggagattttgcacacaacggaaaaccttttcatcctctgaatctcttctgttccgtgcaaagacgatgaaccaatatgccttcagagttcagagacgtgccaagccaatcaagactgcatttcaggtcattttctgaatgggaccgcgactgctgtgttgcagtcaattcagatagcttgaccagcttgccttcttccaaacatttttgtaaaaaaagatggattggttcgaaatacttaattaattatcaggtgattacgggagatcgatcgcctgctaagcgtaagcaaatgaatggaccaagccaacagcaggattggcatgtactaaacagggcgtatcatctgctaatgtcagccatatcttagggggggggggggggggggcgaagatgtcagacaattctgataatctgcagaggagaagaacatacttgtctctcgttttgatgttgacggtaattaaatttggtacgacaggacggcagcaaaaggcttgcacgttggtttttgctgggatctagtagagctgttgtgctcaaagaagtttctgcgtgtctttgtttcaactcatatgatggattatggctagtagctcattcactttcaggaaattctcatggaaatgaaacccgatttcaagcattaccctttctaaacatttaaagccctgtttttcgccaggccggtgggaggacgctagccaaatttattatgattcgaagga

SEQ ID NO: 28704 - DNA, 1501 bp, Oryza sativa
aatatcctatatttaagaacagtaaaaaatattatgttgacgggtgatacccgtagaccggatataaagggtattggggtacgttggtacaaggatctacgtagtacgacatcaagcaaacaaaagacaagaattatactggttcaagagacaagaattatccagttgatgtgggattatatggtagaaaacacaggttacaaagagaacaagggaacttgtcggatccggcgagattgtagtcgagttgattcaactagctctcggtgacttggctcctcgtaagctccggcttcgtaggctgtggagattgtgttggctctgagattcaatgcctaaaccctccccggggggccccttttatatcgcagatctggaggtctccacatagaactcggagatatcagaccctatacgatacgccaacgacccagttctgcctaagtaggattcttcccatctgtagattccgtaaaaggtttccttagaatatacaggaaatatctgcatgcgcgtgggtatgccatatcgatatgtaacgtatatcgaagggtaaagggtatgcctaacccgtaaccttgacagtagcccccgacttctgcttaaaatgaactcgtgcaaccatttgcgacttcgggtgtcgagactattgtcattcccggtgcgaggaccgcggagatagaccgtagtcgagcacgccatttgaagcccaacggtcacgagcgaattttaaactgaagtccaaaaaactgccgcgcgtaacgggaccagaaatttccggcgggcatctctctctgttccctggaattcgcaccgtcggtagtgcgcctatttaaaggaattttgggaatccattttgaagtccgccaaatctgttaaacacacaccacctgcaagcactctttgccttctccgccgccgcaagaaaccctagttcatcaacctaggctcgttttccggcgaccttcgatcagcaacggacctcggcaaatcggcttccaccagtgcaacgttgaagaaactccaggaggatggcgctcttcctggccgtggaaccatggagagtgaagcaggaggtactaatcctcagcccatcttgggtcgcatggttgcgatcgaagattatgttctctgcggttttctccctcctccttccgaatttcttctcctggttttgaatttctatggtctttctcttctccatttgaaccccaattccatcgccttccttagcatctttgtgcatctttgcgaggcgtacatcggggtagagcctttccttgatctttttcgcttttactacgaactgcgttggatggaatccaacagggtatctggttgcgtcgggttccgacttcgggatggcctgaagtcgcgttacattcccttccagtgcccttcttctcgcagcaagtggaggaataggtggttttatcttgagatcaaggactcgaaccctgtcttcgtggttcccggagatcaaccggacaagattccgtct

SEQ ID NO: 28705 - DNA, 1501 bp, Oryza sativa
cccggaggagccgaggtacttgccgctggtcaagggcggcggcggcggcggcgacggtgacagcgacggcggcaggttcagcatcggagacgacgaggacgacctcgaggccgcgaaaggtggcttcggacacgtggcgggtggcgggaacgccgttgaaatcgagcggtaatttactccgcgattccgtgtcagaggaagaaacaaatgtcaggatggctatgtgattagattgaaaaacgagggcctatgtgtaaataatagtatttctttttaaaaaatatttttagtagtactatagggaattagtgatttgtgtgtgagtgaacaagctgatcgacccataaatttgggtaaatctcatgcttggatcgcttcaatttgtttagtcaagagtgtctgatatcacaagggttaaattgatccatggatgtcgcatttggttggttatgtctgtactctagccatatgagtggagattttgcacacaacggaaaaccttttcatcctctgaatctcttctgttccgtgcaaagacgatgaaccaatatgccttcagagttcagagacgtgccaagccaatcaagactgcatttcaggtcattttctgaatgggaccgcgactgctgtgttgcagtcaattcagatagcttgaccagcttgccttcttccaaacatttttgtaaaaaaagatggattggttcgaaatacttaattaattatcaggtgattacgggagatcgatcgcctgctaagcgtaagcaaatgaatggaccaagccaacagcaggattggcatgtactaaacagggcgtatcatctgctaatgtcagccatatcttagggggggggggggggggggcgaagatgtcagacaattctgataatctgcagaggagaagaacatacttgtctctcgttttgatgttgacggtaattaaatttggtacgacaggacggcagcaaaaggcttgcacgttggtttttgctgggatctagtagagctgttgtgctcaaagaagtttctgcgtgtctttgtttcaactcatatgatggattatggctagtagctcattcactttcaggaaattctcatggaaatgaaacccgatttcaagcattaccctttctaaacatttaaagccctgtttttcgccaggccggtgggaggacgctagccaaatttattatgattcgaaggagaacgttcactaaaaaaaaattcagccagcaaggatttgtttctgcatgcgggcagtatgaaaatccgtttgtataaatgacgagaggttttgtggtctaaaatcacatgttaaaataaccatattttcacgggacaaccgcttctaaaaatcaatttttacatataattgtgaaattgcatgtaaaaattaacaattttcacgtaccttttgatagaggtggttgcccaaaacatatttataaatcgatgttaggtagcctcatgttaaaaccgcttcgtagtagtgattgcagtaacg

SEQ ID NO: 28706 - DNA, 1501 bp, Oryza sativa
aatgccagaagaggatgtccccttttgtcacgattgtagagaacaaggacactatgccctgaattgtccatgggtatatgccaaagaagccccttcctttggtttaacagggcagacatcgctaaaccagcctcctcgcaccaagtcaagcttgcagcctagtgtgcaaagtagagagcccaatggagagaatccattgaatcccgggaattgctttcctcctagcccttcgtaccacgtggggtcacgtactaagcaagccaaaggcaagaagagtaagaatcagaagagaaaagcgccgatgcgaactgaagaagaagtacgtaagatggctattagcagcaccgaatggcctcccgcagggataactattcctagacgtcaaagaggaaataccttccgaggtgcacgacagttgacccagcaccttctaagccatggtggcagagtatctgatagtgaagggtcagatcaagtctcctcggatgatgaagatgagtctccccgacatctcggtgaggaagagatggaatcaaaagcatgtatccgttgtggagaaattggacacattgctagcatgtgtctcacactctgcgcttattgtgaagaagaccatccaccaggggagtgtcccacccgcaaggtcacatgctttctgtgcgaaggtacaaatcatgtgcccaaggattgccaactcagtgtgttgttgaccaagaccgcagaaatccaacgaacgaccctacgattgtctcgtcagctagtcagctccaacagcaacatcgacgatatcatccacaacaccaatgctcctcctgctccacctaactctgcaataaatcatagcaataatatctttagcaccaaccattctctgcaccgacagcctcagcaaagagttgtcgtcgatggaagaagttgtgtctctccccgacctactccaggccaagcaaagggcaatcaacctcaggagggcgataccaagcagaaaaccgtcatccgcttcaaccagcaatcagaaggaagcttctcctgcgaatgatagcattatgcagtcctatcacatcatcacagaaccaatcaaggatgatgcagtcactagaacaatgccagctatatctctccggaatcaaaatgagcagccatgtttgtggttttcagtttgctacttatcattgtgtaatcgaaagtatgcagcaatcatgtaataaacaaatatattcatgattttaaacaatgagcttgctatgtttagggatgattcatgttgaggatacaatgtaccaatgataagcaccttccctttttgtttaaggcagtgccttgtattcgtgtaataagggagaaatgggtaatacagacaagttctaagaggattcttgtggaagatgcggatatgtgatcatatgtataattgtttactgacaaggagacctagggtctcgtgtcagaagaactatattataaactcgagttaataaccaacctgttgatggaaaagaaa

SEQ ID NO: 28707 - DNA, 1501 bp, Oryza sativa
aaatggtatcgattaattgatcgatctctctttctctctttctccataaaattatatgggtattttcgtttatattttctatggatattaacatttgtttatcaaactaatcacatgtatacatgcaatgatactttcatttgtgagtagtcatatatggtgtgcccaaaggacatcctgggggagatgtgcctagatctttggccattttaccacctgctcccaagaaaaatcaacatggcaaagctcctacagtggaaagtaattcttccttggtaaatgagccacttctcttgtgcaaactgaccaaacagcagctactgacaagaggaagatgtttactttccctgatcaggtctactgtgttagccagggaaaatatagtacagatcatgcatggtttccttcagttttttttcttgtgctaacatgttttagtttaacagcgcaaacgagttaagacattgacgaagaaggacttggaatcctactttcacataaaacaaaaaagtgctgctcatattggtctgagtgttggcacaactgctctgcaaaacctctgcaaggctaatgacttgaatatatggccatatagataggttatatgatgcatatgcatttgaattctacatatttttcaatttatatacaattgcatttcttgtaaggttcgaaccacatgctagttcaaaagcttataacatttttgcttatgtcttcagatcgctagattggagaacaagttcaacaacaatttgaagaaacggatcactgagtggaatcttggcaaagttcagggagttactaaagctttcaagctccgcaaggaaaaggaacaattttaccaaaaaaaataatgtcaagtatgctggagcaattgcaaggcatagacgagattgtgcatagcctaccggaagcggacgatggcatcgacattgaagacgacgaagacaacgatgaggtgatggaggataacgatgatgagaacagtgatgagaactaaacacgcaagggaaatcgtggaggagctatctatctacttaatttgtaatcctaagcgtgttggggaaatacttatcatgggctatctatttcttattgcttatttgtaattagaaccaccatatctgttcatttgaatactacaggaatctattatatgcaattgtgctatgattttagattatagttagaaacatgatatcctttatttaacattacatgatttatgcgacaatgccaatttcaagtccattttaatatatactgccgtcactaagaaaatgttttgtacaaacatttttctaatagtatagacacttttcaaatgtctgtagaggcattttcaaaaatgcctaataagtgtcttggacattacagtaaaaaaaaagtgtcttggacactatagaggcactttccaaatgaaaaaaaatatctaataagtgtcttggacactatagaggcactttccaaatgaattttctctacaaacaaaagacat

SEQ ID NO: 28708 - DNA, 1501 bp, Oryza sativa
ttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtgattttataactttagactttgggaattctcatatcatttggacactttggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcgtggcagagggttggtgccctgctgcttggggctcagtcctgcctgcctgtcccgggggttccggccgtaggcaggattgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgccgtttactgcaaaacttaacccctatcttattatccccttgtactcctttgcattaattgtgcatctccggtgtggcctgctgagtactgtggttgtactcattcttgctcaatcttttccccccttcagtaagagaagctttggagaagaagtcttaggtggagtcctggcttataccccagttgagcgcctgtgaagatggagccgtaggcccgctagtccgctgctgtttatttttgtttgtcaggcctgaagtacctttgtaataatgtaaatattatcgatataataaagatgtgtcttttataccatgtttgtgtggtgtacccggcttttcctgggacggggattaatacactggtgttcgggaaaaggcaattttcccggtcgcgacaagatggtatcagagccatctcgactgtaggataagcca

SEQ ID NO: 28709 - DNA, 1501 bp, Oryza sativa
acgaagcggatattatccgatccgatccgctccaaatccgtccgaagtgaggatatggtaagggtttttagatatccggccagatgcggatgcggatgcggatatggtatcggtaatatctggcggatacggattatccactattttaagcggattatccgataaacattttggcggataatccgaatttcataacccatataaccactcaatttaacccatataaccactcaatttggcccatttggcatgtgcattttcatcgtgcaaagattcagcccattcaggtccaccttatccatcaatctatccaggagttcagtccgtgactccgtcgacgtcgtgtcaatttttttcatcgagacttctcttcttatagtcctcctacgccgccgcctgacttctccacccagcgtgcgccctaccgtctccagcccggcgccaccgccgccgccgccgccaccttccttctccaccccggcgccgcggcctaccgtctccaccccagaggcggaggcgtcgccgccaccgctgccacctcctgtgctggtcacctggttgtctccgtctcggtgccggcgacgcctcctgccatcgtgatgtcaatactatatgtgtcgattagatgcttttggacagaagacaagtcaatcgttaacaacttgacattatattatgatgtgatcatgtgaattgtgatattggtatctcattgttgctcattgtacagataatcagatgttgtatcgattgtatatacatgtcacatccgattattttcatccgtttccgacccgagtccgcaccgactctgcaccatttccgacatccgaaataatccgctccgcatccgcatctgcacattatccgcaccgcctctgaatccgattaaaaaatatggtataggatatggcatgactgctatccgtccgaatccgatccgttttcacccctagatggagtggtggtccggtggggtgggtcgcgtgacgctttcacgtacgccggggcgccaccacagtacacatgcgtcgagagaacaaacgtgcctcaatggacgctcgtacagatgaaaatacttggtgaaaaccagtactctaatatttgtatacgtcattgtaaataacttttatatttaaatttaatcacgagtaaaaattttacacatgatgataggaataaatatcatacgtcgagtttttattttataatagtttgttgattttcactgcacgtgcggtttcaaccacatattttcctcatctacagcgcgtgccgttttgatggttaggtctcctctccccgtccactagggtgtggtctatggaagacagtggcataactggttagaccattcccagtgagtttaataagaatttcaatctcattaaatgatatgttgtatagggtaaactaatagcatatcagtaaatttattaagagagaaggaataagtttagttttgataaaacttagtttacacacttgcctatgccttgaa

SEQ ID NO: 28710 - DNA, 1501 bp, Oryza sativa
ctccctcggattcgctcggaatctttcccctaaacctcgccggcatcaatggcgcccgagatcgccgcggccgtttccttcccctccggcctctctctctccctcccggcgctatataattgttccccgtgcctctctcctccgtttccgccgctcgccgctcgctctccccgtcggattcgtgctcgcgccgtcctcctctctctccgccgtcgccgccgagctccggttcgccgccgtcgtcgccccggacttcctcccgtctcggcgtcacctccatcggcttcgccgcgtcgtcgtcgacctcgtccgctcctccgtttcgcccgccgaccgccggagcaccgtcgtcctcgccgtcccgaaccgcgccgccgctttcctccactccggtcgtcgtttccgccgtcctcgtcgtcccggggtgaaccgtggaccgcccctttcgcttccctctcttctccgctctctcgggcgccgctccgccgcgccggtggtcgccggcggtgaccatcggggcgcgggcgcgccgtctcccgtcggccgtgccggcgaggccgccttcgggcgcgccccgcggctgccaggtggggcccggccgtcagccgcccgcgcccgcgggtgcggctgacgcgtgggacccacggcgccggccgccgtcagccgcgtgcacccggtccaccgtggaccgagaggctgacgcgtgggccccactcccgtggacccggtccgcgcgccctctctcccggctgacgcaataaatgagtttttaattaaaatttaaatgaagaaattcgtaaatatccatttaaagagcatataaacttcaaatggctatatcttggccatttgaactcggaattggaccgttcaagtctctaatttttccttaagaagtcaagaacccatttttgtgctttgtttctgctgttatgtggagtttattagagtaaaagccgtttcttttccgttagtcgtgtagacgctgcagcttcggaagatccgctcttcgtggaagttgaagccggtgtttgggaaagcgagcaaggcaagtcacatcatccttgagcatattgaatcacagtttataaaattattttgatttaaattattgcattaccgctttatttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtgattttataactttagactttgggaattctcatatcatttggacactttggaattgttggtttatggtggaattggacatacacctctcttcccctttcaaaacccctaaaacctgttttcggtggggtttgggtgcatgccagttgtgggaagtagcaccccggccactataaggattaa

SEQ ID NO: 28711 - DNA, 1501 bp, Oryza sativa
atggtagctgtgaactaagcggcatgcttggaatggaccaagggtgtgccctggttaactctcttgaggccagtggtggattgagttgaaaacttgagttactggaggcataccctctgacattctttcctttttctctgttaaacatctgttacagggattgaggtgagagaggaaacaagctaggaaagaatagaccagaactagggacaggaccttaaaggaactaactctctttgttgatgtgttgtttgtttcacttattctgcaagttgattaagcaaacaacctagcatggttacatcacaaccccccgatgcaaaccacgcgctacacacacaagcaaggaacacacgactaacaacactaccctacagggtggcttaggttctgcgacgggttctccaagatcttcactgcttcacagctggcttcactgcttcctccacttcgctagcggatcctgcagtcttccggagcttcggcgaacaattggcgacatcttcttcttcgcaaactaaccatctagtactagtggaaatccgaagaaggaagaagggagtaaaccttttgcaaatagcattaggggaaggagaaaaaaaaggaactttcgcaaatagttttatttataaaatatgtccttaggttttatccacttggcttatcctacagtcgagatggctctgataccatcttgtcgcgaccgggaaaattgccttttcccgaacaccagtgtattaatccccgtcccaggaaaagccgggtacaccacacaaacatggtataaaagacacatctttattatatcgataatatttacattattacaaaggtacttcaggcctgacaaacaaaaataaacagcagcggactagcgggcctacggctccatcttcacaggcgctcaactggggtataagccaggactccacctaagacttcttctccaaagcttctcttactgaaggggggaaaagattgagcaagaatgagtacaaccacagtactcagcaggccacaccggagatgcacaattaatgcaaaggagtacaaggggataataagataggggttaagttttgcagtaaacggcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagc

SEQ ID NO: 28712 - DNA, 1501 bp, Oryza sativa
ttgtgtataataatatattcaaagtacaataaaatcagtgtatcatatgatcggagggcaaaaggtaacgcactaacaatgtctgaacgaatataatactcccgtcatcccgtgcaagtgtagcatacagtgagcaaattggtgcaaactgcaaaggaccatgtgttagctaatttttttttctatgtactttgtactagttcagaaatccttggaagattggttggaaagctgtgcattttgtttttgtgatcttcagaaatgtcttgccagttgcaaccctgttcaattgttgttcagaagcagcgaaggaaactcccaattggttttcatgcacaattagtgttgaccaaaaaggttcttaccgttaggtcattttggctatcaattctgaattacctctgcctacaagaagcatttattccaactcgcttaaaaggtacataaaaattacaaaaatttaaatgcttctattaaaaccctacaaaagtttgaaccagagcgggttcagaaattttctagagcatatggacaagtatttatgtagttaattaaacattggaaatatagaagctattactgtgatgttacccgctaataaaccttggtcgtcaggcctcggatccacccgtgctttaaaccaacgtcctagctagcaccccaaactctaaaaccggaaatttatcctctcaaaccacaatatccacgtgccatagctctcatgctttaaggaaggggggattttagtccatagcacaactgcacaagttgaaaaaagatttatcgatcatttcaaaatcctcaaccactgaactggatagtttgctctggtgagaagtgagatagtaggacgtcgccacaacatagtcctacatgtgtcaacctagctgggccaaatcgaatacattgttcaccaaacaaacaaattaataagcaccaaacttctgtgcatggttagctaggcttaatgtatatgaggatgctcgctaccaaccgcggtgatatccccaattggctaatgcatcactagctagataaggctccaccgaccaatattccttctccatgaccatgtacacctcttttcttgcattcttttcatgggctttttgaactatgtgtgtgcctctttggatagatcatagatgtgcttagcttctatctgaagcactaggattttgtatatatacaatcgatcaacagatcaccatcgagaggatggtgatgatgatggtgggtcatctgaagacagaataaaaaaaaatgccattatgaatttatgactattagcagggaaaaccacagagtacacaaatagtggtgaaattaaagtacagcaagtacttgttagcaggttgtctgggacagggcatgctttgtcactaagccttcgttagcatcgatcagtccattgccggcctgatgctaaagtagtaccccacactagctaatcatatggcttacattatagcaggtagtactacaaaaatttgtcagtgat

SEQ ID NO: 28713 - DNA, 1501 bp, Oryza sativa
gaggtagcgcatcgccagcgcgatctccagcgcccggctcaccctgtccaccagcggcggcggcggcggcggcgaggacggctgccgccgcctctccctgcttctgccgccaccgtccccaccgtggagccactgcgccagcgtcgcgccggtcagcagctccgtcacgaggaagcagctcgccggcgggcgcaggcacgcggccatcagccgcagcacgtgcgggtgccgctgccgcgacagcgcgtcgagctcctgcgcgaagaaggcctcgccgcggctgcgctggtcggcggcggcgaagaactcggcgcgcatccacttcaccgccacgtcgagccccctccacgtcgccctgtacacatccgccgttgaccctcgcccgatcatctcgtgcagctcgatctgagtccatggacaggagatcaagctttgctgtgatcgatggacaaatgtttcacgcgaacgcacctcgtcgggagcgacggaccagccgtgctgcacggcgaggtctctggtggcggcgaagtaggggtcacagggcggtgcttcagcagcatcttcgtcgtcgtcgtcggcggcggcggctgttgccggctcttgatctccggcgtcgcggtgcggctcgtcgtcgccgccattggagttggacacgaggtgcaagaagtcgtgcacctgggcgacctcgaggcagaacctgagatacgcctgggtgctctccagccgagccatgtaagtctccttgagatctcgctgcttctccacctcctccttcagcttcgccaccaccttcgccattgcagcacacgatcaaacatccgcaagctacatacatcatctcgtcgattaatcaggatttcattggatgcatgtctggctggctacctcgtcggagtgctgatggtggcagggtgacggcgaggagaagaggccggcgaggcggccgcggagcccgagcccgtgcggcgtgcggccggtgttcgtcggcgagctgcccatgacgacgcccggagtgcagagagagcgcagcttgatcaaagcctcgcgctgttgatgtggattcttggtatctattgcggataatacaagagatcactagatcagaattcagaacagaacagaagtttgtgttcacttgtagtgaaattttgcagtaacaaagtgacaattagcaacatgcagacaaagaacagcgatgcatctgatgcagctcagctgaaaattttggagacagcgtgggctcgtggctggccggccggcctgccagttgcatagacttggatggactggactggacgagtcaacatgggccttcaagacgggccagtattgtaccataggcccattagccaccttacaactcagccttcctttttagcaaacgggctgccatgttgggggcgctgatgagcgaccagtcgcgcggcgcgcgatcagttgcccccctctagtatatactagtgtatatatactactatatcctctagtctatactactata

SEQ ID NO: 28714 - DNA, 202 bp, Oryza sativa
cgatatgacacattactataaatctggacatacatttatctagattcatagtactaggatatgtcatccatttgttttttatgagacggagggagtagcgccttcttcaaccatgttgcaagttgtaaaatcatgctacgaacagtggcgctaaataaacttgccacaccattgctgttagggtagcaatatttgcttacca

SEQ ID NO: 28715 - DNA, 1501 bp, Oryza sativa
gacggggctcttggtcatgtgggcccgcttgcctgtggaagaaagaagcccttgacattggagcacaccgtcttgccgaattgccgtgcttctagtgaacttgtagacgaagcagttgatggcgtcgtcatgtccaaatcttcttcttttagatggcactagtttaagtccctatcacatcggatatcacatcggatgtttggatactaattataaatattaaatatagattattaataaaactcatccataatcttggattaattcaagagacgaatctttttagcctaattaatccatgattagcctatgtgatgctacactaaacattctctaattatggattaattaggcttaaaaaatttgtctcgcgaattagctttcatttatgtaattagttttgtaagtagtctatatttaatactctaaattagtgtctaaatatagggactaaagttaagtccctggatccaaacaccaccttaatctcaagttggagtgttccactagcctttgcttgatgtcggtttcagtgtctctttgcttaattgagtgagttgagccatagcttgacaagtaataaatgattagttaaatggagtagtataccactatgatgtgtgacgtgtcttaggcttcgtttagattcaaaatttttttacaaaaacgtcacatcaaatatttagacatatgtatcgagcattaaatatggaaaaaaaatcaattgcacagattgcatgtaaattgcgagacgaatattttgagcctaattacgccatgattttaacaatgtgatgctacagtaaacatttgctaatgacgaattaattaggcttaataaattcgtctcgcagtttacaggcggaatccataatttgttttgttattagtctatattttgtttgtcgtatactttaaaaactttacactaaaaaactaaacagacccttaggataagttagcataaaattactactccctccatacttataaatgaagtcgtttaggacaatgtttaagtttaagtcaaaccttagaaatataaatcataaataactctcaagttattgagtttgaaaatataaaaattatatgaaaagatttgtcttgaaaaatactttcataaaagtatacatatatcatttttcaataaatattttatagtaaaaagaagtcaaagttgtgttttagagaccgtgacgctgttctaaacgacttccgagtacggagagagtacttatcttagtgactcacacggggacacaaagtgcaatcatgttatgtgatcaggaggacatcaattatgcgtacaaagatgacaaatttataggagcctttttgatagatcgaagtttgtagcagtagatcaaaagtgacaccaattatgcgtaaaaagatgacaaatttaggagccttcgatgatcaagttcttcgatcttagatgctgcacatatcttggagaagaaaaaggaataaaaaaacattgaattctcgaaacttt

SEQ ID NO: 28716 - DNA, 1501 bp, Oryza sativa
tgtggtaaaacttgaggtcataaaaacagtttcaagaaatgattatgctaaaaaaatcatatggcttaagctaaccacaacccaagatgagttttgactattagattggcattgatcaccattgaggctttatatacagcattctattccagaatatattatcagaggcaccagcctgtgtcccatactacaatattatggagctccacttgctgaaggcttagttttcattgagttgaaatatagtgtatcatataagacatggattggcatgtgcctttcagctgtttcttagaaacaggtaactgtttattcttcgacaaattcactacttattctattttgcttgtgcagcaactggcctacgtttccacaaatatttatcaaaggagagtttgttggggggtctgatatcatattagatatgcatcaggcaagtgagcttattgtccccaggttttattaccaggtgtatccatctacaatttaattcttaactcagtagttgattccttattttgtataattttcttcagaagggtcagcttaaggatgtgcttggcgatattgcacaaaagcatgagcaaaaagaatcatcatgaagatgacaatagtacgccattttggtcacgtgagctttagcatcagtatgggagctggattcttcctttccaaattttcgttcccgtttatgtagtatggatttgctttctcctatcgtttgagcttttcatgtcaaagatggtggaagaagaataaccctctgttccagttgtatacaagctttttcacgataaataaatgccacttgtccttgtatcgtttcgggctaagctgcgactataaatgattagggtctcatgtacggactgttgtgttttactccttccgtttcatattataagtcgtttgacccctttttaaatcaaatttcttgaaagtttgatcaagtttatgaaggaaatatagtaacatttatgccaccaatttagtttgattacatctaacgtgaacatattttgatagtttatttgttttgtattgaaaatattattatatttttctataagcttatcaaatctaaagaatctaaagaattttaacttgggaaaaattcaaaacaacttgtatatatacaaggaggtacttatataaacggttgatagtttatttgttttgcattgaaaatattgttatatttttctataagcttgatcaaatctaaagaattttaacttatgaaaaattcaaacaacttgtgcatatacaaggaggtactccctccattttacaatataagtcattctaacattgcccacattcatattgatgttaaatgaatctagatacatccatatgaatacatcaatatgaatgtggaaaatgctagaatgactatattgtgaaacaggggaattatattgtgaaacgggggaagtacttagataaacggaggtagtaccactttgccttgggattattaaccaaccaattctcagca

SEQ ID NO: 28717 - DNA, 1501 bp, Oryza sativa
tccgcaaacaaatgcatgtcttctcgttaatttgcatattctgtcctccaagaggtatagaagaatgaataggaccccacccatgtactctcattagagtggacaatgtggaaggagctcaatgcacgcggttttgagaaacaagatgtcaccaatacagcaggttctcgagaacatgctccaagaacttccaagaactcagagtttggaggggcactgggtcgtcgaagtgcaaaccattatgcaagatctaaatcctttttaaaaactaaattctttggagcctgtatgctcccagttttcttgttgtgtaatcaactttatttctactctaatggaatgacatgcaaagcttttgtgtgcccccctgcagaatttttattatactcatcccctgaaggcctgaacctaaaccaaacacagatagcactgtagtgcaaatatgcaaaaacaacatcccttacgatatattcacaatgataaatagcagtacttagtaaatgaacactgctaacggtattcaatatatgcaagaaaaaggtccaatgtggctgcattccagacaaaggaatggaaattgcaaatcaggctttgcaagcatgccctacgttatctcttgctgaatggaaattgtcgatgatatagtaacaagtaattcttactaaatcaatagaaaaggataattggcctaagttttacctaaatccattagcctgcaagaaacaaaggaatgcacttaggtagaaaccgagtgcatcagcaatcaaccaaatgcaaatgtaacacgagaccagcacactaaatacaagatggtggagcatgtctgcatgtgtatcattttcaacaaaactgttgtgtaaagaccagcaatgttcatttggcggcgatttttcatatatatgtactgacaagctgcagctctaataaatttgtgaactcatagctgaaatctttgtatgatacacttaaaactgggaatgctatagaactaagaacaatcattcataaaaagcatgaagtataattccttcgtcataggaaacacttttttagactagagaagcagcagttaaaaattgaaactacatggcctctactctccacaaccgtctcatgtggaaaccacataagaaatcccagttacagcactcaaagagatgtaaactaatcacactccgttaaaaagaatagtgttccgccctgtctaatctaccaatctatataacctatgtgctgtgtgcatcccactgtaacagttaggttcaggctgttagtaattggaacactagtagtttcatactccctccattttaaaatatgaggcataaccaccctttaacctgaaaaaaaaaaacaattattatcacctcctcgttcgaatcaccccaactaatacaatacggaatcagaaatcttcccgatgatagactaatacaactgctgacagctacacaacaaagacaatcaagcgcaatatagcagcttctcgatgatactcctg

SEQ ID NO: 28718 - DNA, 378 bp, Oryza sativa
cggtcgatccaccggctgcgatttggcaccatttgggggcggattcatacgctccagtactccacgcagtgaaggtgcaataaacggttgctcctttgctccttctcgtgctctctcctctcgtcgatcgaatcgatcgcgtgggcaacgtgacgctcgcttccgcctccgccgcgcggcgagctgggctgcctctctctcgagctcttggaccgcctccgacgagctgggccgccgccgcggcggcgacatgggcttagatagttcttatcttgggccgaagagctgggtattttgatgggccggagaggtgggttttctagaatcttgggcctaggatttcatgggccttgattagtgtagcacgttgagcaatga

SEQ ID NO: 28719 - DNA, 1501 bp, Oryza sativa
ggctacagctacattgtatagtaccactatataaatcaatgtattttgaataacttttaaaaagtttaattgaaaacagttagtttggaatggtggtcatcgtaatatactatgagttaatttattaggagtacacgaaagcttgacttgttagcaaagatcaaacagaaatcaaaaggaacacatccatatgtcctctctactaagttgtcattggagatttaggtgacagaataagacgtggctggacgtaagatttctttccgattgcttccgttcccagtgacttatattataacaaatagtctaatactcctatatagtgtcagagaagtaacagatatagtatatcttgttgtccatcgtgcacatcatcaggatcagggcaagttgcagtaggctggtgttgatgttctttgattcggtataaatcaatcgatcaaaatgcaaaatactactggatctgggctaatttgggggctttcgtgatcgtgcaaggtaatgcaggcgatcgtgtacctgacctcgtcctcgtgttcactaatacatgtgattcagttcactgacctcgtcctggtgtcgccggacctgctcgccgcagagctaccggccagaggccaccgcctcggaggctcctcctcgtcgttgtgttgtcgcgcacggcgcaggatgtgcttgccgcagaggtactggctggaggtcgttgcttctttatccctcggtggatcagatgtattgccggtggatgttgatggtggtgtttggtgccggtgaatgtggatggtggaacggcaagaaggaatgtgagacaatgacgagaggaaagaggaatgatggagaatgaatatatatacagagaagaagaagagtcaatcaaggaagacgaagagtcgtggcccttccggagaaatcaggtggctttgcactttttcattatactccaacgtaagattgtcttttatattttagtccttttcgcgttttggagcgcacgcacgaaccacgctgtgccacgtggcatcgctaatcgctcgataacttgcacggatttcgatagtaagagatggcatatttgtaccttcatctacctcattgctgaccttctggttcgatattgacttcactaaatgtgcactaaaatctcttctattccaatgcagtagcttcagtttggcttcatgaaatttgagtaaatgtggcattgcctacatctgaactctgattataataattatggtttcacgtgtaatatattttttctattgtagtaaaaagtctgtaaaatatgcacataatgcaactttaattctcaacagcgaaagttgctaacttcaacagttagacttataaaaagtggcaaacgctaatcagaaaaaaaaagttagagcattatattgcttttcctttttcttacacatattctgctttcaggctgtatttaggctaaatacttatattctgctttcagcctaacgtaattatcaataatggagccggtagt

SEQ ID NO: 28720 - DNA, 1501 bp, Oryza sativa
gagttgcacgtattccattccatctctctctcacacacacggatcgacgatccacgatccactgtaccaaccgcggcatatgcttaccttaccggctcctacccccaccagcatataccacggttctaccgtagttgtacggttcagacagcgtgtgatcggcccacccacatgcatgaaccagaagcattcaatcaatcaaacaaacaaacaaacaagatcttccgcgcaggtgcaccagttttggctccaaacggggacgacgacgcgacccacttgagcctcgccctccagcccatcgatcgatccccctttagctgagcgaattattccacaagttccacgacgacgacgacacggccgggcgaggcaggcgtacatatgaacagcgcgacgcggccggaaacggtcgcgtacgtggaaacggccggtgcgtgccgatcgatccgtgagccaccttccaggcgcgcgggagcagaagtgtactatgccattggcagcgacggcgagcgaagaccgcgagcgagctagtggacacgggaggttgctctcgcggcgcgcgggaggggaggagaggagagggagaccggtggcgcgggtgcgctggaccggttcacgccccgcgtgcgcgccggggaccgaaatatctgtccgcgtcgtcgatggccggtgtcgccgtcgagcgagctacggaccaaaacgccgggatctcgaaggggcgcggcgctgcttacttggttgcttgattagttaagtttatccgccctccgttttacgcttttctgtttcccccggttatttaagccagactcaagtttctcgaaatagaatttaaggaagggtgtgtttcacgtcaaaattgaaagtttggttgaaattgaaacgattcgacagaaaagttgaaagtttgagtgtgtagaaaagttttgatgtaatggaatactttggatctaaactcggccatgggatgcatcagtaactgttactgttgctactatatcacttgatattcactttcattttggtgctcaaaataataataaaaaagctttcattttgggtatgcatcgtttgacatgtatatttttaaaatccactttgagaaaaaaaaaacatatagtaacttattctatatttgaacattgcaatcatagaaagacaactctactgtacgtgaacatttttcattatcaagatgtgaaccattcactaaaagaacaaggaaaacactcgttttcgatttctaaagaaaggttttcaaactatagataaccccatccttggccttccccctgccgataaacgtgcttcttttttcctctccagccaaatttccaaaggcgaaaacaaaaccaccggtgaaaaatccccaaagaataaaacaaccgaaaaccccgtgccgttgcccacgggataaaccaacgaacggagcgggtcccatttacccaaaagcgcactccccccatccccaccgcaaaagcgacggcccgcgtgaaaaagc

SEQ ID NO: 28721 - DNA, 1501 bp, Oryza sativa
ttctctttacctacatgcctgactataattgaagaatgtacttgtgagccatttttactgtatctatatgaaccaaaacacgtaattacaatatttttttgaatttagtaattacaacaattcagggtatgatctttatatttctacttttacctgtccgaaaaatcatggctagaaaaatagaaggcgatgataaaccactaaattaattttaaagttagtttgtaaaattcaaagtttgtaatataaaacttcagttaaaggttaaccatttcgaattgacaaacttgcatgttttaattttaagaggtagagtatagtgttttttttttccaaaaaaggtacatacataggcacttatatacacgcgtgcatgttcacctctatacacacacatcctactattgtaagtatgtccgaagactcagtttaatatatgatgaagattgataaagttagcattagtcgtcacattatcagtggatatggctcccatcaataaagtggagcatagtattctcctgttttaaaatataaatgattttggtttaatagtatgcattctagtaatcgtattactattacttggatatgtcatattgaatataaaaatttcctgtattctgggatggagagagagagagtaatatacatcatttcatggtctggcacaattgacacgtgaaagaacggggagcatagtacgggtggatggcactcgtagatattaggcatgtcctcttgttgagtggtacacggtaaaggagaaaaaaaagagagagcccggtcgccttattttattttaaaaagcccatgatttctttgtcccattcgatctcgaagaacatttttgtctctacacgggtaggagtaacaatccattttttttcgaaaaaaaagtatatatattactcgaatcctctctacccgcagcgtgctcacatggctcacagcttccgttccgtccgagaaaggcaagtggttttacgcttttacgaaatcggatggatggggatgccgctacgcttccggggaggtcaccgtcagatgcggtggatgcgtgtatggtgccttcgcacgccacgctccccgaacccccaccgtcggatggctccggagtggacggcccggatgacggccacgtcgccctccaaaaccccccaaccccaccgacctctcctacccatttccccccatctctctctctctcctcccatcccgcagcagagcacacagactcgttttctctctcctccgctctctcgatttctctctctctcctctcatccgatctgcatctgcttctcctttccacacttgtgcttcgtgttcgtcgtggtctcttgtttcttcttcttcttctagatttgattttctttttttttcttccctttttcgcggcggcgaggggcgaggggggagggtgagtgtggtgtggtgtggtggttggtgggggagatcttgatctggtcgttggagatggcggcgcaggagcaggagc

SEQ ID NO: 28722 - DNA, 1501 bp, Oryza sativa
aaatgaagaagctttcagaatttctaaccatagattgcaggtatatgcatggatgttgcttttaattggatgttcaggctatctaagatctttattgtcatttgtcaccacagggataaaaggtgggcatacctggagagtcggccaaccggaggtacaagttgtcaccaagattgttcctcgccatgtcaacaagctcaccaacccaaagcaagcaccttgactggctggctgtggtaccgggagagccggttatggtcaagttggtgtaagcataggccgtgcatgagcagtttcggctacactcagccgcgcactcctcaaagcttctgtcctggacataaaagaacttgtcagggagcttcattccaggcatggtcatgaaatggttcccttctccacatcttaattgttgctttctccggcatccacttgaagagttggagccgttaggctcaaatccatccgggcactggcatcttgggatgaccgacgtgaagtcacagtaaccgaatgggccacacgagccgtagggatcacaatcgccaatggctgctgggcgttgagaatagattgcccatgatgacgagttgacgttccaactcaggagcctgaaggtgcccgtgtagtcaagcatgatgcgcatgtatggtgagccatcagaggtggtgtagataacatagaactcatcctgtgtgtttacatatgtttggtacatgaaggaggtgctgctgccatatgctttgccggacacccacacactgtcaagcacaatggagcggtaatatggcttggtcccgtgccagacgaagacctgaaggtctgagctggggtctccgctgcatgagaagtcccccgttgttggatcatcaaggcccttccaagctacaagccgcatgcctacttgctccttgtacctcagcagaatcttcatgttcgacagaatggtgtcagttgggtgatcgaaactttgccatatggttacattgtttgacagccggagaaccaagtttcctgagtcgagcagcactgcataagctccgtcacctccggtgacatttgccattgtcgtccagacggtgcgacctttggaatctgacaatacaaggtcagaactattgctgatggcgagcatcgctgatgaaggtgtggtgattgggttgtcacggttagcaacccaaacgtatgttcgctctgggatgttgttataccatatgccgaggaataagctctggttggaagtggctggggagaagaaaccgagtgcaaagacgccgctcttggagacgagcttgccgctgggggagatcaatcgatttacctgtgtcagctgatcatcgcatttgcagaaagagatgagcagcaagtagatgagaactgggaggtaggccatattcatctggcccttgttcttcttttttggacaagcaaggcaggagctctgcaaaatcaaaattagattatgcgattaaaaagacacagagtcttacaaaagaagagc

SEQ ID NO: 28723 - DNA, 1057 bp, Oryza sativa
ttcggctactgtgatgccatgctagccatcccaaggtgccaatgcctcgatgggttcgagcctgacaccaccaactcttcgagaggatgccgaagaaagcaacagttgagatgcggagatgggaatcattttgtgaccatgtccggaatgaaggtccctgacaagttcattcctgtcccaaacagaagctttgatgagtgcacggctgagtgcaaccgcaactgctcgtgcacggcttatgcttatgcaaacttgaccatagccggcaccacggcagaccaatcaaggtgcttgctttggactggggagctagtcgacacggggaggactggttttggtgatggtcagaacctgtacctccggttggcctactctcctggtatgcccaccttttttcccctgcagttgcaatataactcttagggcatccacaatgtactacaaaagtagtccatagggaataaactattccattcagtcatctagtaatattgtgcaactagtctatataaagaaaatagcaaaaggtatccatatgcatatggactacccatatgacataaataatattatctatctctacttctctctcttctcctaatgtcacattgtatccatatacattgtgaggattgctataggtaaagtttatttatgtggatcccatctatatagactacttttgccatatacattgatgatacccttagatagcttgtacatggaattctgagaaaaaaaatcacttttcttgatagggtacacttctgaagccaacaaaaagaacaaaaaagtagtgaaggttgtagtcccaattatagcatgcctgctgacattcacatccatataccttgtcaggaagtggcaaacaaaaggtacagtgagggtcaatactcaatactaactaacactatgcagtcttcctgtaactactgaccgataatgatgttcttattaggcaaacagagaaatgacgaaaataagaagagaacagtgttaggaaactttacaacttctcacgaactttttgagcagaaggtagaatttccaaatatta

SEQ ID NO: 28724 - DNA, 1501 bp, Oryza sativa
tttaaaaaaacatatatattgtaggccagctatttgctctaaactattttgtgttaagctacctgtactaagttattttgtttttttaatgtttcttaacgaaaaatgaggtatgtaactaggacttcccatgaggtctcgtcaactatagacttgttggctgacgggtggttagtacagcgctaccgatgccatgaaatggaatttggttaatcgtggagtgaggtcgatgtcatgacgcagatcatcaacgtgccgcgttcaactctcagatcattttggtcttctggcttatttggaaacaacgttaatgcaaaaatcttccaatctgaatccaatacgcctctggagtctggaggttagaagatcaagaaggaattttgcgtctcgcctgactgctgatttctatttttttttgagcggaacatatattccatttacttattactgatacggccaaatcgccctgattgctgatttctttgtttcataccggtttgataatacttttcgttttggataagggcacggtctctaaaaaacaactttgaccattatttttcattataatatgtataaaattgttaacaaatatacgattatattaaagtactttttaagactaatctatacatatagtcaccatatttaaaagacaaatattttaaaaatgatttataatcaaagattataaagtttgactacacccttatccaaaacgacaagtattatcagcctggagggagtagtaaactttcagaaattaactagagatttctccttttgctgtaaccgtttttaacaggatctattgtacttgttggcagccttgttttattagttacagttgtactgttctggccaggttcttttgccgtcccgggaaaggtaaaaaaggaaaaaggaaaaaaaaataacagtataacggtttcgctctcgttgattttctcgtcgtatccgaacttcgttttcgctttgcgcgtgcatcctgatctggaaggacagaaatgtcttggccgtatgtttgctttcttcggtccaaccatgctctaagactatgggaaatcatctagtatgcatctgataattggatacatatgctctatttcttcacatttacatttttgaaggcaactaggaaacagaagaacaagacctaatgagatttagagccaaagtatggaaggaaaaggaagatgaatgcaagaaccttggtggttggtgtggcaggaacggaacagaagaatttccaacaccaaagccagagggagaagcaaaagtagctgcccaattgtgcaggagttaaatcagatagagcttagcagagcttagcctggtaatttcaagagctacgagagcagttctcctttttatcagatgtacatcttcttttccagttgcctcgcctctcctcgggctcttcttttgtaagactctgtgtctttttaatcgcataatctaattttgattttgcagagctcctgccttgcttgtccaaaaa

SEQ ID NO: 28725 - DNA, 1501 bp, Oryza sativa
atcgaatttaaaacatcaaatattctctgtctcggtgtggtgtctctcctctgacggcgatagagtaagagggagagataataagggaaataaaaggaaaaccgtagaaaacaaagaacgtggcttatgtattctagtggattttgcttctagcctacatgtaagttagatttcgtgggtaaacgggcaaagcgggcatgggtagtgattacccatacccatgcccatttacccatcaggcatagcttttaacccaataaaatatctatgggtataaaatggagaacaaatttaatcctaatagggtttttaaccacgggtaaatagaaaaacgggcacaattgccatccctagatgccgccatggactgtctccatccaaacctacgtgtatcttcaggatgagacacgccgacgcgtcatgccgcctcaaaggccgcggaaacccaaccgcccgtccgccagcccagccgctgtgacgtgctcactgtttcggcggacggacgcatatgtgtccgtttcgcaataaacacacgggagcaatcgcatcacgccgacccaaaaaaaaccgtcccgtccgctccgcggcgcttgacaacgcgtggtgcacccaatagctctagcgtgacaagactcctacgccgtcacgcacccacgcacgcacgcacgcacgcatatatgtgcagtgtagcgtgatgtaccacttctaccaactggtggtagtagcattgcctactttcacatacgcgcggcgccgctggtgctggctggctggcgcgcgcaccggcgggcggagagcgaggtttttcgccggtgttttggttggcctccgccgttccgcgcggtggtggtggtggtggttgctgtggtagcgagggtacgctttggagacggagatggagatcggcgccgttgagaacgggggtgtcgtcggtggtgaagttgtggcaggcaagagggggaagacgccgcaaggttggaagtgcatgccattcatcataggtgaggctcccgttccagtgatttctttctacgttttgcgatccgtatagtatgttaacggccctttgaatcgtaggattaagaaaacataagaataggaaaaacgcaggattttaaaaaggtatataagtgtaaaacagaggatttcgaaacgtaagaaaaacacatgaattaccgtttgattgaaccccaagaattggatgagagagataaactcaaagaaaaattaccaagaggttaaagctcatgctaaattttctctaaaatctctataagattgtgcattccataggaatttcaaagaattggataggatttaatcttttgtttcaaatggcttcatagaaaattttcctatagaattgaaatcctctaaaatttctatgtttttcttccaaatcaaaggggccctaaaggagcgaaggcaggcctagagtagttagggcttgagccttagacttgtcttcagaattatggttaaattatcttaaaccaccatg

SEQ ID NO: 28726 - DNA, 1501 bp, Oryza sativa
acctgcccgtgaccgagaaagcggggtttaattttagttaattagttccgcgtaaagcgctcctctattctacggtgtgtttagttatgctgcaatgatgcccaacccttagctgggtgtgcgttttccgttttggctttggtcgcgggtgtaacgtgatttgttgttttgttcctttaccttagtgtgcgattttggttgtgttctaaaggttgttcattaaccctaattttagtttaagggttggtttggtttgtggcctaaataggccttaccaaattttggcactactaattttggtaaggcaaagttgtgtttggattgaagccaaaatagcctaagttcactattaaaatggcctattttgttaggcatgctaaaatttggcttcaaaccaaatagacactaaacactattgaaattaccaaatattggtaagcctaatttagacttcaaaccaagctagccctacatcttaaagttgttccgattcttttttaaaaaaaaacgcagttcatacaaagtttgagctccgtcggcaaaaaccaaaatttaaatttttcaaaaataattttgaagttgattttaagatattttgaacgtttttttttcagcattggttttaaatcactaagaacacatatataaaaatttacctgtaaaataatttttatttcttaataagcccttacggtgtgtttggataatgggaaatggagggtgggattgggattaggaaatgaatgaagggttaggattaaatggaaaagggagaatgaatggttagaatctaaagatggtgggaaatcatttccgtttcccatttgccaaacactttcttactgtttattagagaatgtgggcaatcagtggtaccttagtaacatttgtactgacattggaacagcgtgttgtgtatggtaggagcatatgaccgggccataagggagccgtttgaacgtaaaagcatggaacaaatggatgaaacttaagtaagacttgcgtaaaaataaaaaaaaaaacttaagtaagacgacgatgaggatgagaatgtcgggcgccctcaaaatgctaatgccaatgtggcggagcttgagccagtttggctttgcacgaattatatgtaatttgacctttctaaaaaaatgtaatttgttgcctgtttccttctttcttaatgacacaaattgagtttttttaacacaccctaattttacttgtagactagagactattgtgaatttgtaattatgttcgtagtttggacgatggttcgttactctctagtagaaatgatttgatccattagttattagagataaagataaactagtaatttactgatagattgattaggggtaactttattatttatcattttttgactaatcgatatgtggccatccacgttggcatcactcatattcaatcgaaatatgccaaaaaagaaaaaaaaaagagatttagccactactaaatttcaattatatttctccgtact

SEQ ID NO: 28727 - DNA, 1501 bp, Oryza sativa
ttccacgatacctgggttctggatggcatggcaacaaagagggactcggcgtcgggcacggaggcgaggcgggcgtgcgcgcagaggagcgagttgaacgagacggcgtcgggggccgcgatgtcggcgagcgcggtgtgtgcggcggggagatcgtcgcacttggcgtagagatcaacgagcgcgttggcgacggggaggcggcaggggaggagcgcgaggcggagggcgagcgcgtgcagggaggcgccgagcgggagcaaccggagcgacgcggcggcgttgagcgcgaaggggagggagaagtggtcgggggagacggggaggcgcggcatgaggaggagcaggcggagcgcggcgcgcgggtgcggcttggagaggcggcgaatggcgcggttgaggagggaccggatgacggggggcggcgtgccggcgtgcgcgcggacgagatgcgcgtggaccgcggcggccgccggcggcgggtggtcggaggcgagggcacgcgagaggcggtcgaggcgcgggtcgccgccgtgctgggacgccatgggaggtggcccagctgtggtcggtggaggcgattgagtcaggagcaagaaataagggaggcaaagtagacttccactgtgccggagacgtgtagttggggttgcggtttttttttgtatcttgggccttttgaaccagactgggcttttcctgagtttgacggcccaattaatttacctgtccctccttgtttttaattagggccgttttggtttgataccaaaacatgcctttccactttgttggcaaactgaataatatgtgtgttagtttggactaacaccaaatatttggtagtgcctaccttatttggtcatattctagaagtttctcctctatactataagagtttggttttatattggtagcaatccaaatattagctaaataactttaccctacaatattttgatagtgccggagtttacctagaatttggcactaccaatgaattcaggcgttaatatgcagtttactggtgtgatgagatcatgagaagagtgacacacacaggcacacgggtgacaaatgcctaatggttcatgtctccctatatttcacatttttactgcaaaaaagttcttttggacacacctctgtgtgcaaattgtacggcactctggctctttccctgaatggaattggaatcaatatcagaaagttgtatctgatgtcaaatagatcgtataccattaaggcattttaccatacgaacatctgctccaaaaataaatacgtaaagttcaagctatgatcagtgtcatccaaccagctagccatccggcactacaattgacctggcgattggttgtctaacgacggatagaaatgcatgaatgcgaagacacgcaaacagcacgttccaagtttttgccaagtagggatcatacgcattcacatttgcatagcaaatgtttagtgatgtgacctcttaacttaccaaagcaattta

SEQ ID NO: 28728 - DNA, 1501 bp, Oryza sativa; identical to SEQ ID NO: 28324

SEQ ID NO: 28729 - DNA, 1501 bp, Oryza sativa
tacattgggaatttgtatttatgatcttttaagattaataaagagcatgttccctatgttttgtttacactgtgtatttaggtacactggcacgcccgcatatatatgtatctctaaacaaacgagatctcagatgttattttccaccctaaacataaactttaacaagataaattaatatatgatagactactttacaaatatacaagatcaaatttctacaagctgtaacgaaaaaaaaattaaccatgaatatacgttaactatatatatttaaatttgtttttttataacttgtagaagttgaattttaacttgcatatttgtagagtgatatattacatattaatatattaatatatgttcttaagtttttaaaatttctttagctagctcagtttgtttgtatcgatgggcttagtaattagccggatattgctcctgcgagatggggcaaagtatcgacctgggatccgcccaaagtgggtgcacgccgccgtcagcgggtccaagtcgatcgggtcggcgtcgaggaggccaactcgtggggtgtcttcgccatcgcagtggataccggcgatcctggccgaagttgacggcactgcacggcaccacgcccaggcgctcactcatcgatcggcaggtaactgtcaaaaactccaacctgcagcttctcctgctgcttactgatcgatgcatgggccgatgtgtaagagtacgcgccacatcgagatagctagctaactagagcttgggccctgaattttcaggtggttgaatgaatcggttggcgaagacgacgatggcatcaaaggcagaactacctctgtcttgaaaagtatatgttcccggtttagatatggtacttcatctgtcccaatataaatgcatctaggagaggaggtggtatattttataactacgaatctagactggataagcagctatctagctaaatttgtagttcttggatatgttacatctatactttgacggaaggaatagtaactactacaccggccggccagccgcaggagaagatcgacctcgtcgctgcagaatcctcctgagattctgatggaataatttcgtacacagttcaagattgttcatatatacagtacgtgcaaacggttcaagctagctgctgcctttgatggaagtgaacatacaaatgtggttggtcgttggtaattaagctgttgccttcttctactactactccagctgccgtcagtctcactcagtcctgtacattcatctggcgggcagcacaggctgtaacaacataaatagtcaagcacggaagtaattgaaccggcgaaaatattgcgaccgatgttgaaagattgtgtccattaacaaaccggctaagtacatactataccgtatgagataatgaaagtcctgacctatttgtagtaggaaagtaacatgagctgcaagctttgaagggaagtgggagtacacataccttaaacttcttcttttattatcctac

SEQ ID NO: 28730 - DNA, 1501 bp, Oryza sativa
tatagatttaaattcgacgtatacatgttaaaaaacactctcactagtatgtgaactattcatagccatgcgtgtttgtacgttttttttctaatttgtattatttggacttgtctgttttattgagttatggagtatgtcacatttatctatggctgtgtttagttcccttcaaacttctaattttttcatcacatcaaatatgtttggacacatacatggagcattaaatgtggacgaaaaaaatcaattgcacagtttgcatataaattgtgagacgaatcttttgagcctaattacaacatgatttaacaatgtcatgctacagtaaatatttactaatgacagattaatttggcttaatagattcgtttcgcagtttacatacagaatctgtaatttattttattattagtatatgtttaatattttaaatgtgtgtttgtgtacgtcaaatttttattgccacatcaactaaacacggtctgtgtcaacttatcaatttttggacatagaaaaacaaagtgacaacggagaaaaatgaaaaactcttcctacgcactgaacagtgtggcagagagatggaagaggttgttgatcaagcaaccgccgtagcttgatgtgaacacgaagcaatattgtcagttggcgagggatgcactgatgactatgctagtgcctactagtaaccagtatactcaatgatacttgtgttataaaatccctaatgctaaaattcattcgagcacaaatcttaaagcaaatcgaatgctgaaaatttatatagtgaaaaagaaaatgaaataatagttgtaagttaggattaatctcacacaaaatctatatatcgtgcactgtcgtacaagcaattccactgcacctcttgtgttagtaaaacccctaatgctacacttgtgttataaaaccctgatgctagaattaatttgtccgatcacaaatcttgaagcaaatcgaattttaaaagtttataaactggaaaaggaaatgaaataatagttgtaagttaggattaatctcacgcaaagggtctcatcttttcgcttattcttatacttatcagctaaaatttaaattttcaaccttaaatttggagctaatttaaggtttttttcatcgaagtttattttttagtctttgcttttttattgctaagtacacgtatataaaagttttatttacaaattactttttttacaaatataccgtttaatggctccggaaaaatatatatcgtgcactatcgtacaagcaactcctctgcacctcttttctttaaaaaaaaaaaacaaaacatcatctgcgtgtttactcaacgtgccctcgcgccatcaacacaaccaacgtcccattgccaccttttatacttctaccttcttcagtagttcatcaatgtcgcgagcaccccaagaaacgtaggatcatccaagcaaacccgccaccacctgccggccggccatgggcggcggcggcggcggcacgc

SEQ ID NO: 28731 - DNA, 1501 bp, Oryza sativa
tcgtgtggtcttagagggaatcagcatgccttgcagaggagacgaatgctttaatttagtgagattaggtggagagatcgagcatggctgagcataccatcacaaaatgagaaatgttgtgtagaacacatatttaatcatgatatgtgtcacagatgcaatgaaagaagaaaccgaaggcaagccaagttaaaagaagaacaaattaaatcgaacgcaaagacatgaaaaatcaaagacaagtaggagctcataggccaaatctagtaaggacatggttagatgcagtactacaacgccgattgcgagaagtgatggatgagaaaagttcacggtaaatcatgatgggtgatggaacttgtaaagggacgttctcacctaaactagcggttaacggtgtagccatttagggggcgtggagaaaaaacaatgacaacacgttgaagctagattgctttactactactactccatctattttatattataagatatttaattttttcttagccaaacttctttgaatttaactaagtttgtagaaaaaatatattaatatttttaatacaaaacaatatattaataaaatatagttaatattaaatttaatgtactaatttagtatgacagatattactattttttttataaatttgattaaataagtttgacaaaaaaaaaaagaaacggagggagtacttcacaatgccaactagagccgtgtttagttcacccccaactatcctcaactttcaactttccatcccatcacatcgcatctaaaactttcctacacataaactttcaacttttttttctaaaattttaacttttttcaaaaactaaacacaacctagctgtacagcaaaggttagcttgaaaggcaaaataatgtgtcgttttttaggcggggaatgtgtcgtgcccagaaacgtctttcatactgctgtctcacatgtgatctgtactccaaccgtgtccatcctgaattttgttgctactaaaactcgtaaactcggcagcaccggaatggccaagcaggacacgcatgacgcagcacgcccacgctgagagtcgtgcagtgcgcccaagcacgaatctcgagggtggtgcatagaagctccccgcccaatcaccgcccgccacgtcgcatccccgttccacacccttcccttcccttcccttcccttcgccaccgctttgcttcctcctctcctcctcctcgcttctgcttttatcccactcccactcttcctcgcccccaccccaaaaaccctagccgccgccaccgccgccgccgccgccgtttgctcgagcatgtactactactcgctgcgaggtggcgcgtgcgtctaccttgtggcggcgtgatacgatacgacgcgtgcggggggaagggaagccgaggtttgacttgagtggtgagccgggcatggaggagaggccatagatcgaagggaggcgcctccgccgccgaaggaagcggcggcggagaaggtgg

SEQ ID NO: 28732 - DNA, 207 bp, Oryza sativa
tcgacgtttgatgtcacgtctacggtatttgtataatatggggatcgttggtactaggatatatgtgagattgaggtaaaagagatggggacgatgatttttatacaggttcggttccctgaattgccaggtaattaataaccctactcctgttggccgaagccggtcgttgctcttattcaccataatcacaccagtacaatattt

SEQ ID NO: 28733 - DNA, 1074 bp, Oryza sativa
ttgaggtcggtggtctcaattgtgatagactaactacattttagtacttatatatgatcgatcaagtaatctggaattatgacaatgtagggcacaataaccaagtctctgcctaccagctttgaggagattcgtgaggagatagccagcttcatcctccgtgaaataattaaccccaaaggaatgtttaggcttaaactaaaatgatgagcaatgttgaacttttatgtctagagaatgatgaacacttattatgcaactgtgatgatgtaactgtgatgcttatatttatgtatatatttcatatgtttatgttaagacttgctaaataaatatttgatccaattaactcggttttgcaggtgaaatacgataaatatttaaatggatgtgaaatatgtgaatggatatgaaatatgagatggctgtcaatgtgtggttgtgtgaaatatattgatgtctgtgtatgtgaatgcatatgtatgaatgggtgatgctggggagctggggatattagatatctgtatttgtttctgtcatttttgcagcgggcatggctagcaaaggcctgaggctagccaaaaaaacaaaatttatttttttttgtggattatactcatctttgacgggccataactaaatgcccgattgagatgatgttcatctatgatgggctctagtttaggcccgattgaggtcagcagtcatctgtgacgggctctagtttaggcccaattgagatgagtgtcacatgtgacgtgctctagtttaggcccgattgaggttagtagtcatctgtgacgggctctatttgtggcccgattgagataggtcatctgtgacgggctatagtacgcttggtagactgggtcaaagctatcggtgacgggctttaattagggcccgattgagataggttcatctgtgacggccatttgcccgattgagattacttttcacatcagtaacttctagcctatgacggacgccgtgcccgattgagatggggcttactgcctgattgagatgagggtatccgttctagtggtccctggtgccgttgccggaggagaa

SEQ ID NO: 28734 - DNA, 160 bp, Oryza sativa
aaccatttttaatggattctacacatttttcttgatttactgagacttgaatgggcttaaacggagctcggatgaattagttatgaattttagaagattcactgtgtttattactataaaagaaaaaccttaaatcattcattgcgcaataaatcccagg

SEQ ID NO: 28735 - DNA, 1501 bp, Oryza sativa
tctagaactgaatagaacactacttaatataaagaatctaaacatgctgttttgtcatgattcgttgtaatatatggtgttctatctaatcctactgttagagatatttgtgtgcatgcatatcttattctgtttttgccgtttatctctcacaatctattccgattttgtttctataagtcggttgagatattgtggagaggtagaggctatatgtacacatgttgcgcgatgaatctttttatcgtgttgagctatccctgctttcacctacattgatatattataggacggagagagtaaatgttataactttgatgaaataatcaaaagttcaaaacataagcatacttgtagggtattttggtaagttttagtctagactttggtactttccaatacctaagtcaatgagaaatatcaaaatttgtattaaaaaatatgataaccttttaagagatagggagaatacgaaaaatgagatacttagggtatctacttatataatccactcgtatatttttacgcctcgtaacaatacaaatgaatgtgaatacgtaaatttaactaagctgttgtcttctctgccatcgttaccaagttgtcactttcttttgtcgattgacagagtctcgtgcaattgcaaaatatatactccacttcgcaaaagcgcatcagacttgctgaaggaaagcaacctctcgcagtctgcaataatggtcgatgtgtggctcgaagttgagtcccaaactttcgacactgccatgtcagcaatcactttccaatgcttaacaatacccactttcatgggcggaattgctgacgacaaaatcgtggaggagaatttggggaaactgaagaaagcccttgaggtttacgaggcacgctcgtgcaggttcaggtacttggccggtgatttcatcagcctggcagatctcagccattttcctatgacgcactacttgttagctactcctcatgcatcagtgctcgatgcatacccacatgtgaagtcttggatcaatgatttgatgaagaggccggctgtgaagagggtgagagagcttatggaggcatgatgagaaaaaggagatatccatcaattaatcatcagtctgtaggtatgaaatgtttgtcatttctggtggggctgttagttaattataatggcttaatccagagaaaggaaggaacgacattcattatcttaattaaaacaaaaaaatgtcacgcctccatgtgtccacgtagcttattatgcagctttgagttgagagacttaattccaagttgtttcatgatttgatcagattatttaaaaaaaaaaatctctgctgttgagatatgcatctccggatctccccatgagttgaccactacagtgctctgatcaactcgctataaaagcgaccaaccccttcgccttcgcctcaagtcacacgacgccatcaatcaccatctacacctctagagagctaattaagctaaggaaagagaaaaa

SEQ ID NO: 28736 - DNA, 205 bp, Oryza sativa
tttgtctctcctctttctctttcctccatgtcaacaagtattcctaattagcaacgctaagagaccactgttaacaaccattttacatatcctaatcttgctacatgaagtagtactacttctgagattggttctgactctttctcagctacatagaagttttgaatttgcacgagagtgaagagggaagatcgcgttacgtacg

SEQ ID NO: 28737 - DNA, 255 bp, Oryza sativa
cgccacctccctcctagctcgccacgtggcttgccgacggctcgctccggcagcatctgaagcaaggatggggaaggataggagttcatttttaatgcaacatgaaacaactatgatgttgatttcatttaaaactttttatgattgttgggttgacactcttgagatattgagtaaataaaacactttccgacgatcttttttctgaaatataatctgcttgctctgacgacacgtctttcagaaaggacgaaa

SEQ ID NO: 28738 - DNA, 1501 bp, Oryza sativa
gttcaaaactacttgcgaaaagctaaggcttcttttggtttccttattttcaatagtttgtttctaaaatggttactgatctttctccctctttcaaaattgtagatggcagtgaacgccagcttcagttcccatggttttggtgagggtcaccacgtcgctcagcttcgtgacctcgcccgtttccttggcttctcgtgtcccgagtacacggggtactccgtgggccgtgttccccctcactgtgagctctctgtgtacctctacccccgtggaggtatacacggagctggccttgcccacaccacttcactttggccaggcccactctccagatcgcgtaccaggacctctcctggactgcgcttcgtcgcctggcccacgactacagccaccgtctcgggggctccgccttccggcagcttccacgccttccttctggccactcagacgccaggtacccttgtccgtacagcgagtctcagccagtgctgactcgcatggttgagctttcggaggctcaggccactcagcacgacctactccttgaggcttaccgctcccttgcccgccgctacgccgccttggaggcccgtctggccgaggagggtgtcacctcagttgacactatctcttgggactcaggccgcccctgtcacgccagccacctgtcctcccacagctcccgcggctctgcccgcactcccagtggcccgcgctcccccagctcgcgtgcgccgtactcaccagtgtactccccctacccacacccagttagcccttcctacacccccggacacaccccagttgcttcctcccgccgtggcccacgctttatccgcaccgcgcggaagcgtgttgttggttcttccaccgtgttccatttccactacccagctcccctaccgccagcggcccgtgctgctgccggccctcgacaggttccgccggtcccttcgcgtcagccgatcgacgtttcttcgactgaggagccgactacaggaggcagccaggccgacgaggagtagaggaggcagtcttcagcagccgtccgtgtgctaggcccttttgttccgccgccaactcttttggagtcgtggcgaggtagtgcgtgcgtgtgtttgttgtgggtgttgtttggtagtctggttctcctaggtggtgtgcgcacagtcaagctcggtgtagctctgtgacttgtccacacccgttgtatcaggtgtttttatgatttgaaaaatccagtttatgcctagtgtgtgctatctgagttgctatttactttgctccttgccctcctaagtgcttatctgattcttaccccgccctcttctgggagtttagatggctagccgcccccgccgtgcagctcgtgcgccagcccgctttggttttgaagatggtagagccgagccagaagtaaatcatgagcagtctccccacagcaaccgttcgcaccgtactgcttcccgcaacgcagaagttgagcaaccccgccgca

SEQ ID NO: 28739 - DNA, 1501 bp, Oryza sativa
acacctgggtcggtgcttgcgaactaaatgaatttccaaaaccgcggaccggggaacgtaccgggtgtacggtttcccgctcttgcacttaaggactgtttccttggaatttcatccaaacataagacaagtacgaccacatgggtggaatgggagacatgtggattcaccggggtggtgtctgggaggacccctgggcttcctggcacagtatggtctgggacctaacctgttgttggtctgggacccctctcgtcggcatatggtaaacctgtgtcggctttggaaatatcttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaaaggggttcgacgtttgaaaatctgtagctgatgggatcagctaggcccgggtggccgtttgaaaagttgtaggcccgggtgaccgttgaaaagctgttggccgggtgccaaccttgttttcatttctaaagattgatacatggcacatactccgaccggacgagacgcactgtctcatccgtgtcgtttgagaagcactcacttagttgtttcagaaaagagttcaaataaaatcaattgcaaaaacaccagtctctccttgaagcctgcattaaacacttatttcccctggcttgctgagtactcccgtactcacccttgctctatataaataattcccccccagttgctgaagaagatgaagcggatcctgctgatgaggagttctttcaggagcaagccggctacgatgagttttagggtttcggcctagttcccaagtcgcgcctgtattgtttggtccaagtcctgcttccgttttccttttgtaatgcagttgtgagctcggggtctgtccgcagcccaacatgactgtactactactctataataaagagacctctgttgctgtgatattctgtcttcctgtgataccagcactgtttcctgggactggtatcgattaacaggttaatttggagcgtcacgggctagttccagtcgggactagttcggggtgtgacaagagatggtatcagagcacaggcttggccctagggcgaaacccgatgtttaggacgaccctaaggatactaagttcaaaactacttgcgaaaagctaaggcttcttttggtttccttattttcaatagtttgtttctaaaatggttactgatctttctccctctttcaaaattgtagatggcagtgaacgccagcttcagttcccatggttttggtgagggtcaccacgtcgctcagcttcgtgacctcgcccgtttccttggcttctcgtgtcccgagtacacggggtactccgtgggccgtgttccccctcactg

SEQ ID NO: 28740 - DNA, 1501 bp, Oryza sativa
tggaaggctttgatgggaggagggcatttgcatggtgacatgaaatttactaaagttgctgcaaagaaggtgctcaccacggaatcatttgattatgggcatgttgtgttactttctaatgcttatgcatcatctggcaaatatagagctgctgaatctgtcagatcctgttatgcaaagcgaattacaaggaaaactttagggcttagttccattgagatagtgccgtacagcagaagatagtagaacaactcttacctagggaagagagaagatacatcaaacaattagtattcactgtctgtctgtctcaagctattggaatctatctcaggcataagttgagtattcactttcaggttgccaagtctcctgtggaaaaagtaaagcatcaagcatgattttcaaatgcaagttgatgaaatagatgattgccttggacctttttctttaaaagaaaaatatgccttggtctatggaacatgaccaacgatatcacatctcaactcactattgctccaggaatctctaacacgtgaatatggattctaatggtactgacacactaaggtctaaggcagcttgtttagtgcatactcatttttcattacttcctttttttcatttgtctttttttttcctttttaaaagttgccttggagtttttacggtgatcctccatctgaccttatgccctcatctggattgtgcatgttgactttcctacatgctaggacaacaacatactattgatagtaaaaagaattggtgatagagcctgtaaataccagctgtggcagtttttttttttaaaaaaaaatgagcagtatattggggctgctgggtgtgcacctctacatatgtgcaagtgttgctttgcacttccatttcatttggcagcctggcagtccctattaatcagccactttaaaatttatcttggatgtttgttcaaggatctagtagcgttgtcccacttttctgccttaaaggtgttaacgtttcatgctcccaccaacagatatagttcacaaatgttgacactcgatagataatcatagaggaaagctatatttgtttcatgacatatatatctaccaagtactaacacttctcttcaatcaatgaacatttgtctgctctgtaagtctaaattatcccacatatttgtatagatgctgccattcatgtcttttcatgcgtatgccccagtgtcaatggctattgcttctgtttgaagcaggttcatatgtggcgtgattatttatcacctatcatatagttttattctgaaagatgacatctcaatatgcatatgccatggaattatctggtggaggcatattggtgtttgcctggtataagatgtgtgtggcaacatgtgttttgctattgtttattctatttaccccacaaattgcaatgcttaatcccttccttacatattcattacgctggtattagtgaacagaattatatgaagactatttgatgatgcagt

SEQ ID NO: 28741 - DNA, 1501 bp, Oryza sativa
gaggaaaaagggtgtatatttaccaacaaatatgaatttctgcattttcttgcccagcacatagatagcaatatagcatctatcagtaaatatttatgtgtgctcgtgttgataagcatacaaaatactcgtgcaagttatgatatgcatgatctatatgagtttaatattcaactgtataaaaggtatctgagtcttacaacttggtaagaggtaatgaataaaaatcactaaattcaacaacctgattaattatttggtgttgctttgctttgaaaacttacaatgttttggcaataaaatagaacaatgtcaagaacttatgtttttcaaatttcgtttttttccacatgtacatatatacatgcaacatcataatttcaaatgtgcctcgggattgatgcagatataaatttcaagaaaaccaacccatatccgattcattgtaatgttcttgcaaaaactcctgaagcacactatacgcgtaaaagtgtgtgcacatatacatatgacaatgcatttatcacttctcagtttgttggatgttctaatactttcactatgactagtcattgttttagtttttcctccactctaagttgattacatctctagctacattagttccaattctgttcatctttagtggtaacagatgtttacctgaactgggaagtaagtggcaatctgaatacgcggttgcccttggaaggagggttgtagagcatcaatccttgttggtttatatcatgaggacaaggaagcttgagatttctctttttaaatgaagccactaaaacctgggcaattccagcaaatatgcttccctctggttgtacatggacgtacaggttggtacccagaaataacatgataatggcgagaaacatgagtaatgtgggtatgccaaatcctattggccagctgacattgttctggatgtagatgatgacaatcatagataacacaagggcagcagtacttgttccatagtaccaattataatagctgtttagtccctttcgaccttcttcgtcggtcttatcaaactggtctactccaaagggcaagctacaaggccggatcgctcctccaccgataattagaaagcctagagaaaggtatagcacacttagctggagtgttgatggactgttgcagcctccgcctagtcgggttttttcatggcagatcggtggcttgagagctggaagtgatgcatacaaagtcattcccagcatcccctgttattttagcaaataaataaattaaaatgagttcatgttgatgaactacactcctgggaagagcttaaatcaacaaaaatgttggatgtgcactatatatcagtttcttgcatcagttggggcttattgtacattcttcgtttctaatgaaaaaaaagcattaagctattgctgatctttttattcgttgggtgaagccttatttgacaatgacaagtgaccttgcatttctttctgctgccaagcaggtgaaa

SEQ ID NO: 28742 - DNA, 1501 bp, Oryza sativa
tagcttgagctggatgcaaaatttatctcccggtcatcgcggtacaccgagatgtcagaatgatatacgagggcgcacatgccttgtaccaaccggaagcatccaaaaacccagatgcacagctaatgcattcactctatggggcattggaccaagagaagagaacacaggacatttttgtttcttgttcgtttgtgcttttgcaattctgcaaagcattaggggcgtttcaccgcgtatgtatgtacagcgtgttcgtgccacgatggttgcgtcagtgaggaaaggcagcccacgttaagttcagacttcagaggagaaagaaacaaggctttctctacactgtggctgcaacaagggccccacatgacagcagaagacactgctgctccacggtcggactggcattctcgccgtcaatgtcgtcgtcttccttcagtttacaactaaaaatatatacttggagtactaggaaaacaagcccaaatagtaggcatacatgtgaccaaaaccgaaccggtaaaaccgctcaggttttgcatcactctcaagtttcaacaaaactaaaacacattctaccatgtgggaaggaaagaacgctatgcgtgaaattaccgcctaaattaaactgttttgggggtcaccggtcacgggcaaattagcaccatcatctcgttcccgtccactccaccatcttgccctctagttgtacttaagtttgcaagtagtaggtgtgatcgtaggatagcctaccatgcaatggttctcatcctcaccattgtcttcctcgtgttacattcctttcgttcattctctcagtgaaatgtacattttcatcaccccacctcaaataacggtggtagaaatatggagggacattattatatataaaaaaaagtacggagaaatataattgaaatttagtagtggctaaatctcttttttttttcttttttggcatatttcgattgaatatgagtgatgccaacgtggatggccacatatcgattagtcaaaaaatgataaataataaagttacccctaatcaatctatcagtaaattactagtttatctttatctctaataactaatggatcaaatcatttctactagagagtaacgaaccatcgtccaaactacgaacataattacaaattcacaatagtctctagtctacaagtaaaattagggtgtgttaaaaaaactcaatttgtgtcattaagaaagaaggaaacaggcaacaaattacatttttttagaaaggtcaaattacatataattcgtgcaaagccaaactggctcaagctccgccacattggcattagcattttgagggcgcccgacattctcatcctcatcgtcgtcttacttaagtttttttttttatttttacgcaagtcttacttaagtttcatccatttgttccatgcttttacgttcaaacggctcccttatggcccggtcatatgctcctaccatacacaacacgctgttccaatg

SEQ ID NO: 28743 - DNA, 1501 bp, Oryza sativa
ttggtggagtaggtgacgaccacccgcgcctgggtgggagtgggatgccggcgcggggcaagtgatcgatcgattgaccatggtaggagccacacaggccacagccacctgggtaactagtgtcatcagctgcattttgctcagttgctgcttgccatcgtcgtcgacttgttgccctcctcttttttcactgtccgttgctgcttcttgggttcacttttggtgcgtttggaactttggatagagtattaggtgatctggataggcacgaggaggaagccatgcgatgcaatgggataatatgcaatgggtgatgaggtgtttgggtgtccacctgttgaaactgtgtcattgttggacgggtgacatgtcacatgctgatggggtggcgtcagtcaatcatgtttttgtagattaaccggagtgaagaatggggtctgatgttctatctgatctgatctgatcatctcttgtggatcatcatggttaggcttggcatgatatatgaatcttggtccagtcagcaagtgggggtttttattggtaaattgctttggtaagttaagaggtcacatcactaaacatttgctatgcaaatgtgaatgcgtatgatccctacttggcaaaaacttggaacgtgctgtttgcgtgtcttcgcattcatgcatttctatccgtcgttagacaaccaatcgccaggtcaattgtagtgccggatggctagctggttggatgacactgatcatagcttgaactttacgtatttatttttggagcagatgttcgtatggtaaaatgccttaatggtatacgatctatttgacatcagatacaactttctgatattgattccaattccattcagggaaagagccagagtgccgtacaatttgcacacagaggtgtgtccaaaagaacttttttgcagtaaaaatgtgaaatatagggagacatgaaccattaggcatttgtcacccgtgtgcctgtgtgtgtcactcttctcatgatctcatcacaccagtaaactgcatattaacgcctgaattcattggtagtgccaaattctaggtaaactccggcactatcaaaatattgtagggtaaagttatttagctaatatttggattgctaccaatataaaaccaaactcttatagtatagaggagaaacttctagaatatgaccaaataaggtaggcactaccaaatatttggtgttagtccaaactaacacacatattattcagtttgccaacaaagtggaaaggcatgttttggtatcaaaccaaaacggccctaattaaaaacaaggagggacaggtaaattaattgggccgtcaaactcaggaaaagcccagtctggttcaaaaggcccaagatacaaaaaaaaaccgcaaccccaactacacgtctccggcacagtggaagtctactttgcctcccttatttcttgctcctgactcaatcgcctccaccgaccacagctgggccacctcccatgg

SEQ ID NO: 28744 - DNA, 610 bp, Oryza sativa
attcgagctcggtacccatcctcctactgtgttaggtattagtgctagtaagtggtgacattttggttaaacatgaaactatttacactgtgtttaaatctgttggcatcatgtctaccttgagtgcatcatcttcaaaatccaatgttgtgcatgcaaaatctcatgttgttgcttgtgttgctaagccatctgagtctaccaatgtttctaatcatcgtgaaaaatatgcttgctcgttttgtgggaaagatggatatattgttggtttttgtttcagattggctcataaaaagaaaatggagagagagattgattttgcaaattcaaagtggcaaaaatttggttttccctcgaggaaaccggtcagactgcagtgggtccagcggtcggaccggcgaccagttggaccggctactgggcagcggtcagaccggcggtgcagcggcggtccgaccgacccccggtcagaccggcagtaccccttcggtcagaccggcctcggagaaatttttctgaaaattctcaaactgtttttgcacgtggatatatgcctattggatcttctggtcgtgtatcttagtactggattcctaaatttttattatca

SEQ ID NO: 28745 - DNA, 507 bp, Oryza sativa
tcaattaatttaaacacctacctacttaaaaaatacttaaaaaatacaagtattccagaaatttgtattttagtaattaagtaatctttcttactcctcccaattctcatcccccctttttttttttcctttttccccgcgggttgggcaaacggcgcggggcactttttcttgaaaaaaatcaaagatgatacaaaatcctaatcgtgaacggagtacaaatcacaacataaaaaccgaacgataatcccaaaaaaaagaaaaaaaaagcggcgtcacctatcatttgagacttttcctatcaagcaaaagtaccaaacagtgtgaaaataactttggctaaaaataaatatttttagttttaatacactgtagcgaagcacgggtattttgctagtatacctatagatacatatacgctatgccctggtcttttgacgtacatattctacatgatacgtttgcaatatctcagtctattaaaagacgatctgataaaaaaacctc

SEQ ID NO: 28746 - DNA, 1501 bp, Oryza sativa
aaagtaggcctgggcaggaggagacgaggcagagaggtcccatgagtcgacctgttcgagcacttggccgctaatctggttcaatacgaactgtgaggtaacagagacgatcaggtctcctccgatggttgcgaagattggattcttaggtttgcctctgaatgtccatttgatggtcaggttgcttgtcgattgcattgacatttcctggactgtctgacgcaataacacgaatgctgattagatagtcagactggaatcaatccaaactcatgagcatgccaatgtgaaataaggagagaggcattctttgtttgaatttgaactgacaaagtcctttttcttttggacagtatgttatgcaacttgtttgggttagatatcttacaacagagttctaacttcatggatatggtatagaattgcagcaatccttaccactgtagggttttcgagtgccttggtgatccacaatggcctcttgtacttctcccgtccaacaaatgttctgaccgggtcctgaaaaaaaaagaaaggcacgaaaccacaaggtgatgtcaagtagctcatcagttattgtatctgcatctggacatcctaatctgtcactagttcagtagtttgtttcttgctgttgtttgagtggtactttcgttgctattcttcttaatataaaatcagcatcagcctggctaaaacttctgaaaatggaggcatgttacctacttaaacattcatcagatttcctcggggaaaaaaaacattcatcagctaacagcagtattttgtgttggttcatagagcttttgcaagagcttctcggggtctactctgtgcctgaaactattcttgttggtgttgctaaaccttcggagcgaatacgcaaaagcgttactcgctgattgaaatggcatagctctatttttcccttccaagaaaaaaaaaacagatagtactgttaaaaaaaaaactacagatagtgtttgccacagttcatggaatcccatgatcatatcagactcgtagcttacatgtttgctagattaacttgaaaggagatgcaaagcattggtgcgagattggtaccaaattaatgtctgaattactgataacacatagtacggagtagcagtaaagtggtaattggtggtacaagggtgatgcgcacaccttgtatttgacggagacggcgtagcaggtgaaggcgcggttgtcgtcgcggaggtcgaggatgtcgcgggcgagctgcctcgcggtggcctccacgtaggggctgcttatgcactcgaagtcgttgcagagctccccgaagtccatcccgtccaccagcttgtccgtctgcgacctctcctccgcaccatctccggcagccgtctctacctccttggaatcatccacaactgcaatcacgcacagagccgggagttaattagatcacgtacgtgcgagctggaccgcacggcgagatcgcattggtgagatgagatcttcaccgtgcagg

SEQ ID NO: 28747 - DNA, 1501 bp, Oryza sativa
aacatcaatttcacaaataagataatccaattcatgaacatcaatttcacaaaaaagataatccttacactgctatctaatcaaagtataaccctccagtctctccaggattgctatctaatcagtctctccaggtttgctatctaatcaaagtatcgatcgaaaatccatcagtttatccaggatttcatcaacacagaagtccagcgagctctgatcgtcccctcctcgcagcggctttttccatctctgcataaatcaaactactatatacacaaaacattctcaaaaacaaaatctttagtcaaaaaaacactcacggttcaaatgactaccgtttcgccgtcgtcgaacgaccacagccgcagcggttcgccgccgtcgtcgtccggcaagactaccgtttcgccgtcgtcgaacgaccacagccgcagcggttcgccgccgtcgtcgtccggcaggaggctttgtggaggagggatcgcgtgttcgcgccagattgcttcgaatcggttgtgctcgatcatgtacccgcccaagttgatgtgctcgccgtcgtacgcgacgccgttcccgctcgccgccggcggcggcgcggcatcctcctgggagtccaccatgagcgcgcccgcgtgagcgtgcgcgtgcgcgcgctcgagcgagacactttgttcagcctcgtcggcggccttctggatcgtgtcgctcgcggcggccagggagacgtcgatggatcggagaagctccagtagctccacgtcgggcatggcggcgatgccgtccacctgcgccgccgccatggccaactcgccgccgccgccgccgggtccttgctttgcggcggcttggttctcgcagtaggaggcgttgtccacggagtgcttccgccgatccttctccggcagcgatttgtaccgagtggcgatcgcccagacctcctccttcgacggccaccacgtcggctcgcccccggcgccgacgcccgggcagatcacggcgacggggacgtcgcaccgcgtcgcgagcgagctcgccttcctcaccagcctctccttcctcatctccaacgccgcgcgccgctgctcgccggcgacggcgggggtgacacgagcctctccgccgccgccgccgccgcgcggcatcggtgctcccatcatctcaaacgtgtgcgtgtgctagcagatgaatcttgtgctagcagatgaatctcctctcgcgcgagttttgtaggctgctccccttccgggcccaagaagcgcacggggttgggcctgaacacgacccggagttcccttcttttttttttttttggaaaaagtccacttagactcccttaattgtttaccaaatctaattggtgaccattaactgaaacaccggataggatgactccccgaattattgaaactagtgcaatttgactcctccaacggttttacaggacggttttgctgacgtggcggtgctaacccgattttcattctacgtggcgctttcgtgt

SEQ ID NO: 28748 - DNA, 1501 bp, Oryza sativa
caactgggggggaattatttatatagagcaagggtgagtacgggagtactcagcaagccaggggaaataagtgtttaatgcaggcttcaaggagagactggtgtttttgcaattgattttatttgaactcttttctgaaacaactaagtgagtgcttctcaaacgacacggatgagacagtgcgtctcgtccggtcggagtatgtgccatgtatcaatctttagaaatgaaaacaaggttggcacccggccaacagcttttcaacggtcacccgggcctacaacttttcaaacggccacccgggcctagctgatcccatcagctacagattttcaaacgtcgaaccccttttcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaagatatttccaaagccgacacaggtttaccatatgccgacgagaggggtcccagaccaacaacaggttaggtcccagaccatactgtgccaggaagcccaggggtcctcccagacaccaccccggtgaatccacatgtctcccattccacccatgtggtcgtacttgtcttatgtttggatgaaattccaaggaaacagtccttaagtgcaagagcgggaaaccgtacacccggtacgttccccggtccgcggttttggaaattcatttagttcgcaagcaccgacccaggtgtcgggttttccaagtcttttgcaaaacccaagttttacccaagttgttactcagattttaagtttgaaggcatccgttgatactcgcgcagggtgcacgaatatcgagacgcaactagatggttacaaggggacatggtatcgcaattaacaaagggaggatcaaatgcaacaaaattaggtaggtctgccaatctgccttgcagacgggacaagcagatcaagtgcgatcctatcaatgcataatattttgcaagcaatataattaaatttcaaatataggctcaagatgttcaaaggtggcttgccttgctcgagagctgaagcttgatcctcgaaatcctcgcactgcgggtcttagggctccgaaactacacgcgaaacgggacaactcaacaaacggcgaaaataaagccctattaatgacctctaagcgtgctattagatagatctcgagatttgaggaattttggaagttgaacggagtcaaacggatctacggttgggaggatattgaatttctaagattcttggatttttggtctaaaggaaaaggatttaattaaatcctttttggaaaagaaaagaaaagaaaagaaaagagggatggaaattagacttccctcgggcggctagggcgcggcccgagagaaa

SEQ ID NO: 28749 - DNA, 1501 bp, Oryza sativa
agtattcgtgatggcatgcgattgatgagatatgttgctgtcatgactgcctcactccatagaaactttggtacattcatcgtatacatgagtgaacgagttacctccagaatatgtcgatttttcctctcagctactccgttctgtggaggtgtgtcagcacaagaagtttgatgtactattccttctgctgagagaaaactcctaaattcatcattcacatattctcccccattatcgctcctaataactttaacacaagtgtttaattgattcctaacccaagcatagaaattcttgaaacatttcaatacttcactcttgtgtctcatgagatatatccaagtcattcgtgagtggcaatcaataaaggtgacaaagtactttgctccacttaccgaagcaataggagaagtccatacatcagagtgaaccaacacaaatggcaaaatgcttcgaagtcctctgcttatgtatgtggttcgtgtatgttttccatactcgcatgcatcacacattaatttgcttttgtccaccttactcatctcatcaggaaataccttagacatagtatcaaaggacatatgtcccaattgacaatgttttagaatcaatttagcctcctcttcacttgtgctagctaacaaagcactacatagtgctttgtccgtccctcttctatccagataccacaacccattatgcctaacgccggttccaagctttcttccagttcttctctcctcaattagacaattctctcggtcaatagtaattcgacaatccatatgatcaaccaacgagcttacggatactaggttaacaggaaaagagggagcatataaaactgacgacaatgtaattgatggagtacatttgactgttcccactcccctcacatgtcgtaaagttccgtcggcagtttgaattgtttctttaaatgatgactgaaatggagtatatgatgtaaactcactcgacattcctgtaacatgtctagatgctccggagtctaatatccaagttgagttaggtacctgcataggatgtgcgagattaacaaagttgccaagcactgttgttttctccttcactttctgaattcttccccttatttcttcaacttcttcagccaatttctcaagtatttgctcaattccttgaatttcccccatggcagatcaaccaaatcttctaggatactagccaaatcaattaataggagtaacaacactactcctcagtttctcaccaaaaacagaacagcagcagtagcactacttcctcccagcagcactacttttcagtttcccccaaatcagcacaacagcagcagcaagccaagctctcgtacacagtttcttccccaaatcagaacaacagcaacagcaaaccaagcttccacttcacctccaaatcctcaccttctcaagtagcagcagcaccagcaacagcaccaccaaagtcaccaccactggaacggacaacaatagccaatagc

SEQ ID NO: 28750 - DNA, 1501 bp, Oryza sativa
taatcacaaagttgcaaaaaatacaatactatgattgtgtatttgtgtgtactatatataaaacaaataaattaacctagtagtaactgatcagtatcgatcgagagtcaacaaaatatatgtagactacgacgatacgtgtgtgccttcctgttttcttttgttcttatctttgggccgcactatacgctgcatctatactaaacagtagtgaaaaatctacctctccaccactcaattattacgccggtctataataattcgttgtataaattacggggcaacagtgaattattcatgtgctcttgcgtgtaggattgccaaacaactgtttcatggtcagataaatgaaaaaaaagcgacaaattggtaacaataaggaaatgttaattaatttatgacatgtattactttcattaaaaatataatagtttctgactatacatgtatctcggaggtacataaccaaaaattcttagaggaagtataaaaaaaatgttttcttgttattggctacgaggtctcccaaaaatccaatgttgtacaaatactatattacatgtcaatttgaaattgtgttaataagtaaaaaaggacactccaatttctccatatcctcaattgaggaaatataaaaacaaaatttgtttaaaaaaatgtttcaggaagtataaaaaatgttttattgttcttggctatgaggtctcccaaaaatccagtgttgtacaaacactatattacatgtcaatttgacattgtgttaataaataataagtcaaaaaaggacactctaatttctccatatcctcaattgagggaatataaaaacaaaaattggaattgaaagttgaaaccatgcaccactagtctctctctctctctctctctctctctctccccttccatctctttctctcccctagcaattacactacgccttctccataaatgcgattgcaccctctcaacactccgcggcaataactccttcgcccccctctccacattctcttccacctgtgttccccttttcttctcctcttcttcttcctctcctcctcctgatcctgatcgagaagatctcaccttgatctcttgccgtgtgatctctagctctcgctagccctctgaaccttgcagtttgttgtttgcacccggtgaaacatcttcttttgtgcaggtaggagagacagcaaagcagagataagagttctatatttgcatgtagttcttgtcttggatctcactggctggctgtctcctctctgcagcaaggttcgttgggctagcttgtgtgctagatctgtttctacttgcgtttgcgttgcttggcaagcaagatatatatatatatatctatatctatctatctatcattctatctccctacatatttagagctagcactttgtgtgttctttgggtttgggacacactcatatacgcgtgttcatgagtggaaatggaaggagctgcaagggcaagaattagggtttgagat

SEQ ID NO: 28751 - DNA, 1501 bp, Oryza sativa
ataaaatatttttttctaaaaggatcaaaatgtgaaaaattcagcagggagaggtgtctgtccctcccacagtcccactcccacctcccctcattgcctcgccgccgctcgccgtcgttatccaccggacaacgagcatcccctgacgagcgcagaaccgagctccggcgccgccgatctcggatgccaaggcgggctacaggtaggtgattttctttttgttccctaatcagttttttttcgatttaattatttcggcctatagtttcttattcgttttccatgttgatatttttcgccttcttttttttcagttttgcctctcccgattgctccgtctctcgagtcggtttccgattcgaacgcaggatgccaaattaaccgctaactccttcaaaatctgaactcgggaggcaagagaagaagagaatcaaacagagcgcctctggattttgattctcaacactacaagaggcatttttttttttgccggtggagtatatgaacggcaagcggaagagatcgggtggaaccatggagactcgtgccatcaagtgcaggacgatgcagcttctccatgaacttcaaataagtatgcttccccgtcctcaagtctttgatctaattcctatacagagattgttgattccgctgtttctagggttcatttcatatgtctgaagaagaaaaatctgttccttttttttcctgggtgagacgcctttttaatggaggggcggcggttgaaaaaaaaacaactctttttttttaataacctggttggttcttcacctaaactacactttttttttcttaaggtgctatctaaacagaaggcaattgttaactctcgtctggtctaagctcaaatattaactttattttagagtaaatttcacaaaactatacgttttgtggtctatgttgcagaaaactacacactttgatacttggcatttaagtacatatatttcggtagtgttgttttataaaaccacactatcaatgaataaatccaccgtgagatgacatggctgttccacctaaacgaggacgtggcatcctatgctattaattttttgcatgacctcctatgcttgtcagcgccggcgcggacggccgttccatatttccgcccatcgacgaccaccgaacaatatcgtgtagctctcaccgccttcggcctgcatctcgtcgtcatgtcagccacaagccagcgcctttcctctcactgctatcccctcgccgccgcgccacgaggttcctcgctaggcctcatcatctctcccggcggcccctcaccatcctctggtcatctctctccaatacatgctatgctcgagatctggagttagcaggcaactcgctggctacatgcctcttcgagtactgcggccccttgtgtctcattccagtactatggtggctctgccattctgctactaacaggtatagtttggttctttttttttggtccaaggaatcaatcaggtgcccattt

SEQ ID NO: 28752 - DNA, 1501 bp, Oryza sativa
ttctaatatattgacgtgcaatccttttgtgcgttcgtggaaaaattaacctttattttggtttgttcaaattagcagttcttgtctgaattacattatcaaattcggaatctaatagttggtttttatctccagacgaattgggcacatctgcaaaaataattgacgcaccaccgcgacgaggtgatatttctactggcataatgcgagaactcccgctcgataaacttccagaggtatggattgctaagaatgttttgattactatcgttgaaacttctatgtcttcgtgtgcttggatcgtaggatttatttttcctcgagggattgattgtaggaatttggtggtgaacacatatttaaacaacaaatcaacaatgtttgggcaaactatctaccactcaatgatcctgaattatcattgttacaacctttacagtactactagcagaacaaactgcatttctttgcaccacacatccttttatccggttgatttaaactagtcatcgtcttatctgagttgggtgaactattactgatcttcctgtgcagccatgtggtttgctcatgttgattcattaatactcactgttgagtgtaggcgtgtgtatttcagcccaatagggcccattccaccaatgtatatgtatagtagatgagaaaggaaatgaagtgaagcttctagaggaaaaatcacaaaactacatggtatcagagctgggtcaccggcgacctcgccgacgcgaaccctagtcggcggcggcgctgtgaccagagcggttctgcggcgacgtcgacagctgaggcggagcggcgacgtcggacagcggaggcggagcggcagtgtcgacggcggaggcggcgacggctgctgcagaggttctcgacgcgagcagcgtgaaggaggagcagggcgcacgctcgctggttgagctgcgcaaggatttggtgcagcacaagctgtagggagcacagcggctgagagacgcgcagctgttggatgtaggatcaacagagaaggatttggtgctattggctattgttgtccgttccagtggtggtgactttggtggtgctgttgctggtgctgctgctacttgagaaggtgaggatttggaggtgaagtggaagcttggtttgctgttgctgttgttctgatttggggaagaaactgtgtacgagagcttggcttgctgctgctgttgtgctgatttgggggaaactgaaaagtagtgctgctgggaggaagtagtgctactgctgctgttctgtttttggtgagaaactgaggagtagtgttgttactcctattaattgatttggctagtatcctagaagatttggttgatctgccatgggggaaattcaaggaattgagcaaatacttgagaaattggctgaagaagttgaagaaataaggggaagaattcagaaagtgaaggagaaaacaacagtgcttggcaactttgttaatctcgcacatcctatgcaggtacct

SEQ ID NO: 28753 - DNA, 1501 bp, Oryza sativa
cagaaagagaaaagttaacgatctcaccatctgggtaaaaataaaggcaaatgttacaacaggtccaggacatctgatatggcagcaatcatctgaataagcaaacagtgcaacagcctgattcacaatgctcatctgaaggaacaaagcagctctaatttcctcatcggtgtccatcagtgatttatgttcaattttgcactgtccacagcctaaataatcagctcattcaattttccagaccaaaataatctcctttaataagaagaaaaggtgcttactgaaaagaagcctgtcattgttgcagccctgaaaaaaatggctgtactcagaacaatgtagctaccaaaagcagcaccgctagcaatgattttcttaactctcagtgtatcccgtgaaatcagataaaagcaacaagtaatacttactaatcatgaaaagaaacaagggcacaaacaatatatattgtagagtaaggttggccttttgtagctgaaactcacagtaattaaaagcagcaatcaccagagtcaagaaacttggtaagtcgaagttccataaaagtaaaatggcatggacaccgaacttcaataaatataattattaatgttagcattgcataatgctgtagttttcaaaacataatcactgtttgtactcacaagatggacagttgatgagacagtgtagatctgcaacaaaagcaacgcatctcaactgactacccattttgtcatctacacgtcaaatgccttgccagcaacaaaaactcttgaactgcatcaaaattgacttaccatatagcccttcatcatctgacaaatttccctactgatttgcacggctgaagaaataggtatcagggcaggctgagtcaaaacaagatcggactcacttttggtgtaatcagtggcatcagctactgatattccaatatgactttcacctatggaatcatgatcaagaaattcatgcccaaccattgcacaacgacatccaaaatttctgagtcttctcactatatcactgttgtcctctgcactaacaaatagagcgagcaaaatggtaaaagtggtgcttctgtgcttaacaaaaataactaaattgcataaatcttaaagcggcattgttggtagtgtagtagcagtggtgtttgccactgtcaaacaagaacttcttgcaattaattacttcgtttggagcgacaggtgaggcatgaagtatggcatcacttggaacataaagattgacctggaaagagatctgaaatcccattgatgtttaagtgaacttctttattgttacgagctaactcaaacactgcacgggcaggtaaaacattgatgcctagttttccaagccttccacacacttgccttgtaaccaacaatggactttctgagagggaaggaaatatcatttgatgaagaattaattgagatctcaacaagaagatagctgggtttctgcatcacctgtgaggactattatatccaaacct

SEQ ID NO: 28754 - DNA, 955 bp, Oryza sativa
gccatcgcatgcttcctttgcttctcatttactactccatgtggggggggtctagctactcctcacaagatagctagcgtgatgtgtctagtgagactactaccttaattaatttgcatatcaaattttggataagggattatctacataatgccaaaaacaccattcattagcgaagaaaataaaggaagtactgaacacttatttctactctactccgtatcggcgatattttgtctccgctgtacctagagtgtggtgtgtttagttcacgccaaaattaaaaatttgattgaaattgtaacgatgtgacgaaaatattgaaagtttgtgtgtgtaagtaagttttgatgtgatggaaaagttggaaaaagttttattgaaattagaacgatgtgacaaaaaaattgaaagtttatgtgtataagaaagttttgatgtgatagaaaagttagaagtttgaagaaaatgttgggaactaaaccaggccctattactgcaccggttggcttacgtggaattcaattgcaagtttgagcatgtatatagcccctagctgaccaatcctagctagtctttgcgggagtgattgacaagaacaacgcataattaatcaatcgttaaataaccagtactaatactaaccagggttaccagacttggctaatgcttgtcttgtaagctggaatccccagccttaaacctgtatacagacatcttatgctttctcagtaaagctgggcggtagcttcttgatccaaaatactaacctgcagggcgtcgttttaacatattttaaagagataaataaatagagagaagagcaacgggctacagatgtatagacagctgcagcatggactataagacgtaatgtgcgtatgacaggtcagaccatatattaatagtatagtaagcaactattgtataaattggctattacattggctataga

SEQ ID NO: 28755 - DNA, 1501 bp, Oryza sativa; identical to SEQ ID NO: 28281

SEQ ID NO: 28756 - DNA, 1501 bp, Oryza sativa; identical to SEQ ID NO: 28701

SEQ ID NO: 28757 - DNA, 1501 bp, Oryza sativa
cagattccgttcatctttggaaggaaaggaatcagtacgaatggaatttccatatgatcccttctcgttgttatattcttgtcttcctgattttagagaaccatccacatcattgcttccagcggattgttgatttggtggctgaaaaaatgaactctcagaattcgagttgccaaatggtttactagcctttgcaggctccacgtatgggacttcagttgttggagctctttgtactccaatagaatcaagaaaagatggccgagatcgattgtatgtagttggataaccagatgacataaaaggatcctgtttatcaaaacaaacaggtgtggaatttgatgtattccaagaattattgaaggcacttccatactcccggctgctggcatacgctaagccatctgcttgggaagagtctttagaggtggctgcatagcagcaaaagtaaagagttaaaagtgccacatattcaagttatcatcactcatcagatagcataatttaatatgaaaaagggcttggatatacctcggaaccgaccaaagatatcattgtttgcagagtaaccctgactttgcgtgccttctaactttccaaaaaggctgccagatgaatatgaactagactgctcagtgtcacttacttccctcaagactggatttcttccctgactcagcaagacctcatctgaagaatgggagacctcatctgagtttccaaaggcactcaatttagattttaaagtcacgtccttgtcaggactatgttcctcccttttccgagcagcatcgcctctccaatcctcattatgcccattaactaagtcagagaagctcaagttcccataaatcttgctccctccaacactactgacatcatgcgatggggcaggattactaacactgactggcacatttacaggggcaggtccatttgacaagggctcgtcacctctggaataactcgttgggccattctcgtagactggtggcacagatgatgtgcttgttgtgttcacatccacgtccgataccaacttgtctcccgagttagtactggtggcatttggaggagggttctctagtgtatcaggaacaggcgccgttgcctggtctgcagtttcagcagccttcttcgccgccttgttcttcttcttacggtactccgccagctggatatatcagaaaacacgacatcattattctacaaccaacttgaacttaatttcgcatcaaatcatcactcaggatcagttgatgaaatagcaagatctaggtaacgaaaattcaacatttcaaactgagcgtgctgatgacgggggtaatttgcgcgcatttgacttctctaccataagcaaaacgatcgatggaactacatctctaacgcaaagcggtcaatgctccctattcaatcaaacgtgtctggacaaaaagatccagcatttccagaaggttaaactaccaacatcgggtaaccaacgactacgtctatcgcaagc

SEQ ID NO: 28758 - DNA, 1501 bp, Oryza sativa; identical to SEQ ID NO: 28702

SEQ ID NO: 28759 - DNA, 615 bp, Oryza sativa
tttcgaaacggagggagtatgtcacaaccaaccaatgtgcgtgcgtcccttttttttattagacgcgatcgatcgatcgatctaatactgttcagtacagggtactacatgtttacctctctcactaggctggtcattgttaccatttattagtattatatatgatcttcagggtccagttaatcgtatccatctttctttgtcagcttcatttagctgctgtcctttgctggattcactcactatatcatcatttctatcattattagtggtatccaatgtctcgttttcttcttaaaaaaattagtggcatccaatgttggtttctgcatagtattattatttacttaattaatgttcattaacatcttcgcggaaacagcaccaaatgattctgcatttttcaggaaaacgaaaaaaaaacagaaagctggattactttatacagctgcacttttcatgctcatgatctgaagatcaaatcaggtttccttggaggaagaaggtgcagcttcctgcagacaggcaggagggaacaccggaatgaaatgcatgcagaattgcagagaactaattgcagatccataggaattaagtgaatttggccatgcccca

SEQ ID NO: 28760 - DNA, 1054 bp, Oryza sativa
cttagaggcactttaaaaaagtctaataagtgtcttatggtgaattatctctacaaacgaaaagacattttataaaatgtctataagatggtagaggcattttctagagacattaaattataccacaaacatatgaaaccagcattttctagagacattaaattgtaccacaaacatatgaaaccagtctaaaaaagagacattttataaaatatctataagatggtagaggcattttctagagacattaaattgtaccacaaacatatgaaaccagcattttctagagacattaaattgtaccacaaacatatgaaaccagtcccaaaaaggagaataaaatactttctttgcttttgtcaagccttgaacacaaacatatgaaaccaagtctaaaaaaggagaataaaatagtttctctgcttttgtcaagccttaaacccatgacttcttggagaaatcttttctacctttaatgcactaaccaactcaactacatgtcattacttgtatgtttgtgcctttagttacttatatttactccttcagtatacattatcattctaagaagtgtctttacatagtttaaaatgtctcaagaaaatacttttacatatcagtgccgaaatattgcctctacaagataaaatctaataaaatgagctgaaaatatctctagagtaaaagttttctaggtaatttttaaagtgcctctataaagtgtctctacactataaaaactcatgatcttagaagaaatttgcaaaacacctctacaaaagtatctctatatgaggtttttgttgtagtcctcttccacaaggattgccaacatggccaacttgcattagctaaggcaccactcgagaggacaaacttctagaaagagcatgcccaaactgttgaaaaaagtttttgccaaggaagcctcctagaggacgtctctagggaaagaagagacgataagacccgccgcactcgttgaggtcttgaggagaaccaagacaaggtttttacccagcaacccactagagggagagagacgactcgacaa

SEQ ID NO: 28761 - DNA, 1501 bp, Oryza sativa
gtctctgtttcaaaaaggagttcacttttctacacaaaatgtggaaacgtaactatggaaactcatctagaaaaataaatctttttaggacaagggtagtagctagttttaggaagatagcatccatcaatatatgtagggataaaaacatagtgtacttagacgtacggttataatcatactatatcttacaccgtacacttttggatatatacacggatgtcggaaatgatatgggagtggaacagctcgatttatgaacatgtcgaaattatcggataggccggcatgcattaaataatgatgccagttatgctcccatccacgtgcttggagggcctcggaagttaaaaagagcaataagctacttgcttaggctctctttatttgggcttagatttattggcttggcttttcaagtcaaccttttggcttatatgttttataagccggtcgattatttaaagtcctaatattttaattatttaatgcttgagtcatacctccactttgatcacgtaaaccaaaaaagcttcttcaacaatgagatcgcaggacaattaatgcattctgttgaagaaaatgatggagcttttggtttatatggctttaaaaaaaaccaaacaaaaaacttgctttgttggttaggagtagactttttatcttataagttagcttataagtctaaaaaaatcctagactatgatggtgtgagattcggtcatgtagtatggtgatataatctagaaatctgttaatccgaatatcggttttagataatagtacgagttttagataacctaaaaaagtattaggtaacccattcacccgtttttaagataaaagcatatcctatttaatttaatattcctggtgttagaaaaaatacttgccatatttggtagaaacggctgaacggtcaagaaaatatccgatccgtttttatccctaaatacacatgtagagtcatcagcagcaactgccattattctagctgccgttatcagctgcgctgtaacctgaaatgaatcttatctctaaaacctggtgatctttattttcttttagagagacatttgaggggaaactgatcttttatcaaggaaaagtatcatcttaattgggatcatctatatgccttagtgctttacaatgaagacagtgcatcatataatgcatggtaattatgttttttcagttaatttgtatgcatgatctttaccttcttcttttttatttgtgtgaaatgggcaagaatcactttgggaaccagcatccggccgccttgaacagctacaggggctgctcgtcgacacacaacaagtggtggatcaagagccatgtcgtagataattaaaccatgtatattccctccatacttgaattagaagtcgttttgggtgtcactggtgttttcacaaagaatgtcgcggcacgctcagaggatagaaggtggatgtgtttgcccctgcgtgcgcatgctcgccgtccgcagtaatca

SEQ ID NO: 28762 - DNA, 348 bp, Oryza sativa
taatttggagctagtagtggactatactattaaacttgctcttatagtgagtacagtagataacgtaagcgggttgtacatgttgtaacatcggatttgtgcttatgtaaaagagagaagaaaatcaagctacatatgtacagccagctacaacatgacctctaataaactatgagagatgtatggattagtttttttttcgggggattagttttttttttcggggaattagttattaatgatacaatatatatttacaactaactattgtataataagtggctatagataatgtttagtagtttttaaggttaatagctgactatattattaaacttgctttaaagg

SEQ ID NO: 28763 - DNA, 1501 bp, Oryza sativa
gttaggttgtatctaatctcgtactataaagctatattttggagtggaggggctccaatatttcattcattccagaggtggcataaccgcataagctacagcagtgcacaaaggtctcgatcacaatacatacacggctacagcagtgcacaagggtctcgatcacaatacagacacggccagaacgtcgcagtgcaggataaggtaacaatagaactagatattgttcgttgtcagatgattcgtttccccagttcagcttggtgaaaaaacgaaaacggtcgcagtgggtgaaaagaattctagtgcttgaagacgatcagcacggcagtgcagttgtccttgcacgcctctcacgaacagcttccttcacgagccgccgcactgccagagtcgctgacgaggtctcctgcaatgattgacggttgaacaaagttttagggttgagaaatttggtgttcatatacttcatccatcccaaaatatagcaacttaaaataaataggccccctaggatatgttttctccgatcctaggttgctatattttggaacagagagagtaatgctttgcggaattgatcgtattaaattcaatcataatcgggtcacatgctttagattttgtgtgccagcgtaatctgatcataaatgctttcactacggtagataattgctgttagatggagtagtggggaaaggaaacgaatgcacttggagatgcaaataacagaaacaaacagcaccttcaattgattctgcacaaattcaacagcatcacctggtccaaatacctggcacatccatttacagcacatgttaaaacaacacggaaaaagtatattactgaagcagaccacaagaacgattggcgataaaggggagaagagaaaaaggacgtactccccataagccatcacacccaagaataataaaatgatctttcctcgttacttcaaaggagtggacgtccggtgtagcaatcagcccaacctgcagagtggggcacataagagatcgtaatataaaaatgtagcaatttcctatggctaaagcaggctttccaaaagcatgtcaaaagaccataggatttcacattttatctttgaaagaacttcacaagaccaggcatggccagttgcccaacagaattcatacctactataattcaatatatgcaaatggcacattgttaggtttgccatatcgagaaagccactgttagtttatccaattatccagacaaagagatgaacagagaaacagggaaatatactagtatcataattttgtgaaggcttgcagcctcgcaaagacctaaaacatgctagcaagcttccacaacgtctgtttacaacttaaatccccagcagttaatagggtcgaacgttagctgaaacaacagtgctagcatatagccagaaatctgacacttcatagttggttcaaaaagcaatgtggaaatgtgcacaactgcttatgagaaatgtatctgcaacagc

SEQ ID NO: 28764 - DNA, 153 bp, Oryza sativa
atagatgtctgatggtccgaaataaatgtggacaacaatagtgggccattatgttatcaactaatcatgctttgggcatggggttgctctgtactgttaatatcacaaatgtgagatatttggaccagcattaagaattgaagacatttgtct

SEQ ID NO: 28765 - DNA, 1501 bp, Oryza sativa; identical to SEQ ID NO: 28704

SEQ ID NO: 28766 - DNA, 1501 bp, Oryza sativa
cattggttgcagtggaggtggcccgtgtgaacacatgcagcgaacggcccagctcgatcgatcaccagcagccgggaagcgtaagcgctaagcagaggcatggcaatgccatggcatacgtgatcttgttctggccgttgcgtgtggaactgtgggtggagcatttgctttgtcttgttcgatcggaggatgcggctaggtaggatacatgttttgcaggggtaagagcaaatttccactttctctttgcttgtttgcttcgcaacaaatgcatttgaaaatgacagacaggcccccaaaatcagattaaaaaatatgttttctttggtgtccttagtgatgaggagcacccaaataacccatgcgacatcatccaaggattttattttttttttgcaagtttgtactttaaaatgagccaataaatctataatacacatttacgactacgtgtccttttcaatatccgtggaatcaattgatatattgattcatggatgcaaacaaaaacaattgtaaattttgggtcattgaacgatatatatctctctaaaatattatttatatcaagatgacgatatgcatgtatctttcattattaattgttcgctcaagcatatcgtatcctttcgagggaatgaagcatcgaagctcttgactcacatccaatacattgtctaattcaataattggatttgaacatcaaatatattccatgcgttgtgcaatttacaaatcatttttaattagtattttactattctcaatctatattatcgataatatgtattttactattcgatagcaactgtaaataaaggtcgttgggtgttacaggtcaacaatcatttgagcgatatggtaggttgagtgtttcccctatgttgttttggcataactttcatattactatgacaacaaggttattttgaagagttaataccgccacgtccattgtgcatatttataaaaagtaactatcaaaacacaactaaacccgtagcaaaccacatgcatatatattgaataagtgattttgtaaaaaaatatttatagattttgatatatgagggatacttgtaaacttatgtatataactcagccatgtcatcatctcaaataattttagacaatcggattaatatatatcacatcatttatacactgaccattcgattggaaaataccggtttgcaacattggaatactactatactttagtcatgattgatacaaatttcgatttaaaagtgtagttgcatgaattttgattcatgataatctatactgcaattatcatttgcattgtgatatattcatgattgatgacttcgatgctcggccacagggtttgtagcgcgcaatctatttgagcgtagccatgtagcattgtaccatgaacatatcaatatgtggtgacttcatgcattaaaagaagatggacacgttgtaaccacaatacaactttcttatctcccaacaacttatattacgtgcggac

SEQ ID NO: 28767 - DNA, 1501 bp, Oryza sativa
cataacagagatcataaagtgaaggaaggtttccttacatgtatttcatagtattgtatactttcggtggagcatttaacatcatgtagtcaagtatgcattttgcacatgtgccagaaccaccaccaatttcgtaaatctgatccatgcaggggaaaattcatatggtttggtgaaaaagaaaacagatgactatgtgccataatattataaggtaccttttctccaaaaaaaaaatttggcatgagaactgcagtaatattactagttgagaaggaatgaaaaaaagaaaaggaaaatggtgcagtagcacagccatcatttattaaatcatatgtgagcggttatggcgcttgtaagagcaaatgggtggatggaggtctagaactatgctgaggaggaagttaagaatgcaccttcagtgggactgaaagatttgctgtacggaggattgatgcagctattgcataggcataccatggctgcaccagagaaagaccacgcatcaagggtcaaactgacagaaaaatgacactacatgctattgaacagcttaagaaaacaccttgaagagctccactggagtgaaccaagcgatgtcatgcttcttgtacaacttatcaaggtactgcatatacgcactcctacctacataagcaaattacttccgtttctagtcaaatatccaagatattaaaacagcacaacacagaatcgtaattggcaaacaatcaatggagttcaacagtcgtggaagaaaaacagaagtcccaaatttctgcatgagaggaacagtggcacgcgcaacgtgttcgtcgaaatgccacctcggcaaacaaatgttagaaccggcctaatctgattcccgcaatgccggaacacacacaccaaactcccacatccaaatccggtccaagcaatagaatgatccaagaagcaggtagaaaggaggattaccgtcgagctggttgaagcggatgctggagtcgagcacgcccacgggtcccgaccgcttggagaagtagccatggttggggtcgtacagcgccgacctcacgaagtcacgcacctgcgcgcacgaagctcccaccaaatcatcacccgctacaaggagatctcactgcgcccctcccagcccgcgaaacctccgccccgagcgcttaccaggatgggcttgttctcggggacgatccccgacgagaacatcgccgccggataccaccgcgccagcgtcgccgctcgccggagcgccgccgggacggacgccatgtgcggcggcgccatgggggagtcggggagtgagtcgctgcggcggcggcggcggcaatgcccacgcggttccgggccttttccccgaaagaaaagaaagggaagtccgattcgtgttcgggcccaagcccaacacgagtccgagtcggagtcgtgggctgcttgggccgtacggcccgcggcctatttaagtcgcgcgagaggagacgcatctcctcgcgcacgcgcacgc

SEQ ID NO: 28768 - DNA, 1501 bp, Oryza sativa
tgggtggcttaccactagcttgactctaggcattgagagacaacacaaactgtcaaagattggtggaagacactagctaatacggcatgagtttgagaggtttgcgcaccctcatcctcctcatggtttgggagatatggaagaaaaggaatcaacgaatctttcagcacaaggaggctacatcatctttcctcttcgccaagatcaaggaagaggcgcggacttggacgatggcaggagcaaaacgtttgcgggaccttctgcccctccatatataatatataaagagtacaaagtttttcatttctgatccttaagagttgttttttcttccactatattcaatgaaaagtcatgatctagtgccgttttgcttaaaaaacaacatgattgtagttaatagttattactccataaagtgcactttttttaagtgtaaataagtaaataactgatggatataattggaatatcgtcgaacaacgattggccctttttttcttttcattggcgtttagatcgtttgacgtagcgacgtccggggtcgttgcgccattcgatttgcatcggacggaaaagagggagtacagcgatagaaggggctattgctcggtccgcaacaacaaaaatcaagccacgaagattgtcctgggcccatggaaacaatacgacggtagcattgattccgaggagttcctctacatccattctacaagtgcaaccgtatatatcatgtctaacctgaccgtccgtcttatttaaaaaaattatatacttttattattaaaaaatagtcacacataaagtaccattcatgttttatcatgtaataaaaaatatttatcataaaaaatttctaataaaataaatggtcaaacattggacataaacaatataaaactacactattttgggatggagggagtaccattcttaatgcaataggggcaaatgacaatgcagtagcgaattatctatcgattacgttgaactgctcatccaccttatgtcatattctcgatcaaccgagcatcgtttttatataacgggtaatattttcaaccgctactgtttttttatatataaatgttttttctaatttctttctgcatcgtactggtgtcaacactgagtagtttaaatgatgaatatgatcaattatcgaccgatcgatcattgtttttgaaaagatgctattgattctgaatgttttcgaccgttttcacctcttttaacttccataaccatgaggatactccatacaatctctactattataaaaattaaagatgtttttgtcggtactttgacacgttatccgtgtatggttcggtttttaagttcgttcgcttttggaaatacgaatctgtatttgagtcaagttttaagatcgctcgcttttgaaaatacaaaaggagtcgtataagaaatccccttaaaagaactaccatgctaacttgagatgatcgaactcttaactacacatcatgattttctagaa

SEQ ID NO: 28769 - DNA, 1501 bp, Oryza sativa
cgcctggtggcataattagcatcgaataccagataatcggtaaccattatgcacaaaactaacaaccataagcaaaataataattcaaaatcagcacagcaaaggacaataggacagtcactgtaccgcggtgcagatgttcttcttgccatcggtggcacggacgaggcaccggtactccactgcctctcccttcgccgccatcttcttcaaccttgcctggcacttcatcgatgctgcacatatcaaacaacccccatcaactcaagcatcagttcttcagccacccaaatcacaaaccagattgccagatgaaagcgcgcactcacatcgcttcatggtgacccagacagatcccttctccgtgctccgctcgtacatgctcgtcaactcgctcagaaacggatctggttgcagcaccacctgaccagaccaaaccacacagacgcgatcaaaacaggaggaaatcgagagcattcagtacgacaaagaccagtagattcttctcagaatcctcgtccccccgttctacttccaatctgaaatcacccaacgcaaaacaccacccaaaaaaaagcctaatcgactcgaaattctagaccataggatccgatctcgcgcaaatccatcgcagttaaccgcgtcgaagacatcgatcgggagtgcggcgcaaatccgaggaaaagtagagagaaattggatgggggattaccatcttgagagatctcgagatcgccgggagagcaaaagttttccccttctggtgtttttgccctcgtcttcgtcgccttcgccgctggtgtttggatcgtacttcgtagaactgtagaaggggaggtaagggggactatagggggaaacggacggctgagattgcggagcacgagggatccaacggatttcgtagtggatagggtctcctattgacggttgcaaactgcggttaccgtgtaacacggcagcagattggtttccttcctcgtctataatttctaattttaatgtgaaccatgccgaatttggatattatttatgaacttatcatcttctaaaatagatctattaggatttatctgtattacggcgtaattcaactagtttggtttcttatggtcaaattaatccatccgaattaagttctagagtcaacacatgtgtttgcatttacgactaattattgtcttgatgtacagatgctcgcctctacgactaattatttttttcagtataatagggtatgtgtgtgcatacgttatgaatgcccacgtttgaattttgtttttaaaaaacttgtcattctccatgtgtatgtgttcatataggtgagtatgttatacgtacgcggttatgaacgcctatgtttgaattgtgtttctaaatacttaccattctccacatgcctgattgtactaagtttctaaaaaaacacaaccatctccatctgacaatgaacgcaaagttacagaatcacatcaattgcaatctgcaaagatgtcttttg

SEQ ID NO: 28770 - DNA, 820 bp, Oryza sativa
ctccccctagccacctcagcatggccccgccacgtcggcagggggacggcgccaaagaggctggcgccgtcctgttgaagacggcgccagccactctggcgccccaaaaaggaccatttctgggataagttttttcaggggtctatttgcgaaataagttttttaaaaggaccaaaatgtgaaaaatccaggagagaggtggtggaagcggtactagtgtttcgcggttaaggttttcttgaattcggcttgaaattacttcctctgttcctaaatacacatgattttggttgaatatgatttatccaagtacaacgaatttagacaggctttatgtctagattcgttgtattagaatgtgtcacattcaatcaaaatctcttatatttaaggagggatgctgtaacaagatagttccaattttgataggaatcgaaaatattcccatgttggaagcaacatggcatcagacgagatatgtgctcgagttgcattgaccatgactcagttggaacaaacagaacagaggatgcaaaattaaggttgatatatatccgagtaactttagtcagaaaatttactccggaatcgtagagtttggtgcccgacacgaagcataagttggcaggggccgggggaggcggcgtgcgtacgtttggacccccggcgagtgaacgatgtcaggcagggtaattaagcaagcatggcatgtactcgtgctcacgagtggagtgatggaccgcgatcctgcctctgcctctcccctgcgccggccgcgcagcttgtagaccccccctcctctgtggctgtctgcggcagg
